United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 28

SEQ ID NO: 125995 - protein, 104 aa, Triticum aestivum
  Clone ID: PAT_TA_20413.pep
GHEAMMLAAAAGVPSLLFGGASSTCRGGAPSKRTHGRHALAGISLICSYLVHPHDVHDEVEVQVRVVAAAGSLRFFLGGEAAAGDNGDDVDILVVARRRGHSSI

SEQ ID NO: 125996 - protein, 192 aa, Triticum aestivum
  unsure (1)..(192): unsure at all Xaa locations
  Clone ID: PAT_TA_20414.pep
MGLPKFLVTLLLICLLTYESYVDAASGEQDFLRTCSSHRCSKHGPEIRFPFRLSSHPPSCGAPGMQLSCSGDDTIFDHHVLGSCRVTEIYYRHRVINVVPLVEPSTQCPLQKLISRNLANDVYEQPQSSFPTTLVRCSKDFIPIDQXVGPASCLGNNASQFWYLASASAYMSDVPWDCVAVSKDIPIPFTLL

SEQ ID NO: 125997 - protein, 108 aa, Triticum aestivum
  unsure (1)..(108): unsure at all Xaa locations
  Clone ID: PAT_TA_20415.pep
MDGGGSGNASGGGGGASTCCYYALLGVRKSASATDIRAAYRRLAMKWHPDRWASDPGAAGEAKRRFQADXKEAYSVLSDKGKKAMFDAGLFDPLDDNNKILRLMQEIW

SEQ ID NO: 125998 - protein, 204 aa, Triticum aestivum
  Clone ID: PAT_TA_20416.pep
GLLEVLYILISNHSVDSEDHAFTQQQLPACKPILAPNMVIPILVFVGLLFIPIGLACYAASNKVFEVVYRYDTKCVPKNMLHNKVGYIQNASINKTCTINLKIPNAMKRPIFIYYQLDRFYQNHRRYATSFNIAQLSDPKEEANADIKDCKPEAYAGKCIPVVPCGLVAWSLFNDTYSLARRPRRAGGIGGVEALRVIKSGISW

SEQ ID NO: 125999 - protein, 115 aa, Triticum aestivum
  unsure (1)..(115): unsure at all Xaa locations
  Clone ID: PAT_TA_20417.pep
MGGFVKTHKSNAYFKRFQVKFKRRRAGKTDYRARIRLINQDKNKYNTPKYRFVVRFTNKDITAQIISASIAGDMVLASAYSHELPRYGLEVGLTNYAXAYCTGLLLAPRVLKTVG

SEQ ID NO: 126000 - protein, 107 aa, Triticum aestivum
  unsure (1)..(107): unsure at all Xaa locations
  Clone ID: PAT_TA_20418.pep
KLMDDTAEAKAYQDEINAVLGEQLSAEDEEAVMAEFENLEAQLAVESLPDAPATEVRPEEKTKAPADTEAAPEDIDDVIELPDVPTKVPERPELQEKNKXWEEPLPA

SEQ ID NO: 126001 - protein, 201 aa, Triticum aestivum
  unsure (1)..(201): unsure at all Xaa locations
  Clone ID: PAT_TA_20419.pep
TVEDEAFVGMGATLLDGVVVGKHGMVAAGALVRQNTRIPCGEVWGGNPAKFLRKLTDDEIAFIAESAANYSNLSKVHAAENAKPLEKIEFEXKVLRKKFAHQDEEYDSSIGRHSRGPTESSRPQIQPNEPLFLFPLRRLALFLWVGAAALVRALSQATGGVASPPPLGPRVSNWLYSQIVSLPGDHKKGGRTIPKGSYPAR

SEQ ID NO: 126002 - protein, 139 aa, Triticum aestivum
  Clone ID: PAT_TA_20420.pep
EGPVLAFRDVASWRAAWEAAEASLVSQCEAGARSGCSVSASRKCKPPWWKRLLVVVAAAPPTDYEERSRCEEREMAACLEAAREACAKFAKAKCAGPFQDARIAHEGVLANTGFDVWGAAADKSSSTAAAACALNVQRV

SEQ ID NO: 126003 - protein, 78 aa, Triticum aestivum
  Clone ID: PAT_TA_20421.pep
TPGGSRSPRSRSPQDQVMSPPPKDNGDRNGSDRGDSPRGRENSRSRSRSRSPSGGNRSPAANGRSPSPRGDRTPEPHG

SEQ ID NO: 126004 - protein, 179 aa, Triticum aestivum
  Clone ID: PAT_TA_20422.pep
MISPRQSSEATEVRRGRSAHMAKFALGHHSEVTEAGCVRAVLAEAVLTFLFVFSGVGSVMAAGRLAGGADTIMGLTAVALAHAMAVAVMVSAGLHVSGGHINPAVTLSLAAGGHITLFRSALYVLAQLLGSSLACLLLAFLTGGAVTMPVHALAAGVGAPQGVLWEAVLTFSLLFTGYA

SEQ ID NO: 126005 - protein, 336 aa, Triticum aestivum
  unsure (1)..(336): unsure at all Xaa locations
  Clone ID: PAT_TA_20423.pep
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKVXHLKGGAKKVVISAPSKDAPMFVVGVNEKEYKSDINIVSNASCTTNCLAPLAKVINDKFGIVDGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 126006 - protein, 101 aa, Triticum aestivum
  unsure (1)..(101): unsure at all Xaa locations
  Clone ID: PAT_TA_20424.pep
MVLYFKARXPDAGDYTIYMGADKNENEELIKYGLPEDVWYEGATAPAAAASQRLATGATTATSREGLRGEWAQGEEARWREGNRTTAACARLGLPLHVEAA

SEQ ID NO: 126007 - protein, 70 aa, Triticum aestivum
  Clone ID: PAT_TA_20425.pep
RRQAVDISPLRRVNQAIYLLTTGARESAFRNIKTIAECLADELINAAKGSSNSYAIKKKDEIERVAKANR

SEQ ID NO: 126008 - protein, 145 aa, Triticum aestivum
  Clone ID: PAT_TA_20426.pep
MEQADEASSVNKGSPERLTIDQDDGASWLSLTVGANESLETVANCSEPEPDPEPKPSATPHKVFSCNFCMRKFFSSQALGGHQNAHKRERSAAKRSYHAQRMVMGLPLEAHAAFVQSLRVSQSSVIQKSSQPTQIRTAPRFMKMG

SEQ ID NO: 126009 - protein, 142 aa, Triticum aestivum
  Clone ID: PAT_TA_20427.pep
LALDGKDLHGRNLRVSAATERTAGFRNGAGYGGGGGSFGGGGYGGGGYGGGGYGGNGGGGGGGYAPPVGNDAFSGGSFAPAGSGNFAAGNFGGNHGAPAGSTSGDEFSLGTPGSSFESAKNDDVMDDLFKDDEPDKYASKNV

SEQ ID NO: 126010 - protein, 264 aa, Triticum aestivum
  unsure (1)..(264): unsure at all Xaa locations
  Clone ID: PAT_TA_20428.pep
MKVSVKTLKGSKFEIEVNPADKVSDVKKLIESSQGQNVYPADQQMLIYQGSVLKDETTLEENKVVENNFLVIMLRQNKGSSSAAPAKSKEPSNQAPPTQTVPATPASQAPATPAPQAVAAPAPIVPVSAPGPAATASPAPAVAVSTEAETYGQAASNLVAGGTLEATIQSILEMGGGTWDRDTVLRALRAAFNNPERAVEYLYSGIPEPMEIPAPPPSAQPADPALASQAAQPAVASSGPNASPLDLFPQALPNASAXAAGEEI

SEQ ID NO: 126011 - protein, 226 aa, Triticum aestivum
  Clone ID: PAT_TA_20429.pep
MALVNKLGNLLKKATSSNPTLYQAIRCMSSSKLFVGGLSFNTDEGSLRDAFSHYGEIIDAKIIVDRDTGRSRGFGFITYAAEEQASSAIMALDGKDLHGRNLRVSAATERTAGFRNGAGYGGGGGGFGGGGYGGGGYGGGGYGGNSGGGGGFAPAGGDNFAAGNFGGDRGFGGNPAGNHGAPAGSTSGDEFSLGTPGSSFESAKNDDVMDDLFKDDEPDKYASKNF

SEQ ID NO: 126012 - protein, 225 aa, Triticum aestivum
  unsure (1)..(225): unsure at all Xaa locations
  Clone ID: PAT_TA_20430.pep
CLEMCRGRWFRDTGPRALRVTFDNEXRYYLYLDSGRAETKAIPPARPSAQSADPALASQAAHPADASSDPNASPLDLFPQALPNASANAAGEGNLDVLRNNAQFRSLLSLVQANPQILQPLLQELGKQNPQILQLIQDNQAEFLRLINEPAEGDEDENLLEQFAEGVPQTIAVTPEENEAILRLEGMGFDRALVLEVYFACNKDETLAANYLLDHMNEFDDGAPQ

SEQ ID NO: 126013 - protein, 70 aa, Triticum aestivum
  unsure (1)..(70): unsure at all Xaa locations
  Clone ID: PAT_TA_20431.pep
ALKEPNQHMFISLYSAFQRASLQTDADIGSRIRRECKVLPRRFLVNLSYQLHACAFKKKKXKKKKKKXNK

SEQ ID NO: 126014 - protein, 94 aa, Triticum aestivum
  Clone ID: PAT_TA_20432.pep
GSQGTLSTGPMAQPVIALPRVSPLWDLATALLSSSNHQLGINPYLPCPPKTRPSKHCCLSWKHPGQLQGNTTFINTTMKTLPRARHLARSFDDT

SEQ ID NO: 126015 - protein, 89 aa, Triticum aestivum
  Clone ID: PAT_TA_20433.pep
PSPPPWPSLPPCRASGEPLEMYKNTPTPPTNPSFPLSPHTRRCSLPHPHPTPPSPCRRRSRAPEAPYATWGRPGGPPLSPSSVPGASSS

SEQ ID NO: 126016 - protein, 183 aa, Triticum aestivum
  unsure (1)..(183): unsure at all Xaa locations
  Clone ID: PAT_TA_20434.pep
MAEAVLIAVTKIGDILLEEATKGIIAKLSEKVTNLKELPVKVEEIKKQLTMMGNVIRQIGTVYLTDDVVKSWIGDVRRVAYHVDDVMDKYSYHLRQLQKEGFLRKFFIKGTHYAIVFTEITDEVVEVEKEIQXVIKMKEQWMQPXQLVANPLTEMERQRXQDSSPKLSKDGILVGIENNRLGN

SEQ ID NO: 126017 - protein, 170 aa, Triticum aestivum
  Clone ID: PAT_TA_20435.pep
MATASPPLATPFRPLAVAGGSGGLVVGARAVVPPRRGRRGFVVRSVASDREVRGPAPTEEELSAVLTSIDSSAIASNIQHHADFTPLFSPEHSSPLKAYHATAKSVFDSLILNWNATYDYYNKVNAKQAYYLSMEFLQGRALTNAIGNLELTGQYAEALKQLGQNLEDVA

SEQ ID NO: 126018 - protein, 151 aa, Triticum aestivum
  Clone ID: PAT_TA_20436.pep
FKVLRVLVIEDGVFPEGRSLKDLGKLVQLRYLGLVGTSVKLPEGIGHDLKFLEILDVRGGAISELPSSIGELKNLRCLWADKGTEMKGEIEKLTCLEELQLYSVDKCPNFCSMVGKLTELRELNIHFNQMAETAGKTLVESLCNLRKIRSL

SEQ ID NO: 126019 - protein, 349 aa, Triticum aestivum
  unsure (1)..(349): unsure at all Xaa locations
  Clone ID: PAT_TA_20437.pep
TRPHTHINTTTPHLILPHLIRSLESCSGGAAGDADGWADQDQGNGGSRGGGEAKRSEIYTYEAGWHIYGMNWSVRRDKKYRLAIASLLEQLVNRVEVVQLDESTGDIAPVLSFDHPFPPTKSMFVPDPQGLRPDLLATSADLLRIWRITDDDAAAPGAADSNNGSVRCNGVGGPAGQQPGVKLCCELNGNRNSDFTAALLTFLWTGNDADPRRIGTSSIDTTCTIWDVEREVVDTQLIAHDKEVYDIAWGGAGVFASVSADGSVRVFDLXRDKEHSTIIYESILGGGPILAATDGGLCXRHIWLSWGXXKQDPXYXXTSSMVXKVAXLXRXPTLLXLXQRHQAPGMPMG

SEQ ID NO: 126020 - protein, 80 aa, Triticum aestivum
  Clone ID: PAT_TA_20438.pep
FLIANIRSIKHIPCIPPRSTTTTTTNHTMHTYIYIYIYILQQASKQAGNHHPILLATRATIYLPIVLAPRCPVLLVPAQD

SEQ ID NO: 126021 - protein, 382 aa, Triticum aestivum
  Clone ID: PAT_TA_20439.pep
PCPAAPPPPRPTAFPVSSLPTRIPSPPAPAAPRPRAAAVPGRPRRVRRVLASPPPRLVIAGGPCALYKWVREDRLAALKSKDKKEGACTAKPDPATEVLFLCSYDGCGKTFVDAGALRKHAHVHGERQYVCHYEGCGKKFLDSSKLKRHFLIHTGEKNFVCPHEGCGKAFSLDFNLKAHMKTHFADNYHMCPYPECGRRFTQESKLRAHFRAQHEKSGAQNPGGPVMNRNALGDHPHNTAKSLVTPPVPSADRPYVCPYDGCAKAYIHEYKLNLHLKKEHPNHYSDAGAQAGPSRGTVSKNSRRSKPNLTTSMPLAKISKRSGYTVPSPAVSIPEEHQWPRKVLYEDDSEETEEEGDNLEEGGLRYRAASDGDDDEETEEEE

SEQ ID NO: 126022 - protein, 149 aa, Triticum aestivum
  unsure (1)..(149): unsure at all Xaa locations
  Clone ID: PAT_TA_20440.pep
MVGVMMLSSETLVCTMLLNTKPQAPSHSVEAPFQRAQLSMAPPASPVPVTFPGWANARNKRGVFLAIRRRQTTLTPAAREQXXRXARGFFLMXEAILXXDFKSSTTXPGXNIXLRXTXPLAXNITYQXKPKXNQKRDXTTXTKTMAHVX

SEQ ID NO: 126023 - protein, 151 aa, Triticum aestivum
  unsure (1)..(151): unsure at all Xaa locations
  Clone ID: PAT_TA_20441.pep
MADSPNPSSGDLPSAAGSSPDKPYPADRRVAALAGAGARYKAMSPARLPISREPCLTIPAGFSPSALLDSPVLLTNFKVEPSPTTGSLSMAAIMHKSAHPDILPSPRDKSIRAHEXDGGSRDFEFKPHLNSSSQSLAPAMSDLKKHEHSMQ

SEQ ID NO: 126024 - protein, 52 aa, Triticum aestivum
  Clone ID: PAT_TA_20442.pep
RELPWLHCSDERASRPHFHCACSDIELLINATCPLCKFSIRKGGSSSGSEEV

SEQ ID NO: 126025 - protein, 163 aa, Triticum aestivum
  Clone ID: PAT_TA_20443.pep
APQLYWLCIVFLAFDVFFVVFCVALACIIGIAVCCCLPCIIAILYAVSDQEGASEDDIRQIPKYKFRRMDEPEKDSADATESSGGIMIECGTNQPIEKALAAEDAECCICISAYDDGAELRELPCGHHFHCACIDKWLHINATCPLCKFNVRKNSSSSGSEEV

SEQ ID NO: 126026 - protein, 161 aa, Triticum aestivum
  Clone ID: PAT_TA_20444.pep
LNSGRLLGFRLLEGNKTCYEDCLGNSNRTGRFRVCASFPTVWAEVKKPSEKIKSLKAHFPISIIGGGGSSRGKEAFYPSREKKSRGEEAEATMSAMTAAVPFWRAAGMTYIGYSNVCAALVRSCLKEPFKTEVSSREKVHFSLSKWADEKQQKPTVRTDDE

SEQ ID NO: 126027 - protein, 263 aa, Triticum aestivum
  unsure (1)..(263): unsure at all Xaa locations
  Clone ID: PAT_TA_20445.pep
MATARLRSASASSLRGILLRHCSAPPRAVSDFQVPGSATWRHFSTCRPNPLAKGNSFGSMASMYSQTRWASQATAVKETDPSGGKISMPASTXSIKQEDKDDGGIXQGPISSTSNQGRTAGIKKVKLLSLSTCCLSVSLGPVITFMTSPDMNVILKGGVASTVIFLSATTTAALHWFVSPYIHKLRWRQGSDSFEAEIMSWLATPLKKTIKFADIRPAETNRPFVTFRANGNFYFVDADHFSNKALLERLTPKLPNESAFKNL

SEQ ID NO: 126028 - protein, 100 aa, Triticum aestivum
  unsure (1)..(100): unsure at all Xaa locations
  Clone ID: PAT_TA_20446.pep
EKLKVGWHHXLGDVQPDVLLXXINILKAXQNXXSSGWENMCPSSDNAVSFGMVWSLVFRMEYVNSIQRKQVAAAEDQKSNHGNLYSWTWLQLCAKVKPLV

SEQ ID NO: 126029 - protein, 95 aa, Triticum aestivum
  Clone ID: PAT_TA_20447.pep
KAWPEPEKFMPERFLEHEVDFKGRDFEFLPFGSGRRMCPGTPLAVRMVHLMLASLLHRFQWRLPVDVEKKGLDMAERLGVNLSMVTPLEAIATPV

SEQ ID NO: 126030 - protein, 283 aa, Triticum aestivum
  Clone ID: PAT_TA_20448.pep
MAAMVRACMPLRTPPAAASSTATAPAAPSKPRSSARVLVLGGTGRVGGSTATALSKLRPDLNILIGGRNREKGESLASELGEQSEFVKIDTGNAAMLEKALEDVDLVVHTAGPFQREAECTVLRAAISTKTAYIDVCDDMDYSWRAKAFHEEAKAQGVPAITTAGIYPGVSNVMAAELVNAARSEDGEPERLRFFYYTAGSGGAGPTILATSFLLLGEDVIAYNKGEEIKLKPYSGVLNIDFGKGVRKRDVYLLNLPEVKSAHKFLGVPTVSARFGTSAATTL

SEQ ID NO: 126031 - protein, 172 aa, Triticum aestivum
  unsure (1)..(172): unsure at all Xaa locations
  Clone ID: PAT_TA_20449.pep
ARALRDSGISNSIERLCPTSNITGPMLIVHRLQNLDSCLPASMAQATQQAVXTISSQHAFSSRKLGSSSLLKRSALGGDCPPLPPSLLLCLWATMLGSRLSGEPGMTSQGLSPFPPRPSCPTRYQMPLFVFAPKYLVPNSGTTSSGDNARPPYVPTXAHPGVPMTSRPPAPP

SEQ ID NO: 126032 - protein, 90 aa, Triticum aestivum
  Clone ID: PAT_TA_20450.pep
FFFLNKNRYLATLFPVLGLQSLLLRGQIAHSASKTERLAVQAVSYNKFPPVSSLAPQNNNTTTTLLNREIIHWKDGPKIGRFLNTRHTNT

SEQ ID NO: 126033 - protein, 165 aa, Triticum aestivum
  Clone ID: PAT_TA_20451.pep
MVAPRVPSTKSPRVATPVASRSSARVASSTASRTSAMAVPPTRSRVSTTSAQPATSRTSTTANPHATSRTSTTAIHSATSRPSTTAHLRPTSSTSATTIPSATSRPATTTNSSMTSRMSAASVTVVLCDSRCQQDRSFCCDSRASTGQRWLKRRHMQQVATQDRS

SEQ ID NO: 126034 - protein, 89 aa, Triticum aestivum
  unsure (1)..(89): unsure at all Xaa locations
  Clone ID: PAT_TA_20452.pep
FFFFXEXGXWIIIKPPGGGIPRKTHRENTXQETRMIWGNQGELEAIRAASRLXNHSFCWARRMMNPSMYLLIAFFSFGNGISNSLKIGL

SEQ ID NO: 126035 - protein, 135 aa, Triticum aestivum
  unsure (1)..(135): unsure at all Xaa locations
  Clone ID: PAT_TA_20453.pep
SSLRAHEASSPLPMARTKQTARKSTGGKAPRKQLATKAARKSAPATXGGVKKPHRFRPGTVALREIRKYQKSTELLIRKXPFQRLVREICARTLKTDLRFQGSAVSAXLQEAPEPNSFGSXXDTTLGLSQPLRLP

SEQ ID NO: 126036 - protein, 172 aa, Triticum aestivum
  Clone ID: PAT_TA_20454.pep
RKGRQRGAGGQRGTSAEPAAERQQPVVNPKIEKELKKAVQKTAATFAPRASTKSKNPAVPGSTLYTIFEVQAYASMLAGGALSFNLVFPSSEPDIWRLMGMWSIWMFTIPSLRARDCSNKEKEALNYLFILVPLINVIIPFFVKSFAVVWSADTVAFFVMYAWKLGWLQKTE

SEQ ID NO: 126037 - protein, 225 aa, Triticum aestivum
  unsure (1)..(225): unsure at all Xaa locations
  Clone ID: PAT_TA_20455.pep
MAWPVLQQLLLIAAATTAAASGSATTPDGPAPWPEQFHAVLFTNLTNVSIASTGPPLRLHDLYYDWPRRRNLNLIRHQLPGTRCRVEVRQPPTFYFYSTSRXTQQVPVGVLPPGWLADGGAVYLGRETTGGIDCHVWGKADFIVYYEDALTGRPVHWNFLDVTGLQQFVMSFEVGVVLENDDQWQAPAHCFLDETANRTNEDDAHLDEWQAARLFRKFAGAAAAY

SEQ ID NO: 126038 - protein, 208 aa, Triticum aestivum
  unsure (1)..(208): unsure at all Xaa locations
  Clone ID: PAT_TA_20456.pep
APPPGGPAAWRADFRGALLTSLPNVPISSTRPPLRLHDLSHYSPRRRNLNLIRYQLSGDPXYDVEWNNGTSFYLRXATCRQVPVGPLAVLRPGWLAXGGAVYLGRETTGGIDCHVWGKADFIVYYEDALTRRPVRWNFIDVTGIEQFVMSFEVGVVLEDDSQWQAPAHCFLDEAANKTNEDDDHVAVSNGVMDAARLFRKFAGAAAAY

SEQ ID NO: 126039 - protein, 78 aa, Triticum aestivum
  Clone ID: PAT_TA_20457.pep
LLTSHHHTSTSSTIISYQDQRGVHICDKPFSWLQFGVNSNLELLVLDMLLRAVLMAFFSGLSQPSRSPKLIDLPGRPL

SEQ ID NO: 126040 - protein, 147 aa, Triticum aestivum
  Clone ID: PAT_TA_20458.pep
FYKGKKHYIIVNFLINQVLTPMSKYHGQLYACISKKGVVWLKSDPVLTNNRNKTRQLSPNPPGPLPTLFFPFLDNKSPDKEKEQNSSEYWRLPGPSFNLHHTSHLGGAVAHGRGEQGRTRRTTSHGRQGGGGARRRGREAKTGRRTS

SEQ ID NO: 126041 - protein, 147 aa, Triticum aestivum
  unsure (1)..(147): unsure at all Xaa locations
  Clone ID: PAT_TA_20459.pep
GCSVPKGARVLINVWAIGRDPEVWAEPEVFMPERFLDREVDSRGRALEFIPFGXGRRACPGMPLAVTVVPMVLASLLHEFEWRLPDGMAPGDVDLSDRFXAALELAVPLRAVPVWDERRRGFEFSFVTNSLPVDYLFLIYFHHQCTK

SEQ ID NO: 126042 - protein, 219 aa, Triticum aestivum
  unsure (1)..(219): unsure at all Xaa locations
  Clone ID: PAT_TA_20460.pep
NLTSPVVLDDFRCPISLDLMKDPVIVSTGQTYERGCIERWLEAGHNTCPKTQQKLLNKSLTPNYVLRSLIAQWCEANGVEPPKRPAQPNNTPATCTASEHSKVIELLQKLSSQNLADQRGAAGMLRQLAKRSAENRACIGEAGAIPILVSLLPTTDVSTQEHVVTALLNLSIYEENKARIITSGAVPGIVHVLKRGSMGAPENSAAXTLFSLSLVDXNK

SEQ ID NO: 126043 - protein, 231 aa, Triticum aestivum
  unsure (1)..(231): unsure at all Xaa locations
  Clone ID: PAT_TA_20461.pep
SGSRISTPPGCPRRLPPSYLFPVTLRLPSTGAARLPPSAAAFVSRSLHRPPPLHWTGSGVRMISSCFVVKRRRRRNGISASLFGVGAPEALVIGVVXPTSRELQDVSRDFKNTLEREIGLDEXLPSMSYRPPPPMNNSPQPAVDPDVKPETTVPYTSEELMKVTEEQLAASAIAAWNAKQPPTSEQQEEAAAATPSESTDSALSGGSDGPDAVTAESTSGNTENAKPRDEA

SEQ ID NO: 126044 - protein, 106 aa, Triticum aestivum
  unsure (1)..(106): unsure at all Xaa locations
  Clone ID: PAT_TA_20462.pep
VPSXQWXFGGIVRPFVYPXAKGFLQGXIGXPRFPVRSLNDAIERGNRXXIGXLVRAPPXRMXXVEIVGYHQXICRMSYMWDEGSEEVMEVYPNXVYSCVCSXIGRA

SEQ ID NO: 126045 - protein, 154 aa, Triticum aestivum
  Clone ID: PAT_TA_20463.pep
RGRGRGVDMHSGCTFNHRYVKSNPREVENATWMLTVFHCFGQYFCLHFEAFQLGMAPVYMAFLRFMGDENEARNYTYSLEVGGNGRKMVWEGTPRSIRDSHRKVRDSHDGLIIQRNMALFFSGGDRKELKLRVTGRIWKEQPNPEGTCIPNLCS

SEQ ID NO: 126046 - protein, 116 aa, Triticum aestivum
  unsure (1)..(116): unsure at all Xaa locations
  Clone ID: PAT_TA_20464.pep
MARGKVQLRRIENPVHRQVTFCKRRAGLLKKARELSVLCDADIGIIIFSAHGKLYDLATTGTMDGLIERYKSASGEGMTGDGCGDQRVDPKQEXMVLKQEIXLLQKGLRYIYGTGK

SEQ ID NO: 126047 - protein, 155 aa, Triticum aestivum
  unsure (1)..(155): unsure at all Xaa locations
  Clone ID: PAT_TA_20465.pep
XFQXLXXGLPXQLAQPXXCLGSPXLSPXXTCARAAGARRASHRPEDREGRRRGGSREGAPPGAGPAGAELAAASNRTGECRLRRSSHRQQVTILRLLPRRRDRLPPKALDQAPIHRGYQSSQNCCTQQGRRAPPLPPCSSVCFLPMFRPCLCKPP

SEQ ID NO: 126048 - protein, 86 aa, Triticum aestivum
  Clone ID: PAT_TA_20466.pep
KSRCKCFSLLICRYKSPYISTNKAIIPKKVLLLQTLQLNKEYECLNEERSQFLQKEYRIIFWIIYLRLWGSVCSNESSMPITFVGS

SEQ ID NO: 126049 - protein, 312 aa, Triticum aestivum
  unsure (1)..(312): unsure at all Xaa locations
  Clone ID: PAT_TA_20467.pep
AVCMGLALAVVLCVILVNISKTEASAIDEEDDAGGACHDSYYSYSKPVLFFQNSAKELTVSDLIRSTDNFDQANIIGCGGFGLVYKAYLPDGTKAAVKRLSGDCGQMEREFRAEVEALSQAQHKNLVTLRGYCRHGSDRLLIYTYMENSSLDYWLHERADGGYMLKWESRLKIAQGSARGLAYLHKDCEPNIIHRDVKSSNILLNENFEAHLADFGLARLIQPYDTHVTTDLVGTLGYIPPEYSQSLIATPKGDVYSFGVVLLGLLTXGRRPVGSVRKPRDSRDLAPWGTXXMKSENKEEQISDRLIWGQRA

SEQ ID NO: 126050 - protein, 338 aa, Triticum aestivum
  unsure (1)..(338): unsure at all Xaa locations
  Clone ID: PAT_TA_20468.pep
MSNPDVEAAGPARAATTGIKPPPGRYYAGGDGQHAPAAPFYYGQEAERERQHHTWLVPVVVLANVAMFIVVMYYNDCPRNGRGADCLGGGFLRRFSFQPLKENPLFGPSSATLGKYGGLDRYKVVHGDQAWRLETATWLHAGLIHLGANMISLIFVGVRLEQQFGFWKVGLVYLXSGLGGSVLSVLFIRNXISVGASGALFGLLGAMLSQLITNWTIYTNRLAAMANLIIIAAINLALGILPHVDNFAHIGGFLTGFLLGFVLLIQPRFGWLEQPFGGKTKSKYTACQIVLLIVALLLAIAGFAVGLLMVFRGVNGNDHCSWCHYLTCVPTSHWKCDN

SEQ ID NO: 126051 - protein, 285 aa, Triticum aestivum
  unsure (1)..(285): unsure at all Xaa locations
  Clone ID: PAT_TA_20469.pep
MGQARAYLLASLAAFYLIALATPQVTAADITEEVNLLWGKCNVLRDGAGRQTVAMSLDRSTTSGFSSKIKYLFGRIDMDIKLVPGNSAGTVTTFYMMSEGPWQYHDEIDLEFLGEXTGNPYTLHTNVYARGVGSREKGYRLWFDPSQDFHTYSIIWTQQYIRILVDNKLLRQIKNQMMYGAPYPNYQPMRVYSTIWNADDWATQGGRVKTDWSLAPFTAYFRNYKASTCSPSSKACGQSSPGSSGPELDQTQQQQLKEVAANSKVYDYCDDSKRRIGSPKDCESQ

SEQ ID NO: 126052 - protein, 119 aa, Triticum aestivum
  Clone ID: PAT_TA_20470.pep
IDRTIFEGTLRKEGKKKATRDILPGNYCRARSSKRAAELRFTSSSFHLPCLPFVCLLGAPAGKIHWPLGWSRRTHLAASSTFAGHSSMAAAETRKASRHASREPVMGKKISTGRRASHL

SEQ ID NO: 126053 - protein, 303 aa, Triticum aestivum
  unsure (1)..(303): unsure at all Xaa locations
  Clone ID: PAT_TA_20471.pep
MCHYNSLCITRSPVMEEVIAGGDTADVAAEKAPYWDPPPAPLLDTSELTRWSLYRAVIAEFVATLIFLYVSLATVIGYKSQSAAQPGTGVGYLGVAWAFGATIFVLVYCTGGVSGGHINPAVTFGLFVGRKLSLVRTVLYIVAQCLGAICGAGMVKGIAGASYVALGGGANSVADGVSVGAGLGAEIXGTFVLVYTVLSATDPKRTARDSFIPVLVPLPIGFAVFIVHLATIPITGTGINPARSLGAAVMYNQHKAWKDHWIFWVGPLLGATVAALYHRFVLRGEAAKALGSFRSTGAATART

SEQ ID NO: 126054 - protein, 339 aa, Triticum aestivum
  Clone ID: PAT_TA_20472.pep
MAEKQQQGSNVEEGSSRAAGKVVCVTGASGYIASWIVKLLLDRGYTVHGTVRDTADPDKTWHLRALDGANDRLQLFNANLLEEGSFDAAIDGCECVFHAASPVFFTIKDPKAELLEAAVSGTLDVLRSCKKASVKRVVITSSMAAVTFNGKPRTPDVIVDETWFSVPELCEKHQQWYVLSKTLAEEAAWKFSKDNELEIVVMHPTMVIGPLLQPTLNASVEVILNLINGSSSTYPNIAHGWVNVKDVALAHILAYEVPSADGRYCIVERVAHYLELVKIISKMYPNIPLPYKRGDDEPLFPTYQVSTDKIRSLGVELIPLETTIKETIESLKERGFFEF

SEQ ID NO: 126055 - protein, 141 aa, Triticum aestivum
  unsure (1)..(141): unsure at all Xaa locations
  Clone ID: PAT_TA_20473.pep
LRLPXGNVCIRVTPLKGLKKYLVKDVKSAPQGGGRNETTRAALGLGNRTEGSREGSNAITKGRRPSHRNCIHADRESADQHVHRDRKHRRGRGTISPGEHVDLDMPAEPYVQKSMARKDTHYDSGQRCEAAVPCIHHVNIH

SEQ ID NO: 126056 - protein, 270 aa, Triticum aestivum
  Clone ID: PAT_TA_20474.pep
WVTRRVGFTARVFEKAVQPVDKFRGLNGPAYLMVAAGFVWISVWCVAVIGAVNFRFPGLTILALVVSLAWTAEVMRNVANLTASRVIALYYLRGMQSSVQFSFQRALSYNLGSACLGSLFVPTIEALRILARGLNLLEGEDEFMFSCAHCCLNVMNAVFEFGNSWAFVHIAAYGRGFVQASRSTWNQFEGQPGMPALADADITSSVCFLTGVTSGALCVALAGSWTFVTHKHYTATVSLMAFYVGYLMTRIGMALPHACVGCYYVCYAEN

SEQ ID NO: 126057 - protein, 129 aa, Triticum aestivum
  Clone ID: PAT_TA_20475.pep
MKQGHALPPVRCRTNKSRVAMMLSRRRSPVVASLQLPPVTTLLFLWVLSCGHATANTDIANMTALQKHVSFFDRNKDGIITPIETFEGSMLVAMVCFGLRHIDLPFKDLLQLVVMLHILETLPPPCMLP

SEQ ID NO: 126058 - protein, 117 aa, Triticum aestivum
  unsure (1)..(117): unsure at all Xaa locations
  Clone ID: PAT_TA_20476.pep
AASVSLSLAILQNSRLPVVFDAIQERLLQFPWLPAQDSSSFADEIGGDRRVVIHLSLAVYIIGSPGYVSFKQLQHGFCANVIWGADIPPRGPGPLPIPGSPASGLVSGXQSLNRLDP

SEQ ID NO: 126059 - protein, 168 aa, Triticum aestivum
  Clone ID: PAT_TA_20477.pep
LGLTLRLVLPPLWRRLARVALGRGCSRRFMVLFSEFCAPFPLCEGWAPFPLFLGCLAVFALGPAPGGGTCEDGPPVHPRRLPLFFILPSLTGGVDFLLSSLPCVGAMYSRDRRMALKLDNPPVEAAFPRDFVPWPSVWVDSFVCVLFPGGLPPSRVCVLPYPPRGPVP

SEQ ID NO: 126060 - protein, 119 aa, Triticum aestivum
  Clone ID: PAT_TA_20478.pep
SSYTISQSSSMASAGKEEQVSATPTVDAGQARALLSSGGGGHAYLDVRLPVDFDKDHAAGAVNVPYYLAVTPQGKGRKEPQNSVEEVTARYGKGTSLGPWLARTGVGFQARPPTSNAGL

SEQ ID NO: 126061 - protein, 79 aa, Triticum aestivum
  unsure (1)..(79): unsure at all Xaa locations
  Clone ID: PAT_TA_20479.pep
VTPSDVGKLNRLVVPKQHAEKHFPLKRTPETTTTTGKGVLLNFEXDARGKCWRFRYSXYWNSSQXSYVLTKGLEPASSR

SEQ ID NO: 126062 - protein, 133 aa, Triticum aestivum
  unsure (1)..(133): unsure at all Xaa locations
  Clone ID: PAT_TA_20480.pep
LEEYTAVFFRVFKHDGKYKVLMCTDLTRSSXKEGINKPSYGAFLDVGVEEXERSISLRTLIDHTVVESFADGGRTCMTARVYPEHAXAEGSRLYXFNYGAGAVKVSKLEAWELATAAVNGGGHMYSAAGRRDA

SEQ ID NO: 126063 - protein, 126 aa, Triticum aestivum
  Clone ID: PAT_TA_20481.pep
SNESMFPPSGFSYEEKSEGCFASYEVRPRMNWITTEYGGHKIDKVLKRFGSNIIFSNGMRDPWSRGGVLKNISSNIIALVTEKGAHHLDFRSATKDDPDWVVEQRRQEVEIIHGWIDQYNKDIAQM

SEQ ID NO: 126064 - protein, 348 aa, Triticum aestivum
  unsure (1)..(348): unsure at all Xaa locations
  Clone ID: PAT_TA_20482.pep
AIRTNIHIHFLTGCRPREVAVGGSNGGVLASSFTPKXPPFSTGAVASSAPMLQFDDFTPWSSFCDAISQDFKSESLRCFSRVRAFWDALDKPGCHHTGLAALTXTGRAGLTMTSAASMTVWLWYALTYWPATAFPSPANFMMNLPAYPVKEMCKIIDSFPAGADIIDKAFAAASLYYNYSAGLYCFDTGGGDGPQVLGGDDPHGFKGWGWQACTEMVMPMTVSNESMFRPSSFSYEXMSESCLAGYRVRPRMHWITSEYGGHKIDKVLKRFGSNIIFSNGMRDPWSGGGVLKNISSSIIALVTEKGAHHLDLRSATKDDPDWIVEQRRQETEIIHGWIDQYNKDIAQT

SEQ ID NO: 126065 - protein, 100 aa, Triticum aestivum
  Clone ID: PAT_TA_20483.pep
RNGGKRTDGEIPLQLMFLGLNFYQEEFFSTGFRLYRGWIRQDVYMSDGVGLLGTWDRSRTVILDGLEYCGRIIRVRERKKLSSDPVHRRRGIRPNLFLCL

SEQ ID NO: 126066 - protein, 103 aa, Triticum aestivum
  Clone ID: PAT_TA_20484.pep
KVGGLYNSTNCGMIMNELVYDKYTHLLNLLYNNCTRYVCVQVQIATASPRARATRPCWPLPPGRGARRRGGGRRGHPRRHRRTTIRGSCRTARASGTQPSRCP

SEQ ID NO: 126067 - protein, 253 aa, Triticum aestivum
  Clone ID: PAT_TA_20485.pep
RTRGWRDKDAMGELAIAGHARALLEWHNTAKFCGACGAKAVPTEAGTRKQCSNESCKKRIYPRVDPVVIMLVIDKQNDRALLSRQSRFVPRMWSCLAGFIEPGESLEEAVRRETWEETGIEVGQVIYHSSQPWPVGPNTMPCQLMVGFFAYAKSLDIHVDKKELEDAQWHSREDVKKALTFAEYEKAQRSSALKVKQICKGAERGQSTSSDLRVESEEPAPMFVPGPYAIAHHLISSWAFEGAPKVPSSFSNL

SEQ ID NO: 126068 - protein, 170 aa, Triticum aestivum
  Clone ID: PAT_TA_20486.pep
DPLFIDHLLNAITMACLDAYSGGKGQRRKSKSKRKTESWSVQKLNQKKRGSIDPFLKNSYAQLGRARKKTRTRGIYKRKKRRRLITRWSRAIATQGSVEDRSGDDGGGVEAVEAAPDLPEGGGRAAAAGDDEEDPLQLPHEVHEPPRRRQQQREGQQPDAQLQYEHLRSP

SEQ ID NO: 126069 - protein, 489 aa, Triticum aestivum
  unsure (1)..(489): unsure at all Xaa locations
  Clone ID: PAT_TA_20487.pep
MKSRSSARGEPRRFGNVALLALMLXSLVALSLIRARFSPIRKPRLSTAGRPANWRPTRAAAVAVEEDKEEEAQPKDEEIQPKTEQALDAAVRPAKAAVAVDASKPVCYETSRRSDTCEAAGDVRLVGRSQTIYVDTLEREWKTRPYCRKHDTYALSHVKEWSLKPFPSGDGAAPKCTSNSSATAFVISTGGFTGNPFHDYTDVLIPAFITAHRFAGEVQFLVSSYKSWWMSRYIQIFQQMSRYEVVDIDADDEVRCYPSAVVGPTFHKELGVDPSKAPSGVSVADFRKMLRSAFGLERATATPSGDRWDIRRRPRLLIISRRTSRGRAFMNERAMADMAGSLGFDVRIGDPDTTSDTSKFARLVNSCDVMVGVHGAGLTNMVFLPAGAVLVQVVPYGRLEWLARNTFAEPSAGMEVHYLEYVVQLDETTLSEQYPSDHLVLKDPMAIHKQGWDALKTTYLDKQNVRPHLGRLKKTFLQALKMLPHGRDD

SEQ ID NO: 126070 - protein, 99 aa, Triticum aestivum
  unsure (1)..(99): unsure at all Xaa locations
  Clone ID: PAT_TA_20488.pep
GDPCRRVGRRAPXPPLRRRRPRAPAPGPGPRRRRPRPPAPPAVARPPPLAGLSPPAAPPTVASTAAATPRPRQAGGRACLESSLVAESLCLCLSRPTLR

SEQ ID NO: 126071 - protein, 194 aa, Triticum aestivum
  unsure (1)..(194): unsure at all Xaa locations
  Clone ID: PAT_TA_20489.pep
KHDDYHMMLRFLKARKFDVEKAAQMWDEMLQWRNEFGTDTILEDFEFHELEEVLQYYPQGYHGVDKDGRPVYIELLGKVEPNKLVQTTTVERYIKYHVQEFERAFREKFPACSIAAQKHIDTTTTILDVHGVGWKNFGKIARDLVRCMQKIDGXTIIPETLHQMXIVNAGXGFKLIWGTIKGLLGPKTSSKIHV

SEQ ID NO: 126072 - protein, 160 aa, Triticum aestivum
  Clone ID: PAT_TA_20490.pep
SLLADAESLVPARGSSMVAQNAVEDIMLDDGEKMVNALRAELLQLLTFMESQALYNERGHPYALATIASHGRQRTAGRGDEGEVISLYVTPRMIAYLEQAKRFEENPEEPVPTADDDVEEEIRNDPFGTIAAPLALYLDTAIQALQSIKKVLAGASQRKR

SEQ ID NO: 126073 - protein, 52 aa, Triticum aestivum
  Clone ID: PAT_TA_20491.pep
YDYDFEFPQDLTSISAISAKRNRYQRAKSVMLAEMDAHNTDGFYTNGNGNTR

SEQ ID NO: 126074 - protein, 144 aa, Triticum aestivum
  unsure (1)..(144): unsure at all Xaa locations
  Clone ID: PAT_TA_20492.pep
XXSLTLLGXNQQPFXKQXXXYHTSRLFRQPGSSGILXILWGKQLKXLHKLYLKTQFSIPGNQHNTPMANWPCSSPMAARPRPPSPVACTGASGTAGPCAPAAAPPPAARTWRASPRTPDRALAPGRAGIVLSAWMVSFSCLIAW

SEQ ID NO: 126075 - protein, 68 aa, Triticum aestivum
  Clone ID: PAT_TA_20493.pep
DASNAAEKAERKMQLKDKKRREEMERVVKERQAEIRSYKGLMVAEKMTSNRQIASAGKSIQEMEDEFV

SEQ ID NO: 126076 - protein, 184 aa, Triticum aestivum
  Clone ID: PAT_TA_20494.pep
MEDGVDFKYDGVNNESKERKGGHGIPKVSMVPLVFLIFYEVSGGPFGIEDSVKAAGPLLAIVGFLLFALIWSIPEALITAEMGTMFPENGGYVVWVSSALGPFWGFQQGWAKWLSGVIDNALYPVLFLDYVKSSVPALGGGLPRTFAVLILTAALTYWTYRGITIGGWVAVLLGVFTLLPFFVM

SEQ ID NO: 126077 - protein, 135 aa, Triticum aestivum
  unsure (1)..(135): unsure at all Xaa locations
  Clone ID: PAT_TA_20495.pep
EEKXDHVFTXSEPRQKRAGFERVYLVLVRIRRSTYILAVASTIKASPRHIATFLPAGLYAGQRIKPHAQTCADTRRRSHHAASPPMFNTTWGGGPTPAGSFPGPLCTSHQGPGIILLVLRIKMSACHKALDHPDI

SEQ ID NO: 126078 - protein, 174 aa, Triticum aestivum
  unsure (1)..(174): unsure at all Xaa locations
  Clone ID: PAT_TA_20496.pep
VLPDGDHDLQRCQYVTEKVLAAVYKALNDHHVYLEGTLLKPNMVTAGHSCPKKYTPQDVAVATVTTLLRTVPAAVPGICFLSGGHREEEXASLHLNAMNQSPLPKPWKLAFSYGRALQASALGXWLGKSENKKAAQEASXKRAHLKIWLXGTXXTLGXMKKLPSHFNASSLETK

SEQ ID NO: 126079 - protein, 220 aa, Triticum aestivum
  unsure (1)..(220): unsure at all Xaa locations
  Clone ID: PAT_TA_20497.pep
SQLGFQDASSPIIEELVEFHDHALIVALAICSLVLYLLTLTLIEKLSSNTVDAQEVELIXTILPAIVLVLLALPSLQILYIIDEIDEPDLTLKAIGHQXYXTYEYTDFKDLSFDSYITPTTDLPLGHFRLLEVDHRIVIPIESPIRVIITADDVLHSXAVPALGVKTDAFPGRLNPTSSTTLXPGVFYGQCSEICGANHSYIRIVVESSPLNTRACPHTY

SEQ ID NO: 126080 - protein, 135 aa, Triticum aestivum
  unsure (1)..(135): unsure at all Xaa locations
  Clone ID: PAT_TA_20498.pep
FTPTTQLSINMALALPLXLATLLTGLRNQPSASLGHLLPEGTPTPLIPALIIIETTSLLIRPLALGVRLTANLTAGHLLIQLISTATIALLPIMPSISALTALILFLLTILEVAVALIQAYVFVXLLRLYLQGNI

SEQ ID NO: 126081 - protein, 402 aa, Triticum aestivum
  Clone ID: PAT_TA_20499.pep
REKAKGVSVKQQYFCGILKQFGDRVFQARQLIYLSQKYPKAPFSEVSKFVHDSIGVHKECCEGDMVECMDDMARMMSNLCSQQDVFSGKIKDCCEKPIVERSQCIMEAEFDEKPADLPSLVEKYIEDKEVCKSFEAGHDAFMAEFVYEYSRRHPEFSIQLIMRIAKGYESLLEKCCKTDNPAECYANAQEQLNQHIKETQDVVKTNCDLLHDHGEADFLKSILIRYTKKMPQVPTDVLLETGKKMTTIGTKCCQLPEDRRMACSEGYLSIVIHDTCRKQETTPINDNVSQCCTSSYAHCRPCFTAMGVDTKYVPPQFNPDMFSFDEKLCSAPAEEREVGQMKLLINLIKRKPQMTEEQIKTIADGFTAMVDKCCKQSDINTCFGEEGANLIVQSRATLGIGA

SEQ ID NO: 126082 - protein, 148 aa, Triticum aestivum
  unsure (1)..(148): unsure at all Xaa locations
  Clone ID: PAT_TA_20500.pep
MKWVTLISFIFLFSSATSRNLQRFARDAEHKSEIAHRYNDLKEETFKAVAMITFAQYLQRCSYEGLSKLVKDVVDLXAQKCVANEDAPECSKPLPSIILDEICQVEXLRDSXGAMADCCSKADPERNECXLSFKVSQPDFVQPYKDSF

SEQ ID NO: 126083 - protein, 135 aa, Triticum aestivum
  unsure (1)..(135): unsure at all Xaa locations
  Clone ID: PAT_TA_20501.pep
MKIFLAFLLAMGIIVTQGDAFCFSKLFKPGEAEKGCMLDGVLYPFGEIPRTENCFRCSCSKNEMHCCSLHHTPGELMIKERVKVIFNKEXCDYEVVQKHPSKPCSGVCSCRLTVCPAPSYSVPWDSPVPGRCSKT

SEQ ID NO: 126084 - protein, 82 aa, Triticum aestivum
  unsure (1)..(82): unsure at all Xaa locations
  Clone ID: PAT_TA_20502.pep
MMRNLADYHPATSKAANWWPADGGPRRGLLRRPPPKRTPPLPPLAPXPQAPTAPPPKXSPPVTPSSPXRERLTAPPRPRRMS

SEQ ID NO: 126085 - protein, 86 aa, Triticum aestivum
  Clone ID: PAT_TA_20503.pep
VIYEISIPVQKRECEHKTRRPCGTLKSRPPYNLTQPHWVHPHINPWVDIFRLGRPWEKKKSSKPTDHNSSLRPTPQSTNSNQTQYN

SEQ ID NO: 126086 - protein, 109 aa, Triticum aestivum
  unsure (1)..(109): unsure at all Xaa locations
  Clone ID: PAT_TA_20504.pep
MNLSFFDQFSNPCLLGIPLILPSLLLPALLLPSPGNRWINNRLSTIQLXFTHLITKQLITPLNKAGHKXALLLTSLILILLSINLLGLXPYTLTPTXQLSINMGLGLXL

SEQ ID NO: 126087 - protein, 134 aa, Triticum aestivum
  unsure (1)..(134): unsure at all Xaa locations
  Clone ID: PAT_TA_20505.pep
MKVSILLLLICTAILAVGARAEAPDKTEVVVKKVQEYVKQATEAVKTAFTTVHESEAAQQARKWLSDNADLVKQXWAKLKEQLAELWEADADRVARLWAGGGRLGAVLPPIPRTAPFPFCRGSCNKVDWSEKKV

SEQ ID NO: 126088 - protein, 176 aa, Triticum aestivum
  Clone ID: PAT_TA_20506.pep
IQEKERRSSESLLMSQFPVTLKKQLVDDWEFVTQLGKLVKLPRSPTVDDILTKYLEYRVKKDNKISDSCAEVTKGLRCYFDKALPAMLLYKKEQKQYKEEIKGDVSPSTVYGAEHLLRLFVKLPELLSSVNMEEDALNKLQQKLLDILKFLQKNQVHFFLSAYDGDSKGADGAKGK

SEQ ID NO: 126089 - protein, 74 aa, Triticum aestivum
  Clone ID: PAT_TA_20507.pep
GGVTPSTVYGAEHLLRLFVKLPELLSSVNMEEDALNKLQQKLLDILKFLQKNQAHFFLSAYDGDSKGADGAKGK

SEQ ID NO: 126090 - protein, 113 aa, Triticum aestivum
  unsure (1)..(113): unsure at all Xaa locations
  Clone ID: PAT_TA_20508.pep
LTTQAGWRGCCGITTFSNAAPTTLSAAAPLSLTAPAPQSLNRWXSTAPSGTPPTTCSSGSPTTAATRTHCTCSCSSRSPVTASAAPSSRPAPTRTTAASTAPTKPTSSCPPPT

SEQ ID NO: 126091 - protein, 161 aa, Triticum aestivum
  unsure (1)..(161): unsure at all Xaa locations
  Clone ID: PAT_TA_20509.pep
TMGRGPRALCLPPRSSRAMPSFAWGLSTLLSTGMLLALVRRCRWWRGRVALSVGVPCLISADGVIRPFLRPLYGCACVVPLVGAALGRQTLLPLXTIFAHSWFSWNEHSMCVCCPCLFHTVESCSVGFELCSAAGEPKRNTPLSSHAMPYFVWGKITLQKT

SEQ ID NO: 126092 - protein, 184 aa, Triticum aestivum
  unsure (1)..(184): unsure at all Xaa locations
  Clone ID: PAT_TA_20510.pep
MALPNQNTVDYPSFKLVIVGDGGTGKTTFVKRHLTGEFEKKYEPTIGXVEVHPLXDFTTNCGKIRFYCWGHCWGKRIWVALRDGYYIHGQXCAIIMFXDVTSRLTYKNVPNVAQGLCRFGENIPXVLCRNKXDVKNSKLRQQVTSQEEELHTLDARQIHFPSLLQEPVFSLTWNPDDTASKNRL

SEQ ID NO: 126093 - protein, 60 aa, Triticum aestivum
  Clone ID: PAT_TA_20511.pep
MACATNVKSCFMPKKAEWGLSRQVAPTRMSMVRRARPYDDQLAKTWKSIRSTARGIMAMD

SEQ ID NO: 126094 - protein, 163 aa, Triticum aestivum
  unsure (1)..(163): unsure at all Xaa locations
  Clone ID: PAT_TA_20512.pep
LELLDTSLICLAALAGGATSAPLHLQCLDNPPDLTAAGAQAGKVVDDLSGFRAYVTGPVHSDRAIVLASDIFGFEAPLLRQAADKVAEAGYYVVVPDFFNGKPYTGDPSVNITQWIDDHSPVKAAPDAKPIFATLKKERKSIIGVXGGYCWGGKVRGDSKMER

SEQ ID NO: 126095 - protein, 255 aa, Triticum aestivum
  unsure (1)..(255): unsure at all Xaa locations
  Clone ID: PAT_TA_20513.pep
MKVSCATLSQPEGAVLSNDVVARXIFSGKFSQQEDFIHASNRIMDXLGGFFLIDXFPSSRLVRWLSSEERRVKSSRDVMQRIITDVIDERKAARAASNGSTYDEGLLDVLLTRQEEDTLESPLTTEMITTVLFERIGSAIDCPPTTTVRALTCLCKHRAEEATAQREDREEHGPDRAIIASSDLXQELHYMRMVIKETFRLHPTCSLLYRTXKRTGKIMGHDMLKGTNXXLNFLXNSQDPQYWENPEXLTKVGNT

SEQ ID NO: 126096 - protein, 123 aa, Triticum aestivum
  unsure (1)..(123): unsure at all Xaa locations
  Clone ID: PAT_TA_20514.pep
KKITNDFSKEREISDNPFGKLYKGINPDDGTVIAVKKLQENAPMPAGKIFINEVQNIMVLKHANIVKMVGYCSETTKKLVQFDHRYIQADVTESVLCYEXLPKGDLPEPLGGTPIGVCVHVQK

SEQ ID NO: 126097 - protein, 107 aa, Triticum aestivum
  Clone ID: PAT_TA_20515.pep
MHRWLHGPASSTHMVVALSSTVGAPACTPTNLLGTKLKRHATSTGNYHWKSYTANRLTAMAREKIYQTRYTDTWKAFAYDMSYDHHDITRRKGMVDSMLHAPNGNGS

SEQ ID NO: 126098 - protein, 31 aa, Triticum aestivum
  Clone ID: PAT_TA_20516.pep
YNSRYYTLLSKPSQVTKSDVAFVLYEVNFST

SEQ ID NO: 126099 - protein, 72 aa, Triticum aestivum
  Clone ID: PAT_TA_20517.pep
TGEGVNDGRERGTGPYGGQGPAPPGNQKVISNTNYTSCIIVFIPGIYMPLSQYGTHGWCSLTLGSNKRQPNA

SEQ ID NO: 126100 - protein, 72 aa, Triticum aestivum
  unsure (1)..(72): unsure at all Xaa locations
  Clone ID: PAT_TA_20518.pep
KIKFFPLICSSSLCMCTWGIKNPWCPNALLILLYFHPIGVVVREPTRETLXXSWFKXLNLRILGSKILLVRK

SEQ ID NO: 126101 - protein, 126 aa, Triticum aestivum
  unsure (1)..(126): unsure at all Xaa locations
  Clone ID: PAT_TA_20519.pep
YVPTLRTHASKLYTYIVQPWPSLVMGSWATSVSPLEGLKSTVGLPVRRRSNGSSLCSVSNCGRIRCMQAWPIXGHXKLETLSYLSPIRTDAILKHVYYLIRSKXLPWLTFNTVGSILREHNACARY

SEQ ID NO: 126102 - protein, 168 aa, Triticum aestivum
  unsure (1)..(168): unsure at all Xaa locations
  Clone ID: PAT_TA_20520.pep
FGVTKCTSGDSGVEPYIAAHNTLLAHASVVSLYRKKYQAMQKGVVGISIYSFWSYPLTNSTVDLEATRRCIDFFFGWXLDPLXVFGDYPQVMKKNVGSRLPPFTEVQSELIKGSLDFIGXNHYYSLYVNDRPXGKQAFGDYSADMSVSLRGSRIDPPSSQGFPSKCSK

SEQ ID NO: 126103 - protein, 92 aa, Triticum aestivum
  unsure (1)..(92): unsure at all Xaa locations
  Clone ID: PAT_TA_20521.pep
HSKPLHVRSRNPTCVRSGCAGNCGCGTXCTCGNRCGGXNMYPEVEAARATVLVSCTGTHKASSGGMDMAGANRGCGCTHGKCGTICGCSCCT

SEQ ID NO: 126104 - protein, 141 aa, Triticum aestivum
  Clone ID: PAT_TA_20522.pep
FFFFFFFFFFFPPKLVLTVIIFIERSNTRILDDVADVPWQSKAMQFQPKHPLNYTEYIYSYHYHHLIHYSLLVGQIINTPSKYVTLLDWIKHGARPQGVLLIFLMLSHRSAPEPRPVLALPPPPLPPSPLLDAPALRGRDV

SEQ ID NO: 126105 - protein, 68 aa, Triticum aestivum
  Clone ID: PAT_TA_20523.pep
EVIDGAFKEGADKQAKAALTRVVVSRSDADMEEIKEAYLKQHGAKLVDAVAKNTHGHYRDALLAMIGK

SEQ ID NO: 126106 - protein, 159 aa, Triticum aestivum
  Clone ID: PAT_TA_20524.pep
RSFALRKLCRVTDRDETQLEPMMLSEPTDCFPDRERCCVHYERPMMQIFSLKLASVSINTSSVELYGYIAVRDYVDSLLNYIVNRSRDDPIIAQQGSFIEMTGPKRGIAMNSPVLVEFGMRIKTGEKEEDDLTLIDGATDYCDLTIPSVSFTHRIHGNC

SEQ ID NO: 126107 - protein, 110 aa, Triticum aestivum
  unsure (1)..(110): unsure at all Xaa locations
  Clone ID: PAT_TA_20525.pep
TFVVPAEIFPARLRSTCHGISAAAGKAGAMIGAFGFLYAAQDPHKPDAGYRPGIGVRNSLFVLAGVNLLGFMFTFLVPEANGKSLEEMSGEAQDNEXDQARAAAVQPSTA

SEQ ID NO: 126108 - protein, 104 aa, Triticum aestivum
  unsure (1)..(104): unsure at all Xaa locations
  Clone ID: PAT_TA_20526.pep
MKSTKLAAILILQAVLVMGILSHVNADYFPKCCNNCRSFSGVDVCDDAHPXKCPKGCSACRVVTPSPHKTFRCADMKSTVDGTCGGHARTLIRSAQAQDVCRLK

SEQ ID NO: 126109 - protein, 497 aa, Triticum aestivum
  unsure (1)..(497): unsure at all Xaa locations
  Clone ID: PAT_TA_20527.pep
MAGTGVFADVLDGEVYKYYADGEWRASASGKTVAIVNPTTRQTQYRVQACTQEEVNKVMDAAKVAQKAWARTPXLWKRAELLHKAAAILKEHKTPIAECLVKEIAKPAKDAVSEVVRSGDLVSYTAEEGVRILGEGKLLVSNSFPGNERNKYCLSSKIPLGVVLAIPPFNYPANLAGSKIGPALIAGNSLVLKPPTQGAVAALHMVHCFHLAGFPKGLISCVTGKGSEIGDFLTMHPGVNCISFTGGDTGIAISKKAGMVPLQMELGGKDACIVLEDADLDLVAANIVKGGFSYSGQRCTAVKVVLIMEAVADTVVEKVNAKLAKLKVGPPEDDCDITPVVTESSANFIEGLVMDAKEKGATFCQEYRREGNLIWPLLLDHVRPDMRIAWEEPFGPVLPVIRINSVEEGIHHCNASNFGLQGCVFTRDINKAIMISDAMESGTVQINSAPARGPDHFPFQGLKDSGIGSQGITNSINMMTKVKSTVINLPSPSYTMG

SEQ ID NO: 126110 - protein, 197 aa, Triticum aestivum
  unsure (1)..(197): unsure at all Xaa locations
  Clone ID: PAT_TA_20528.pep
TENMLLDKTRTVKIADFGVARVEASNPSDMTGETGTLGYMAPEVLNGHPYNRKCDVYSFGICLWEIYCCDMPYPDLSFSXEVTSAVVRQNLRPEIPRCCPXSALANVMNRCWDANPDKRPEMAEVVAMIEATDTSKGGGLSPRHPSLAPVPCSRPDPGPRPPGLTPSPPDLIPLCSSPPLPMSGTANLADARFPASP

SEQ ID NO: 126111 - protein, 84 aa, Triticum aestivum
  Clone ID: PAT_TA_20529.pep
PGRYSSSLSSGHGHGRGKTKEEENVGLEPASKRESMSYSTSSYGSFTTYEKIAAKNRNKDDEAMTPVRRSSRLRSVKSPEAESS

SEQ ID NO: 126112 - protein, 75 aa, Triticum aestivum
  Clone ID: PAT_TA_20530.pep
SVVEIICFLFLWVISLLTLRIQYHLYHKFITSLAIIASIVHHFLCMNSVELLSVSSAKTDPDLQGSVECYSVFWA

SEQ ID NO: 126113 - protein, 64 aa, Triticum aestivum
  unsure (1)..(64): unsure at all Xaa locations
  Clone ID: PAT_TA_20531.pep
PPLXAQSRTPSPRSTQLRTPSPHRILLELRSHRPRPITRGKSSGDFPTFTDSVTRRSTIPLGCS

SEQ ID NO: 126114 - protein, 107 aa, Triticum aestivum
  Clone ID: PAT_TA_20532.pep
PPLFFWHCQICHPTCVYTTSHVMASLLFILDYTATVFGISPSLLFHTSIYIKAVPRGHQDTKGLAYIYKRSSKAKYRCLHTISSAARAHQTDLKTKYLMDSTTVEND

SEQ ID NO: 126115 - protein, 140 aa, Triticum aestivum
  Clone ID: PAT_TA_20533.pep
GCWPSGSTPRRGTGPWRRSSPRWRPYGCTCRRPRSRSRSSRCRWASSGGDRRRRRRGRGRERTHADISGRTCVSTCKFIRPTPPILCLLALHIQTDIFFLSFYFCHKSLFFFLHSSSESDWIDTAHQIEHASPGLWLCPP

SEQ ID NO: 126116 - protein, 108 aa, Triticum aestivum
  Clone ID: PAT_TA_20534.pep
LAILRSFLQFSLHLTCIGFVFGLWPLGLGRPLSRPLRLVFLGLLQLGPLGLGRSLSRPLGLVFLVRLRLVGPGGRGGDKEKNDRRHNQHDSQAPRHCESTHGVAPSLY

SEQ ID NO: 126117 - protein, 164 aa, Triticum aestivum
  Clone ID: PAT_TA_20535.pep
PAGPSAADVPALARALATPRSLGSPFVPDRLAPRALFTSDAALLSSQDTGRMVRANARFPASWEKKFAKAMVKMANIEIKGSGVGEIRKNCRLRQLAGGQCTYAKATATAIPFYPVRRCDGEDGLHRNQGQRRRRGQEVLPLRQLAGNAHTQKLLLFDPVFNWL

SEQ ID NO: 126118 - protein, 70 aa, Triticum aestivum
  Clone ID: PAT_TA_20536.pep
KKIISSGIKLLLPEAIVSDSGDIAIGWGRLVIGDSYRCFRVRHELAVPCCYSADMNIPVDPVEPKIGIEG

SEQ ID NO: 126119 - protein, 118 aa, Triticum aestivum
  Clone ID: PAT_TA_20537.pep
RRRRQHLLPPARRRRRRWLRATASRCRSPRLATARRCRRLGCTTTARRPGTTMGSYPGPTCKPEGGSIPGCSALLPLHYFFYGGASHCLLCHSDPYVRAYCCAMTLLLYFFKRTLLLY

SEQ ID NO: 126120 - protein, 163 aa, Triticum aestivum
  unsure (1)..(163): unsure at all Xaa locations
  Clone ID: PAT_TA_20538.pep
KWKXLKPXEACLXXFXLILWITLFQFIEPQLQQLXPGIPPGRKGKLRFPCSQVTMTELFHIWNQSGKERKKGGGKESKRKKWQELSISSKERTPRDHRKTDQSRAERGQALFSFLSPVPXPTNPCYSRRRGARGGAACRSGRSSDRPRRPGRQGPRXAGAXXS

SEQ ID NO: 126121 - protein, 107 aa, Triticum aestivum
  Clone ID: PAT_TA_20539.pep
SSIFELGMFYYYVQIHFVQTAPSIFGRLLTTMYIYSGSIQHRPLYVHVKVHLAALAFKLQGVHTDGTRGSSSCSCYYTSTRHKIPKHQGLDPKIARTITIMISLLNS

SEQ ID NO: 126122 - protein, 143 aa, Triticum aestivum
  unsure (1)..(143): unsure at all Xaa locations
  Clone ID: PAT_TA_20540.pep
PNYHLHNELHFLLPTSLLLLLLLLLLLLRIVTTNRRSGEEGVHKKDSLAQLYHTATNAGAKRSTGLVEAPPHEIPALVRHARGLCDPDGHHRLVRRQVGPLHEGLGPAAQLDRLLHGLLRRAVSLNNLCKXSPSPTCKKNRAF

SEQ ID NO: 126123 - protein, 89 aa, Triticum aestivum
  Clone ID: PAT_TA_20541.pep
RSEEEDQARLAAITDNLKARDSIRLYTWLSHRCFSDCVTTFYRKTLGKREGDCVRACVRKYQLATAASAARFNKLADPSAAAADADEDD

SEQ ID NO: 126124 - protein, 105 aa, Triticum aestivum
  Clone ID: PAT_TA_20542.pep
CSLHKERNQAAPAGSSKPASPPSVRSACNLGSKRMDSAQCARRALAPPPSAQQSQQHRRRAGGFRPRPSRLSAVSTAGERPINKYQVNKSTSTCHSKMQDTVRCF

SEQ ID NO: 126125 - protein, 113 aa, Triticum aestivum
  Clone ID: PAT_TA_20543.pep
AGGSYHILSQASMVTLKSTHAAAALVVLVVALALTLTLAEVSACPQGDPCVEVMSGGKLPEPYIMKHCCESLSEDSMSCLCELRDKFAKRLPVMFFDGVCPTSCGTSTTHESG

SEQ ID NO: 126126 - protein, 107 aa, Triticum aestivum
  Clone ID: PAT_TA_20544.pep
AWLVKSSEMATPELPKELPDDFLKDITGNFSEERKIAPPIQAGHWGKFAPRSSAPAPEKVKLLYILITENSTHLGDRRGTLGAHLLTAAPLRLRASPGLTPITACHT

SEQ ID NO: 126127 - protein, 110 aa, Triticum aestivum
  Clone ID: PAT_TA_20545.pep
MDNGASAASVYDLLRQLTVSKRRIIVEEDSGYTAGKHCFVQGRALGRMVSSHSSCCGRNTERNHLDCESLSWHVNQHKHGHRNYHDGNDPRHSVRLHLSSVSFLFLRQCA

SEQ ID NO: 126128 - protein, 107 aa, Triticum aestivum
  Clone ID: PAT_TA_20546.pep
MPTYHPMRTSSLTDTGYLTSAWTFVRAYLISGAEGPGRRGWTSWTRSKASPPSHLLTAARYSPRPSPPPSSRRWRHCSHRPAFSGRPPSPAGGRPRNVRPRTAAAAG

SEQ ID NO: 126129 - protein, 77 aa, Triticum aestivum
  unsure (1)..(77): unsure at all Xaa locations
  Clone ID: PAT_TA_20547.pep
ACLGGAGAGVAPGRKDPPCCRNLVMQHVDHSAGDLIDVLPGAFLXYDPDERLXRHRQALQHPFFTRCXRRCGYLRVY

SEQ ID NO: 126130 - protein, 174 aa, Triticum aestivum
  Clone ID: PAT_TA_20548.pep
EFEVAKILEELEFTMDQFIDLCILCGCDYCDSIKGIGGLTALKLIRQHGSIEGILENINKDKYQIPEDWPYQEARRMFKEPDVTLDIPELKWTAPDEEGLVNFLVKENGFNQDRVTKAIEKIKSAKNKSSQGRLESFFKPTVSTSVPLKRKETAEKPASAAASKKTKSTRGRKK

SEQ ID NO: 126131 - protein, 110 aa, Triticum aestivum
  Clone ID: PAT_TA_20549.pep
LLLGLPLACLYAWLSRWLLRAGLLDAPAGVALSRRQCFLLIAAGSLSHFFLDHLFEENGHSTMYTWILSTGWWKGRAPINPRCSVCCRPSLRLPHWGDLCTLTEWSMESQ

SEQ ID NO: 126132 - protein, 330 aa, Triticum aestivum
  unsure (1)..(330): unsure at all Xaa locations
  Clone ID: PAT_TA_20550.pep
MCTLLNARSESTQVGLIRGLLFILISAPFETAKALAVVGDLGLTILTTSTLKHIKHCEYDMLSLPVDLSYADSIQDVCDSIGDWVEPVASTRPWXVTQTNHEKESVQLVKSGVQSKNSRSRTPYEQGSCTSKLRLXFGVPGVNVIVLVSYTDNKESAVQYAWLXSDLANIVRAKTXCLVVLAHVAXYNSNWAHQGEGDSMMSAMEPLLHAAHVDIIISGHVHAYERTERVYKGGVNPCGAVHITIGDGGNREGLARRYHNPKPLWSVFREASFGHGELKIINSTHAHWTWHRNDDEEPVRTDDVWITSLAGSQCVQDSSSPEFRKILMSP

SEQ ID NO: 126133 - protein, 168 aa, Triticum aestivum
  unsure (1)..(168): unsure at all Xaa locations
  Clone ID: PAT_TA_20551.pep
MALRRIVKELKDLQRDPPTSCSAGPVSVXNDMFHWXQATIMGPXDSPYSGGVFLXVTIHFPPXDYPFKPPKVAFXTKVFXPNINSNGNICLDILKDQWSPRPQHFQGLLSICSLLTDPTGTTAGAGIPNCKATGQVQSRQGWTTVPWIDNTNKLTHHDSRWEHYVFPP

SEQ ID NO: 126134 - protein, 162 aa, Triticum aestivum
  unsure (1)..(162): unsure at all Xaa locations
  Clone ID: PAT_TA_20552.pep
MPMTRTTKEVSVVRPERVVPRSAWKLSEAGIQFLPSNTSCLDDIELHNGRLYMPKVQMDDSTAYRIHNMMAFEAMHVRTGNDVTAYVLSVKGPTTSADDVRXXEEXGILEHDLADDDDAVVRLFNSLTRDVSQEGVICAARYPFGATTTPTTSTCHPYASKL

SEQ ID NO: 126135 - protein, 426 aa, Triticum aestivum
  unsure (1)..(426): unsure at all Xaa locations
  Clone ID: PAT_TA_20553.pep
GSCAGCIPLTFCCSRSAFPTAQRLPQFVTAAGMKATPDDALAGWLSCRSVPFRERPRKAEREIDTVRGPXIQVKLSVFGRELNVILSSRRSRHFAGTRYLKRGVNDHGKVANDVETEQIVFEEEAGSWKGRMSAIVQMRGSIPLFWSQEAGRLSPKPDIFVQRYDPTYEATKLHFEDLAQRYGQPIIILNLIKTVEKRPREMMLRREFFNAVGYLNQNVPEERKLRFIHWDFHKFAKSKSANVLGVLGGVASEALDLTGFYYSGKPKVQKRRSIQLSRTSTARDVEIRASSGDLPRLSSNADALGSIASQDMRKEDSKHEPLGDAPCYQTGVLRTNCIDCLDRTNVAQDAYGLAALGRQLHAMGLTDVXEIHPDSSIAXALMEMYQSMGDALAHSDGGCASHNTVVPERQRKRKATTQSRELLKRL

SEQ ID NO: 126136 - protein, 65 aa, Triticum aestivum
  Clone ID: PAT_TA_20554.pep
CGPLDACSSGRGDTEICPLGVTCLNFPKGNIGWRGDPRPAFGHSPVVNVQRYYCGSGDTPCAASN

SEQ ID NO: 126137 - protein, 187 aa, Triticum aestivum
  unsure (1)..(187): unsure at all Xaa locations
  Clone ID: PAT_TA_20555.pep
RADLILSKCGEDNFIRVAYDYKNMAQRDGCNYRVRRLSLKLSAGSATSGTIATSLTQIRSFAWFGESKYTPPLSEFKYLRVLLFDFPRLPGDGXADRTAAGQLFQLKVFEXFQLHQAALELPYWNPMGLFIWETIDIDCPNXQNTPSDIVMLHRLPLCSFRRDXGLPMGIGKXTXLXXCYSWANHWI

SEQ ID NO: 126138 - protein, 130 aa, Triticum aestivum
  unsure (1)..(130): unsure at all Xaa locations
  Clone ID: PAT_TA_20556.pep
LSFGQRGKEICIYDQRTKICMPPVRRKEKSKICHLFLRLLLLLCHNHMDAKTGRKIFPLSKYVYTWARNIHIVLSSNKCLPCFPHAQLRSNASXVNKSXEDXQTXQGXTMGPVAXKIGSTXTRKMSGNSN

SEQ ID NO: 126139 - protein, 269 aa, Triticum aestivum
  unsure (1)..(269): unsure at all Xaa locations
  Clone ID: PAT_TA_20557.pep
ALLAMDVGFXSPNYSLSTACATSNYCFYAAANHIRRGEADIIVAGGTEAAIIPIGLGGFVACRALSQRNDDPITASRPWDKERDGFVMGEGAGVLVMESLEHAMKRDAPIIAEYLGGAVNCDAYHMTDPRSDGLGVSSCITMSLRDAGVAPEQVNYINAHATSTLAGDLAEVRAIKQVFTNPSEIKINSTKSMIGHCLXAAGGLEAIATIKSITTGWVHPTGRGFNPEPEVDFDTVANEKKQHEVNVAISNSFGFGGHNSVVVFAPFKP

SEQ ID NO: 126140 - protein, 114 aa, Triticum aestivum
  unsure (1)..(114): unsure at all Xaa locations
  Clone ID: PAT_TA_20558.pep
EISVTTTPHXFXITVDNALVWQQWTVLISCYKIFPHIPLSDHQQIKHIVTVGGTIHNVHLRYLRLLPPLPIVASPLAAPGSWPSPSAAQLNGGGRWARARPWQQRRGVGSLDPS

SEQ ID NO: 126141 - protein, 84 aa, Triticum aestivum
  unsure (1)..(84): unsure at all Xaa locations
  Clone ID: PAT_TA_20559.pep
MIPDTKDNLVVLEISVGSQIRRMSYSCGSRCTCXAHTSKCGTMYPDLTEQGIAGVQVTGVVMLRVAPDNKARHVEVATTQCAKG

SEQ ID NO: 126142 - protein, 161 aa, Triticum aestivum
  unsure (1)..(161): unsure at all Xaa locations
  Clone ID: PAT_TA_20560.pep
AALCFXASALSVACFLLALPLLMAQDPSNLSLEHYSKTCPNAEHVVRAEMECAVRDEPRNAALMLRLHFHDCFVQGCDGSVLLDDTATMIGEKQADQNVNPLKGFEVVXTKPRQSWEAECPGTXSCADXLLAIRKXKDAVVLXVGGLYWDFPVGNWPQRSP

SEQ ID NO: 126143 - protein, 156 aa, Triticum aestivum
  unsure (1)..(156): unsure at all Xaa locations
  Clone ID: PAT_TA_20561.pep
DGKMDDMSCFLNRFDYSVNPTRCSGFYSVIRKYFPNLKDGSLEXWXSSGIRPKLFLARXQRPSDFCCFRGGEXHGIPRAGLXLFGNXNPLGLTSSXLAIAEHVVSRYNSTLILKQSPIDELQLDEPTAGVYHVNHIAHNDFLVYFLLFWGRTRCCL

SEQ ID NO: 126144 - protein, 63 aa, Triticum aestivum
  Clone ID: PAT_TA_20562.pep
GRRGAPRAPPAAASPPAPRGGPPPRGAPTGPAGRSSPTTSSPPPAGPPPPSAPPSSSSMVPAR

SEQ ID NO: 126145 - protein, 61 aa, Triticum aestivum
  Clone ID: PAT_TA_20563.pep
RDGDGLVSAAELWGVLRRLGMTEGARYEDCARMVAAAAARHGGVDGGLGFPEFKAMMEHAV

SEQ ID NO: 126146 - protein, 181 aa, Triticum aestivum
  Clone ID: PAT_TA_20564.pep
YAQGVVVAKVIQNIQPTPGRTWELRISAFCLCIPKVTPVTKMGPWGGDGGAAFDITELPRSLQTVTIRCGDVINSVAFSFPDQPGHKKTAGPWGGDGALTASITLAPSEFIKQVLGTTGTVGGETVVTSLTLVSNVTTYGPFGKANGTPFSSQVPDGNNIGGFYARVGGSVNALGVYACPI

SEQ ID NO: 126147 - protein, 163 aa, Triticum aestivum
  Clone ID: PAT_TA_20565.pep
MVSFDLIELTVAMAVALPSTLPMKHGKVGLRGKAAATGVAGRARVLVTVTVLGSAGPLPFLVDRGESVYGLIRPALRCYARPGRMPLLGSDAANFLLYTANGRSDALKADERISFNGCRSFMLWQKTVADNNGSEPNSSPGRKGISGWKFGLNKILLNFSFKV

SEQ ID NO: 126148 - protein, 118 aa, Triticum aestivum
  Clone ID: PAT_TA_20566.pep
KNKNDEHHFNRRRGRSIGLFVLGHQRRGRRAMLLLFHLVLLGGSEILVDRAHGAAQLVVAGGGGAEASGGRLDEALGSVAGLAEGIEAAVEVRERHRTPELADCGGRRVDQRVVGTNP

SEQ ID NO: 126149 - protein, 119 aa, Triticum aestivum
  unsure (1)..(119): unsure at all Xaa locations
  Clone ID: PAT_TA_20567.pep
PSTISTPGVTEKVYEEDKKLWKKHVDTYKRVNKLIGKSRYRNIMDMNAGLGSFAAVLDSPGSWVMNVVPTISREEHXLGIIHERGPXLGIYHDWGGPCPPGLPRVLARYPIGPNNMFSL

SEQ ID NO: 126150 - protein, 182 aa, Triticum aestivum
  unsure (1)..(182): unsure at all Xaa locations
  Clone ID: PAT_TA_20568.pep
IHKPPSRWSPAAALATTTRARRPLDPPLLFHGTSTTNAAAPSPTLCIRHRASSASPNHPTTGTCSPVRLYLGYKQAPGAVPLFPGYQATGSLRHSFPPREAPGGHNNNFLPMGPNGLGDAPGAAAFPFPLLAGRPPASLPSRSLERQQLYTHPLXXKQAAIPDVLXMFXXVXSXQTGKIPVN

SEQ ID NO: 126151 - protein, 126 aa, Triticum aestivum
  unsure (1)..(126): unsure at all Xaa locations
  Clone ID: PAT_TA_20569.pep
PAPAAREGAQGHAGDNAPAAQHHVPPTDAASGGLVAFGEVGGTESRGVSANPLASLPSVTYQAXDNQDSNMEQCVICPVEFEDGESLVALPCKHSYHSDCINQWLQLNKVCPMCSAEVSTPGNNEA

SEQ ID NO: 126152 - protein, 83 aa, Triticum aestivum
  unsure (1)..(83): unsure at all Xaa locations
  Clone ID: PAT_TA_20570.pep
FGESSGGKPFFGGDGIGFVDVVLGSYLGWFVVIEKMIGVKLLDAARTPALAAWAHRFXMADAVKGVLPEDVXKVLQFLQTFLD

SEQ ID NO: 126153 - protein, 52 aa, Triticum aestivum
  Clone ID: PAT_TA_20571.pep
RVCFGEPLPANLAHRFGLEDVVSDPYVMGSFGGQDRHFAKEIGGHLLHDFVG

SEQ ID NO: 126154 - protein, 158 aa, Triticum aestivum
  Clone ID: PAT_TA_20572.pep
MGACVSSSRRRRPQRLRCTYRRGKVLRNTPTIRASDVGTCAASGEVVHVETSAATRRKSDGSNVTFHLTQLQWHHSELDSENGSVVCQEEAWFDSVSILGSDSDEDFSSVNGDFPAMSGAGRTHLVQCEDASCIADCIQKFEKFFDCVAQAVGQYLTA

SEQ ID NO: 126155 - protein, 186 aa, Triticum aestivum
  Clone ID: PAT_TA_20573.pep
MDRHDLGASGEIEKTPREAAAPDMESEPAAARAAERVPPWREQVTVRGMVAALLIGVVYTVIVMKLSLTTGLVPTLNVSAALLAFLALRGWTHALHRLGIACRPFTRQENTVVQTCAVACYTIGFGGGFGSFLLGLDKKTYELSGVNTPGNVPGSYKDPGIGWMMGFLLAISFVGLLTLLPLRKVL

SEQ ID NO: 126156 - protein, 106 aa, Triticum aestivum
  unsure (1)..(106): unsure at all Xaa locations
  Clone ID: PAT_TA_20574.pep
PTLLVPLDQINEPKRPSDKPLRLPLQDVYKIGGIGTVPVGRVETGVIKPGXVVTFGPXGLTTEVKSVEMHHDLSWEALLGDNVXFNVKXVPVKDXKRGFVASNSKG

SEQ ID NO: 126157 - protein, 430 aa, Triticum aestivum
  unsure (1)..(430): unsure at all Xaa locations
  Clone ID: PAT_TA_20575.pep
MPLFHPAPCARPAAARAASRFSGAVVAASGAGGARPPKAPPRRPRGKPRFSRQSAIKKSFQQEQVVFSTPVPADPTVAIIGGGASGLACASALAARGVRAVVFDTGMHGLGGRMATRMVDDGRRLVFDHAAQFFTASDQRFQKLVDEWVDKGLAREWRGSIGELEAGGHFTAIPSSTPRYIGVRGMRPLADAMLPENDLIKVVRPSWISKLEPFNGLWRLFESEKPQGQYDAVVIAHNGKCANRLLSTSGLPQLTRQMKRLELSSVWALLAAFDDPLPIPQDNSYGTFEGAFVRDIDSLSWMANNTQKLFPLETNRPECWTFFSTASYGKKNKVPQENIPNATAEKVKRDMLGGVELALGLSTGSLQRPFYTRVQLWGAALPXNTPGVPCIFDPQGRAGICGDWLTGSSIEAAXLSGMSLGDHVANYFAS

SEQ ID NO: 126158 - protein, 439 aa, Triticum aestivum
  unsure (1)..(439): unsure at all Xaa locations
  Clone ID: PAT_TA_20576.pep
ARGPIPISSLRKLRRVPPTHAVLHLLADLARAPRPSPGRVRGGLDCSASGRWTSSSGCRRLRPSPGAPRRLRPRRPSSSSGWWARTRGHSPPPPCSPPTSSSPTALCSLSTPSRPLLLAPTPAKTTARKTLRKMPTPTSTSTPARGRRRRKGSLPRSRLRRPAPSRRWTSPRSLSSGRTSSRPPASPRGAPRRRSAQXSAATPSSSTSTYGPXSRSRSAGHSTSGAGARASSKAKASTPSTGNASAAAASAPVAATATAAGRKVSSAPCSRSNSRGEASGSGVPAVAIAAAAEKAAAQAPATSMLRRWVPGGQGRAGLSANGIRLGRASPVWQLRRNKLQQQQAAAEQKQSSNATATASGKSKAVPEQDDAATSQGQADGGEAADKATASAAADAAPATVSAPAAACRNNAACAEVAGEECVPPQGLFGLRTFFSKKVY

SEQ ID NO: 126159 - protein, 313 aa, Triticum aestivum
  Clone ID: PAT_TA_20577.pep
TDCLGHVALVTQLMRRLGEVKPPLKHSVIVVFIANEENSSVTGIGVDGLVKDGLLDKLKTGPLFWIDTADKQPCIGTGGMIPWHLKATGKLFHSGLAHKAINSMELNMDALKEIQTRFYNDFPAHEKEKLYKFATPSTMKPTKWSYPGGGLNQIPGECTISGDIRLTPFYSTSFVVQKLKEYYVDDINAGLETKLPTRGPVSKYVLPDENLRGRLEISFDGDVMNGVACNLESRGFQALCKATEEIVGYVEPYSITGSLPLIRELQDEGFDVQTAGYGLLKTYHAKNEYCLFSDMAQGFQVFVSIISQLEADA

SEQ ID NO: 126160 - protein, 455 aa, Triticum aestivum
  unsure (1)..(455): unsure at all Xaa locations
  Clone ID: PAT_TA_20578.pep
MASPAPPLKDAVGGLDRDPFVALLAKLIGESQRLQNDPPALVPQEDLVXQHVVDALRPVSTDTGGGPLVVRKVSYTDGRSNVIVEYPGTVPGRVVSFVGMHMDVVPANPSEWDFDPFSLTFEGDDKEKLRGRGTTDWLAHVVLVTQLVPRLGRVQPALKQSFIVLCIGYVXDNRSQALVFIVVESIVGELSFARNCCCGEILGLRCDAAEKLPCFVASXEDTWSLSWRPGCYYTIGLXRKARNPMELNMDALKEIQTRFYNDFPAHEKEKLYKFATPSTIKPTKWSYPGGGLXTKIPGECTISGXIRLTPFYSTSFVVQKLKEYVDDINAGLETKLPTRGPVSKYVLPEXKISGGRLEIASEGDVMNVVGSCVECRGFQALCKATEEIFGYVVPXSITGSLPLIRELQDEGFDVQTAGYGLLKTYHAKNEYCLFSDMAQGFQVFVSIISQLEADA

SEQ ID NO: 126161 - protein, 208 aa, Triticum aestivum
  unsure (1)..(208): unsure at all Xaa locations
  Clone ID: PAT_TA_20579.pep
MAQNQQQEAVISHFSHPGHDLVKRHYTGPFRCDMCWEDLSGAGYGCRSGCDFAIHDSCAGHTQTFSSLGAPXHPLVLVQDXATTRPYLCDVCLGSCAPGSFPYRCPPCXXDMHPSCTQLPQVVRSARHAYPAHDLTLVVGDGRSAACNGSAGRASSFPGPACDAGLPLPCAPPSSDLRGSRQAPSAPQAASVIRVQGLTRGPGAPLTR

SEQ ID NO: 126162 - protein, 243 aa, Triticum aestivum
  unsure (1)..(243): unsure at all Xaa locations
  Clone ID: PAT_TA_20580.pep
XAEXLQRLXGSGIIASLDDIAGKESSTSLXDRLVSXDERYSMAVYTSKKCKIXDAFPVWVAWGHALIRMEHYAQARVKFKQALQQFKGDAPPVVLDIINTIEGGPPVDVSSVRSMYEHVAKSAQPIFDDSLSADSYLXNVLYMPSTFPRSERPRQSRDSLXYQFSSANPYLENGPPNNLXDASRYPKCIHYLQEYASPQSLXFHFKAGHFAKTAPIFSSRTPPRGDSPFSPASRDPYRQWTQN

SEQ ID NO: 126163 - protein, 161 aa, Triticum aestivum
  Clone ID: PAT_TA_20581.pep
QTSRQAPNKSGGCVLGLLLSCVAMSGVARILEETVPSKEEHQNEVPHIPKVELPLFPEVHLPPKPELPKVELPPVPEVHLAPKPELPKVELPPVPEVHLPPKPELPKVDCQRSREFTCHPTGRCPRWSCRKPGDAQGGASTQSPEMPTVPVFHFPKPGAKP

SEQ ID NO: 126164 - protein, 71 aa, Triticum aestivum
  unsure (1)..(71): unsure at all Xaa locations
  Clone ID: PAT_TA_20582.pep
TKQSTSSSSLTLSSGRYCFDLRSLELLLDLDVRKSASFSLTSPAVSCRLLLVESXHVFRLNSLKVXRXGXP

SEQ ID NO: 126165 - protein, 67 aa, Triticum aestivum
  unsure (1)..(67): unsure at all Xaa locations
  Clone ID: PAT_TA_20583.pep
MDPASSCRRGDADSVATVERLVKTAMWCLQDRADMRPSMGKVAKMLEGTVEITDPVKPTIXFCVQDD

SEQ ID NO: 126166 - protein, 99 aa, Triticum aestivum
  Clone ID: PAT_TA_20584.pep
ATEDGLSEASGQYDAVLGGDGDGATGGTDEKERIESGLRRFAGIRRWRSIELIGTAYAVGFVQQSGNRIISFLREKVLAGVLAGRLLKMSDYNCGTLSS

SEQ ID NO: 126167 - protein, 188 aa, Triticum aestivum
  Clone ID: PAT_TA_20585.pep
QAGVGRADDDGAEESGTKMKQYVLTKLRSSKVPAEALELVERSDDAPATPLRFRPPLSLVFAGISKGNVCVAGDALHPMTPDLGQGGCAALEDGVVLARCLGEAILGGDGDGATGGTDEKERIESGLRRFAGIRRWRSIELIGTAYAVGFVQQSGNRIISFLREKVLAGVLAGRLLKMSDYNCGTLSS

SEQ ID NO: 126168 - protein, 124 aa, Triticum aestivum
  Clone ID: PAT_TA_20586.pep
MASGSTQESKQPSPELPSELPYDFLKNITDDFSDKHILGVSPFGTLYKGTVPEGGKVIAVKKLQENAPILAGKTFNTVVQNVMALKHINIVELIGFCSEAQKKMVQSWKIYHADILKVTCYEYY

SEQ ID NO: 126169 - protein, 65 aa, Triticum aestivum
  Clone ID: PAT_TA_20587.pep
FFFLMRTKHKFITEIRTYSWISSPSKLQRSTNPCRRTLTTKCLYIFSLEMPCMVDSWIILFPPCA

SEQ ID NO: 126170 - protein, 152 aa, Triticum aestivum
  Clone ID: PAT_TA_20588.pep
QLRHILTLSPIHSIPSCPLSLYHTSPRPNGHCSQVRRHGRRPLRPAGPCLGRAVGRTAIAHAGRGAAAATPSARRGRGVTAPSSAQPKGRAARAGAPSSVSPTRRPLARPTLAQLPCLIMEPGALLCLLYMDCLVLFHPVHNKCRDFELKWN

SEQ ID NO: 126171 - protein, 276 aa, Triticum aestivum
  Clone ID: PAT_TA_20589.pep
MAGAEASTGSAQRGDTLPNGDVYVGNFDGLVPHGMGKYMWTDGSLYDGEWDRSKMTGRGMIQWPSGASYEGDFRGGFIDGTGTFKGVDGSVYKGSWRMNKKQGMGTMVYSNSDSYEGLWNEGLPDGYGKYTWAAGNIYIGSWKSGSMNGRGVMQWIHGDTLDCNWLSGLAHGKGYCKYASGACYMGTWDRGVKDGHGIFYQPGSKIPCNPEVSECATNNDGTSASSSSNEKVKVGLLFLLQNLCNKWGLRRFFHRPRRISNGTTPIFVDDSGNHLS

SEQ ID NO: 126172 - protein, 156 aa, Triticum aestivum
  unsure (1)..(156): unsure at all Xaa locations
  Clone ID: PAT_TA_20590.pep
RAEFGTRSTAESGSDVDDLGSPMMRSTLGCSRLAPVREEMQMRARESAAYYSCDDHFVVVDKTVDYGRGGSMPDKSSAPQVIVQAQPLGTQNTPGSSRNSRAILVPKEIPEEGKFYRFLRLLLVLVVRSFYLLTHKYASQPXDNDCQQPTTSSPGX

SEQ ID NO: 126173 - protein, 239 aa, Triticum aestivum
  Clone ID: PAT_TA_20591.pep
PPRKAAKQLALAFAKRTLARCQKFEEREKSCFREPFLWSVLSAPLPKSDPVDGVPPGSADRPKALKLDRSPLSQGSTKLKKGERERDQSRDGSAKNSSSKSGSGRNSSGSGRNERKTKMKPKQKLAQLSTSGNVLGRVTEPSNSSFPSPSPRESNEWNNPLSTRPTQQPRNSAANVAPESLDAPMNLPPMDPMVDILDVPEGNDISAWFTDGLDDSLQDFDFSGGLEIPDDDLTQLGFM

SEQ ID NO: 126174 - protein, 170 aa, Triticum aestivum
  Clone ID: PAT_TA_20592.pep
MLSLLLYFPTSPQQSGQGQQSGQGQQGQQPGQGQQAYYPTSSQQSRQRQQAGQWQRPGQGQPGYYPTSPQQPGQEQQSGQAQQSGQWQLVYYPTSPQQPGQLQQPAQGQQPAQGQQSAQEQQPGQAQQSGQWQLVYYPTSPQQPGQLQQPTKSSQSSHVSSSIISGGAWH

SEQ ID NO: 126175 - protein, 249 aa, Triticum aestivum
  Clone ID: PAT_TA_20593.pep
PFQLQQPAQGQQPAQGQQSAQEQQPGQAQQSGQWQLVYYPTSPQQPGQLQQPAQGQQGYYPTSPQQSGQGQQGYYPTSPQQSGQGQQGYYPTSPQQSGQGQQPGQGQQPRQGQQGYYPISPQQSGQGQQPGQGQQGYYPTSPQQSGQGQQPGHEQQPGQWLQPGQGQQGYYPTSSQQSGQGHQSGQGQQGYYPTSLWQPGQGQQGYASPYHVSAEYQAARLKVAKAQQLAAQLPAMCRLEGSDALSTRQ

SEQ ID NO: 126176 - protein, 205 aa, Triticum aestivum
  Clone ID: PAT_TA_20594.pep
PRVRPGQGQHGYYPTSPQLSGQGQRPGQWLQPGQGQQGYYPTSLQQPGQGQQPGQWQQSGQGQHGYYPTSPQLSGQGQRPGQWLQPGQGQQGYYPTSPQQSGQGQQPGHEQQPGQWLQPGQGQQGYYPTSSQQSGQGHQSGQGQQGYYPTSLWQPGQGQQGYASPYHVSAEYQAARLKVAKAQQLAAQLPAMCRLEGSDALSTRQ

SEQ ID NO: 126177 - protein, 262 aa, Triticum aestivum
  unsure (1)..(262): unsure at all Xaa locations
  Clone ID: PAT_TA_20595.pep
RDREQGQHPHQEQQGQQGHQGDHGHQGQQPGQGQHPAQGQQXSQQPGQGQQGQQPGQGQQPGQGQPWYYPTSPQESGQGQQPGQWQQPGQWQQPGQGXQPGYYLTSPLQLGQGQQGYYPTSLQQPGQGQQPGQWQQSGQGQHGYYPTSPQLSGQGQRPGQWLQPGQGQQGYYPTSPQQSGQGQQLGQWLQPGQGQQGYYPTSLQQTGQGQQSGQGQQGYYSSYHVSVEHQAASLKVAKAQQLAAQLPAMCRLEGGDALSASQ

SEQ ID NO: 126178 - protein, 51 aa, Triticum aestivum
  Clone ID: PAT_TA_20596.pep
GRIERTKELAQEHVNLAVKAIESLPDSDDEDVLISRRALIDITQRVITRTK

SEQ ID NO: 126179 - protein, 326 aa, Triticum aestivum
  Clone ID: PAT_TA_20597.pep
MVGGGTGAGPVDAQGLRHVSQSQARQDGLPPASQQLRPLVLVCDEPAFLGTRWRHVAAADVTRLDAAAGAVVQQDPLELVADQPSFLGNRPPSMVVAEVPKLESAAGYFFNVRAEGKRFRPTVLLLMASALKFPIPESTDVGVFSILASKLRTRQQNIAEITEMIHVASLLHDDVLDDADTRRGVTSLNCIMGNKLSVLAGDFLLSRACVALAALGNTEVVSLMATAVGHLVTGETMQMSTSREQRRSMEYYLQKTYYKTASLISNSCKAVAILAGHTAEVSVLAYEYGRNLGLAFQLIDDFLIPKELCTLGRVIIDIMHTLNAYH

SEQ ID NO: 126180 - protein, 240 aa, Triticum aestivum
  Clone ID: PAT_TA_20598.pep
MAAAAATSAPLRLLSSSPLSRPLLSRPHLLTLSRPVSFQRLAARSAASPTPSTSSSAPDPAPVDPAQLPPALRDIIALFQSVPDERTRYKQLLAYAARLPPMDPALKSDANRVRGCVSQVWVHAAPEAEAPGCVSFQADSDAQLTKGLAALLVLGLSGAPARDVAMVPVEFIEMLGIRQSLSPSRNSGLLNMINLMKLKALEIAAGQEVTGGQEIRQEHTETPAVEKEEPQFEAFGGQVH

SEQ ID NO: 126181 - protein, 163 aa, Triticum aestivum
  Clone ID: PAT_TA_20599.pep
MPAMMLNLKDRTLARDNCRSKLFVFDRTILVSQPEGNFRIDKIKETEKPLWPLLKNMGIILSAEKAVLYRSKTFPYIAISLARKTNGYPSKASSNGLSTPTPRRAFLASATPELSTPRSYTSRYNRYFGDSRRLSVSQLNFGDDSLSTFTSISGSEPESPSIG

SEQ ID NO: 126182 - protein, 171 aa, Triticum aestivum
  unsure (1)..(171): unsure at all Xaa locations
  Clone ID: PAT_TA_20600.pep
LELDRRGEESARLHRACXEWGFFQLINHSVPHDVVEAMKANIQQFFQLPAETKKRFAQERGQLEGYGQLFVVSEDQKLDWADMLYLYTQPPESRNTKFWPDQPVNFRSTLDRYSGCCEGDSGSLLAMLAENLGLKQEVIADRCVGGVXSVRMNYYPPCAQADKVLGFSPAL

SEQ ID NO: 126183 - protein, 275 aa, Triticum aestivum
  Clone ID: PAT_TA_20601.pep
AHAIWDPHFGQPAVEAFTRGGAAGPVNIAYSGVYQWWYTIGLRTNEDLYTGALFLLFLSTLSLIAGWLHLQPKWKPSLSWFKNAESRLNHHLSGLFGVSSLAWTGHLVHVAIPASRGEYVRWNNFLDVLPYPQGLGPLLTGQWNLYAQNPDSSNHLFGTAQGAGTAILTLLGGFHPQTQSLWLTDMAHHHLAIAFIFLIAGHMYRTNFGIGHSIKDLLEAHTPPGGRLGRGHKGLYDTINNSIHFQLGLALASLGVITSLVAQHMYSLPPYAFIA

SEQ ID NO: 126184 - protein, 181 aa, Triticum aestivum
  unsure (1)..(181): unsure at all Xaa locations
  Clone ID: PAT_TA_20602.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQXLIDIXDDGYVSFXLESGNTKDDLNFQLDDXLLGQIKTGLLMARTDPVRDVRMGEDNXPVKESVGAITLSVVPPANWNNARVLRTIIG

SEQ ID NO: 126185 - protein, 144 aa, Triticum aestivum
  unsure (1)..(144): unsure at all Xaa locations
  Clone ID: PAT_TA_20603.pep
PLSLARSLSRALSPAPPPSSEPQLIEDVEMTXSNGMKKSNISIEEKPQSEATSVVKDVEMTIDAGIEADHTQLADGSTENGVGEPRHEEACIDKSDFSEMSDHHTNHQLIPNGVLPATDEALCSQETKEGDLVGCSAALREDNN

SEQ ID NO: 126186 - protein, 169 aa, Triticum aestivum
  unsure (1)..(169): unsure at all Xaa locations
  Clone ID: PAT_TA_20604.pep
MQIFVKTLTGKTITLEVESSDTIDNVKAKIQGQGGHPPGTKQRLIFAGQAVRGWPAPWAGYNIQEGSTLHWVLKVRXWHASYPSKTSTGKTXTLEVDPPDTXDNVKAKFQDKXGSSRDNNSDFAGNTPRMAYLADYNIXKGSTSTGVRSWGINLGNSARHTSPAGPVTS

SEQ ID NO: 126187 - protein, 173 aa, Triticum aestivum
  Clone ID: PAT_TA_20605.pep
MEINSSGEETVIKVRKPYTITKHRERPTGPEHKRFLEALKLYGRAWQRIEEHVGTKTAVQIRSHAQKFFTKLEKEAINNGTSPGQAHDIDIPPPRPKRKPNCPYPRKGCLSSETPTREVPKSSVSLSNSNAEMASNGTLQLTCIRKLQRKELSENGSCSKVINIFREAPSASF

SEQ ID NO: 126188 - protein, 87 aa, Triticum aestivum
  Clone ID: PAT_TA_20606.pep
PRSPRRPPSPPSARRPQATAAPGAAAPLSAATGRCFRTKLPGQLVRFGDLASPAAGGTSVRACVRARANDEGREGKGRVEMSGTQVR

SEQ ID NO: 126189 - protein, 211 aa, Triticum aestivum
  Clone ID: PAT_TA_20607.pep
MDCVLLSSHLSSHATVNARLQQCSVSLNSIGFAVIRKGCLRLRCYAIGDAGRRNDPLNENKNGPISQELNGSSASFTTVGAEITQETGDFFSSDAEGDPDKPTEGFSSIEDAINSLREGKFVIAVDDEKGDNEGDLIMAADQASPESIAFMIRNGSGIISVGMKEEDLERLMLPMMSPVTEIGDISAVASTVTVDARVGISTGVSAADRAK

SEQ ID NO: 126190 - protein, 98 aa, Triticum aestivum
  unsure (1)..(98): unsure at all Xaa locations
  Clone ID: PAT_TA_20608.pep
LRSAAKCVRLNGEGPAGDERGGDDAPKTCGLKMKQLRLDANPKGYDDDGQSLPTTRQXKGTPEQPSGEYTXGRQXCFPEKYLQMICFGLKNNLLHGPL

SEQ ID NO: 126191 - protein, 58 aa, Triticum aestivum
  unsure (1)..(58): unsure at all Xaa locations
  Clone ID: PAT_TA_20609.pep
YHSEEVSVAKDXEAESFFLRVDGAPSFYSNKLLLLIVVVLNKKQNXKTPGGARYQSPK

SEQ ID NO: 126192 - protein, 59 aa, Triticum aestivum
  Clone ID: PAT_TA_20610.pep
YCHSHTAPCFTSLRSIEISYIQFATFTIDGLMLTETIVQAPKKAIMCMLHHFEELQQTK

SEQ ID NO: 126193 - protein, 123 aa, Triticum aestivum
  unsure (1)..(123): unsure at all Xaa locations
  Clone ID: PAT_TA_20611.pep
MSGRGKGGKGLGKGGAKRHRKVLRDNIQGITKPAIRRLARRGGVKRISGLIYEETRGVLKIFLXENVIRDAVTYTEHARRKTVTAMXDVVYALKAPRPHPLRLPAAKSGRLSLSSSQPADSKT

SEQ ID NO: 126194 - protein, 273 aa, Triticum aestivum
  unsure (1)..(273): unsure at all Xaa locations
  Clone ID: PAT_TA_20612.pep
MSQDGGDDDDDRMSFLSRSLDWKTLLGLSPDPAPVSPTRVAFATHFQRAFMNLLRNAQFEELSAQDLLLTYSLNSDYLLTLPVYVDWKKAAESNAIIFQRGYSTESQKGLLLVEKLDYLQSKLLQNIFFSLSKPLGKLGKWTNEALKKSTGSPGFQIWIDKLKLWLKEQTYAENSLLLIENYSRGKLTPDQLPDADLPIWIAAQRAVSRYEGFLSPVGPRGRLLRRVLTWTGLIPSLPEATLNSDTETNNXEGYVRPNFLPRITLANIWEPAS

SEQ ID NO: 126195 - protein, 273 aa, Triticum aestivum
  Clone ID: PAT_TA_20613.pep
MRGDGEAEEASAPLLVPAAKGTGQGRVAREWWEESKRLWRIVGPAIFQRVALYGINVVSQAFIGHIGDLELAAFSIASTVIAGFNFGFLLGMASALETLCGQAFGAKKHHMLGIYLQRSWIVLFLFALALTPTYVFTEDLLLLLGQTPELSRLAGKMSVWLIPQHFAMAMLLPLTRFLQSQLKNWVTAATAGATLALHVLVTYLLVTRFHLGYAGVVVAADVAWWVVVLGQFFYVVCGGCPLSWRGFSVEAFADFWDFIKLSTASGVMLCMEN

SEQ ID NO: 126196 - protein, 176 aa, Triticum aestivum
  Clone ID: PAT_TA_20614.pep
DAWARSVLHSTPHPTPARAAAMVALASLSSLCLCGAARRRSASAPTSISCCMLATPSGRGSHESRIPRRRFRRTEGATKSMEDSVKRKMEQFYEGVDGPPLRVLPIGGLGEIGMNCMLVGNCDRYILIDAGVMFPDYDEFGVQKIIPDTTFIKKWSHKIEAVIITHGHEDHILGYP

SEQ ID NO: 126197 - protein, 78 aa, Triticum aestivum
  Clone ID: PAT_TA_20615.pep
AQSCRTDQRSRKPYGVAAAHALVRLATPVLQMLMLVLMLMASSPFSRSIVPRHRDLRRRCMLPTVRVERGEDPHVPLA

SEQ ID NO: 126198 - protein, 179 aa, Triticum aestivum
  unsure (1)..(179): unsure at all Xaa locations
  Clone ID: PAT_TA_20616.pep
RDHVIPVHHPWSFKSVRRFVKKAMWLLPDMDSTGNWYKPGQVYLEKDVILPYVPNVDLCDYKCVSETQSKRSTLLFSRGSLKRSAGGRLRCKLVTELQSIEDIIIEEGSAGAKGKVAXKTGIAISXLLDPAGEPIFAXLFDAIVKWCXPVIXRKXLTPFEGXLDYSKIHCCSTTMSAGE

SEQ ID NO: 126199 - protein, 143 aa, Triticum aestivum
  unsure (1)..(143): unsure at all Xaa locations
  Clone ID: PAT_TA_20617.pep
IFPGFLSEDTGSHGLASRFPLVLITMYNVLDLIGRYLPLIKCLKLTNRKGLMVAILXRFLFIPAFYFTAKXYGDQGYMIFPQRPFLGTGPIATSTVCVLRLXPNGYKGPRAERSWGTCPWCAPPGGIFPGVPPPSGWRIGKGW

SEQ ID NO: 126200 - protein, 128 aa, Triticum aestivum
  Clone ID: PAT_TA_20618.pep
VDVKEATRQPRGRRTRPPPSSAPRSSTDLVLSPIYTLIPCTTKFSEKSALQQSPQPPRKASEAGILEHACMPRSGMHCFFQLPEPRAHDETCIEATISCCCPRSASGRVPPPRPTAEEPCPTCRTTTS

SEQ ID NO: 126201 - protein, 82 aa, Triticum aestivum
  Clone ID: PAT_TA_20619.pep
GGRAPREHRRRDAHLRGHHRAVQPPVAGAHRPAARRPRLGHAGPHRRPPAPARACPFSLFFSRNLIVVAYCFLTSCLQRGGD

SEQ ID NO: 126202 - protein, 73 aa, Triticum aestivum
  Clone ID: PAT_TA_20620.pep
PPPAASAAPCSPGPPSAAAAAPRGGGAPARAGRPAAGPRPPRSLAPRPLPRPLRPAPPLPRPPPPPPSSSSSA

SEQ ID NO: 126203 - protein, 211 aa, Triticum aestivum
  unsure (1)..(211): unsure at all Xaa locations
  Clone ID: PAT_TA_20621.pep
VIKTVLQAYLPQLALIVFLALLXLLMFLSKSEGIPSQSHVVRAASGKYFYFIIFNVFLGFTISSSLFSALKTIVDNPPGIIVMLVNSLPGSATFFLSXVALKFFXGYGLELSRLVPLIISHLKKKYLCKTEDEVRAAWSPRDLGYNTKVPSDMLMVTIVLCTPSLHLGFIRSRRGWXVYKNSLRSSPIQTMGLRNRSVKQHIWVQILLRTY

SEQ ID NO: 126204 - protein, 102 aa, Triticum aestivum
  Clone ID: PAT_TA_20622.pep
STAIALIVLNTNLSSTRRIFREVDSQVPVVCNFSIYKQFLGQQPHSGTYAHRTTWGKAGSTHYLRHTNAQLFTCLSGSSAALSCHKLQQQPSIPVHHELMYS

SEQ ID NO: 126205 - protein, 220 aa, Triticum aestivum
  unsure (1)..(220): unsure at all Xaa locations
  Clone ID: PAT_TA_20623.pep
MAKYQXVKDIGSALXYXHHECDXYILHRDIKPXTYSXDNNFNAKLADFGLSRIGXQDKATLMTTALGTEGYIDPECRKDGKVKFYPRSDVYSFGIVLLDIVCTWKSREHVWELYKGGKVIEATDARLHGDDFDRWQTQMQRVAVLGLWCSLLDGAKRPTIQKAMEFLERHEPLPNLNYTVNTWLPSPHHDAYTSHCSDEQTLMSNLKMTARSPWELHTKI

SEQ ID NO: 126206 - protein, 208 aa, Triticum aestivum
  unsure (1)..(208): unsure at all Xaa locations
  Clone ID: PAT_TA_20624.pep
MPEGRRDHQTPPSTADGPLSPRPRRLCSQEFPSDITIQVGESSFXHKLPLASKCGYIRKLVSGANGSRVTHLEITGMPGDAKAFDLVIKFCYGINFEITTDTIARLRCATEHLEMTXECKPGNLIGGTEAYLEEVALVNLEXTLCRARTEELLPTSDKVQIISRCIDAIATMTCSDGSHEGLDSATAAWARRPSPWMTGGPTSWTVGV

SEQ ID NO: 126207 - protein, 128 aa, Triticum aestivum
  unsure (1)..(128): unsure at all Xaa locations
  Clone ID: PAT_TA_20625.pep
SNISYSCISIGQLGVSVSVCHHLLLLLAVPALEVVRRDGRDGEHLHXRRAGPRRRRRRPPRRTGSAATTSARACTPVTPRRRARTSRPRRAPPALLLPSISRHARXPPPRRAAPAPPPTRRPPPRRRR

SEQ ID NO: 126208 - protein, 65 aa, Triticum aestivum
  Clone ID: PAT_TA_20626.pep
VQLCSFKELKSSEVNKNGRSSAMMGVKNDVYFRKGAVGDWKNYMTPEMAAQLGQDSSRRRFKVQA

SEQ ID NO: 126209 - protein, 189 aa, Triticum aestivum
  Clone ID: PAT_TA_20627.pep
RLTYSGRGPTFHLPPPYSIVIQESEAGSWHVPTTTGDDIESPRQWLCATRKTSEGPPSPPPQARATSKTSERPPSPLPQARATSKTLERPPSPPPQTRATSKTSERPPSPPPQARATRKTSERPSSPPRQARATRRTSERPSSPPPQVSATRKASERPSSPPPQASTTSKTSDGSSSPPPQSRLSELGW

SEQ ID NO: 126210 - protein, 120 aa, Triticum aestivum
  unsure (1)..(120): unsure at all Xaa locations
  Clone ID: PAT_TA_20628.pep
EVRLGLGGGGGLISPPAISSFLTTRPLHISLQLQYRSGRSVGGHVVRQRNLLCFWENLGFDGSARLQIRDGPVPXTIIDYPQGFGDLWVADAKRHLILQAQSPSPGXENPNKTXSPRLWQ

SEQ ID NO: 126211 - protein, 38 aa, Triticum aestivum
  unsure (1)..(38): unsure at all Xaa locations
  Clone ID: PAT_TA_20629.pep
MWPFSSPKSHSLFVLCQEPDLNWXHEDFQSSALPTELS

SEQ ID NO: 126212 - protein, 171 aa, Triticum aestivum
  unsure (1)..(171): unsure at all Xaa locations
  Clone ID: PAT_TA_20630.pep
YNIQKESTLHLVLRLRGGMQIFVKTLTGKTITLEVESSDTIDNVKAKIQDKEGIPPDQQRLIFRWASSLRMAAPLADYNIQEGXTLHLVLRLXVGGMQSLVKDLNWARLSPWEVDPSDTIRQREGKFQDKXGIPPDNTLIFAGNTLXWPTLGNYNIQEGXTSLGCPSPKWQ

SEQ ID NO: 126213 - protein, 159 aa, Triticum aestivum
  unsure (1)..(159): unsure at all Xaa locations
  Clone ID: PAT_TA_20631.pep
AASTAIIRSSWKNWKFTYLHLIEQGTKYLLEADINEKNLKEFSLSLLDGTLPPYFRSEPVPQEKGLVEKVVGRTCGSAGRPGPPNVLLEAHAPWCVDCEAISKNIEKLAKHFSGXDNLKFARIDASVNEHPKLQVNNYPTPLLYPAEDKTNPIQTFQRN

SEQ ID NO: 126214 - protein, 151 aa, Triticum aestivum
  Clone ID: PAT_TA_20632.pep
VPRRAPLPGPRVPPPPPPARPQHPPRRRPRRRLRRPRRRPPRRPRRPPLRPPLLPRAQALRRHLLRQPHRHRGHGQEQGHPGSSTASRTAATSTPRLHGPAVPTTATSSTPTPSGRCWKAGTTTSSPGARTSAAKLGKKESWHMTGTPLHR

SEQ ID NO: 126215 - protein, 133 aa, Triticum aestivum
  unsure (1)..(133): unsure at all Xaa locations
  Clone ID: PAT_TA_20633.pep
DHWMGCLFEIILMEFSYKRHYKHTTSCCYLTTHIEFKLDLTEWHLDCHYIILCANFHWTLFXRFXSWTIRACSIRIYFXPTILXVSLXSXXTRNHIHYKXTFGAKXNHPCNNVDXXIPXXXPXTRXPDIDRNV

SEQ ID NO: 126216 - protein, 135 aa, Triticum aestivum
  unsure (1)..(135): unsure at all Xaa locations
  Clone ID: PAT_TA_20634.pep
MAASAAFAAVAVMMLVAAHLAVAAAAPVTAPAFLWAPENYGSHETKGVVHYQTMPPASLAKSVLDEGGWSNLVCSREGSYKNVDIAVVFLGSKLQSSDISRVXQADPSLADTLKLSFIGSGLSMAFPNLAFCFDE

SEQ ID NO: 126217 - protein, 82 aa, Triticum aestivum
  Clone ID: PAT_TA_20635.pep
ALRAELLQLLAFMESQELYNQRGRPYALATVTSHGRQRTAPRDDEGEVRCLYAAPRMTTYLEQAKRSEENPKEPVPSADDDL

SEQ ID NO: 126218 - protein, 341 aa, Triticum aestivum
  unsure (1)..(341): unsure at all Xaa locations
  Clone ID: PAT_TA_20636.pep
MALSPASVGPVISEVEMNAGADQGATTVRATVVQACSVFYDTPATLDKAEKLIAEAAGYGSQLVLFPEVFVGGYPHGSTFGLTIGSRSAKGKEXFRKYHAAAIDVPGPEVSRLAALAGKYNVFLVIGVVERAGYTLYNTVLSFDSLGKYLGKHRKLMPTALERVFWGCGDGSTIPVYDTPLGKVGAVICWENRMPLIRTAMYAKGVEIYCAPTADALPSWQSSMTHIALEGGCFVLTANQFCRRKDFPPPPEYTFGGHEEEPSPETAVCPGGSAIISPSGTVLAGPNYEGEALLTADLDLGEIVRAKFDFDVVGHYARPEVLSLTVKTEPKHAVSFTSTVG

SEQ ID NO: 126219 - protein, 154 aa, Triticum aestivum
  Clone ID: PAT_TA_20637.pep
MDAATVIGCFRDRSILITGSTGFLGKLLVEKILRVQPDVRKLYLLVRSPDAASAQHRVLTEVVGTELFDVLRRRHGADFNSLIKDKIFPLAGDIVYENCALPSSTIEQISKEIDVIVSVAATTSFYERYDVALASNALGVAHVCHLANKCGYLK

SEQ ID NO: 126220 - protein, 76 aa, Triticum aestivum
  unsure (1)..(76): unsure at all Xaa locations
  Clone ID: PAT_TA_20638.pep
LLVLGLQLHWVIHVGCYCPLHQIILLFYIGILFQRTDGGDIXAAEHATWEISKTYDTAGLRLAPHLGPGXKCAAVT

SEQ ID NO: 126221 - protein, 192 aa, Triticum aestivum
  unsure (1)..(192): unsure at all Xaa locations
  Clone ID: PAT_TA_20639.pep
MANPRVFFDMTVGGAPAGRIVMELYKDAVPRTVENFRALCTGEKGVGKSGKPLHYKGSSFHRVIPDFMCQXGGDFTXGNGTGGESIYGENSPDENSSTSTRTPGILSMVNAGPNTIGPLLICTSLQLARRNHWSSASRPGMDSQEIEKWVRNGTVNNRIAMRHSNRRRRRCSPRSGLIKKNRSSFPGPKSRV

SEQ ID NO: 126222 - protein, 258 aa, Triticum aestivum
  unsure (1)..(258): unsure at all Xaa locations
  Clone ID: PAT_TA_20640.pep
LVILSKTSISSKDSVDEANRKDNSNAEEQGAAGSVDEDGAPVASTEVSINTQKTEDTRQLFASAETAVEAGAMLATSMGRSSFIKSDFEKICFLDNVSTDTQVAIWRDSSRRRLVVAFRGTEQTSGFLSAYDSVRNRIMALVKXAIGYMDEEDAETIPTWHVYITGHSLSGALATLLALELSSSQMAKXGVIFXTVYNFGXPKVXNRRXADVYNAKVKDTGEXXNHRDTSNNATLRAMPCGTFTKVESTHGKELDKTI

SEQ ID NO: 126223 - protein, 442 aa, Triticum aestivum
  unsure (1)..(442): unsure at all Xaa locations
  Clone ID: PAT_TA_20641.pep
MAPAQCARVQRVFHFGKGKSEGNKAMKDLLGGKGANLAEMASIGLSVPPGFTVSTEACEQYQAAGRALPPGLWEETLEGLRWVEEYMGARLGDPARPLLLSVRSGAAVSMPGMMDTVLNLGLNDEVAAGLAAKSGDRFAYDSYRRFLDMFGNVVMDIPHALFEEKLEAMKAAKGVDNDTDLTANDLRELVGQYKNVYVEAKGEQFPSXPKRQLQLAVLAVFDSWDSPRANKYRSINQITGLRGTAVNVQCMVFGNMGNTSGTGVLFTRNPSTGEKKLYGEFLVNAQGEDVVAGIRTPEDLDAMRDHMPEAYAELVENCDILESHYKEMMDIEFTVQENRLWMLQCRSGKRTGTGAVKIAVDMVNEALVDRNTAIKMVEPGHLDQLLHPQFANPEAASYKGKVITTGLPASPGAAVGQIVFTAEDAEAWHAQGKSAILVRTET

SEQ ID NO: 126224 - protein, 142 aa, Triticum aestivum
  unsure (1)..(142): unsure at all Xaa locations
  Clone ID: PAT_TA_20642.pep
TMSSPYPGLGRPKWLFAYPPHPDYPHPQVGWIPPRRELPFPVYDPRPFHMRVRWFGRWWAHFDSGSQTVLMAQTGKQGIICQLSIHKSKXLVNTGXNLSSXELVLPNVRYSMGISTISTIGEXPQPXNKTWXAMPXRKNXNX

SEQ ID NO: 126225 - protein, 155 aa, Triticum aestivum
  unsure (1)..(155): unsure at all Xaa locations
  Clone ID: PAT_TA_20643.pep
MARTKQTARKSTGGKAPRKQLATKAARKSAPTTGGVKKPHRYRPGTVALREIPQXYKKSTELLIXRKLPFQAPGSAKIRARTFKDGLRFPIPTPVLGLPRKAAEAYSVRLFXEDTNLWRIQRQTRHIMPKDIQLARRIRGEKANCLLPFNTYGFG

SEQ ID NO: 126226 - protein, 377 aa, Triticum aestivum
  Clone ID: PAT_TA_20644.pep
MDTSCLSSMNIAGAKQVRSFAGQLHTQRCFTSSSVQALKTSHRTTSLGLRNKVKGSRHGLRALQVVCQDFPRPPLENTINYLEAGQLSSSFRSSERPSKPLQVVIAGAGLAGLSTAKYLADAGHKPIVLEARDVLGGKLAAWKDEDGDWYETGLHIFFGAYPNVQNLFAELGISDRLQWKEHSMIFAMPNKPGEYSRFDFPETLPAPLNGVWAILKNNEMLTWPEKVKFAIGLLPAMLGGQAYVEAQDGLTVSEWMEKQGVPDRVNDEVFIAMSKALNFINPDELSMQCILIALNRFLQEKHGSKMAFLDGNPPERLCMPIVNHIQSLGGEVRLNSRIQKIELNPDGTVKHFALTDGTQITGDAYVFAAPVDIFKLL

SEQ ID NO: 126227 - protein, 231 aa, Triticum aestivum
  Clone ID: PAT_TA_20645.pep
ALELAHGHAPFSKYPPMKVLLMTLQNAPPGLDYERDKRFSKSFRDLVAVCLVKDPQKRPSSEKLLKHSFFKQARSADFLAKSILEGLTPLGDRFRALKAKEADLLLNNKLGPESKEQLSQKEYIRGISGWNFNLEDLKTAAALLDSSNGTYHFDGANNKDRNGLQDVYNESENIYQERVNHGASARHDEHEIQEVEDLDGDLASSFPTRPLEALKSCFDVGGDDDPDPTAT

SEQ ID NO: 126228 - protein, 250 aa, Triticum aestivum
  Clone ID: PAT_TA_20646.pep
PSGSRRTASTARAATTCRSKASNGNTQVYINGREITKSELKILKVAHVQCPRDTHFWVYDDGRYEEEGQNNIKGKIWESALTRFACALFSLPVPPGDSNGTKDEIPFVPRAVPDYLDQKRIQKLLLLGPPSAGTSTIFKQAKYLYGTRFTQDELDAIKLMIQSNMFKYLGILLEGRERFEEEALSRLDQTIPEDEAAQKDENKANGRDSCIYSINARLKKFSDWLLDIIAMGDLDAFFPAATREYAPFVD

SEQ ID NO: 126229 - protein, 100 aa, Triticum aestivum
  Clone ID: PAT_TA_20647.pep
MNQALGPSASTVFPLESAGTVYPLCDQADLYQSFSSGAMENQCSMGLLDMALPPAPQYPFQKQQQDFWEASAQNGLHMDHEQSQENAGSAPNFDGSYSEQ

SEQ ID NO: 126230 - protein, 247 aa, Triticum aestivum
  unsure (1)..(247): unsure at all Xaa locations
  Clone ID: PAT_TA_20648.pep
AWEYARAQVAGGGHGATAGDGSAGGERGRKQAKGKGSKSKQPAADEPPRDYVHVRARRGQATDSHSLAERVRREKITLKMKMLQDLVPGCNKVIGKALMLDEIINYVQSLQQQVEFLSMKLSTVNPQLDFDTLSNLLHKDMNQALGPSASTVFQLXSAGTVYPLCDQADLYQSFSSGAMENQCSMGLLDMALPPAPQYPFQKQQQDFWEAGAQNGLHMDHEQSQENAGSAPNFNGQLQAADHPEIEF

SEQ ID NO: 126231 - protein, 297 aa, Triticum aestivum
  Clone ID: PAT_TA_20649.pep
KIEDRGHCQRDPATSNQRGHSQVLAREERNRRGRETEGGRDGKNSGHGTLVPPRHGDGGAEEEAIVPTDFNLITDVDFRQLVDRVPPGASFTIVSDSCHSGGLIDQEKEQIGPSVGSGPGAPSARTARFLPYGALLDHLSAVSGMPSSHHVADHLVALFGADASAKFHVHGGGGNGSALSTTPAPAPTPPRPDEGILLSGCQTNETSADVPAYEASGGKACGAFSSAVQSVLAAHQAPLSNRELVAKARAVLEEQGFEQHPCLYCTDANAEAPFLSQDKKEETAVGAASPAMSPALL

SEQ ID NO: 126232 - protein, 139 aa, Triticum aestivum
  Clone ID: PAT_TA_20650.pep
MGRRRSPALPLLLIFGVLAVVLAALPPLAESSSSHHHHHGHGHHSRVQSRGHGGEGEQSSSAAAAAKARGSAWPCCDSCGGCTKSDTPQCRCMDAAPGGCHPACRDCVKSSLAVHPPVYQCMDRVPNFCQRRCSAIAAH

SEQ ID NO: 126233 - protein, 328 aa, Triticum aestivum
  Clone ID: PAT_TA_20651.pep
MEGETSKRLATLVGCNYVGTRYELRGCINDVDAVRAALVARFGFAPGDVAVLTDGDGRGAEVLPTGANIRRALADMVARAAPGDVLFFHYSGHGTLVPPRHGDGGAEEEAIVPTDFNLITDVDFRQLVDRVPPGASFTIVSDWCHSGGLIDQEKEQIGPSAGSGPGAPSARTARFLPYGALLGPPLRRPGSTQIEARGHCQRDPATSNQRGHSQYKNKLDLGLFERLRVSSSASCLSLETELLVIIKFGKACGAFSSAVQSVLAAHPAPLSNRELVAKARAVLEEQGFEQHPCLYCTDANAEAPFLSQDKKEETAVGAASPAMSPALL

SEQ ID NO: 126234 - protein, 127 aa, Triticum aestivum
  Clone ID: PAT_TA_20652.pep
GNGIVLTNALATAGDLLSSPVSRAAGKVQEAVRMVTDEYMRSAVDYFEATRARPSLASTLLITTWSRLAFNGADFGWGEPTMSGPVTLPEKEVILFLAHGKERKSINVLLGLPASAMDAFQELMDEI

SEQ ID NO: 126235 - protein, 234 aa, Triticum aestivum
  Clone ID: PAT_TA_20653.pep
MADPQAEARGPPEPRAEALVELVRVNGSAAEATLSSAELAWRTTGAGRDSGGRRKLELESDVLGFQVEGRSLKLATFTRGDVTGAGRPPSPVGCGGGAEDRKRGEVAVEMESEEAAERWGHAIRDRFASLGRPKRLFFIVNPYGGKRGGRKIFQTEVLPLIEAAHIHYTMQETNYRLHAQEIAGSLDLKKYDGIVCVSGDGILVEVGNGLLQRDDWDKAIKVPLGIIPAGTGNR

SEQ ID NO: 126236 - protein, 523 aa, Triticum aestivum
  unsure (1)..(523): unsure at all Xaa locations
  Clone ID: PAT_TA_20654.pep
GRALKLVTFTWADPPAAARPPPPPRSGARAEPGRGGGAAAEAARAGAALAWRPAAAGRRAARRRYLSPPTGRLGPTSKGGTRQLASSYRQGVPAAGSPPSPAARGGGERHRSTRQGALQGERSQARAAAAARHQQPRRLARPPRAAPRNPXASAHASGKIFQTEVLPLIEAAGIHYTMQETNYRLHAQEIAGSLDLRKYDGIICVSGDGILVEVINGLLQRADWDKAIKVPLGIIPAGTGNGMVQGLLHSAGEPFSMSNAVFAIIRGHRRALDVTSVVQGKTRFFSVMMLTWGLVADIDIESEKFRWMGSARIDFYSLLRAVNLRRYNGRILFVPAPGYEGFGDPVEQTISCKSNGAANAAEGDITDVCNNETCTYSGPSTDDADLEWRSLKGPFVNVWISNIAFASEGVMIAPQAQFADGYLDAAIIKDCPWSVALGLLLRMKDGSYIESSYVEYFKVKALRIEPGLRVGSSTIGGIIDSDGEVLARGDRSQTKEEPEHLMAYGPPIQLTVDQGLATIFSPR

SEQ ID NO: 126237 - protein, 104 aa, Triticum aestivum
  Clone ID: PAT_TA_20655.pep
VVAFLLQTDGFIFSQKKAGLVSFKKKIFQNRVPIEMAWKTEMVAACILKLELPLGEYQVAEMMTRVDAHSYRNIYLGGGAEIVSACLQSSIMHNHVCTPIYPKD

SEQ ID NO: 126238 - protein, 130 aa, Triticum aestivum
  Clone ID: PAT_TA_20656.pep
ARGNVLLSDDLEPRISDFGHLSGGDGDDNATPEADVYGFGALVLELMTGQARWDEASVSWARGLVRDGKGLDIVDPRVHGGEAAEREMVECLRVGYLCTAHSPDKRPTMQQVVGVLKDIRPRPLDGGGDA

SEQ ID NO: 126239 - protein, 177 aa, Triticum aestivum
  unsure (1)..(177): unsure at all Xaa locations
  Clone ID: PAT_TA_20657.pep
KISDFGIAKLFSSSGDNSQDSTITERIVGTYGYMSPEYAMDGMVSFMQDVYSFGVLLLEIVSGRRNQRSFNLIAHAWNLYEENRSLELLDPAVRGGCSXAELEHVKTWIQVGLLCVQGEXSQRPQMAAVIPMLSHQQAPGRPLRPVVCMPARTPVDLLNMEENTSSNELTITNLEGR

SEQ ID NO: 126240 - protein, 42 aa, Triticum aestivum
  Clone ID: PAT_TA_20658.pep
ADNPEQKYIHMATVDGFEFWFMGFVSYQRCCKYMQQVISSQL

SEQ ID NO: 126241 - protein, 114 aa, Triticum aestivum
  Clone ID: PAT_TA_20659.pep
GHGSSVADPVELSKLGSAPPKREQYNGICIAKGGPSKLQGDHPPHQVAMRKKSEGCPIEKRRMAPAAPTAGRAGRGKNGGHVPVSPARCAGRGHGGAQAPGLPSPIPPEQQGGR

SEQ ID NO: 126242 - protein, 66 aa, Triticum aestivum
  Clone ID: PAT_TA_20660.pep
LWTEQESALRSRARKRAYVEELEKEVRRLVDDNLKLKKQCRQLKREVAALILPTKSSLRRTSSTQF

SEQ ID NO: 126243 - protein, 109 aa, Triticum aestivum
  Clone ID: PAT_TA_20661.pep
TFGCPASLGSWLSSLPSAAVWRPCVVGCCVCPAALPPLLRPWVVVNCTGPAAFALGPPQRRLRASLLLGILAAFNFLAADVFLFVVLYLIVLLSSLIRESPRQGAASFS

SEQ ID NO: 126244 - protein, 339 aa, Triticum aestivum
  Clone ID: PAT_TA_20662.pep
MAQRHGSSDAKAWEYSIGQHLRNLLLTSSPPRELAPRGVDLPRAIPGGRTGRFTNGYNLADIIAQRVGFDMSPLAYLSLTPQASLDLLSGRVGANYASGGSGILDDTGNGTITLREQIKRVADTEAARNGDSELGRKRVRGLLSQSLFLISTAGNDFLAFGDGRATRSDASAYIAKMVTTYLKHIKELYRLGARRLGLLDALPIGCLPGCRTSFGHDGACDAVANSLARRFNALLRLEMASATAASMPCMEYSIASIYGIFSDMITNLELDNGLQEATSACCGGGRLNAEIDCSASSNLCTDRDGYVFWDKVHGTQAAYQRAVAAMFDRAGVTKFTEPV

SEQ ID NO: 126245 - protein, 55 aa, Triticum aestivum
  unsure (1)..(55): unsure at all Xaa locations
  Clone ID: PAT_TA_20663.pep
XFSTFPINEVPREILNHLGYAVHVQPMCCFVSSPKDKSPLPMQLGFKIHAPKLHG

SEQ ID NO: 126246 - protein, 126 aa, Triticum aestivum
  unsure (1)..(126): unsure at all Xaa locations
  Clone ID: PAT_TA_20664.pep
NCDPCGRPGTQKSYMEVMEMIQRGXERPIHIPDINDEPPNPDQPISKPSMAPKPKPWEKQGQQSSGWDLKVHSSDPSESSSGVRTDSTSQATGSNNSSGHGDLMLTAEPATGSEAPVDDVAASPKQ

SEQ ID NO: 126247 - protein, 204 aa, Triticum aestivum
  unsure (1)..(204): unsure at all Xaa locations
  Clone ID: PAT_TA_20665.pep
ANVLLDDFCEAIVGDFGLAKLLDHRDSHVTTAVRGTVGHIAPEYLSTGQSSEKTDVFGFGILLLELITGQTALEFGKSSNXKGAMLDWVKKDAPRRRSSNVLVDKGXSGSSYDHIGLEEMVQXVALLCTQYXPVXRPKMSEVVRMPQGDGPAARGGAPRRTPSLKGPVPVGTGGPPYSAPSDDSSLLVQAVELSGPRVDAAANS

SEQ ID NO: 126248 - protein, 203 aa, Triticum aestivum
  unsure (1)..(203): unsure at all Xaa locations
  Clone ID: PAT_TA_20666.pep
LQSSTHPPPRPTPPAAPGAPAAAAAPAAAPPAEEEPAAEKAEKTPAAKKPKAEKRPPAAKASAAAKEGGKAKKKAKKSVETYKIYIFKVLKQVHPXDIRISSKAMSIMNPSSTTLRELAGEAANWQVQQEPTITXREXQDSVRLXLPGELAKHAVSEGTRYHKSTLLSPCLGRPVVAFSWCSVLCARPNVTSASANIRENQVG

SEQ ID NO: 126249 - protein, 69 aa, Triticum aestivum
  unsure (1)..(69): unsure at all Xaa locations
  Clone ID: PAT_TA_20667.pep
XLEXXAKLLQIYISKAELSLITLTTPAHVTKNLANQKLSKNEKKLREGNRLMQLAFPCPLCFTEHRTST

SEQ ID NO: 126250 - protein, 123 aa, Triticum aestivum
  unsure (1)..(123): unsure at all Xaa locations
  Clone ID: PAT_TA_20668.pep
MSSSEVACTLAALILHDDGIPITSEKIATVVKAAGIKVEAYWARALPPSPGRKRSVDDLXLSVGSGGGWCSQXAAAAAPAAGGALPRRRRRGRKEEXARKKXXTWFLVHSFKSPVSRKFLSLL

SEQ ID NO: 126251 - protein, 260 aa, Triticum aestivum
  unsure (1)..(260): unsure at all Xaa locations
  Clone ID: PAT_TA_20669.pep
DCPCKFGMKGDGKTGTCTPVFTPAAKATVGAIAGVLLLVIISFLVILRKEKKKAKEFYRKNGGPTLXEKANVIKLFRKDELKPILKKSNLIGKGCFGEVYKGILDNKLVAVKKPINGSVLESDQFANEVIIQSQVIHKNIVRPIGCCLEVDAPMLVYEFISQGSLHDILQXSNNKVAFNLXARLSIATHSAXGPTYMHSXKTNYTILHGDVKXTNILLGDTSYPRFKLXXTKPMQVDKGTHAQPGATEMVRVPQEGYHEK

SEQ ID NO: 126252 - protein, 695 aa, Triticum aestivum
  Clone ID: PAT_TA_20670.pep
KGLFFFLFQKKKKGDPPPLKKKKKKKKKKKKKKKKKKKKKKKKKKKKKLAASAPPSKEAGRRAKGKWSCVDSCCWLVGCVCSSWWLLLFLYNAMPASFPQYVTEAITGPLPDPPGVKLQKEGLHAKHPVIFVPGIVTGGLELWEGHHCAEGLFRKRLWGGTFGDVYKRPLCWIEHRARDNETGLDKPGIRVRPVTGLVAADYFVPGYFVWAVLIANLARIGYEEKNMYMAAYDWRLSFQNTETRDQTLSRIKSNIELLVATNGGNRAVVIPHSMGVLYFLHFMKWVEAPSPMGGGGGPDWCAKHIKAVANIGGPFLGVPKAVAGLFSSEAKDVAVARAIAPEMLDSDFLGLQTLRHLMRMTRTWDSTMSMLPKGGETIWGGLDWSPEDGFECKSKKRKTNDSEVSKDVHGEPVEVNPEPVNFGRMVSFGKDVAEAPASNIEQIEFRDAVKGNNLAHSNTSCRDVWTEYQELGWGGIKAVSDYKAFTAGSIIDLFNFVAPRMMQRGSVHFSYGIADNLDDPKYGHYKYWSNPLETKLPNAPKMEIFSMYGVGIPTERAYVYKLSPQAECYIPFQIDASAEGGDENSCLKGGVYMSNGDETVPVLSAGYMCAKAWRGKTRFNPSGSKTYVREYSHSPPSNLLEGRGTQSGAHVDIMGNFALMEDIIRIAAGATGEEIGGDQVYSDIFKWSEKIKLKL

SEQ ID NO: 126253 - protein, 102 aa, Triticum aestivum
  Clone ID: PAT_TA_20671.pep
RSTSTSTGFCQLAMASTRAVAIVFSLLILAAAAPSPLVRARMVPADGEGVPPAGRIAAPEVTGSGPEQRPLCKEALLQEAPACRCPLLTSPPDDDRLRAAQH

SEQ ID NO: 126254 - protein, 127 aa, Triticum aestivum
  unsure (1)..(127): unsure at all Xaa locations
  Clone ID: PAT_TA_20672.pep
XPEDGAPQGFDRGGETGERASGVQASGINMTSRCCKRXLRTAPHREMVMHDVLFPVLSIRNAEFVLEYEVAPIYFILWRISISCSISSVMPSNIANLYACMSNTTRLTIQMLSTDVYTRCEPKQQEY

SEQ ID NO: 126255 - protein, 476 aa, Triticum aestivum
  unsure (1)..(476): unsure at all Xaa locations
  Clone ID: PAT_TA_20673.pep
MSTTEGKPDAAAVEEMAREAAAWCAMHGLVVGDRADPRSGTVPGVGLVHAPISLLPSRLPESFWSQACELAPLFNELVDRVSLDGDFLQDSLSKTRQVDDFTSRLLDIHRKMMDANKEENIRLGLHRSDYMLDSETNSLLQIELNTISVSFPGLCSIVTELHRTLINQYGNLLCLDAKRVPGNDASRQFAKALAKAWDEFNVDSAVVMMIVQPEERNMYDQYWLVKYLRESHGVTTIRKTLSEVEAEGQVLPDGTLVVNDRKVAVVYFRAGYTPNDYPSEAEWSARLLMEQSSAVKCPSISYHLVGTKKIQQELAKPNVLERFLENKEEIAKLRQCFAGLWSLDDEEVVKSAIENPDLFVLKPQREXGGGNNIYGLDVREALIRLKKEGGDALSAYILMQRIFPKASLASLVRGGVCHEALTVSELGIYGAYLRNKDKVIINDKCGYLMRTKVSSSDEGGVAAGFAVLDSLYLTDK

SEQ ID NO: 126256 - protein, 98 aa, Triticum aestivum
  unsure (1)..(98): unsure at all Xaa locations
  Clone ID: PAT_TA_20674.pep
SQLYTSTHTLSRGXPSAHHTIEVHXVHPCLTAACRAIDGDLTNSGWMWEGRRWQESGERPGGQMRRDGVKGGMCRENTEPKHQARRVPKFGRQPRFNP

SEQ ID NO: 126257 - protein, 70 aa, Triticum aestivum
  Clone ID: PAT_TA_20675.pep
LKNQRGTTSNRRHPYNLTKTESIHHHHESEHEHHHCSTLSTHHIVIHFLLNNCTKSYVPSYDFSGCSRIL

SEQ ID NO: 126258 - protein, 171 aa, Triticum aestivum
  Clone ID: PAT_TA_20676.pep
ASSAAAARRRPPPPGPAPATPAPPAGRVLAKSGLSLTDPLPRNDAVTTTVGEALMAPTVIYVKQQVLDIISKGGVKGLAHITGGGFTDNIPRVFPKGLGAKIVTGSWQVLPVFEWLQQVGKIEDAEMLRTFNMGVGMVLVVSKDAADRILEESSPAYRIGEVIQGEGVQYV

SEQ ID NO: 126259 - protein, 49 aa, Triticum aestivum
  Clone ID: PAT_TA_20677.pep
ARLLRRSAVAGLETLLPLHTAVASARLKSCIAVDSTCWCSLSQGFKKRI

SEQ ID NO: 126260 - protein, 365 aa, Triticum aestivum
  unsure (1)..(365): unsure at all Xaa locations
  Clone ID: PAT_TA_20678.pep
MRPSAAAPAAFLAPAVTASSRLVPLRRARRFAVRCVAAPPAPKPAYSPSKTGNWQWTFEDKPVSVYYEEHEQGTAENVKNILMIPTISDVSTVEEWRVVAKDIVTRKGELSYRATIVDWPGLGYSDRPSLNYNADVMENFLVQLLNSPNSPVADADGELVVVGGGHAATIAIRAAGKGLIRPSAVAAVAPTWAGPLPIVFGRGSDMETRYGLLRGTLRAPAIGWMMYNVLVSNEKSIQSQAKSRVYPNPGIVPPEIVESRYELTKRKGARYVPAAFLTGLLDPVQSREEFLELFAKLDGDVSVLVVSTLNSPKRSKAEMEALKGAKGVTKFXVEVPGALLPQEEYPLAVAEELYDFLQGSLSSGR

SEQ ID NO: 126261 - protein, 57 aa, Triticum aestivum
  Clone ID: PAT_TA_20679.pep
LQKAELEVDLLGDEVEALTDLLAKIYIALDHYSPVLQHYSGVMETLNMIRKHISTTK

SEQ ID NO: 126262 - protein, 152 aa, Triticum aestivum
  Clone ID: PAT_TA_20680.pep
MAPKAEKKPAAKKPVEEEPAAEKAEKTPAGKKPKAEKRLPAGKSSAAAKEGGKAKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 126263 - protein, 136 aa, Triticum aestivum
  Clone ID: PAT_TA_20681.pep
MAPKAEKKPAAEKKPVETEKKPKAEKRVPGKDGGADKKKKKAKKSVETYKIYIFKVLKQVHPDIGISSKAMSIMNSFINDIFEKLAGESAKLARYNKKPTITSREIQTAVRLVLPGELAKHAVSEGTKAVTKFTSS

SEQ ID NO: 126264 - protein, 152 aa, Triticum aestivum
  Clone ID: PAT_TA_20682.pep
MAPKAEKKPAAKKPAEEEPAAEKAEKTPAGKKPKAEKRLPAGKSAAKEGGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 126265 - protein, 228 aa, Triticum aestivum
  unsure (1)..(228): unsure at all Xaa locations
  Clone ID: PAT_TA_20683.pep
LVKKTVDRIGQLPDREPIDVPADSTDQFSNKRGLRKRPPNPLDVSKDTTGKPEQFIKAETPGSDNLKHYAILAKYKAVTNATYRDKWLDKLVDTIPLTSKEGAEASHADAGSVAKISNSSSSARDTSSSDNENSYPPDVVVSIMASLERSTYDALHADFQKYNQKMRKLEFNIKNSPVLRRRLMNKELDPPVLLTMSXDELKAGLTPAEKTSEPEEARRLQMTDARCE

SEQ ID NO: 126266 - protein, 119 aa, Triticum aestivum
  Clone ID: PAT_TA_20684.pep
VGNGNGNKKAPVSRSSRAGIQFPVGRIHRQLKQRVSANGRVGATAAVYSAAILEYLTAEVLELAGNASKDLKVKRITPRHLQLAIRGDEELDTLIKGTIAGGGVIPHIHKSLINKTSKE

SEQ ID NO: 126267 - protein, 199 aa, Triticum aestivum
  unsure (1)..(199): unsure at all Xaa locations
  Clone ID: PAT_TA_20685.pep
RRGHRVPKHDPDAASRLIMELMLRVQGGVFGSVGSSLVDVGXGAHGTAPEAIAXAFPQIKCTVLDLPLVVAGPPARDNLTFNAGDMFEYIPPADTVLLKWILHDWADEDCVKILRQCKKAIPTRDAGGKVIVMDMVVGTAGSQETVSKETEVLFDVFMMYIDGTQREEHQWSKIFYEAGFSDYRITPMTGIRSIIEVYP

SEQ ID NO: 126268 - protein, 100 aa, Triticum aestivum
  Clone ID: PAT_TA_20686.pep
IEIPKVRPLSVDTNVHYIITSHNKTTVYKNNKSAPDIMWCTGLIQLPETSHGSGIPPKKKPASSCLHRSNVDPALGRRRRPVAAPSGEASLGLRRVLHAV

SEQ ID NO: 126269 - protein, 259 aa, Triticum aestivum
  unsure (1)..(259): unsure at all Xaa locations
  Clone ID: PAT_TA_20687.pep
HASGNVDGAVITTPEEFKWMLDELFFLNGVFNIGDSIPWLNWMDLQGYVKRMKKLRKMFDQFLEHVVDEHSERRRREGQSFESKDMVDVLLQYASDPGLEVKLNRDSVKAFTQDLIAGGTESSAVTVEWAISELLKKPKLFTKATEELDRVVGRGRWVTEEDMWSLPYVEAITKETMRLHPVAPMLVPRLSRDDTSIDGYDIPSGTQVLVSVWSIGRDPELWXAPEEFTPERFLDSRLDVKGQDYELLPFGSGRRMCPG

SEQ ID NO: 126270 - protein, 169 aa, Triticum aestivum
  unsure (1)..(169): unsure at all Xaa locations
  Clone ID: PAT_TA_20688.pep
EIDTEFRTISPRGSEGDIVTPNSNLFAGHPIGREPVDNHPGPATPGRTSGNSGCDPHDTPVPRSPFGLSTSIMVPEGDLLQPEKIENGILFNVVRRDALRSXTSGVEPHGSSQEADVETVXTECLYGASDDDDDNVELNAVPEALSDPGVQRSPVAGNLDPSTSMDCPS

SEQ ID NO: 126271 - protein, 202 aa, Triticum aestivum
  Clone ID: PAT_TA_20689.pep
MEGDDRSAPLLANGAGRPSLRRRDSARSLRSSFLRRLPDKMRTELDPERGADVDVARVKDLSQGEREYYRKQLAALKTFEEVEALCMPGEFGSDDDGDPDASDADDEEQKQSEFAMKISNYANIVLLAFKVYATIRTGSMAIAASTLDSLLDLMAGGILWFTHLSMKKVNIYKYPIGKLRVQPVGIIVFAAIMATLGFQVLV

SEQ ID NO: 126272 - protein, 160 aa, Triticum aestivum
  unsure (1)..(160): unsure at all Xaa locations
  Clone ID: PAT_TA_20690.pep
MAATAPGIRQTKAGQCTATGKQHPQQPRKQHRPPGDHSLSGSLHREAAIQQSPVAKPTTGQERRRLPVPGVTAGTPQGQGERVEEAVAGQGDEQPVVIVRSIQCQCSRRRSPPAVAATPAPTQGGGPDKPRPPPRLRGPRAQGAGXNQKAEKPGGSQRAK

SEQ ID NO: 126273 - protein, 157 aa, Triticum aestivum
  Clone ID: PAT_TA_20691.pep
ASMPPIFSSQSSASTPPIFSSQFFTSTPPIFSSPSFASTAPPPTDDGSQDPWRRCLKRPDGSGSQQLPMQRAAATRKQRPRPWIYCRGLLLRLPGRAAASPSGGSVQPARDEERTTTVTCRRHKLDLAGDNDAPHKELSASPVPWTVTTGTHARARQ

SEQ ID NO: 126274 - protein, 258 aa, Triticum aestivum
  Clone ID: PAT_TA_20692.pep
EFGSVLRATRSAADLAVLRAAGAAPAGPRAGGPAAAPPARAAGGRRTPGALLLPRLPRRPRLPRRRRAPRRLPPPAAHAQRLRRLRPPRLPRRPLLPAGRHARAARTVRAPVRSAPRGTQSAPVRVARGASPSTPRAPSPSSYSLHAWVGIATITLYALQWLAGFLAFFFPGAAPETRRSAVPWHAVLGLLVFALAVGNAQLGFLEKLTFLQSPPARLVGKYGAEALLVNFTAVIVLLLGIAVVIATVNADSTRYTAM

SEQ ID NO: 126275 - protein, 163 aa, Triticum aestivum
  Clone ID: PAT_TA_20693.pep
MLRLLPLSLSAQCRSGGPPSHRCFVDGGSPSQRTGPGLLANNGVRVRVRRRALRGADVQPDTPPSRRDGDKPLHADAEQVEGSGVDLLDSVKKLLLEDAEPGEEEQGQFPKRWAIVFLCFSAFLLCNMDRVNMSIAIMPMSAEYGWNPQTVGLIQSSFFWGYL

SEQ ID NO: 126276 - protein, 328 aa, Triticum aestivum
  Clone ID: PAT_TA_20694.pep
IVPAVEKFQKKKERDLKRRQQKNERLERLAFANVFQTRSLRERKAVSYDYSDYDRRINEAIKATAKGKEADSGKEAAKKEKQVPRQADNRTDIGADIEHNEDREQEDAKEDLDDLSSGDDEVSDYDDKDDGSSSSDGDTDASDSHESNSDEEVIVPRKRTRLAARALASKQFRPGVRRSRRNMKGSDEEMVHPGEVTPEAMTKKTTRQRPTHISKQFSMSGSEDGSEEDHHSESAADSEEEPEDGSKDDHHSESAADSEEEPEDGSEDDHHSESAADSEEEPEDGSKDDHHSESAADSEEEPEDGSKDDDHHSESAADSEEESDSESS

SEQ ID NO: 126277 - protein, 177 aa, Triticum aestivum
  unsure (1)..(177): unsure at all Xaa locations
  Clone ID: PAT_TA_20695.pep
SDGKGVIYQARNAKEVSMEMINMHEKQQFMDDKKLIAIISEAGSAGVSLHADRRAKNQRRRVHVTLELPWSADRAIQQFGRTHRSNQTSAPQYXLLFTNLGGEKRFASIVAKTLGARGALTQGDRRAGPXLSAFNYXSTYGKKALTMVYRGIMEQVLSIVPPRVTTSQAKIKQVPYH

SEQ ID NO: 126278 - protein, 105 aa, Triticum aestivum
  Clone ID: PAT_TA_20696.pep
RSYAESRRGDCALVHSSGPYGENLFWGSGTGWAPAQAVGAWLAERPRYDYWSNRCSGGMCGHYTQIVWRGSTRVGCAMVECYAGRGTFITCNYDPPGNYVGMRPY

SEQ ID NO: 126279 - protein, 167 aa, Triticum aestivum
  unsure (1)..(167): unsure at all Xaa locations
  Clone ID: PAT_TA_20697.pep
MSRRAVNPGRRASDGGLPTVASLLHHKSRSPSVLTMALLALGVIILIVYFNSGSGVTVTSRESVSRAEGSCTSEVIQALPYLKKAYGSAMQKVLHVGPDSCTVVSNLLKEGKEAWGVEPYDLDDADSXCKSLVRKGFVRLSDIKFSLPYRPDXFNLVVVSNVWITDP

SEQ ID NO: 126280 - protein, 157 aa, Triticum aestivum
  unsure (1)..(157): unsure at all Xaa locations
  Clone ID: PAT_TA_20698.pep
LRTHLSQNKMSTVKVGMFGGSKGDVCDITGLSSFAPSSLRSMEIWSTPGHEGVINAIRFTFVDTKNNAIPVGPWGTPLRGQKSQDYSLDKCACHRALRLHQWAIHHSXSFRTTDAQRHHGPIGKVTATTGFDTISGPLMQGSIVASAPTDTTQARCY

SEQ ID NO: 126281 - protein, 75 aa, Triticum aestivum
  Clone ID: PAT_TA_20699.pep
MDPSPAAAERDRSPPPPPAPPPSSSTSPLAVVCSFWKDFDLEKERSGLDEQGLKIAENQETSQINRRTLAENTLD

SEQ ID NO: 126282 - protein, 139 aa, Triticum aestivum
  unsure (1)..(139): unsure at all Xaa locations
  Clone ID: PAT_TA_20700.pep
FSPSFPILPWSPAPSLHLVRPPLPFVPTASKRFATPSLPRVFIESGRPSGRGGPPAGQLGMLASILALGSVGCARLPRPCSSPSFFESVRRSAQGGARAQRTHGRTNAKAGARXPATKQQRAGVWFSNKSGXFXCSHGD

SEQ ID NO: 126283 - protein, 357 aa, Triticum aestivum
  unsure (1)..(357): unsure at all Xaa locations
  Clone ID: PAT_TA_20701.pep
MTPPAAATRPYWPRWPCPLGGPKRKLAPASRTWRVTRRPLPSPLRPRAPPSVQRRRQDLLLFAHLHEGKLIAIETDTLKTLHYALATTLFNVLLAEYLKYSSLCSPNDTSPLERSELAXMKVVRXRAQLQDGQSILDVGCGWGSLSLYIAKKYRNCNITGICNSTTQKAFIEEQCRENELSNVEIIVADISMFEMERSFDRIISIEMFEHMKNYKALLKKISRWMKEDSLLFVHYFCHKTFAYHFEDKNDDDWITRYFFTGGTMPSANLLLYFQEDVSVVNHWLVSGTHYARTSEEWLKCMDKNIATIRPIFEKTYGRESATKWIAYWRTFFISVAELFGYNNGDEWMVAHHLFRKN

SEQ ID NO: 126284 - protein, 83 aa, Triticum aestivum
  Clone ID: PAT_TA_20702.pep
FLQVFSSGLVGPNSKHFYTTKKNKRKEKKSGLLIRRLARSGFRDATAALPRRGFGDALQGRPPVPASAATGRLRAAGAPVPVL

SEQ ID NO: 126285 - protein, 272 aa, Triticum aestivum
  unsure (1)..(272): unsure at all Xaa locations
  Clone ID: PAT_TA_20703.pep
DHLESRRSASSSEQVDQEDIIDVLLRVQGEGNLEPPLTMNNIKAVVFDLLAGGTETTSTTLQWAMAELMRNPSIMXRAQDEVRGAFMGKNKVTEEGLGELSYLQCIIKETLRLHPPGPLVPRECREHCRILGYDVPKGTTILVNVWAISRDPECWDEPEEFVPERFVASARDFKGNNFEFIPFGAGRRICPGMLFGLATIELALASLLFHFDWSLPDGTLPSELDMTEXMGLAAKKKVPLWLRPTPQVYLPLLNHAFMVLHLVSPVPPPGEH

SEQ ID NO: 126286 - protein, 67 aa, Triticum aestivum
  Clone ID: PAT_TA_20704.pep
LLLRHRLRARRHRRQPLLTYAPRAARGSDGAGDRARRPCVVVLVACLTQLLGIERRATSLICTCTYV

SEQ ID NO: 126287 - protein, 165 aa, Triticum aestivum
  unsure (1)..(165): unsure at all Xaa locations
  Clone ID: PAT_TA_20705.pep
LTXXKXRPGGATQMRFQPRKGKYLAAASEKAIYILDGETQHACRSPLQGHAKDIQSVCWDSAGDYLASVSEDAVRIWSFTSGQDGEFVNELNCSGNKFQTCVFHPAHPSLLVIGCYESLELWDIREKNAMTFNNAHDGLIAALAASSATGKVASVSHDRLVKLWK

SEQ ID NO: 126288 - protein, 231 aa, Triticum aestivum
  Clone ID: PAT_TA_20706.pep
TTENLIESDTNTSRGPSSSKLAVSPGHSLTKLQTSVYSGCVSKRKIDISDDQEKQLESPSNPKRPHRTSSVPFDLNLPVGDDGSSDADGDDGSSNDSPDESIDSLMGLVDGAIEFKAFDFGKLANDILQGVSSVLGSILGSGCTLEVGDGAMEQMLAASWASEDGRRPLRAWLEQVFARSLEELKLKRSKQASSSALRLVACEDGAAAATAAKEDGGFGPLLPSRIILEWR

SEQ ID NO: 126289 - protein, 150 aa, Triticum aestivum
  unsure (1)..(150): unsure at all Xaa locations
  Clone ID: PAT_TA_20707.pep
MFSILLVESQLQLNIAALPVFCWALVHVARFLGRNFCRSSFYRGYLXEEPCLWVGDKQHPRSASLCSNAELALGLXFLIISLFSXWQAQFHSKTFMSWQXLHLMKPVFVXAGYHXERVGPWSGRTVNPYIDRYAPFLQTPISMVQRWWLR

SEQ ID NO: 126290 - protein, 67 aa, Triticum aestivum
  Clone ID: PAT_TA_20708.pep
RTSKFIASKPHDFSLGERQKINIMVQLRRNVGPSVIVGRTPANTSRTLEPPCQAPVFSSWPHELFLL

SEQ ID NO: 126291 - protein, 458 aa, Triticum aestivum
  Clone ID: PAT_TA_20709.pep
MARVVAAVPLLLFLLLASSSVVFADTVLGRKGSTMVEGPVQFPGVGKYAVIFDAGSTGTRVHVFKFDNKMDLLEIGDDVEVFAKVSPGLSSFSGRPKEAAKSMIPLLDKANSVVPWWQMNRTPLKLGATAGLRLIGDKPSEQILQAVRDIVHTKSKFQYNPKWINVLEGSQEGSYMWVALNYLLDRLGGDYSKTVGVIDLGGGSVQMAYAVSPNTAANAPATPDGKDPYITKEYLKGNDYNVYVHSYLYYGNLAARVEILKAKSGPFSSCMLRGSTGNYTYNGEVYDAAASPEGAVYTKCRKEVAKALKLDAPCASKNCTFGGVWGGGGGAGQATLYAASFFYGKATQVGWVKKDAPSAKSSPGAFRAAAKKICPLSLEEAKAAYPGVRETPYICMDLVYQYTLLVYGFGLAPAREITLVEKVKHGEYFMEAAWPLGEAIEAVAPKKRIQHDPPVNVA

SEQ ID NO: 126292 - protein, 111 aa, Triticum aestivum
  unsure (1)..(111): unsure at all Xaa locations
  Clone ID: PAT_TA_20710.pep
ASSPAAAPPLPRIPPALLPLLPRLADPLLLCLLPPSPCPRPAPASPLPPPTAAPXPPRSPPPPLPPPPSRSLSLSQISVTFTSVIIYYVMFSFEKCNILLFGSVSKFNINA

SEQ ID NO: 126293 - protein, 138 aa, Triticum aestivum
  unsure (1)..(138): unsure at all Xaa locations
  Clone ID: PAT_TA_20711.pep
MILGGSTCCCFTQLHPAATAARLRLPPARAANTSSEPAAARLRAVLEQVDDELRKGNDEAALSLVRGSQGEGGGLRCFGAARQVPQRLYKLDELKLNGIDTSSFLSPXDQTLGSIERNLQIAALLGGLSVSFAFELSQ

SEQ ID NO: 126294 - protein, 151 aa, Triticum aestivum
  unsure (1)..(151): unsure at all Xaa locations
  Clone ID: PAT_TA_20712.pep
MVSLKLQKRLASSVLKCGKGKVWLDPNEVNEISMANSRQNIRKLVKDGFIIRKPQKIHSRSRARRAHEAKQKGRHSGYGKRRGTKEARLPTKILWMRRMRVLKRLLRKYREXAKKIDKHMXHDMYLKVKGNMFKETKXVLMGEVSTKSKEE

SEQ ID NO: 126295 - protein, 190 aa, Triticum aestivum
  Clone ID: PAT_TA_20713.pep
GIAVNCMNSLRGVVPGGARRRGAFAASLRRLEPRVVTVVEEEADLVATDPDASDEGGDTEAAFLKVFGEGLRFFSAYMDSLEESFPKTSNERLALERGAGRAIVDLVSCPASESMERRETAAAWARRLRSAGFSPVPFSEDVADDVRSLLRRYREGWSMREAGTDDSAAGAGVFLAWKEQPLVWASAWRP

SEQ ID NO: 126296 - protein, 164 aa, Triticum aestivum
  unsure (1)..(164): unsure at all Xaa locations
  Clone ID: PAT_TA_20714.pep
PWXXXYKFPESLSNNMFKCCSAAFSCLIFLIVWLMIYQFDSCRKGKIRVICISWEVAGVGECNYADYLVSRGIPIPAGWGVGQVTEGTTEEEDAEQKVKDAVPLLMAKQQLLNGLDSNGGDERLVKIMGKIDVLCXMIVSLIAVYVHXDVSMGYDMTLAETSNE

SEQ ID NO: 126297 - protein, 79 aa, Triticum aestivum
  unsure (1)..(79): unsure at all Xaa locations
  Clone ID: PAT_TA_20715.pep
SCSXXTRIXGPXIXNXPXSRTPXIACEKMMNSLTTLSVRIVTGRMTGRNDHVLLMVCAALLCHIQGRDHWSKALLPPRE

SEQ ID NO: 126298 - protein, 78 aa, Triticum aestivum
  Clone ID: PAT_TA_20716.pep
FFFFVSTNMQLSQSNISRRMRLGKTHTRIFAAPSVAVPAGRHRHHAMYKAQTNTTLVSYRSGHWRRRPPRASATVRRA

SEQ ID NO: 126299 - protein, 113 aa, Triticum aestivum
  Clone ID: PAT_TA_20717.pep
QFFGLANLLLDCKTASSNTLLERGTDASVIVFRIFTANYMPSLMMRLNQSDIHFLQMNGVIPALCLEPCAMPGEEKRMHSCFDWPVTLNHFRLSWQACPLETSCRRSCCRRTP

SEQ ID NO: 126300 - protein, 60 aa, Triticum aestivum
  Clone ID: PAT_TA_20718.pep
RQLRESSITETFEPEKVQLTLTVPQCSQHSAMVIIWFIHSAVPRNAGADQSMTTLAPRAF

SEQ ID NO: 126301 - protein, 228 aa, Triticum aestivum
  Clone ID: PAT_TA_20719.pep
WNLGVLCLLGNCFLMGAYLVIQAPVLVKYPASLSLTAYSYSFATIFMVLTGVFATNGLHEWALTGTEIIAVLYAGVVASCLNYAIMTWANKILGPSLVALYNPLQPACSTILSTLFLGTPIYLGSLIGGVFIIAGLYLVTWARYNEAQENTDVWLSESSSCGRGGCASSQETGKFKRSGSLIRTTLPPLWLPSKACSRSFTLYTTSTLRPVPAPRGVSCAFKIPNTST

SEQ ID NO: 126302 - protein, 206 aa, Triticum aestivum
  unsure (1)..(206): unsure at all Xaa locations
  Clone ID: PAT_TA_20720.pep
XYPVSVGVNDXXARYRLLXRLVRPPFNTYFIYYRFTRVITTXSTARARPDGRRRGYAAGGEAAGAGRPPLRATRGACKRRGDDGQWRGRVTGRREGWRKKGSRPGSETQQQRGSTVPPHGGRQLSWYSHGGLASRQMPQGLSVRVRLLLIGPGAGMRVARAGLPRFGALRRDNTPTPACLRVCIRDVHRAVQSAPEAVSGISAMGI

SEQ ID NO: 126303 - protein, 91 aa, Triticum aestivum
  Clone ID: PAT_TA_20721.pep
QRGRRREGSAAQAIRGGEAAQGVPHRLLGTQLIRTNSGTFLFCCLIDSGLSLSLRFGLFPERRICEWRVNRDICLLPRTKKEREIYKRKRS

SEQ ID NO: 126304 - protein, 113 aa, Triticum aestivum
  unsure (1)..(113): unsure at all Xaa locations
  Clone ID: PAT_TA_20722.pep
MSEAVGTPESGGAKEQERFLPIANIGRIMWSGVPANGKIDKDAKEKRKXTINGDDLIWSMGTLGSSDYRRPLKLXLKLYREMEGDTSKGSKSEQAAKKVGALNGQPGSSFNGM

SEQ ID NO: 126305 - protein, 72 aa, Triticum aestivum
  Clone ID: PAT_TA_20723.pep
YRGPCSSEATRVNHAVTIVGYCEGPGDNNKYWIAKNSWSNDWGDQGYIYLAKDVSWRTGTCGLATSPFYPTA

SEQ ID NO: 126306 - protein, 205 aa, Triticum aestivum
  unsure (1)..(205): unsure at all Xaa locations
  Clone ID: PAT_TA_20724.pep
RPAAPRPRPPAGPAAATPPLRRLLLPLSPPRFAAAAASSPARLLHAAAVRGGSRWLASDASASAAREPSAELVEVPLAQTGEGIAECELLRWFVSEGDHVDEFQQLCEVQSDKATIEITSRFKGXVHEIQFAPGDIVKVGETLLKMIVNGSQVVPHDSLASSPDIPLGVDTSASPLSEGNAPRGSLSTPAVRHLVKQYGLNIDDI

SEQ ID NO: 126307 - protein, 199 aa, Triticum aestivum
  unsure (1)..(199): unsure at all Xaa locations
  Clone ID: PAT_TA_20725.pep
RVGSAGRIYHNVEVRIVDIVTGEPLSVGQXGELCVRGPSIMTGYVGDNEANAAAFDSEGWLKTGDFCYIDEDGFVFIVXDRLKEFIKYKAYQVAPAELELVLQSLPEIADAAVMPYPHEEAGEIPMALVVRQPGSKVTEAQVMEQVAKQAAPYKKVRKVVFVDSIPKSPAGKILRSSCKSVRRPVLCLDSHCTPSVLPP

SEQ ID NO: 126308 - protein, 137 aa, Triticum aestivum
  Clone ID: PAT_TA_20726.pep
RPQPQPASDAASTTQLPPTPSTPLHSTIRIRCSRPPATPSPPLHRQLQPPQPEPIPYAPAKPRPFTLTDLDAIRRRVADAPMEVARSDYPDGDGQLSTDVDEISQRVADVRMGSRLLRHPDEALRSAATSTVRVPFL

SEQ ID NO: 126309 - protein, 150 aa, Triticum aestivum
  Clone ID: PAT_TA_20727.pep
VYNAAVMSDYASLGAPDPEEEQEIDNLTIMETSRPDSRDRRLSFPQSVRDVVLGSGEIMVDDVRYTVSHVVEPMERSFTKINKTLHQISENVKQIEKQKRKAKDDSHLIPLESWSEEFSEAQDQVQGGSFSDSGLARRRYNKFRRLRRWF

SEQ ID NO: 126310 - protein, 137 aa, Triticum aestivum
  unsure (1)..(137): unsure at all Xaa locations
  Clone ID: PAT_TA_20728.pep
MLLPSSSSSSYDPKGDSFGKSVDDHMRSTLTFGDKHSVFAGQNTDYGHPMACISYPFNDSGSGVWAAYGSRAMFQPLMAGRXASATARVPLPVRXAADEPIFVNPKQYNGIXRRRQLPPKLEAQNKLPKNKKPYFQD

SEQ ID NO: 126311 - protein, 182 aa, Triticum aestivum
  unsure (1)..(182): unsure at all Xaa locations
  Clone ID: PAT_TA_20729.pep
KAEEYRGAKGGFPPHFFLSSALVDRLRLKRHVVVVACLPWKLPWWKQAGDGQRPCPRPAAPAARVSLPFVRSLLSASCGNGPIDLQSFPLISCNPVLPSVNVRLIVLICWLLCIFSLVINLAVIFSSVIEYLLKPTSKYXKNXXEKIKXXGGPVPIPXMIYXRHGVXXTLXGNRVQLXPEKP

SEQ ID NO: 126312 - protein, 111 aa, Triticum aestivum
  Clone ID: PAT_TA_20730.pep
ARNSCPLCRYELPTDDKDYEEGKRNVLDVSEDSSSSDDGTESGEEEYVERGESESGVSRVSRGRWLFLAAAPVVSLVGVVLAMWLSSPHRRGIAISHSQRENRTRRWLPFF

SEQ ID NO: 126313 - protein, 244 aa, Triticum aestivum
  Clone ID: PAT_TA_20731.pep
MFGWMTPPQLKGKVVLMRRNLLDLNHWQQPLSHDTWDEVTTKGVTCQLISSTVADPNDESGTRGLLGEEERVEHWVLHLPPINHGDTTYDVTFDWDVKKQGIPGAVIVRNYHATQFLLKTITIDDVPGHAGPIVFVANSWVYNTNKYHYDRVFFTNDTYLPSEMPTLLQPFREDELRILRGDDPRQKNGAYEEHDRVYRYDLYNDLRDPDHKNPRPTLGGPDSLYPYPRRGRTGRKPMVTDPTC

SEQ ID NO: 126314 - protein, 161 aa, Triticum aestivum
  Clone ID: PAT_TA_20732.pep
MADHQRQRIHPVDLEAGQPRPSAPLVPPGSSFRSDKGDPAAAPDRRPPHHQPLPPPKRRRGCCCRFICCVLVTVILLAVLAAVALGALYLVFQPKAPHYSVDRLSVSQFQVDPTLTASARFDVTVTAANPNSRIGIFYERGSSLSVWYDTHRLAQGALPPF

SEQ ID NO: 126315 - protein, 161 aa, Triticum aestivum
  Clone ID: PAT_TA_20733.pep
MKGAKSKGAAKADTKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSDEDEDDDE

SEQ ID NO: 126316 - protein, 156 aa, Triticum aestivum
  Clone ID: PAT_TA_20734.pep
HASGEELLQSSPRMKNVASEGPGGSSECSNVLSTQAEGRELSPSSIQDKSGMSEATSFQEPTPDPLPGAEADKHPISTSEPEIIDKSVIEEELVVNTEIKNPGDKPNLYTPEDDDDKEVEDWLEDMDHADNKTGNITSVGQDEDVSFSDLEDDDDD

SEQ ID NO: 126317 - protein, 161 aa, Triticum aestivum; identical to SEQ ID NO: 126315
  Clone ID: PAT_TA_20735.pep

SEQ ID NO: 126318 - protein, 161 aa, Triticum aestivum
  Clone ID: PAT_TA_20736.pep
MKGAKSKGAVKADTKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSDEDEDDDE

SEQ ID NO: 126319 - protein, 402 aa, Triticum aestivum
  unsure (1)..(402): unsure at all Xaa locations
  Clone ID: PAT_TA_20737.pep
SAPLHELPAMSWLARSIAATVFFAPDDDEDYHSEAVSGDKSPDHAASADDEEDEQPDTPGRGVKGDISELTESLTRRFWGVAFFLAPPPSAGAEAAETSTPRVRAEAEGEYGPQSPRVAGIRNDLAEIGGRVRSGISMLSNANAVAEISKIASSFLPFVPEEERVXDVGVGVVXEVVVFVRHISTSPETWLDSPLFVNDRHADDFELSDTQYEHALAIERIVPSLSYLRTELCSTNMSEACFWKIYFVLLHSKLNKENAEVLSTTQILEAREELLQSSPRMKNVASEGPGGSSESSNVPSTQAEDIEFSPSSIQDKSGIAEATSFQEPTPDPLPGAEADKHPISTSEPEIIDKSVIEEELVVKTEIKNPGDKPHLACVSSSFPQPRPGAPSLPRPLPPGNQP

SEQ ID NO: 126320 - protein, 169 aa, Triticum aestivum
  unsure (1)..(169): unsure at all Xaa locations
  Clone ID: PAT_TA_20738.pep
MERCASRTSARPPHPQPAPAPAPTPGRGICMMSTAWRDKQEHHLINFIGAFLAANLYRLNFLSISPDFIFNNGGLSVAFIFETSWDCGNXAAVFSRVNALKRQFXNLYVVCXVPTVEQIESFNQSXFKYGMELGXPTFVSVNDXEMGFEMMLKXAQARGVCKQQXXTQQ

SEQ ID NO: 126321 - protein, 537 aa, Triticum aestivum
  Clone ID: PAT_TA_20739.pep
PRVRNNSDSDREVSVDSERLGPRCRSFEDLCSMDGEKVDYLSGDETNRSKSNLHVLCAGPSSPGISEALGLEDCSGGRSGAAEDGQRSSASVDGNFVRDGMLSHDYWDGKYIAADNKAYPVAACCADSGHNCVINGALDQESKEKLWHRNSDLYHESLGIDMPNLKNLSDSKDISEEAEHNETGMNGDQHFDEDLNELSPRAYSIKRIEDWISRIDIDSDIIVEEQGESSSSASTKYSEPVISVSAVRPDAKSPLGMEIAYTYISKLTPVSSSAQLPNLGLVAIPRLSAFSGLRLLNLSGNSIVRVTAGALPKGLHMLSLSKNNISIIEGLRELTRLRLLDISYNRISRIGHGLASCSSLKELYLAGNKISEVDGLHRLLKLKVLDLRHNKISTSKGLGQLAANYNSLEAINLDGNPAQKNVGDQHLKKYLLGLLPNLAVYNKQPVRATGSKEVSDRHTRKISSSHRSDRSSRSDRKSSRLVAGTSSRHARPAHTSGPLVKQSRSRNMPMAALGSRPVEYAGAGVPAKQIQMEEKSQ

SEQ ID NO: 126322 - protein, 148 aa, Triticum aestivum
  unsure (1)..(148): unsure at all Xaa locations
  Clone ID: PAT_TA_20740.pep
FFFFXLFFEDPAKLRSLIIAESNGKQQDDEGXRTKRSEDQRKRKEKEKRALTTAAQHSIQTTLRQRSSDSDGELRRQSKVGVTEDHRTNHLSRVIVYHRPPTVASTSPRRAVEARARPRRRRGPPTATKDHASDIAHRRHCCHRSHRA

SEQ ID NO: 126323 - protein, 242 aa, Triticum aestivum
  unsure (1)..(242): unsure at all Xaa locations
  Clone ID: PAT_TA_20741.pep
LKTVSSNAGSVASTVRSAGASVAASIAPQAEDEKDQVLWAGFDKLELRASSFKHVLLVGYSNGFQVLDVEDAANVCELVSKRDGPVTFLQMQPTPLYSEETEGFRASHPMLLVVAXGDETNGLGYGSRWGRLSAXSRDTSTEPQTGKLHLYPNSWSLHSLEPTPPYSPLRPAGCMSFVPPPGRSVHVTTTELYLENINSVIPKLGKMGPMSLVRWLSPRPFTHGLKLTFKMGTIQDYNGHTN

SEQ ID NO: 126324 - protein, 170 aa, Triticum aestivum
  Clone ID: PAT_TA_20742.pep
GKPSTFATLEFWAWGAVFVAAFATAFVNPTALGTTARTCLPFMLASTVLGYMVGSGLPPGIKKLLHPIICCALSANLSAVAYGYLSGSGIDAALGDYLTKVPSNPGAGDVLMGFLGSVILSFAFSMFKQRKLVKRHAAEIFTSIAIASTFFLYSTAILGRLIGLEPTLTI

SEQ ID NO: 126325 - protein, 72 aa, Triticum aestivum
  Clone ID: PAT_TA_20743.pep
NNHPLFCLLALILEVVAHGIDLEHINRLGDLKQIFSACSSCILVKTRWTVSLKYIIVFFIRCKILSCYNQTP

SEQ ID NO: 126326 - protein, 133 aa, Triticum aestivum
  Clone ID: PAT_TA_20744.pep
LKGFQMFRLPQKYLHPCPPPYQKPHFPYFCVPFQVETFTPCLQRRLLAGDPRSCCSASSIQAGNPHPTPILLLLPHPTCPDRRRNTFHPNHRPLHQLSAALSHGAQYNHDLKEHLAAEKQITPACLDERLTIA

SEQ ID NO: 126327 - protein, 110 aa, Triticum aestivum
  Clone ID: PAT_TA_20745.pep
MLVRLGFVVLATFAAFTLKRGKGPKKDNGQAGKRKEKARHTGHGEKEDEEEEVKTISGIINSAPSVDDDDEDDMFSEIESLLGGEVDIPIPGDRYDVKERSRYNAHMANN

SEQ ID NO: 126328 - protein, 51 aa, Triticum aestivum
  Clone ID: PAT_TA_20746.pep
ATGSSPPELFSITYSRVKLGERGPIVYKYSWSSHSGRQREELLQHCTADSK

SEQ ID NO: 126329 - protein, 147 aa, Triticum aestivum
  unsure (1)..(147): unsure at all Xaa locations
  Clone ID: PAT_TA_20747.pep
MATAAASQVAFSAPXSDRAVSGSGIQGINSLSFGNKSWIGTALACDSKAAAQPRHLCRAVQQSSKSKVSVAPLDLESAKEPPLNTYKPKGPYTGTIVSVERAVGPNAPGETCHVVIDHGGNVPYWEGQSYGIIPPGENPKKPGNPQN

SEQ ID NO: 126330 - protein, 402 aa, Triticum aestivum
  unsure (1)..(402): unsure at all Xaa locations
  Clone ID: PAT_TA_20748.pep
TARARPPPSPPPPFLPRTARPAASQVAFSAPVGGSVRAVRGLGIRGIESLSISNKPSNGRXVACDSTAAGTGRTRAGRAGQDCSGSKASVAPLVSVTTTEPPRSTYPPNTTYTATAPSFARIGRSGAPLXERHATSDPSHVVIYRGGKGPDREGQSYEIIPKREDQKKTGKPQNVRLNSFAATRXGNSFVWKTASQCVRRPVNXGQERGKGDPSKNVLQLNEVRKTARGNMIQESELFGQIMILPGCETNATKSQITTGDWFLLWCTIIKHACXEDHETIFRFRGLAWLLLGLANSDSLLYDEEFTSYLKQYPDNFRFDKALSREQKNKSGGKMYVQDKIEEYSDEIFKLLDGGAHIYFCGLKGMMPGIQDTLKKVAEQRGESWDQKLSQLKKNKQWHVEVY

SEQ ID NO: 126331 - protein, 180 aa, Triticum aestivum
  Clone ID: PAT_TA_20749.pep
FRIYFSTLHTRKYPFLEASSKPIRCISRGRPSRPLSAAKRTSSATVDEIHLLNNGQGLDRDGKANACSLSQDQSSVACLHPSKFLKVEGDGTETHKMVSQSKQARKMVVEAQSVRTESTMSDSDSIDARSSWSGSDKDEAETLSDAMIFRYCLEGTYERSTFLKSAASSIIVDDLITLAN

SEQ ID NO: 126332 - protein, 86 aa, Triticum aestivum
  Clone ID: PAT_TA_20750.pep
MNLAKEKVKDAASAAKAKAKITQAKVAEKTEAATARSHDERELAHERGKAKVAAAEAELYQAKVTHREEAMEHRLHKRGHKHGGGH

SEQ ID NO: 126333 - protein, 238 aa, Triticum aestivum
  Clone ID: PAT_TA_20751.pep
PGAPPPAPPARRRRPPSRLPRRRRPEREGDRSTGKGRREPGADRRYSSRPRDVGGCGLGECGVNCSSSRRGGGDPCDRVYWLIWGFMLCAIWVYSYMALGLYLMFLHGAPWAPACIDEGGDREGARQGHRTRSARLVAYLEDCFMPVHGVIDSAWLFALWIVSLFFMHSVLVSDGIVVGWGVFLSYSQWTFFLVTLYFGLGSKHSHLENNTNASKFDKSFKRKCFYVTDQGRESVEDD

SEQ ID NO: 126334 - protein, 129 aa, Triticum aestivum
  Clone ID: PAT_TA_20752.pep
EANQLANKVAMGVGMGSRKKVIVSCAVLGLALLVVGAAAKDLSYCGEQSHVGLAAHGGTKGDEAKKEEEELGSLRCQWNVLDMKMKKKLRGSKRMPPSTRPSTTRCARQTIAAKSPAHLSSGAWTGKRY

SEQ ID NO: 126335 - protein, 184 aa, Triticum aestivum
  unsure (1)..(184): unsure at all Xaa locations
  Clone ID: PAT_TA_20753.pep
SYGGMVAFKLAEARXDLVRSLAVSGSVVAMTDAVNRETMERLGAGSSAELLMPETLQGLKALFSVSMYRKMWFPDRMYKDYLKAMFTNXRKERLELLQGLLDSNMDAKMPAFQQKIMLIWGEEDKLFXDIELAKKMKEQLGEXCYLQGIPKAGHLLHLEXRPCAYNRHSASSSPTQSQGNQAPI

SEQ ID NO: 126336 - protein, 217 aa, Triticum aestivum
  Clone ID: PAT_TA_20754.pep
AHGGYTFCGLAAMVLLNEVEKLDLPSLIGWVAFRQGVECGFQGRTNKLVDGCYSFWQGAAIALAQKLMAGSDEQSKQSQPSKLSSVDDSCGTSSSGLASEKSSVVDYAKIGFDFMKQSNQIGPLFHNIALQQYILLCAQVPEGGLRDKPGKNRDHYHSCYCLSGLSVSQYSAMTGSVSCPLPQHMLGPYSNLLEQIHPLYNVVLEKYEEAYEFFSSE

SEQ ID NO: 126337 - protein, 662 aa, Triticum aestivum
  Clone ID: PAT_TA_20755.pep
RCTPSSAVRQSKKSWQARHTGIKIVQQIAILMGCAVLPHLKNLVEIIEHGLSDENQKVRTITALSLAALAEAAAPYGIESFDSVLKPLWKGIRSHRGKVLAAFLKAIGFIIPLMDALYASYYTKEVMQVLIREFQSPDEEMKKIVLKVVKQCVSTEGVEADYIRSDILPDFFKHFWVRRMALDRRNYKQLVETTVEMANKVGVTGIVGKIVEDLKDESEPYRRMVMETIEKVVANLGASDIDPRLEELLIDGILYAFQEQTSDDANVMLNGFGAVVNALGQRVKPYLPQICGTIKWRLNNKSAKVRQQAADLISRIAIVMKQCQEEQLMGHLGVVLYEYLGEEYPEVLGSILGALKAIVNVIGMTKMTPPIKDLLPRLTPILKNRHEKVQENCIDLVGRIADRGAEFVPAREWMRICFELLEMLKAHKKGIRRATVNTFGYIAKAIGPQDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTAASAVKHMALGVAGLGCEDALVHLLNYIWPNIFETSPHVINAVMEAIEGMRVALGAAVVLNYCLQGLFHPARKVREVYWKIYNSLYIGAQDALVASYPALGDDGDNIFSRPELAMFV

SEQ ID NO: 126338 - protein, 265 aa, Triticum aestivum
  unsure (1)..(265): unsure at all Xaa locations
  Clone ID: PAT_TA_20756.pep
TLENGVFLTVKWLREGVARPKREFTKEAKKFANIRHPNVVGLRGYYWGPTPHEKLILSDYVSPGSLASFLYDRPGRRGPPLTWAQRLKIAVDVARGLNYLHFDRAMPHGNLKATNILLDGLDLNARIADYCLHRLMTQAGVVEQIVDLGXLGYRAPELAASKKPSPSFKSDVYAFGVALLELLTGRCAGDVITGSEGGVDLTDWVRLRVAEGQESECFDPAMASDSENQQGVKGMKEVLGIALRCIRPVSERPGIKSVYEDLSSI

SEQ ID NO: 126339 - protein, 96 aa, Triticum aestivum
  unsure (1)..(96): unsure at all Xaa locations
  Clone ID: PAT_TA_20757.pep
RIGYRAPGTRQNENPFLLIFSYLQSLISTKKSSKSPGRRERGEINKEIAKMKKGRQNCKEEEDSPSSXSAHTLLSSFRVQEAYCCCPQSSNRHNAR

SEQ ID NO: 126340 - protein, 711 aa, Triticum aestivum
  unsure (1)..(711): unsure at all Xaa locations
  Clone ID: PAT_TA_20758.pep
DMMSGEEDRXNILRSRATGKAVLTRPFRLMSNHLGVVLTFPVYLVDLPPDAKVEDRVAATAGYLGGAFDVESLVENLLRQLAGNQELVVNVYDVTNHSNPLVMYGSEVPLGAPSPSHTRILVFGDPFRNHHMICRYRSEPHVPWSAITTPSGVFVILMLIGYIIYAAWNRYDSVTEDCRKMEALKKRAEAADVAKSQFLATVSHEIRTPMNGVLGMLDMLLDTELKSTQRDFAQTAQICGKALISLINEVLDRAKIEAGKLELESVPFDLRSILDEVVSLFSSKSREKGIELAVYASERVPEILLGDPGRFRQIITNLVGNSIKFTERGHIFVQVHLADHSNLATEPKVESVANGINGHIDETSVVSTSVPHNTLSGFEAADSRNSWENFKXLLSYDTNXMAYGSDSGNVTLVVSVEDTGIGIPIHAQGRVFMPFMQADSSTSRNYGGTGIGLSISKCLVELMSGQINFVSRPNVGSTFTFTAVLQRCERNAINVSKSALLHPLPSSFQGLSTLLVDKRPVRATVTEYHLQRLGIASKSVHTIEQALSVLLGRNGTSLPRKQLSMLLVESDSWGLKMDVPLRTRFLEMKQNGCESVFPQVILLSLADSDKMKAEYGVHSVITKPLKASTLAACLFQSLGISITQANNEKKHHGPDSLYGLLLGKNILVVDDNKGNLRVAAGTLKKYGAKVECVESGXDALELLKSPQFDLC

SEQ ID NO: 126341 - protein, 96 aa, Triticum aestivum
  Clone ID: PAT_TA_20759.pep
SLKKTKTKHKTREGTGRVKPERTQTEDLGVEGGAHDLLMLEVYDHDTFSRDYMGRCILTLTKVLIEEGYTDSFPLQGAKAGKLKLHLEVVATIDHA

SEQ ID NO: 126342 - protein, 68 aa, Triticum aestivum
  Clone ID: PAT_TA_20760.pep
RGRGRGGGALRLHPPRHSRRRDQVRPQALPVPAPRPVLIDPRPRPSDREMQQSVVSVVVSYVIISKTC

SEQ ID NO: 126343 - protein, 120 aa, Triticum aestivum
  unsure (1)..(120): unsure at all Xaa locations
  Clone ID: PAT_TA_20761.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQXYQLIDITDDGYVXSLLTESGNTKDDLNSH

SEQ ID NO: 126344 - protein, 129 aa, Triticum aestivum
  Clone ID: PAT_TA_20762.pep
MAGDDEDEGEMAALREALRQQSLAVEMLKAELEEERQAASSGADEALAMILRLQGEKAAVRMEADQFRRVAEERILHDEDSLAFLKGVVFNQGDGHHLPQEPPAGRLPEQMVPTRRPPGPGGVIQPPPG

SEQ ID NO: 126345 - protein, 163 aa, Triticum aestivum
  Clone ID: PAT_TA_20763.pep
MAAAGDAGEKKMITLKSSDGEEFEVEEAVAMESQTIRHMIEDDCADNGIPLPNVNSKILSKVIEYCNKHVQAKPADGAAAAAGASDAAAPAAPAEDLKELGRPVLKVDKATSSTHPGANSLIIKGFWTNCMLPIKARPGGDRKTQHKNPPGGGSGKHGPKDTP

SEQ ID NO: 126346 - protein, 132 aa, Triticum aestivum
  Clone ID: PAT_TA_20764.pep
MAAVARAIVCEAAPQRVAPPSQQQQQQKQTRRDKILLQPRLSTLRSYGADGSGAVTRKRLPGEALEEGGVGGAPPFFASLADYIESSRKSQDFETISGRLAMVAFAAAVAVEATTGDSLFKKLDTVQIEEAT

SEQ ID NO: 126347 - protein, 131 aa, Triticum aestivum
  Clone ID: PAT_TA_20765.pep
MAAVARAIVCEAAPPFFASLADYIESSRKSQDFETISGRLAMVAFAAAVAVEATTGDSLFKKLDTVQIEEATGLCLAVVASAATFAWVSSARGRIGQMLTLGCNSFVDGLIDNVVDVLFSDDQMQDWSDDV

SEQ ID NO: 126348 - protein, 275 aa, Triticum aestivum
  Clone ID: PAT_TA_20766.pep
PWHPSLKKQGTTCSSDGTWKCSSISSIVSSCRTWRLCLVAVLYRHVYAVHLHHVRADRRRRTSPASGRRRRERFRPVSMTPPTKEWQPRVSICPILAARAGDPRERGPGGPHGEEQPRRLLDLHRDQLDAPGVPRRRPQRWHRRARHKGEAADDFPEALAPWGSHSVFVDNGRASHGRLRPRPPPSSKGPGREPPPRHRAAAVGPVSTGAWRGRGWSRILSRLVCCFCCDGGAALCGAASHTIAPGHRGRHGIPRTRRTDNHRRLCFDEPLGFLE

SEQ ID NO: 126349 - protein, 234 aa, Triticum aestivum
  Clone ID: PAT_TA_20767.pep
MIEQQFQHGLSGNPLVSLRQFIEDINISRLHRRGHNRGTNKLKGDLSSSNIGKSVAVKIIPSREPSLPLPSPAGARGRSLAEEAEDALLQLDVFRGRGHQGLETLPPRAPPRRRRRPRGTGAPARCGTRAPPCRRRPPSGGRRGGCASGGRAPSRGRTRPSRGRSRGRAFRRRRATGSRAPRRPWPAPRRPGWRRDRCAPAPRSLSRTAASCGRRRGPRPWTRAAPPRRRTPSS

SEQ ID NO: 126350 - protein, 117 aa, Triticum aestivum
  Clone ID: PAT_TA_20768.pep
MLLRPRPFLLQALTPLPFSRGPLAVRRTLSAHAAAAGAAPRGDAPAPARTRHKNSRKAEPPRVPTDTALFFPPGVDRDAAVAAEMLIPGSNIVVGPYAGDARVKEAEFIGCSAHARD

SEQ ID NO: 126351 - protein, 123 aa, Triticum aestivum
  Clone ID: PAT_TA_20769.pep
RTSVGRCLQPQPQTLEAGSFDFDIFLDFAADPVVTLCGHLYCWPCIYEWLRPSVVSASGANSTSARQQCPVCKAALSADSLVPLYGRGGSSKKSLDGTAIPRRPTVHRENVAHQHAQSSIDDD

SEQ ID NO: 126352 - protein, 158 aa, Triticum aestivum
  unsure (1)..(158): unsure at all Xaa locations
  Clone ID: PAT_TA_20770.pep
RLFERACLVVPEPTGPGNRFVRFLPGAPGALAYLGQLEFFIREAXPERMKSXSTGLFLVTLXLGFFLEQLXLSSSSHTVTRGAWIRNNLDRGRLDLFYWMLAVLGVVNFLVFVVIARRHEYKPSTSVVVAPAGEDNDTKEKEMDDVLVVNENTVGMDV

SEQ ID NO: 126353 - protein, 138 aa, Triticum aestivum
  unsure (1)..(138): unsure at all Xaa locations
  Clone ID: PAT_TA_20771.pep
XLVWGTIALYVRKEDPSPTELRRRSPSINMHTTVPLLFCFTVRISSAVPKCPTRPSPPLNLLLPPLRTVLHFCYYYCLRSLLATMSVHWVSSAVRETASLLAFVCFHIKTNLRMCAYCKPATESCFHFQTFFLFALPV

SEQ ID NO: 126354 - protein, 108 aa, Triticum aestivum
  Clone ID: PAT_TA_20772.pep
TFFKGTVVNAHKGCRWRTETVVTPDHVRGHGELHLKANKKCKIKFSELHEASLPLRGVAVHYSMSNAGLQYGVGLRRSGQPKILQKKSRAKEALLNCTRVGNVLPGHR

SEQ ID NO: 126355 - protein, 122 aa, Triticum aestivum
  Clone ID: PAT_TA_20773.pep
EQFIDETGIDALAVCIGNVHGKYPPSGPNLRLDLLKELRALTMKKGVSLVLHGASGLPHELVKECIDLGVRKFNVNTEVRNSYLQSLKKPEKDLVQVMESAKEAMKAVVAEKMRLFGSAGKA

SEQ ID NO: 126356 - protein, 775 aa, Triticum aestivum
  unsure (1)..(775): unsure at all Xaa locations
  Clone ID: PAT_TA_20774.pep
DDGAVVKVYVTLSGLKVEGRPPMLNQEDVLRSLPAEWPEVPMDDLVSSASRDSKKVLLVFADDPTGXQTVHDMEVLTEWPVEALTEQFLQLPTCCFNLTTHRSFLPVKPARLVXVVYANLEETAKPGPCPGCTRVLRGVSTLRAQLTGVSMKLVLMHYHMDAWIICPFFLPGGRYTVDDIHYVADSERLIPAGETEFAKDAAFGYTSSNLKQWVEEKTKGRILENQVSSISISLLRKETPDAVCQLLCSLEKGSVCIVNAASERDMNVFAAGMIQAELQGKRFLCRTAASFVSARIGIKPKPPIRPNDLGLKRNLAGGLIVVGSYVPKTTKQVDELRSQCAQSLRVIEVSVEMISLKSTEERDQEISRIVELGNAYIQSGRDTLVVTSRQLITGKTPEESLEINYKVSSALVEIVQRIDSRPRYILAKGGITSSDLATKALEARRAKVMGQALAGVPLWQLGPESRHPGVPYIVFPGNVGDNSALAEVVQNWACPSRSSTKELLLNAEKSGYAVGAFNVYNLEGIEAVIAAAEAEESPAILQVHPSSLKQGGVPLVACCIAAAERASVPITVHYDHGADKHDLLGALEMGFDSVMVDGSHLTLEKNILYTKNISSLAHAKGMLVEAELGRLSGTEDGLTVEEYEARFTDIAQAEQFIDETGIDALAVCIGNVHGKYPPSGPNLRLDLLKELRALTMKKGVSLVLHGASGLPHELVKECIDLGVRKFNVNTEVRNSYLQSLKKPEKDLVQVMESAKEAMKVVVAEKMRLFGSAGKA

SEQ ID NO: 126357 - protein, 209 aa, Triticum aestivum
  unsure (1)..(209): unsure at all Xaa locations
  Clone ID: PAT_TA_20775.pep
FERPPGQVPLHGNVKIYSSKELKRATRNFCSGNKLGQGSFGCVYLGKLKNGQKVAIKVLSSESKQGTREFLNELSVISSITHHNLVKLHGCCVDGGQKMLVYLGRDHASXHEPPWEYHSXXRFDWSTKAKXCNCVPXGSISHEESXTYLHVHQXDNICXTKDLAQNIFGYKLSREHSHKVQDRIWTDNNYKINFGSALCNEGPCQLKTV

SEQ ID NO: 126358 - protein, 76 aa, Triticum aestivum
  unsure (1)..(76): unsure at all Xaa locations
  Clone ID: PAT_TA_20776.pep
ALLWSPGCRIRTRDLDGYKGLPLQEGVDXCVKERXTRLAGLIAVSGTGEVXYGFNCTGMFRGCATEDGFMEVRIWE

SEQ ID NO: 126359 - protein, 460 aa, Triticum aestivum
  Clone ID: PAT_TA_20777.pep
GRVGAAPAPAVAAAAWGSSRRAAGPSSTRVALSAARGRGRLSPVVGTGRPALSVRCNASSRDGRITQQEFTEMAWQSIVLAPEVAKESKHQIVETEHLMKSLLEQRNGLARRIFSKAGVDNTRLLDATEKFIQRQPKVLGEDPGSMLGRDLEALIQRARNFKKEYGDSFVSVEHIVLGFADDKRFGRQLFKDFQITVEALKTAIESIRGKQNVIDQDPEGKYEALDKYGKDLTAMARQGKLDPVIGRDDEIRRCIQILSRRTKNNPVLIGEPGVGKTAIAEGLAQRIVQGDVPQALTNRRLITLDMGALIAGAKYRGEFEDRLKAVLKEVTDSDGQVVLFIDEIHTVVGAGATSGAMDAGNLLKPMLGRGELRCIGATTLDEYRKYIEKDPALERRFQQVYVDQPTVEDTVSILRGLRERYELHHGVRISDSALVAAALLSDRYISGRFLPDKAIDLVDE

SEQ ID NO: 126360 - protein, 134 aa, Triticum aestivum
  unsure (1)..(134): unsure at all Xaa locations
  Clone ID: PAT_TA_20778.pep
SAFRPVVVLADDGPDNVAGATVGTALAIALRSGLSSCIPSLVPSLLGPWRWCLRFCLYVCTYGSISMRVKMFAEWFRGQHLDGYLDGYLAGDFVFHPMGLDNVQRNKEREMEHWIYHWLCATLXLPAVLLPQAL

SEQ ID NO: 126361 - protein, 144 aa, Triticum aestivum
  Clone ID: PAT_TA_20779.pep
MAPKAAEKKPVATAEKTTAGKKPKAEKRAPASKEAGGEGKTRGRKKGSKAKKSVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 126362 - protein, 144 aa, Triticum aestivum
  Clone ID: PAT_TA_20780.pep
MAPKAAEKKPVATAEKATAGKKPKAEKRAPASKEAGGEGKTRGRKKGSKAKKGVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 126363 - protein, 153 aa, Triticum aestivum
  Clone ID: PAT_TA_20781.pep
MLPLLLISTLPAFTLLLVAPASCKPWKLVRELGLVALLLARELLRHSASAAAGAGRKEQQGARMPPSKPKTPPPALAEGDADALPVLDLPELALERVLEELSPASLAAMACVCAGLRDRCSMDGLWARHVRRKWGRVLGAAARREWQAELAAR

SEQ ID NO: 126364 - protein, 294 aa, Triticum aestivum
  unsure (1)..(294): unsure at all Xaa locations
  Clone ID: PAT_TA_20782.pep
MRELVSSSSSSAALVAAGNAALRGWWEEVNESPAWQDGAFFSLTAAYALVSAVALIQLVRIQRRVPEFGWTTQKVFHLMNFVVNGVRAVVFGFHAYVFLLQTKVYKLVLLDLPGLLFFSAYTLLVLFWAEIYHQARSLPTDKLRIIYLAVNSIVYAIQICIWVYLGINDNALVELVSKIFIVSVSAVALLGFPVYGGRLFVFLTGFPXIESKGGKKKLYEVGLVRTICCPCFLIKCIVVAVSAFDADVSLEVLDPPPLDFFYXMLTKIPPPAGALFPLGKLPPKRVWAQNPPIK

SEQ ID NO: 126365 - protein, 307 aa, Triticum aestivum
  unsure (1)..(307): unsure at all Xaa locations
  Clone ID: PAT_TA_20783.pep
GSWSPPPASRQTTSQRASCPSGDRWEEVNESPAWQDGAFFSLTAAYALVSAVALIHLVRIQXRVPEFGWTTXKVFHLMNFVVNGVRAVVFGFHAYVFLLQTKVYKLVLLDLPGSLLYSVYTXLFFPGPVVLLRLHLTCSFLGQELYHQARSLPTDKLRIIYLAVNSIVYAIQICIWVYLGINDNALVELVSKIFIVSVSAVALLGFAVYGGRLFVLLRRFPIESKGRKKKLYEVGTVTTICCTCFLIRCIVVAVSAFDADVSLEVLDHPILDFFYYMLTEILPSALVLFILRKLPPKRVSAQYHPIN

SEQ ID NO: 126366 - protein, 126 aa, Triticum aestivum
  unsure (1)..(126): unsure at all Xaa locations
  Clone ID: PAT_TA_20784.pep
RDYRRLGDKWHRVERSSGKFVRRFRLPEDAKVEEVKAGLENGVLTVTVPKAQVKKPEVKAIQISGXVDASRRMIIRXEPVWLMCVRGLQPESXYSCVLFLASLVRHLCSAFLSPVTCVIANRFGDE

SEQ ID NO: 126367 - protein, 42 aa, Triticum aestivum
  Clone ID: PAT_TA_20785.pep
SNKRFHLEFAMDNTTTLETVDGGVQAHATRPCASKFELRQED

SEQ ID NO: 126368 - protein, 152 aa, Triticum aestivum
  unsure (1)..(152): unsure at all Xaa locations
  Clone ID: PAT_TA_20786.pep
MSIVRRSNVFDPFADLWAXDPFDTFRSIIPAISGNNSETAAFANARMDWKETPEAHVFKADLPGVKKEEVKVEVEDGNVLVVSGERTKEKEDKNDKWHRVERSSGKFVRRFRLPEDAKVEEVKAGLENGVLTVTVPKAEVKKPEVKAIEISG

SEQ ID NO: 126369 - protein, 180 aa, Triticum aestivum
  unsure (1)..(180): unsure at all Xaa locations
  Clone ID: PAT_TA_20787.pep
MADEQVAKPASLPPYPEMILAAIAALNDKNGSNKSAISKHIEGKYGDLPKEHAALLTAHLVRMKESGQLLFLKNNYFRTDAPDAPPKRCRGRPRKXIDPNAPXKPVSPRPRGRPVKPKDPEAEAVNPSRKAKTVPGLATVRQARAGLFAQAPPANRGGLTRSPSTWGRFGFFWYTRGWVG

SEQ ID NO: 126370 - protein, 127 aa, Triticum aestivum
  Clone ID: PAT_TA_20788.pep
MFLAKSKEVMQYQVMEGRKDMQESDAAPVVQVPREPAIVINGVPNFPPDFASGSQLAVRDAPRSRVDHRFGEWLVERKVRKWFGDKYYAGNVVWYDSVNNWYTVVYEDGDQEDLEWHELEEILLPLD

SEQ ID NO: 126371 - protein, 151 aa, Triticum aestivum
  Clone ID: PAT_TA_20789.pep
MSIVRRTNVFDPFADLWADPFDTFRSIVPAISGGGSETAAFANARMDWKETPEAHVFKADLPGVKKEEVKVEVEDGNVLVVSGERTKEKEDKNDKWHRVERSSGKFVRRFRLLEDAKVEEVKAGLENGVLTVTVPKAEVKKPEVKAIQISG

SEQ ID NO: 126372 - protein, 161 aa, Triticum aestivum
  Clone ID: PAT_TA_20790.pep
MAAEEAAKPATLPSYPEMILAAIAALNDKNGSNKSAISKHIEGKYGDLPKEHAALLTAHLVRMKETGQLLFLKNNYFRTDAPDAPPKRGRGRPRKPIDPNAPPKPASPRPRGRPIKPKDPEAEAANPPKKAKTAPTPAVDGSAKRGRGRPPKARPAEPAAA

SEQ ID NO: 126373 - protein, 154 aa, Triticum aestivum
  Clone ID: PAT_TA_20791.pep
MSMVRRSNVFDPFADLWADPFDTFRSIVPAMISGNNNNDETAAFANARVDWKETPEAHVFKADLPGVKKEEVKVEVEDGNVLVVSGERTKEEEDKNDKWHRVERSSGKFVRRFRLPEDAKVEEVKAGLENGVLTVTVPKAEVKKPEVKAIEITG

SEQ ID NO: 126374 - protein, 342 aa, Triticum aestivum
  unsure (1)..(342): unsure at all Xaa locations
  Clone ID: PAT_TA_20792.pep
SVTSRRSPPPTRFPRSARIFRRKLSPSLCRRTPPPPPLCRASRQDADALPLQRRPLQTCLCLVTGGLFVVKSKELVQYQVMEGSKDMQESDTEPVVQVPREPAIIINGLPDLPPEFASGSQLAVRDAPRSRVDHRFGEWLEERKVRKRFGDIYYVGKVVKYDSQRNWYTVVYQDGDQEDLEXWHQLEEILLPLDITIPLKTLVMDKFKHQNGVPNYRTKVARPRSNVASNQMVVRAVNGQQSNNLPLPGLVQASTSAGENALVCLKPSDQPKKRGRPRKDGTASGELSKQRSTSGDIQPKKRGRPPKEPGEKSIDRRKLETVRAEKLKRESMLLRGPPPGSQ

SEQ ID NO: 126375 - protein, 259 aa, Triticum aestivum
  unsure (1)..(259): unsure at all Xaa locations
  Clone ID: PAT_TA_20793.pep
MASSALRRSLXRRLLTSDPSSAAASFFRRSFLSGEGAGESADDFEKRLFESDDKVILREARWGWELLWKTRHGLWNGNGGFMDGFDSLNDGMNEKLDDAARTFHMTEEVEDDDYDFRPDVNYKRGSTYNVRDLDLTRPAAPRNPPRPQFETSTKEVLRKADFRNVRFLSNFLTEAGIIIKRSQTKISAKAQRKVAREIKTARALGLMPFTTMGKKPFMFGRSAEEDASEEEYGYDFVEKDAGPEDAVADADAVPDVETA

SEQ ID NO: 126376 - protein, 423 aa, Triticum aestivum
  unsure (1)..(423): unsure at all Xaa locations
  Clone ID: PAT_TA_20794.pep
MADPGGSQRAALLAVASLFPVPAGAXFSYGTAGFRADGSTMAPAVCRAGIVAALRSLKLGGAAVGLVITASHNPVGDNGVKIVDADGGMMSQAWEPFSDALANAPTPNTLLQLVIQFAKDEGITLGGGHSAQVLLARDTRPTGEYLLDVATKGISAIVGSVALDMGILTTPQLHWMVRNKNRGLKASEADYFTQITESFRHLLELTPDDKGIDELNEKLIVDGANGIGGLKLEQIKPNLARLNILVRNSGKEGEGILNERCGADFVQKEKVLPLGFGPNDVGVRCASFDGDADRLVYFHVTSPSKTSVDLVDGDKILSLFVLFIREQLDIINGEDNKGLLPTRFGVVQTAYANGASTEFLKNLGLEVVFTSTGVKYLHKKALEYDIGVYFEANGHGTVLFNDEFVSRLAKSVAQHVERILGFC

SEQ ID NO: 126377 - protein, 333 aa, Triticum aestivum
  unsure (1)..(333): unsure at all Xaa locations
  Clone ID: PAT_TA_20795.pep
GIRHEADLGFVRPCELRPRSPRSTQSRAYQPPPRAVRAQASSQRHLLPPPPPPSTRLFLAKSKELVQYQVMEGSKNMQESDTASVVKVPREPAIIINGVPDLPPDFASGSQPAVRDAPGSRVDHRFGEWLEGRKVRKQFGDKYFAGKVVKYDSESNWYSVVYDDGDQEDLEWLELEEILLPLDITIPLRKLVMDKFKHQNAVPDYRLKGARXRKELMVLATKMVVRAVNGQQSNNLPQPGLLQATPSNAETVRAEKLKMQISKRKTEEVYQPKKRGRPRKDRTISVSGDIQPKKRGRPPKEKNISGESSVHKRNAETVRAEKLKRESLRVQGA

SEQ ID NO: 126378 - protein, 175 aa, Triticum aestivum
  Clone ID: PAT_TA_20796.pep
TSPPFPLLVPAASPWADERVAKPASLPPYPEMILAAIAALNDKNGSNKSAISKHIEGKYGDLPIEHAALLTGRLVRMKESGQLLFLKNNYFRTDAPDAPPKRGRGRPRKPIDPNAPPKPASPRPRGRPVKPKDPEAEAANPPKKAKTAPAPAVDGSAKRGRGRPPKARPAEPAAA

SEQ ID NO: 126379 - protein, 151 aa, Triticum aestivum
  Clone ID: PAT_TA_20797.pep
MSIVRRSNVFDPFADLWADPFDTFRSIVPAISGGSSETAAFANARVDWKETPEAHVFKADLPGVKKEEVKVEVEDGNVLVVSGERTKEEEDKNDKWHRVERSSGKFVRRFRLPEDAKVEEVKAGLENGVLTVTVPKAEVKKPEVKAIQISG

SEQ ID NO: 126380 - protein, 151 aa, Triticum aestivum
  Clone ID: PAT_TA_20798.pep
MSIVRWSNVFDPFADLWADPFDTFRSIVPAISGGTSETAAFANARVDWKETPEAHVFKADLPGVKKEEVKVEVEDGNVLVVSGERTKEKEDKNDKWHRVERSSGKFVRRFRLPEDAKVEEVKAGLENGVLTVTVPKAEVKKPEVKAIEISG

SEQ ID NO: 126381 - protein, 222 aa, Triticum aestivum
  Clone ID: PAT_TA_20799.pep
RIIAYRFGVVQTAYANGASTEFLKNIGLEVVFTSTGVKYLHKKALEYDIGVYFEANGHGTVLFNDEFVSRLESLTARLSEAAGSPQHQAALRLVATSQLINQAVGDAISGMLLVEAVLQHKRWSFQNWCDLYTDLPSKQLKVKVKDRTSIVTTDAERKVCQPSGLQELIDKEVVNYSHGRCFVRPSGTEDVVRVYAEASTVEAADSLAKSVAHHVERILGFC

SEQ ID NO: 126382 - protein, 270 aa, Triticum aestivum
  unsure (1)..(270): unsure at all Xaa locations
  Clone ID: PAT_TA_20800.pep
MFLAKSKESMQYQVMEGRKGMQESDTAPVVQVPREPAIVINGVPDFPPDFASGSQLAVRDAPRSGVDHRFGEWLVERKVRKWFGDKYYAGQVVRYDSGNNWYTVVYEDGDQEDLEWHELEEILLPLDITIPLNTLVMDKFNHQNIAPDYRTNVASNQMVVRAVNRQQSNNLPLPGWLQASASAGENALVCLKPSDQPKKRGRPRKDRSTSGDIQPVRKTTGDIQPKXRGRPPKEPGEKSIDRRKLETVRAEKLKRESMLLRGPPPGSQSF

SEQ ID NO: 126383 - protein, 284 aa, Triticum aestivum
  Clone ID: PAT_TA_20801.pep
MASSALRRSLPRRGSLRRLLPSHPPPAATSSFRRSFQSEEGAAGESTEDFEKRMFGNQREPDANSFFGKLDGVGSSFGGRHGTGSGMGAFSQQGGMGNLFGERSVHGIMDGFDSLNDGMNEKLDDAARTFHMTDEVEDDDYDFRPDVNYRRGSTYNVRDLDLTKPAAPRNPPRPQFETSTKEVLRKADFRNVRFLANFITEAGIIIKRNQTKISAKAQRKVAREIKTARALGLMPFTTMGKRPFIFGRSAEEDASEEEYGYDFVQKDAGPEDTAGDAVPDVETA

SEQ ID NO: 126384 - protein, 258 aa, Triticum aestivum
  unsure (1)..(258): unsure at all Xaa locations
  Clone ID: PAT_TA_20802.pep
MQESDTAPVVQVPREPAIVINGVPDFPPDFASGSQLAVRDAPRSRADHRFGEWLVERKVRKWFGDKYYAGIVVRYDSGNNWYTVVYEDGDQEDLEWHELEEILLPLDITIPLNTLVMDKFKHQNVVPDYRTNVASNQMVVRAVNGQQSNNLPLPGWLQASASAGENALVCLKPSDQPKKRGRPRKDRSASGDIQPKKRGRPRKDISTSGDIQPKKKRQTSKRTWREEYXRSKLETVRAEKLKRESMLLRGPPPGSQSF

SEQ ID NO: 126385 - protein, 453 aa, Triticum aestivum
  unsure (1)..(453): unsure at all Xaa locations
  Clone ID: PAT_TA_20803.pep
AHVTCDFPRLISCPSDKFMALLGPNFGFMQPTYPDLLASAPGVTGILMIIIMTFSFTLAMHTFRRSVVKLPSPLHHLAGFNAFWYAHHLLLLVYVLLVVHSYFIFLTRIWYKKTTWMFLIVPVLFYACERIIRKVRENNYHVNILKAGIYPXNVLSLHMKKPPGFKYKSGMYLFVKCPDVSPFEWHPFSITSAPGDDYLSVHIRTLGDWTSELKNLFGKCFEAQVTSKKATLSRLETTVVADSATEDTRFPKVFIDGPYGAPAQNYKKYDILLLIGLGIGATPFISILKDLLNNIKSNDEVESIHGSEIGSFKNSGPGRAYFYWVTREQGSFDWFKGVMNEVADNDHSDVIEMHNYLTSVYEEGDARSALIAMVQSLQHAKNGVDIVSGSKIRTHFARPNWRKVFSDLANAHKNSRIGVFYCGSPTLTKQLKDLSKEFSQTTTTRFHFHKENF

SEQ ID NO: 126386 - protein, 151 aa, Triticum aestivum
  Clone ID: PAT_TA_20804.pep
MSIVRRSNVFDPFADLWADPFDTFRSIVPAISGGNSETAAFANARVDWKETPEAHVFKADLPGVKKEEVKVEVEDGNVLVVSGERTKEKEDKNDKWHRMERSSGKFVRRFRLPEDAKVEEVKAGLENGVLTVTVPKAEVKKPEVKAIEISG

SEQ ID NO: 126387 - protein, 151 aa, Triticum aestivum
  Clone ID: PAT_TA_20805.pep
MSIVRRSNVFDPFADLWADPFDTFRSIVPAISGGSSETAAFANARVDWKETPEAHVFKVDLPGVKKEEVKVEVEDGNVLVVSGERSREKEDKNDKWHRVERSSGKFVRRFRLPEDAKVEEVKAGLENGVLTVTVPKAEVKKPEVKAIEISG

SEQ ID NO: 126388 - protein, 284 aa, Triticum aestivum
  unsure (1)..(284): unsure at all Xaa locations
  Clone ID: PAT_TA_20806.pep
MASSALRRSLPRRLLTSDPXPPQPPCSAAPSCPNQNIESDGGRRDLGEGAGESADDFEKRLFESDDKSFFEKLDGVGSSFGRHGTGSGMGAFGRPEFGQRSSNGGFMDGFDSLNDGMNEKLDDAARTFHMTEEVEDDDYDFRPDVNYRRGSTYNVRDLDLTRPAAPRNPPRPQFETSTKEVLRKADFRNVRFLSNFLTEAGIIIKRNQTKISAKAQRKVAREIKTARALGLMPFTTMGKKPFMFGRSAEEDASEEEYGYDFVEKDAGPEDAVADADAVPDVEAA

SEQ ID NO: 126389 - protein, 269 aa, Triticum aestivum
  Clone ID: PAT_TA_20807.pep
MASSALRRSLPRRLLTSDPSSAAASLFRRSFLSGEGAGESADDFEKRLFESDDKSFFGKLDGIGSSFGRHGTGSGMGAFGRPEFGQGSSNGGFMDGFDSLNDGMNEKLDDAARTFHMTEEVDDDDYDFRPDVNYRRGSTYNVRDLDLTRPAAPRNPPRPQFETSTKEVLRKADFRNVRFLSNFLTEAGIIIKRSQTKISAKAQRKVAREIKTARALGLMPFTTMGKRPFMFGRSAEEDASEEEYGYDFVEKDAGPEDAVADAVPDVETV

SEQ ID NO: 126390 - protein, 158 aa, Triticum aestivum
  unsure (1)..(158): unsure at all Xaa locations
  Clone ID: PAT_TA_20808.pep
MSIVRRSNVFDPFADLWADPFDTFRSIVPAISGGSSETAAFANARMDWXKETPEAHVFKADLPRRXKKEEVKVEVEDGNVLVVSGERTKEKEDKNDKLGNRRGSRSSGQVXSRRFPAAREDAKVEEVKAXGLENGVLTVTVPKAEVKKPEVKAIQISG

SEQ ID NO: 126391 - protein, 106 aa, Triticum aestivum
  Clone ID: PAT_TA_20809.pep
MASLTMMASLSAAVAVDRRAAAPRRGLVVARAAKVESQQEPAAKMAAVEPATDGRRAVVFAAAAAALSAIGGVAFAESDVKKGSPEAKKKYAPVCITMPTAKICHN

SEQ ID NO: 126392 - protein, 151 aa, Triticum aestivum
  Clone ID: PAT_TA_20810.pep
MSIVRRSSVFDPFADLWADPFDTFRSIIPAISGGNSETAAFANARMDWKETPEAHVFKADLPGVKKEEVKVEVEDGNVLVVSGERTKEKEDKNDKWHRVERSSGKFVRRFRLPEDAKVEEVKAGLENGVLTVTVPKAQVKKPEVKAIQISG

SEQ ID NO: 126393 - protein, 154 aa, Triticum aestivum
  unsure (1)..(154): unsure at all Xaa locations
  Clone ID: PAT_TA_20811.pep
MSIVRRSNVFDPFADLWADPFDTFRSIVPAISGGSSETAAFANARVDWKETXPEAHVFKADLPGVKKEEVKVEVEDGNVLVVSGERTKEEEDKNDKWHRVEXRSSGKFVRRFRLPEXDAKVGEVKAGLENGVLTVTVPKAEVKKPEVKAIEISV

SEQ ID NO: 126394 - protein, 100 aa, Triticum aestivum
  Clone ID: PAT_TA_20812.pep
WRPSPRPWRSTGARQPRAAGLVVARAAKVESQQEPAAKMAAVEPATDGRRAVVFAAAAAALSAIGGVAFAESDVKKGSPEAKKKYAPVCITMPTAKICHN

SEQ ID NO: 126395 - protein, 258 aa, Triticum aestivum
  Clone ID: PAT_TA_20813.pep
MAPKRGGKAPVPAKKKTDKVTNPLFEKRPKQFGIGGALPPKKDLHRFVKWPKVVRIQRQRRILKQRLKVPPALHQFTRTLDKNLATNLFKMLLKYRPEDKAAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 126396 - protein, 152 aa, Triticum aestivum
  Clone ID: PAT_TA_20814.pep
MSIVRRSNVFDPFADLWADPFDTFRSIVPAISGGSSSETAAFANARMDWKETPEAHVFKADLPGVKKEEVKVEVEDGNVLVVSGERTKEKEDKNDKWHRVERSSGKFVRRFRLPEDAKVEEVKAGLENGVLTVTVPKTEVKKPEVKAIEISG

SEQ ID NO: 126397 - protein, 258 aa, Triticum aestivum
  Clone ID: PAT_TA_20815.pep
MAPKRGGKAPVPAKKKTEKVTNPLFEKRPKQFGIGGALPPKKDLHRFVKWPKVVRIQRQRRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 126398 - protein, 106 aa, Triticum aestivum
  Clone ID: PAT_TA_20816.pep
MASLTMMASLSAAVAVDRRAAAPRRGLVVARAAKVEGQQEPAAKMAAVEPATDGRRAVVFAAAAAALSAIGGVAFAESDVKKGSPEAKKKYAPVCITMPTAKICHN

SEQ ID NO: 126399 - protein, 259 aa, Triticum aestivum
  unsure (1)..(259): unsure at all Xaa locations
  Clone ID: PAT_TA_20817.pep
MAPKRGGKAPVPAKKKTEKVTNPLFEKRTKQFGIGGALPPKKDLHRFVKWPKVVRIQRQRRILKQRLKXVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAQRMN

SEQ ID NO: 126400 - protein, 373 aa, Triticum aestivum
  Clone ID: PAT_TA_20818.pep
HGHDQSPQLTGGCCNGVHEDLRAAGARHARALLAHRRARVLPRLRVRQRHPVERHALRPAASAYPRSSAVSLAPSLPIIGGAAPTVGGVVGKVTPVVGGVVGKVTPVAGGAVPTVGGVVGKVTPVVGGMVPTVGGVVGKVTPVVGGAVPAVGGVVSPVVGTVGGAVPAVGGVVSPVVGTVGGAVGGVPAVGGVVTPVISPAIGVVTPIIGGSPSPKSRHGGRKACPPRPPNPHPVSPNPGADSPDAHAEPHALLRHVPDRHAEAGRVPGPARQRAAHRRRQRQVLPAGAGHRRAHRRGLPLHRHQGQGAQPRPLRAARPPAARQRLRAAPCPRATPAPDPSVHSTSDAHNLSRKFEIKVVVRSMKPLASCLFI

SEQ ID NO: 126401 - protein, 209 aa, Triticum aestivum
  unsure (1)..(209): unsure at all Xaa locations
  Clone ID: PAT_TA_20819.pep
TRPVSVELPHAIYSSSCQGSSTRTARRTSSSRFEQSPPQTFRSLARERGGHRRINMEGIAEVLLVLERIEQEAELTYEQLRVLETNLLLGAFASHDQHSDMRMDIDNMSYEELLALEERIGYVSTALSEEQFAKCIRRRLYRPVAAKGNSSAIDDIKCSICXEGARESEEXASSVAQYKCHQWSLQKTGAHPTQRCLERTTDQTVNNYK

SEQ ID NO: 126402 - protein, 111 aa, Triticum aestivum
  unsure (1)..(111): unsure at all Xaa locations
  Clone ID: PAT_TA_20820.pep
MATEAASHISGGSESTTVALLEQLTEVFGKLKSHTEASLQLQSGIQWEDIKVHFLNLEKSYRSKCDELEGKQKALEEQKAGSRRLIAEKEADLSAKERASVNKLXELKDAA

SEQ ID NO: 126403 - protein, 179 aa, Triticum aestivum
  Clone ID: PAT_TA_20821.pep
LIPASELSQHISTAGMRAGATSNMKFAMNGCILIGTLDGANVEIREEVGEENFFLFGAHAPEIAGLRQERAEGKFVPDPRFEEVKEYVRSGIFGTGNYDELMGSLEGNEGYGRADYFLVGKDFPSYIECQEKVDEAYRDQKLWTRMSILNTAGSPKFSSDRTIHEYAKDIWGISPVIMP

SEQ ID NO: 126404 - protein, 287 aa, Triticum aestivum
  Clone ID: PAT_TA_20822.pep
MDGSIMGMGGNKVNYGGLYNIQGWGAPYFTVNMEGNLCVKADGQETKAGQEMDVLHVIQAAKQKRKDIQFPMILRFPNVLKHRLDALHAAFHTAISRARYTNTYQGVFPVKVNQNRAIVHDLVCFGHAYSYGLEAGSKPELLIAMSCLTKEANSRAFLVCNGYKDAEYVRLALSARAIGLNAIMVLDMEEELDIIIHQSSKLGVEPVIGVRAKLLTKIPGHYGSTAGKHGKFGLPADRIYEVAKKLKGLNKLHWLKLLHFHVGSMIPTTELVAKAATEAADIYCTLV

SEQ ID NO: 126405 - protein, 64 aa, Triticum aestivum
  Clone ID: PAT_TA_20823.pep
MGRILLLCAFLLVLLSVASLMEVTEGRGRGGSRGGGSGSPRGLSGGTWVACVGSSLLAAAAMLL

SEQ ID NO: 126406 - protein, 111 aa, Triticum aestivum
  unsure (1)..(111): unsure at all Xaa locations
  Clone ID: PAT_TA_20824.pep
VQAIPGTNTTHLSQQVQPIQRTNPFSGTVKKSAPQRSLSAPIASQGQQGQLAASSQAASNVVHGVGPQLSRCTSLMNESRQFLPEPVIDVSTQSWXQDILASVASDLGSIR

SEQ ID NO: 126407 - protein, 72 aa, Triticum aestivum
  unsure (1)..(72): unsure at all Xaa locations
  Clone ID: PAT_TA_20825.pep
FFFWRQRLSILNVVNFSTXDXYISSFHERGHPFNMKQLQTCTLLNVALNPWQCSYKLLPSEMRSGSSHKREK

SEQ ID NO: 126408 - protein, 291 aa, Triticum aestivum
  unsure (1)..(291): unsure at all Xaa locations
  Clone ID: PAT_TA_20826.pep
MTPLHAAPPPLSASAAVSSSAPPPLLAKAYHPKAAALCSLTVTAATPSRKAFLACPDHGPAGGRSLTPARGAPASSPALISAVKDLYEFICSGPLVDRIGYTREKIAESIDRWLWCGSQVSRLFRIDELRLTDAEKSRIYHFYIPVFLWCEDQVADHRSKYNDGDEIQPLVIGVSAPQGSGKTPHGFALVHLFRVSGRNSEEFCIDDFRLTLADQGELGXTHAKHALGKCSFKSFVENAXNHXXPNFXLTHXEXHLXKLTKXEXPXMKXXRXDKSXFXGKGXRXXPXXWXE

SEQ ID NO: 126409 - protein, 270 aa, Triticum aestivum
  Clone ID: PAT_TA_20827.pep
MVLCQGLSAGQGQLLAFPAAKPPLLRRSCIRIPAGSPGLKSARLSSKRKKLSVQAVRAGTGFLHHDMLTSSLMEGSIKGIPSLLTRQNQRRRSEVGCRASSLASFSYPELTSKPRWWWRTLACVPYLLPLHNMWSYADVIYQLHTYLQGFSLVYTFIDTMTLLPGWRLLVIFMTVYFFVVRRKWSPHFMRFHVILAILLDTGSQAVATMCTWMPSFVYQGKPMQYFWMAVAFMQIFTVLECMRCALCGMYPNVPFISHTAFIHSDLNLFR

SEQ ID NO: 126410 - protein, 268 aa, Triticum aestivum
  unsure (1)..(268): unsure at all Xaa locations
  Clone ID: PAT_TA_20828.pep
IGADRTASIETLMNHLQETALNHVKVVGLLGDGFGSTPEMSKRNLFWVVSQMQAIVERYPCWGDTVEVNTWVGHHGKNGMRRDWHIRDSVTGLTVLKATSKWVMMNKVTRRLARIPDEVRTEIEPFFSEYAAIDDQDNRKFPKLPEHDRATSAKYVRTGLTPRWADLDINQHVNNVKYIGWILESAPISILENHGLASIVLDCKRECRRNSVLESXTTVHTDCADESGETTLHCEHLLSLESGPTIVKARTMWRPKGAKSQETAALSW

SEQ ID NO: 126411 - protein, 136 aa, Triticum aestivum
  unsure (1)..(136): unsure at all Xaa locations
  Clone ID: PAT_TA_20829.pep
MASGIQVGDEVVQAFNDVKNGKPKLRYATFVFNDSNTEVVVQSKHSEGTWQEFVSSLNAKQGCYAVFDYDCEVEAGRSTSRILFITWAPDGGPIKXKMLLSATKAELKKKFVGIQVEVQATDLSELDPSQFSAKLK

SEQ ID NO: 126412 - protein, 128 aa, Triticum aestivum
  Clone ID: PAT_TA_20830.pep
PNTKPPNPVVSKFHFAPAACSNSNKKLLLEEMEGDEIFASLDSLWFHSSVLHRRPRFKQHSEELKPPRNQDQASQMRRRRGDAGSEKSGSGKQGASKSASRHGKRSSGGGRSSSPHRHGARPSAMVWP

SEQ ID NO: 126413 - protein, 63 aa, Triticum aestivum
  Clone ID: PAT_TA_20831.pep
SVWCIAPPHLIDSSQHFVTHRVLSIQSLVLTAHTLAVLSIDPVTRNLAGELLLYIKRGESLFW

SEQ ID NO: 126414 - protein, 204 aa, Triticum aestivum
  unsure (1)..(204): unsure at all Xaa locations
  Clone ID: PAT_TA_20832.pep
MASNGDNKRLFRVRRTVLQMLGDRGYSVKDEEIKLSLHEFVERYGDPVRRDEIVIHCEKQGDPNDKVNVFFLDESKTGLAVVRSCVEKMKLGNATNGILVLQKALSGPARTEVAQSKKYHLEVFQEGELLVNITEHHLVPKHELLSDEEKKELLQKYTAHETQLPRIQLTDPVARYYGMKRGQVIKITRQSEVAGXYVTYRYVI

SEQ ID NO: 126415 - protein, 148 aa, Triticum aestivum
  Clone ID: PAT_TA_20833.pep
PRVETTGSKMLKPVHSAPHPLAGEMVPLTLFDRAAMDIFVSLILVYPAPTPSNEALVEGLRRAVAPYPHLAGRLAVDHSGRRSIYLNNDGVLVLDTEVPVDMASVVADGCFTAATEGLYPALPPPEENVGAALLQIKLNRYKCGGLVI

SEQ ID NO: 126416 - protein, 421 aa, Triticum aestivum
  unsure (1)..(421): unsure at all Xaa locations
  Clone ID: PAT_TA_20834.pep
LFSFLALSNGTSGWILLLEELPQQRGIVRVTAPLAGSDPRTDEKHVKWLHLNIRPSTVPFLDPEKFKGKTKKYLVDGRWTLAFRDEQSCKAALDAVVALFSRANISADVRVVGGWLFRQLLPHGEDEFTAFHLKLLKDSHKDCSEKLLEESGGCWCDLLLPILREAWKNCKXISIQASSPPKGSKSIISPLDSCLFGGDSSIAIAERIYEMVKGFVLQHQVILFCLGETFTDQPPIYSPXDLPVNKRATAAGFDGSVPKPGLEVNLVDAIPCRIAFERGKERHFSFLALSNGTSGWILLLEELPQQRGIVRVTAPLAGSDPRIDEKHVKWLHLNIRPSTVPFLDPEKFKGKTKKYLVDGRWTLAFRDEQSCKAAEAMVIEEMKLQQDAVREQLKALLELNMPENGLQHPQLSQETSSDDGS

SEQ ID NO: 126417 - protein, 50 aa, Triticum aestivum
  Clone ID: PAT_TA_20835.pep
NETKQLHFSWPSLMDTHINTSKECTTIHSLRKYLDLIGPVDISGKLDSIY

SEQ ID NO: 126418 - protein, 123 aa, Triticum aestivum
  Clone ID: PAT_TA_20836.pep
SRSEQMNPLVSVLHLYDVVNTPGVTADVSHMDTSAVVRGFIGQQQLEAALTGMDLVIIPAGLPRKPGMTRDDLFNKNAGIVRSICEGVAKSCPNAIVNLISNPACPPTTGTLTSLGSTPRTSA

SEQ ID NO: 126419 - protein, 226 aa, Triticum aestivum
  Clone ID: PAT_TA_20837.pep
MHPDATSPSHRIARVAAHLNPTRPQMEEGAALRPAACRAKGGAPGFKVAVVGAAGGIGQSLSLLMKMNPLVSVLHLYDVVNTPGVTADVSHMDTSAVVRGFIGQQQLEAALTGMDLVIIPAGLPRKPGMTRDDLFNKNAGIVRSICEGVAKSCPNAIVNLISNPVNSTVPIAAEGFKRAGTYCPKRLLGVTTLDVARANTFVAEVLGVDPREVNVPVVCRHAGVTI

SEQ ID NO: 126420 - protein, 229 aa, Triticum aestivum
  Clone ID: PAT_TA_20838.pep
NTRDDLFNKNAGIVRSICEGVAKSCPNAIVNLISNPVNSTVPIAAEVFKRAGTYCPKRLLGVTTLDVARANTFVAEVLGVDPREVNVPVVGGHAGVTILPLLSQVSPPCSFTPDEISYLTNRIQNGGTEVVEAKAGAGSATLSMAFAAAKFADACLRGMRGDAGIVECSYVASEVTELPFFASKVRLGRGGAEEILPLGPLNDFERAGLEKAKKELSESIQKGVSFMNK

SEQ ID NO: 126421 - protein, 340 aa, Triticum aestivum
  unsure (1)..(340): unsure at all Xaa locations
  Clone ID: PAT_TA_20839.pep
MASRAAAAVAVLALVCAAVHSSEGQLSPNFHAATCPDLEHIVEFHVAETFRRDVGVAPALIRILFHDCXPQGCDAIPSRGPSPPLTRQDRGPHPAAPRRRRPLHRXAAARPPSAAPPSTLATRDAPVRPGGPRFDAAXGRRDALAPASPAXVLPLPQPSFAVPDLLPSSRRPGASEAGATCSPSLGAHTLGLAHSSSSSRPPPPATSGTRPASVPKLFATSLRNKCAGDNPAGTLTQNLDVRTPDAFDNKYYFDLIARQGLFKSDQGLIDHPTTKRMATRFSLNEGAFFEQFARSMTKMSNMDLLTGTKGEIRNNCAAPNRRVQDIETAATRDEGIAADM

SEQ ID NO: 126422 - protein, 77 aa, Triticum aestivum
  Clone ID: PAT_TA_20840.pep
RKLKKKLELNFGGDSNNRTPRDGWVNLWWWLQFPKWLRRQIAPPPPRSRVSPPATVRPSVRPSMIRPNLTWLRRPRA

SEQ ID NO: 126423 - protein, 179 aa, Triticum aestivum
  Clone ID: PAT_TA_20841.pep
TLVLPELDKRSFWADPSDFGDIFDVNHFINSLRDELKIVKALPLKLQLKTRRRLYSMPPISWSNDTYYLKRVLPLARKHKVIHFNKTDARLANNGIPIHLQMLRCRVNFEALRFTPQIEALGRKLISTLQRSGEFVVLHLRYEMDMLSFSGCTHGCSDKETEELTKMRYAYPWWKEKEI

SEQ ID NO: 126424 - protein, 72 aa, Triticum aestivum
  Clone ID: PAT_TA_20842.pep
LINREKCPLLCPCLDAMYYIYISDRENHSVQKFVMHTERSDRSTSPSPRDWSNNKFSYHVSDATGYIHVQYV

SEQ ID NO: 126425 - protein, 65 aa, Triticum aestivum
  Clone ID: PAT_TA_20843.pep
IQSSVLRLVKLYLLISFSLGGPTIKMTFIPLPLSVPSESEAFRRIVLRLHRTSSQSILHTQGKPQ

SEQ ID NO: 126426 - protein, 418 aa, Triticum aestivum
  unsure (1)..(418): unsure at all Xaa locations
  Clone ID: PAT_TA_20844.pep
LSATPHVRVSGHGTTSVQLCIALAILYNAVGAAMVSSLVVIIIAVLCNIPLARRQHKFQSKLMEAQDVRLKAMSESFVHMKISERYAWEALFNKVIAGLXEVEYKWFAPFLFRRAYHSVLCWASPYFVSAATFITRYLLKTPPLAGHVFTFVATLRLVQEPVRSIPDVIRVVIQAKVAFTRISKFLDASELNGQVKKKYNLGIDYPTPLAMNSCSFSWDENTSKPALNNINLXVKAGEKIARCGHGGPRVSTLLAARRAGVPDTTGPILPAAQFAFISQNAWIQTGTVQDNILFGSPMDVERYQNTLVRCSLVKDLEMFPYGDCTQIGERGVNLSGGQKQRVQLARALYQNADIYLLDDPFSAVDVHTATSLFNLFVTXEYVMSALSDKIVLLVTHQVDFLPVFDSILVPLSTWKCQR

SEQ ID NO: 126427 - protein, 181 aa, Triticum aestivum
  unsure (1)..(181): unsure at all Xaa locations
  Clone ID: PAT_TA_20845.pep
GNRRGVPVCILSALGATMFSVQYRFDRLPTAARGSADMADVTDPCLMENYIPGLKSIRLTDLEPTHSDKIRLDKILEAYPYVRKAQCVIFTSFYELESNAIDFLRQELPCPVFAVGPCIPFMSLQRKPGRFKRKNKATRLGWDTQPASSMLYFSLGSFLSVSSXQLDEXAIGLAQSKVKFL

SEQ ID NO: 126428 - protein, 86 aa, Triticum aestivum
  Clone ID: PAT_TA_20846.pep
YVCSNSLPLCMNLSSRFRPLIWCMYAAVRRNVILSSSISFLACTMCYNINFIGLEKVINMQPFLLDDMNASLEQKKKKKKKKKKTR

SEQ ID NO: 126429 - protein, 215 aa, Triticum aestivum
  unsure (1)..(215): unsure at all Xaa locations
  Clone ID: PAT_TA_20847.pep
GNLYNAGYGVNSAALSTALFNNGASCGMCFTITCDASKTPSCKQGTSITITATNFCPPNYALASDNGGWCNPPRQHFDMSQPAWETIAVYQAGIVPVNYRRVPCQRSGGMRFTINGNDYFELVTVANVGGSGVVSQMWIKGFKTDWMVMSRNWGASWQSNAYLNSQSISFRVQTDDGRVITADNVAPYNWXFGGTYTSVAAVLISCEVLSQRVLK

SEQ ID NO: 126430 - protein, 166 aa, Triticum aestivum
  unsure (1)..(166): unsure at all Xaa locations
  Clone ID: PAT_TA_20848.pep
XYLTKKYIVCKNXRKMGTTMLSXAKSKDXDEHIIVDRRRKCRPQRIAXQLKTCCSLVKAGGEHNWLELYPLYALSGDAVEAVVSAPTAFGSFYVCGGGVIGFSGLTHIDGFGAGGIFLCRFTGGTPTFGAFFGCFPSGLTCDDTFEVHKAAKIDRTRKSLSSFIVG

SEQ ID NO: 126431 - protein, 314 aa, Triticum aestivum
  Clone ID: PAT_TA_20849.pep
MEELLLRHGRLSRPVATRRLRVVAVALRSRPSSSLAVPGFPPATAPAPAPALEHVLPSPHVAADAAAVLLEAGVRPEDLRRAAGMCPELMSVPVETITAALRFLTDEAGVPAEELPRVLRRRPRLLVSSAAARLRPTLYFLRALGVPDLHRRADLLSFSVEDKLLPRIEFLESLGLPSRAARSMARRFPALFYYGIDGNMRPKAEYLLGVMGRDADELFDFPEYFSYALDTRIATRHEACAARGVRMPLPAMLRPGERKFEDCLAGCVGSTPPRRRSPLWHAYWVDGDGAGVSAVVKKARRDDAIVASYRHVHY

SEQ ID NO: 126432 - protein, 146 aa, Triticum aestivum
  Clone ID: PAT_TA_20850.pep
MQDPRGMAREDFSASKSQKRKVVYRPLPSVQIKTEPELLRRDIPHLLANTQKPPKRSFRSEPRPPMPQSDRGTPDSLPDSGPADEYRALRRKYMMLEEENYTLDAQLGMAEKEAKTLEDEKFALLDQLVVLEGLVEPSQLQTQRRL

SEQ ID NO: 126433 - protein, 92 aa, Triticum aestivum
  Clone ID: PAT_TA_20851.pep
MAPKHAGRGKGRGGGGKGDRKKKEEKVVPSVVDVAVTTPYESQVTLKGISTDRVLDVRKLLASNVETCHLTNYSLSHVVRGHRLDHRVEIVA

SEQ ID NO: 126434 - protein, 154 aa, Triticum aestivum
  Clone ID: PAT_TA_20852.pep
KMLGYNIVTQELSVIWPPSQHEYYSCTVLVKADDGKLGFAGVQNGTLYLWSMKDGADGNVEWVQRKVIQHKTMLRTRGLSTPPEVVGFADGHGFIFVRTGNTVFSMDLKSGHVRKVYTCRSRNYDVIVVPYMSFCTPDRAMGRLPSPRGPTVIL

SEQ ID NO: 126435 - protein, 116 aa, Triticum aestivum
  Clone ID: PAT_TA_20853.pep
MEWSIWSIIMKSISSRVWLSLARFELCYRSMPPDLRLCFAYYCAVFPTGHNIVKDDLVQQWIALHLVEPSDTLSAAQIAEEHITRLQDMAFLQTAELDHVSNCLRLVRSSPASALF

SEQ ID NO: 126436 - protein, 250 aa, Triticum aestivum
  unsure (1)..(250): unsure at all Xaa locations
  Clone ID: PAT_TA_20854.pep
MATVGPPGAYRRITVHYSTAGDDVNHDDFLEYVIGDVLQHQEGLHQSFGTGAPGASWKHALXHGESSRGTAAETSGSSDXQIAADLKYARMLQEMEDLDVDTPPNEDEQDDISCVPSPSDTDDDDDRGDEEDTAGQDDDDNDDTNDDVDPDNMTYEQGQELVESVGNESRGLSDELLSYLVPWKYRSGSGFFSRKTNHDDTCTVCLSAFRNRENIITLPCKHNYHASCISSWLKINKTCPVCKYEVFGPS

SEQ ID NO: 126437 - protein, 344 aa, Triticum aestivum
  unsure (1)..(344): unsure at all Xaa locations
  Clone ID: PAT_TA_20855.pep
MAVRVPSMELNRSPPLLSGGRGKTCLQKPFIVQAKRSGGLEKANTRSRGPQASEKLKKREPLTRGTVSAPLPVPGHIPRPPYVGSNKMPEISSERQMQDKDTIVHMKAACELAXRVLQNAGHGVQPPRAPHVGGRPVRRMIIDAGAYPSPLRYGGFPKRVCTSVNECMCHGIPDSRELKDGDIINIDVTVYLNGFHGDTSKTFFCRGVDEAAKRLVKVTEECMLRGISSCKHGVSFKKIGRRISEHAERNGFGVVEQFVGHGVGRVFHSQPIIYHQRNNMPGQMVEGQTFTIEPILPMGSNSNSIECDMWEDGWTAVTTDGSLAAQFEHTILITRTGAEILTKC

SEQ ID NO: 126438 - protein, 52 aa, Triticum aestivum
  Clone ID: PAT_TA_20856.pep
EEDHPTLCRWARAYRADEAVRQCLPDRDRVLGALAARKDLYVSIAKAMAAQK

SEQ ID NO: 126439 - protein, 304 aa, Triticum aestivum
  Clone ID: PAT_TA_20857.pep
RLLRSLPHFRRRRASPFPSPPPPLKPAPMGNQIGTGKMEADLIGAGVGTGKTEAAPVSAGVSTGKTEAAPVGAGKMEADLIGAGDKLGIPEEKGLEITADQLEALEKASIDLAVIKLREASDYFNAAGCFAAARQVSYLPEPEPLAPVVIQKVKEAPMIVHDLFEDIIFHRMSPRARILSGVYGATPAQVRAVQQFTRKQLKLDPVVVDPIAAEVHREFTRTAGLAENVMSASDVARILKIREGMSSLHPDDQKKLEMIKIFVDNINAGSAICTAGGSVLGGMWTLRHWNTSFPMSDLPEDWVW

SEQ ID NO: 126440 - protein, 97 aa, Triticum aestivum
  Clone ID: PAT_TA_20858.pep
SEGIKIPSILHSQTGPGIYIYLPHPYFFTSGRRHGQAGVVVRLRHPSSHPSPATPYPSAPLTPSCTTCAMHSPPHLVRPLPTDGAPLPADVPISSSP

SEQ ID NO: 126441 - protein, 161 aa, Triticum aestivum
  Clone ID: PAT_TA_20859.pep
MCFRNYISYIFTEGERVSDAVADLCPLLAITIILNGIQPVLSGVAVGCGWQQFVAYVNVGCYYIVGVPLGVLLGFVFNFGVKGLWGGLIGGTAMQTAILLWVTIRTDWSKEVEEAQKRLNQWVDTKGGAPSCWRHRLITSGIAGGSLLLLGFEVCRPALRL

SEQ ID NO: 126442 - protein, 171 aa, Triticum aestivum
  Clone ID: PAT_TA_20860.pep
QEPQQPAAQVHPQIRTEQGRTLSPWTSPSRRRRRPPRRRGRTRRPTPTPSRASSPSRSTRWPSPPPRPSSPPAASSRTSTTASPSSASTPSTPPSPPSAPCPPLLRPPLPAHQAQVQPARRSHAPSPLSGRLRLERPLPPSRSPRPESRPLKTAPLESGALILGRRDRRYH

SEQ ID NO: 126443 - protein, 288 aa, Triticum aestivum
  unsure (1)..(288): unsure at all Xaa locations
  Clone ID: PAT_TA_20861.pep
MSPTQTKNSSQDLLQAQVDLWHHALGFVKSMALKCAMELQIPNTIQHHGGAMTPSELAAKIGLHPSKLPRLRRLMRVLTVSGIFAVHESTTADKESVYVLTPTTCLLVSDEVKSNLFPILSLMLDSTVLSPFFGMNSWFLDEHSTSLFKKAHGLTFWEMADKNDSFNQSINNAMVSDSNFLMDIILREXWVMYFLGINSLIDVAGGHGGSCQCNXRRHSPQMKCTVLVLPHVXVEELPTDXHVSFFPGDMFKXIPQAEPFPEWXFKMGAQRCVKILKXAREYPPEEXG

SEQ ID NO: 126444 - protein, 91 aa, Triticum aestivum
  unsure (1)..(91): unsure at all Xaa locations
  Clone ID: PAT_TA_20862.pep
ATYKNPAESPATVVAVLPQHSATAPMAFHHLGPQILHKNPYGSMFETASVVGYPHDLVGSMTLPVVTADSKXMVDKLNAGSNVTSPRDWPA

SEQ ID NO: 126445 - protein, 418 aa, Triticum aestivum
  Clone ID: PAT_TA_20863.pep
MGGSDQKAAGGAVGGKAARACDGCMRRRARWYCAADDAFLCQACDTSVHSANPLARRHERLRLRATSPLPAEGVAAVKGSPATTSKCLDVAPAWPKRKARTRRPPVKSVGQLLSRRLVVPEVGAGESSTSDERRAPEEEQLLYRVPVFDPALAEFCSPPPIDDSRHGEDVEGAVEDTKEHMATPSPVQELPDCFASFGPTDADLREFAADMEALLGQGLDDGNELEDSFYMEALGLISPPGEHGGRVKVEADGSLVSRSNGVLASGHDLKREFNGSPPTLVDDDDSFEHKTSTASNGDAVDDAQFLKRSLDLRLNYEAVMESWGSSPWTDGRRPSGQLDDLLLHDHAGMWTAGGGGRHGDAAWPPRPRTDEWREARVSRYREKRRTRLFAKKIRYEVRKLNAEKRPRMKGRFVKRTGG

SEQ ID NO: 126446 - protein, 171 aa, Triticum aestivum
  Clone ID: PAT_TA_20864.pep
MGRGKIEIKRIENSSNRQVTFAKRRAGLVKKAREIGVLCDAEVGVVIFSSAGKLYDFWTPKTTLPRILEKYQTNSGKILWDEKHKSISAEIDRVKKENDNMQIELRHMKGEDVNSLQPKELIAIEEALTNGQTSLRDKMMDHWKMHRRNEKMLEEEHKLLALRMHQQDDLS

SEQ ID NO: 126447 - protein, 210 aa, Triticum aestivum
  unsure (1)..(210): unsure at all Xaa locations
  Clone ID: PAT_TA_20865.pep
MGLGNIEIERIRNSTSRHLTFAYRRPRLGKKASAIEILWDAEAEVVIVNIASANKDYDIWKTKLTLMRVXKRSPTSTCRGTRDTRHSTRRVEVDRVKKENDNMQIELRHMKGEDVNSLQPKELIAIEEALTNGQTNLRDKMMDHWKMHRRNEKMLEEEHKLLALRMHQQDDLSSGMREMELGYHQGRDFTSQMPFTFRLQPSHPNLQEDK

SEQ ID NO: 126448 - protein, 206 aa, Triticum aestivum
  unsure (1)..(206): unsure at all Xaa locations
  Clone ID: PAT_TA_20866.pep
PLCAVLPPHASGRLLSATLLAHSSGPLPRRSNCSGGGAAPPHGHGRIWRSRPWSWRRATLGCGAVRRGGAAEVSGCGDGRCMRRRRPRTHGHGGATEFVPGRRGTRLRRRKLEEIGEVGPTTDGERVTGRRRPVPARLLALLRRRERQRDQHPGRWRWLAEVVLAKEAGGSARQHGAASMSCLRVRLARQEREKAFCGDRDQYXLQ

SEQ ID NO: 126449 - protein, 174 aa, Triticum aestivum
  unsure (1)..(174): unsure at all Xaa locations
  Clone ID: PAT_TA_20867.pep
VKVTRAMQGSLWADAQNQGNQARAPDIDMSELETLFSTAVATNASEKGATKRGSAISKPEIVHLVDMRRANNCEIMLTKIKMPLPDMISAILALDTSVLDNDQVENLIKFCPTNEEIEMLKNXNGNKEMLGKCEQFFLEXLMKVPRVEVKLRVFAFRIAFSTQADELRTNLTTI

SEQ ID NO: 126450 - protein, 95 aa, Triticum aestivum
  Clone ID: PAT_TA_20868.pep
RRRGLDCTAPPEPPVQPLLAHSVSRSTPYMPHVSLLYGDLTDEEKEAARKKVEEMDSELSGLQFEISELALYRTDTEDKSLESWELVEVCHLGKK

SEQ ID NO: 126451 - protein, 184 aa, Triticum aestivum
  unsure (1)..(184): unsure at all Xaa locations
  Clone ID: PAT_TA_20869.pep
PRPRSHLTISCCLFFLFRVDRLRFLPSESSEMMQLFWLGGHHHRPISSSPRCGTCSAGIICSVVSFLACMDTSLITRFRCPNNGVYLFRHNSDSNLFSGLSLVLSVKILEIIASKIYSPPKKKKADWRRLKSDRGPGTNPTGNSPSQRGXQKXHMPQNXHLXXGPLXXNRGWVPXRNSXHXPFF

SEQ ID NO: 126452 - protein, 99 aa, Triticum aestivum
  Clone ID: PAT_TA_20870.pep
RFQASVVQAATSIHYKSILAEHMMEPVAVIHSTKQSWSLPWVVYNLVAAEICSARAMAWPSHLPRQRKLVGSRQRHLHITKVPSICQHLDATPPPLHPP

SEQ ID NO: 126453 - protein, 129 aa, Triticum aestivum
  unsure (1)..(129): unsure at all Xaa locations
  Clone ID: PAT_TA_20871.pep
KGXLEAXPLLTVCXPPXTLLVEELPXLPSTVHXEGCTNLPXSVAGXXLGEAXVKVGXAPIMPAEDFSFYTQRFPGAFFMIGTRDEAMATAVHPLHSPNFVIDEGVLPVGAAFHAAVAMEYLNKRGTVAN

SEQ ID NO: 126454 - protein, 145 aa, Triticum aestivum
  unsure (1)..(145): unsure at all Xaa locations
  Clone ID: PAT_TA_20872.pep
RQSPLAATNNHSLYASLVSSQQVSLTRQQAKLGVELGRMGGKVALLLLLPDAQASCPRSESEPEVRRRLHERLGRAGPRCGSKVRSSDEGLPAGWVPASATFDRKGRQLTSTXSHQEKXPPTPNLGACTSSMHQPCIRSPRHXGP

SEQ ID NO: 126455 - protein, 116 aa, Triticum aestivum
  unsure (1)..(116): unsure at all Xaa locations
  Clone ID: PAT_TA_20873.pep
AXADDAAPADGLRRAGVVVQRVQGLPDRAGGEVQSTRSTRPVRAPSCDSQAGDRACMHACAVPPLRTLFFVVRPMFHVCPVCFVHSTAFVYVCTRSKEGVAATCNFQCENRCSRNN

SEQ ID NO: 126456 - protein, 142 aa, Triticum aestivum
  unsure (1)..(142): unsure at all Xaa locations
  Clone ID: PAT_TA_20874.pep
NLNVTDYTSQTTENSEKRRRKRDGSRRLEKEEAATGAWREEQQQYGXREEQQRGREQQRGEDSEVNSSKVRRXEGQQRGKEKSSSSRLRREEXRSSKQRKEEEEEEEQQGKRRRRQQQEVGEGRSSSRKRRRTRDVAREMQQ

SEQ ID NO: 126457 - protein, 165 aa, Triticum aestivum
  Clone ID: PAT_TA_20875.pep
IKQRSIQFKFNNTRHTIVGATAQSSQGSKREIEKKPSCGVRIASFPGSNRHFHFISTLITITNNWCFWVLTTVTDDWCLILTKNIGGRLTSSHTMLLDRRLKTSPTLKFELTKPTPPWISITTRASGFRPWRQGGSSLMAHCRAPSPPRSSCTAGSPPVARARGN

SEQ ID NO: 126458 - protein, 86 aa, Triticum aestivum
  Clone ID: PAT_TA_20876.pep
KELKSITNVQQKYKGHPRPTKDPVSLHAHTEVHTQACWVTQHRNHTTCTQTGLLTPNNKNIHIHAQSCPSFLLILSGGNGTLVQHC

SEQ ID NO: 126459 - protein, 152 aa, Triticum aestivum
  Clone ID: PAT_TA_20877.pep
FFFLKKRRNLTGFIKTDVRTTRSKHLVTSSVSRKWTTMARAQQRLGTYSYVHRCSPRSCLTMSRSGGDTVGLAAGGAAGDARLDDAADAFVALPTGRAAPTLARGFVVDVAARAGAEAGAVGIPRRGAARACAGAQARRAAGGLAALHAVRR

SEQ ID NO: 126460 - protein, 126 aa, Triticum aestivum
  unsure (1)..(126): unsure at all Xaa locations
  Clone ID: PAT_TA_20878.pep
FFLPCSCPVDQLPSRIGAPPEQPRRRPLRPSPPRTATAPPAPRNSPLRWIHGGHGPPAPPNSPLRRIHCGHGPPAPPNSPLXGSMAATVLPRRPFXPTPDPWRPQPLPCTVGDGSGHYRQAAQGRR

SEQ ID NO: 126461 - protein, 315 aa, Triticum aestivum
  Clone ID: PAT_TA_20879.pep
MADEVQALTKAFSGLGGLGVDEPTMVAALANWRRQPEKRSGFRKSFPGLFKEHGVIERCEDEYMLHLAAEFSRFKNLMVLWAMHPWERDARLAHHVLHQAHPAAIVVEVACTRSAEELLGARKAYMALFHHSLEEDVAYRAKDKPYCSLLVGLVSAYRYEGPKVSDDTAKAEAKALGAAVKSAAGGKLVENDEVVRILTTRSKPHLVQTFKYYKELHGKHIEEDLGSEEALRETVQCLATPERYFSQVMAAALREGADHHGKEALSRVAVTRSDVDMDGIRAAYQEQFGAKLEDAVAGSAHGHFKDALVSLIVGK

SEQ ID NO: 126462 - protein, 142 aa, Triticum aestivum
  Clone ID: PAT_TA_20880.pep
MLHSMAPLHAAAATAQHAAVGAAPSRDAAPKKNGGSVPAGRDTRRAFLSGVVVAAAGAGVLLGHVDAAPAASKRRAPPPPSEEKEKKDPNLSGVQAKVLASRKRKEAMKEAVAKLREKGKNPADAASAVTGIKPRSTGAVVE

SEQ ID NO: 126463 - protein, 144 aa, Triticum aestivum
  unsure (1)..(144): unsure at all Xaa locations
  Clone ID: PAT_TA_20881.pep
TRHACLSLPSPPPLSFPFSPIQIQPKRPSSTAAPSPAAAAMSRPCSTHLPRVRSARALAPSPPSGPRPCAAPRRRGRAREPRPAGLVHVAGDXGGGGTRVVARGPEEASSWPSPTSTAFFLRRRPDSLVLSLPVNSAHALLSRP

SEQ ID NO: 126464 - protein, 92 aa, Triticum aestivum
  Clone ID: PAT_TA_20882.pep
RNTLSSTWKWCFTSHKSSKTTPSQVAWHKSTSMVSNKPNMEVTLAPGTAIQNRHVPNREGGSIIHGYVGCTLDVLHIPANDSRLSLALMSQD

SEQ ID NO: 126465 - protein, 191 aa, Triticum aestivum
  unsure (1)..(191): unsure at all Xaa locations
  Clone ID: PAT_TA_20883.pep
MEAALVLVVAVLLGSSALVASDFCVCRSEQPXAVLQKAIDYACGQGADCTAIAQSGACYSPDEVASHCSWAANSYFQEFRSSGATCDFTGAATLSTNDPSFSGCTFPSSASAAGTATGTGTATTGTGTTTARDGTTTGGTFSPGMGTGFNSTGFSPTTGSMDGTAAAAGLLPSIRLAASIAVLLLSYLALP

SEQ ID NO: 126466 - protein, 426 aa, Triticum aestivum
  Clone ID: PAT_TA_20884.pep
GGGSNLGKDFPTPKEISKGLDKYVIGQDRAKKVLSVAVYNHYKRIYHQSLQKGSGADLGCSDGEADGEDNVELEKSNILLMGPTGSGKTLLAKTLARFVNVPFVIADATTLTQAGYVGEDVESILYKLLTVADFNVQAAQQGMVYIDGAAAFAKKAESLNISRDVSGEGVQQALLKMLEGTIVNVPEKGARKHPRGDNIQIDTKDILFICGGAFIDLEKTISERRQDSSIGFGAPVRASMRTSGISSAQVTSSLLESVESGDLIAYGLIPEFIGRFPILVSLAALNEDQLVQVLTEPKNALGKQFKKLFSMNNVKLHFTDAALRIIAQKAMCKNTGARGLRTILENILMDSMYEIPDTKSGEKRIDAVVVDEGAVGLVDRPGCGAKILYGDGAFDRYLSQIKAMGDGAGSEVDGDPDLSSSRAMSM

SEQ ID NO: 126467 - protein, 83 aa, Triticum aestivum
  Clone ID: PAT_TA_20885.pep
KVGLQVARDDDDGSFDRHGVAAAVRTVMLDGEARRGFVASALKMQAIVADKERHERYIDEFVQQLRSYLPTDDLTTTTPSSSS

SEQ ID NO: 126468 - protein, 430 aa, Triticum aestivum
  unsure (1)..(430): unsure at all Xaa locations
  Clone ID: PAT_TA_20886.pep
MTTVASLSLVPHLLIKPSLRCLSRKGVGRYGGIKVYAVLRDDSADYLKDNHHWEALFHVDDPGPRVPIEKGQYLEAKQALDVVRFDIQYCDWRARQDLLTIMVLHNKVVEVLNPLARDFKSVGNLRKDLDGLQEELAKAHNQLYLSESRVSSALDKLAQMETVVNERLLSDGSAFANTADCASLDPSTSLDTTTSTSSTVRVGAKKPKRRSLNISGPGTPCPPNLLVPGVPLALSSDLGPDSLVPRDCFGEPSVRFRGKDKRPGCVQNTCAHRACPLDLGSVNEGRITCPYHGWEYSTDGKCEKMPSTKMLNVRIRALPCFEQEGMVWIWPGDDTPTPTIPSLLPPSGFTIHAEIVMELPVEHGLLLDNLLDLAHAPFTHTSTFAKGWSVPSFVKFLTPTSGLQGYWXPYPIDNGVTDPPXHWFLSNHLG

SEQ ID NO: 126469 - protein, 77 aa, Triticum aestivum
  unsure (1)..(77): unsure at all Xaa locations
  Clone ID: PAT_TA_20887.pep
PGFPRRARPLPRWGRRKLASSSLDTSQVXMGPHDSPGYWLATGARLDVDKGKISLHVKFSLLRPVAFLTVPESVQFS

SEQ ID NO: 126470 - protein, 296 aa, Triticum aestivum
  Clone ID: PAT_TA_20888.pep
TFSPTSPPSIKARALLLRSIPLATAQIQTMTVPPSPEPFRVFVGYDPKEHEAYEVCRRSLIRHATVPLDVRPIRQPDLRASGLYWRTRGHMESTEFSFTRFLTPFLAGYRGWALFIDCDFLYLADVAELIASAVPSDAAAAKRLAVVCVKHEYTPLEATKMDGAMQTVYPRKNWSSMVLYNCAHPKNVAALTPDAVSTKTGAFLHRFSWLDDDEIGEVPFVWNFLVGHNKVDPDDPTTQPKALHYTCGGPWFDRYRDCEFADLWIKEAEELRAEKEKRRAEKERLELEDDEDDGGN

SEQ ID NO: 126471 - protein, 160 aa, Triticum aestivum
  Clone ID: PAT_TA_20889.pep
MAAAVKTSGGFCNTQQQWLHSTRDLFLHGSTHSNAKECKSKKAKKPTSLRVKATSTKVELDFNDPSWKQNFQEDWDNRFNLPRITDIYDLKPRPTTFSLKKQRTPTGDEDSTPMDMWNGYVNNDDRALMKVIKYSSPTSAGAECIDPDCTWVEQWVHRAG

SEQ ID NO: 126472 - protein, 191 aa, Triticum aestivum
  unsure (1)..(191): unsure at all Xaa locations
  Clone ID: PAT_TA_20890.pep
FFFCSSKSSISFIRGEXCGNTRCEIKASKGNAGEGEEEARIAAPGVEGEVARSPHGKGREKEQRRRRNPRDSRARQPVSSGGNCGKIPGIPRATLQRPPYVQHPRRGRSVRTQQLAFCSAGSPICLCQGANFPSRPPWQPNEEGETGKTGQMASSRARSRRRRWPGSRGRRGRGGGGGSRRRRRGCGEHPG

SEQ ID NO: 126473 - protein, 363 aa, Triticum aestivum
  unsure (1)..(363): unsure at all Xaa locations
  Clone ID: PAT_TA_20891.pep
MGLDVGEIGMGADLSLDLKMFAAKSLGRVREAPAAAMDDCIRRLEEEKSKIEVFRRELPLCARLLADVIDVMKKEVEEKKRGGDRGGDREDAGAGDKSNWMSTAQLWTGDSVQGDDASEKVDGSRISSVPRDDGGAFRHSXEPGVQASLFWCRRGGRALTGLRGYSCCYYVXLPMRPSLAPATGGAKVSRSRQRGRARQAPWPPPPLPPAAPSLSLQAQSQQTAQQQQQQRQARKARRCWSPELHRQFVTALHQLGGPQADTRGVATPKQIRELMKVDGLTNDEVKSHLQKYRLHNRRAPGSPAANRPIVLMGGLWITQDQSSSQSGGSPPGPLHFSSSGVAASSVTVSGEEEDGRSESYGWK

SEQ ID NO: 126474 - protein, 183 aa, Triticum aestivum
  Clone ID: PAT_TA_20892.pep
HMRAHGDEYKSKAALANPTTRLFATSGEDAAAGRPRSSKYSCPQDGCRWNRRHAKFQPLKSVICAKNHYKRSHCPKMYVCNRCNRKHFSVLSDLRTHEKHCGDHRWICSCGTTFSRKDKLAGHVSLFAGHQPVAPLAPGSGRHGKRSRYCPRPPPTLLETAQHRFSIILLHDIIVQMWLPPSY

SEQ ID NO: 126475 - protein, 210 aa, Triticum aestivum
  Clone ID: PAT_TA_20893.pep
MKITALVVLKPSAGGAGGSSSSGGQGSEALVLANATDVSHFGFFQRGAAREFIVFVARTVAQRTQPGQRQSVQHEEYKVHSHNRNGLCVVAFMDDHYPVRSAFSLLNKVLDEYQKAFGDAWKAATADSTQEWPFLMEALTKFQDPAEADKLTKIQRDLDETKIILHKTIENVLQRGERLDSLVEKSSDLSAASQMFYKQAKKTNSCCTIL

SEQ ID NO: 126476 - protein, 95 aa, Triticum aestivum
  Clone ID: PAT_TA_20894.pep
RAHRRRSRHRHHRRPAPRRLSTARHSRTSSSDPPPRCSCSQPCKASTHATAMAAAQARARNKRDDPSFFLMLLVFQVNYYSTKNWESRGVFTAPN

SEQ ID NO: 126477 - protein, 206 aa, Triticum aestivum
  unsure (1)..(206): unsure at all Xaa locations
  Clone ID: PAT_TA_20895.pep
MKDLVGLGHLFVVAFLFHFSSFMVLPAITDVTMEAVCPGRDECSVAIYLSGFQNAITGLGALVVTPIVGNLSDKYGRKALMTLPVTVAILPLFILACNRSEVYFYAYYVMKILAGIFCEGSIHCLLLAYVADHVGTKRRAAAFGLLSGVSAARXLSGTLTARFLATSSTFQVAAAVGAAGAIYLRAFVPDSGAAVSFHDDACDPLL

SEQ ID NO: 126478 - protein, 93 aa, Triticum aestivum
  Clone ID: PAT_TA_20896.pep
THTQMPTADYRPDYPREPPPHEYIQSHTSTATGAEHQLKTNRMSTIWTIFFRVASLGTHSIHVMGLHQATQQLVFSFYSLPRGVPISGMEHLR

SEQ ID NO: 126479 - protein, 284 aa, Triticum aestivum
  unsure (1)..(284): unsure at all Xaa locations
  Clone ID: PAT_TA_20897.pep
EAEALPRVRLAAVDVEWAHVLAEGWASPLRGFMREHEYLQCLHFNSLRLPSGGLANMSLPIVLAVDDAAKDRVGAAPDVALAGPDGELLAVLRSVEIYPHNKEERIARTWGTTAPGLPYVDEAITPAGNWLIGGDLEVLQPIKYNDGLDHYRLSPQQLRDEFDKRGADAVFAFQLRNPVHNGHALLMNDTRRRLLEMGFKNPILLLHPLXGGFTKADDVPLPVRMEQHSKVLEDGVLDPETTIVSIFPSPMHYAGPAEVQWHAKARINAGANFYIVGRDPTGMG

SEQ ID NO: 126480 - protein, 123 aa, Triticum aestivum
  Clone ID: PAT_TA_20898.pep
MGTATATGTTTVGPCPTPPPPTECFGGGEQGQGYYKKEVKQHKNRERVGEVGALAAGAFALYEGYEVKKDPAHARKHQIEAGVAGAAALGAGGYAYHEHREQKQAAYGGQQEYRMPVHNGYCN

SEQ ID NO: 126481 - protein, 163 aa, Triticum aestivum
  unsure (1)..(163): unsure at all Xaa locations
  Clone ID: PAT_TA_20899.pep
MSDTDEHHFESKADSGASKTYPQQAGAIRKGGHIVIKARPCKVVEVSTSKTGXKHGHAKCHFCXPLDIFKWERSLKDIVPSIPTTGDVPHVXPAKDYQAGFDIXDDGYVKLLXLESGNTKDDLNFPTDDVLLGQIXDXFPDGKADPPVMPXGXXKXCAXKGTG

SEQ ID NO: 126482 - protein, 240 aa, Triticum aestivum
  Clone ID: PAT_TA_20900.pep
MAAANAPFALVSRLSPAARLPIRAWRAARPAPLSTGGRTRPLSVASAAQENRDNSVDVQVSQAQNAGNQQGNAVQRRPRRAGFDISPFGLVDPMSPMRTMRQMLDTMDRLFDDAVGFPTARRSPAAASETPRMPWDIMEDEKEVKMRFDMPGLSREEVRVMVEDDALVIRGEHKKEAGEGQGEGGDGWWKERSVSSYDMRLALPDECDKSQVRAELKNGVLLVSVPKRETERKVIDVQVQ

SEQ ID NO: 126483 - protein, 247 aa, Triticum aestivum
  unsure (1)..(247): unsure at all Xaa locations
  Clone ID: PAT_TA_20901.pep
MAAANAPFALSRLSPAARLPIRAWRAARPAPVSTGATRPLSVASAAQENRDNSVDVQVSQAQNAGDQQGNAAPRPXVQRRSRPAGFGICPLWLLGRRWPMRTMRRMLDTMDRLFDXDAVGFPTARRSLAAASVTPRMPWDIMEDXKEVKMRFDMPGLSREEVKVMVEGDALVIRGEHKKEAGEGQGEAAEGGDGWWKERSVSSYDMRLALPDECDKSQVRAELKNGVLLVSVPKRETERKVIDVKVQ

SEQ ID NO: 126484 - protein, 271 aa, Triticum aestivum
  Clone ID: PAT_TA_20902.pep
MGIVEEAHNLRVVGEGKRGVIVLAHGFGTDQSVWKHLVPHLVADYRVVLFDTMGAGPTNPDYFDFSRYATLEGYALDLLAILEELGIASCIYVGHSVSAVIGVLASISRPDLFSKLVLLSASPRYLNDVDYYGGFEQEELDELFEAMRSNYKAWCSGFAPLCVGGDLESVSVQEFSRTLFNIRPDIALSVVQTIFQSDVRTLLPLVSVPCHIVQSTKDLAVPVVVSEYLHKHLGGDSIVEVMPSEGHLPQLSSPDIVTPVLLRHIQHDIAF

SEQ ID NO: 126485 - protein, 450 aa, Triticum aestivum
  unsure (1)..(450): unsure at all Xaa locations
  Clone ID: PAT_TA_20903.pep
IQENILFGQPMDAERYKEVTRSCCLQKDLEMMEFGDQTEIGERGINLSGGQKQRIQLARAVYQNCDVYLLDDVFSAVDAHTGSYIFKECLRGMLKGKTILLVTHQVDFLHNVDNIFVMKDGMIAQSGKFDELLEAGSGFSALVAAHDSSMELVEQSRQVEKTEHSQPAVVRIPSLRSRSIGKGEKVIVSPEIEAATSKIIQEEERESGQVSWRVYKLYMTEAWGWWGVVGIFGLSLVWQASDMASDXRVAYETSGGTPFNPSLFIGVYVAIAGVSMVLQVIKTFLETVMGLQTAQIFFRKMFDSILHAPMSFFDTTPSRRILSRASSDQTTIDVVLAFFVGLTISMYISVLSTIVVTCQVAWPSVIAVIPLLLLNIWYRNRYLATSRELTRLEGVTKAPVIDHFTETVVXATTIRCFKKENEFFQENLDRINSSLRMYFHNYAANEXXXV

SEQ ID NO: 126486 - protein, 189 aa, Triticum aestivum
  Clone ID: PAT_TA_20904.pep
MAAISAAISGWCSSSCLSQSQRGLPSPARRRHFKVTAMAPKNKVNKYDDGWSKQWFGAGIFAEGSEEASVDVFKKLEKRKVLSSVEKAGLLSKAEELGVTLSSLEKLGLLSKAEDLGLLSLVESAATVSPAVLASLSLPLLVASIATVVFVPDDSTLLVTVQTVVATLFAAVAAGLFVGSVVLDGLQDD

SEQ ID NO: 126487 - protein, 177 aa, Triticum aestivum
  Clone ID: PAT_TA_20905.pep
MAHPPPRNWAMAPPYHYHGTSQQEQAAPAAEDESGAGSGGQEAESRSLRIRELFPWMDEDYLRSCFTRSPELVTAVITRNKETKQSEGFGYLTFSDHATADQILQSYNGQKMPNADRDFSLSWVQYAGPDDDCAIYVGGLGFDVTDFMLHHVFKNRYPSVKRAKVIWDYLARRSKGY

SEQ ID NO: 126488 - protein, 261 aa, Triticum aestivum
  Clone ID: PAT_TA_20906.pep
GRRFLLSLHVALLLLVPCTCQVGDSCSAARDCGVGLYCGDCAAAGRTRPSCIRDLAIQPTSIVKGLPFNRYSWLVTHNSFSIVGEPSRTGVERVTFYNQEDTVTNQLRNGVRGLMLDMYDFGGDAWLCHSLQGQCYNFTAFEPAIDTLKEVEAFLSENPTEIVTIFIEDYVHAPMRLSKLFTAADLMKYWYPISEMPTSGQEWPTVTDMVAKNHRLLVFTSDASKESSEGIAYQWSYLLENECKYGFLGFIEKNRGSIDSR

SEQ ID NO: 126489 - protein, 143 aa, Triticum aestivum
  Clone ID: PAT_TA_20907.pep
HASAHASAHASAHASAHASAHASDSVGLPQMVQTCYAAAGNRIPNFIAVNFYMRSDGGGVFDVQDRINGLTLCGCNTIAACQAGAPAGACKNTGAPNRTTSSVNGNVYSGTVEFKTSASRASSTSTWSNLVISLSLALILKPF

SEQ ID NO: 126490 - protein, 412 aa, Triticum aestivum
  unsure (1)..(412): unsure at all Xaa locations
  Clone ID: PAT_TA_20908.pep
MARLSRRRFLLSLHVALLLLVPCSCQVGDSCSAARDCGVGLYCGDCAAAGRTRPSCIRDLAIQPTTIVKGLPFNRYSWLVTHNSFSIVGEPSRTGVERVTFYNQEDTVTNQLRNGVRGLMLDMYDFGGDVWLCHSLQGQCYNFTAFEPAIDTLKXVEAFLSENPTEIVTIFIEDYVHAPMRLSKLFTAADLMKYWYPISEMPTSGQEWPTVTDMVAKNHRLPGGQAGPSVTDMVAKNHQWSYXLENESGDPGIDPSACPNRKESQPLNSRSASLFMQNYFPTIPVESEACKENSVGLPQMVQTCYAAAGNRIPNFIAVNFYMRSDGGGVFDVQDRINGLTLCGCNTIAACQAGAPAGACKNTGAPNRTTSSVNGNVYSGTVEFKTSASRASSTSTWSNLVISLSLALILKPF

SEQ ID NO: 126491 - protein, 84 aa, Triticum aestivum
  Clone ID: PAT_TA_20909.pep
DCPAPATTVATGSSPRFDVYGNDFGWGSPVAVRSGSGNKVDGKVTVYEGRGGGGSIALEVCLSPEAFPRLLADEEFMGMVGATD

SEQ ID NO: 126492 - protein, 93 aa, Triticum aestivum
  Clone ID: PAT_TA_20910.pep
SLLRRRRPAPPTASGRAATSTSRTVGSIDSPTADACAASGAGAGCARCPFPWYSSPPPYLTCSSTTSYSLAVPDGLSATKLVDGGWTGSWWVG

SEQ ID NO: 126493 - protein, 126 aa, Triticum aestivum
  unsure (1)..(126): unsure at all Xaa locations
  Clone ID: PAT_TA_20911.pep
MAFWQARDFLFCGVCGTLLDFNSHRYASCPLCGFKRKAKDIEGKETRYAVTAEDIRRELKIKAFVVLESAPNLDIVVQRIPDRASLCXECNNPELEFYTKQLRSSDKGPTIFDAYPECGHTCNENS

SEQ ID NO: 126494 - protein, 133 aa, Triticum aestivum
  unsure (1)..(133): unsure at all Xaa locations
  Clone ID: PAT_TA_20912.pep
MAYRRAGIDLFGSFSLGGPKAEDRTVRTLPTTYKIWITKGCKKEFMDLQKYLTTSCTPGPACADPFHWQATIRGSPDRPYXDGHLPVHLHFTPDCPFMPPKXDLQTKVHHPEHQLPPQHLPGPCSKEQAAARK

SEQ ID NO: 126495 - protein, 179 aa, Triticum aestivum
  Clone ID: PAT_TA_20913.pep
MDRSVSGGRGYYYSAAPVGTGMGMGPLAGQLGEWLLRAVQPPAPTPCGSPGGPPITAPRVRMRDGRHLAYEESGVSKETARFKIVFSHGFTGSRLDSLRASPEVAEELGVYMVGFDRAGYGESDPNPGRSVETAAQDMEDLADALGLGDKFYVVGFSLGCHAVWGALRYIPERIAGAAM

SEQ ID NO: 126496 - protein, 137 aa, Triticum aestivum
  Clone ID: PAT_TA_20914.pep
RGKTLLGKGDNFFSLLGVKNSTDGITGTPSVSSQETTRPYVEESGILHPEPVPEHRRGLVPAVEPLVHRSGGAGECVEEDDGDDGGGEEQRYYHQIGEGARRHIRACVVLFFFPDGGRRLRPASLSSLKPRPKAART

SEQ ID NO: 126497 - protein, 356 aa, Triticum aestivum
  unsure (1)..(356): unsure at all Xaa locations
  Clone ID: PAT_TA_20915.pep
PVIASRNDHQMGLARPAARSTMTMMLSGCVVQPTAAFARSPRQQAPSLLAGAPPSAPARSHFAGCDFSHTNRTLDDEAAVAAPASSKRCFELFLGKAPPAKVFAKPVTPTAAASAVAACTTSSAEGHRGVRLRKWGKWAAEIRNPFSGKREWLGTFDTADLAXSAAYQGASQELXSKAKRRRPVSVRGLPPSVCCVNKTDTTPTYTYGYHQAVSSVVLPPPLVPSAHPSPSSCPGGHQATNRVPVPLKPTPVPVMLSTTAETAQLPDDPEFYQDLLRGLQLPDIDPMDFRAGLDALDVSEASAYLDGEQDLLLGDLADEDLELDMDLDIGDDFLEMPGCDFGRGMDDFLQTVDFCV

SEQ ID NO: 126498 - protein, 110 aa, Triticum aestivum
  Clone ID: PAT_TA_20916.pep
MLQTQKVRITNFLDERSAYLTKFTKDADTEFDMIGQNAMKELDQIGDQIMERLDSKMQSYEETAEMQRQEIEMNERVLEDFEDWIEEEKNEGMFFKSLGKVQKPQNNEEI

SEQ ID NO: 126499 - protein, 265 aa, Triticum aestivum
  unsure (1)..(265): unsure at all Xaa locations
  Clone ID: PAT_TA_20917.pep
MLKRRSLLSTPLRQPFPRRADPLCANSPCNYAGGDFPSVRAAPRLLDPMLPCPTAGDQRQQEVLAKIAMLQTQKDRITNFLDERAAFLNNSQRDGDTEFDXLGQNAMKELDXLGNQIMXRLDSKMQSYEETAEMQRQEIEMNERVLEDFEDWIEEEKNEGMFFKSLGKVKKPQNNEEIKVKAKIEAQKVREIAEESAGSKARMNIYLALTAILGLTIANAVFATPEVEWRKVAALGLIFIGLVAQVIYEQDISPPVADKDEKREE

SEQ ID NO: 126500 - protein, 225 aa, Triticum aestivum
  unsure (1)..(225): unsure at all Xaa locations
  Clone ID: PAT_TA_20918.pep
MAAIMAAGLVVLALLAAVAAPAHATDYVVGDSAXWAXGXDYATWASGKTFAAGDNLVFQYSAMHTVAEVSSADYSACSASNSIQSYSDQNTKVALTAPGTRYFICGAPGHCGNGMKLAVTVAAAAATTTPASSPPAPAAPPTPPPAVPVSPHADAPPVAPPLRPPPPRRPPRPRRRRPRALASLARPPRARALWGLARRALPGSPSRASLVALAFPVPSVPALRG

SEQ ID NO: 126501 - protein, 361 aa, Triticum aestivum
  unsure (1)..(361): unsure at all Xaa locations
  Clone ID: PAT_TA_20919.pep
MLLARASPAFLPSTSSSPTPSSQTLPPSASFGRSQRTGGSLTVASPNCTVRRPVMAGAAAAVPAAKLEDAEALIDSVETFIFDCDGVIWKGDKLIDGVPEXTLDLLRSKGKRLVFVTNNSTKSRKQYGKKFETLGLSVNEEEIFASSFAAAAYRQSIDFPKDKKVYVIGKEGILKGLELAGFQSLGGPTVAXQVELTPACHMERDKHVGAVVVGFDRYFNYYKVQYGTLCIRENPGCLFIATNRDAVTHLTXAAQWWAGGGSMVGAVLGSTKQEPLVVGKPSTFMMDYLAKKFGITTSQICMVGDRLDTDVLFGQNGGCKTLLVLSGVTSEQMLQSPDNKIQPDFYTNQISDFLTLKTAAV

SEQ ID NO: 126502 - protein, 54 aa, Triticum aestivum
  Clone ID: PAT_TA_20920.pep
YSNTATFTKEKTDLSPINWKVGVTTEYMIDIPYILGRLTSQMGGILNKSKGAFN

SEQ ID NO: 126503 - protein, 151 aa, Triticum aestivum
  Clone ID: PAT_TA_20921.pep
ALLLIGISVNQLKSLPEGSTALGLPVAAGAYLYTLFFITVPALASVYNEKALKSQFDTSIYLQNLFLYGYGAIFNFLGLVITALVQGPRSFHILEGHSKATMFLICNNAAQGILSSFFFKYADTILKKYSSTIATIFTGVASAILFGQTPD

SEQ ID NO: 126504 - protein, 144 aa, Triticum aestivum
  unsure (1)..(144): unsure at all Xaa locations
  Clone ID: PAT_TA_20922.pep
MAPKAEKKPAAKKVADEEPSEKAAPAEKAPAGKKPKAEKRLPAGKSAGKEGGDKKGRKKAKKSVETYKIYIFKVLKQVHPDIGISSKAMSIMNSFINDIFEKLAAEAAKLXRYNKKPTITSGEDTHLPLASSGPRNSPARRSKA

SEQ ID NO: 126505 - protein, 132 aa, Triticum aestivum
  unsure (1)..(132): unsure at all Xaa locations
  Clone ID: PAT_TA_20923.pep
MAPKVALFLALSLLFAATAHGCEPNCSGPVVPTPPVVPTPSSHSHGRCPIXDALKLKVCANVLGLVKVGLPQXYEQCCPLLAGSXVHLDAALCLCTAIKANVLGIHLNVPLSLNXILNNCGRICPEDFTCPN

SEQ ID NO: 126506 - protein, 114 aa, Triticum aestivum
  Clone ID: PAT_TA_20924.pep
ASPKPLSIEPHFSSSSKEDDSSSLETIVKCKEAEAKLFQKLANDARKEVDSYRQIVRAKTHKLEEEYAAKVAKLCFQETEEKRRKKVEELKVSQGGPVPNFALYGPFTSLPFYS

SEQ ID NO: 126507 - protein, 165 aa, Triticum aestivum
  unsure (1)..(165): unsure at all Xaa locations
  Clone ID: PAT_TA_20925.pep
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGXTREHALLAFTLGVKQMXCCCNKMAQQSEIPKDL

SEQ ID NO: 126508 - protein, 159 aa, Triticum aestivum
  unsure (1)..(159): unsure at all Xaa locations
  Clone ID: PAT_TA_20926.pep
QCDQEATTAKSKRGHGGGPPLLRAAVXRGRLEPPPGRSTPGQVRHXPRQRXLPGXLFHAVSFHXPRAFPGRIPCGSRPPPGTLXNXRLGALEXHKXVXTTXFRASRKPTPXLFWVDQGSDIXXXRGSRLXDXQCSXADKGPSIPKXLPXAFXXXNXXXP

SEQ ID NO: 126509 - protein, 100 aa, Triticum aestivum
  unsure (1)..(100): unsure at all Xaa locations
  Clone ID: PAT_TA_20927.pep
MSSRMAGAALLRHLGPRLFAAGPAVSGLTARGGMPAAARLLPARMASTAAEAAREDAGANKRHGGTEXHEEXAACGQSKKPVXYWGIDTPTPLRKLHGVK

SEQ ID NO: 126510 - protein, 70 aa, Triticum aestivum
  unsure (1)..(70): unsure at all Xaa locations
  Clone ID: PAT_TA_20928.pep
MAPKAAPAKKGDAKTQALRLAAAVESGPAEKKTKKVPTSVTLHRPPTLXKRARDPEYRRMSTTGRNKFLQ

SEQ ID NO: 126511 - protein, 183 aa, Triticum aestivum
  unsure (1)..(183): unsure at all Xaa locations
  Clone ID: PAT_TA_20929.pep
MMITGGQRNPARLQVSSSFLLALVFASSVLVGIVAGGSFYEECDATWEPQNCWAYDDGNRLSLALVSSSSGSMIRSKRQFVYGTVSTMIQLXPRRLRRHRHHLLYVVXGDNHDEIDFEXLGNVSGQPYTXHTNVYAPAWPTRSACMLASPHAATLCTPLRAGRGLRSPSRRLARPPAARGPHH

SEQ ID NO: 126512 - protein, 95 aa, Triticum aestivum
  Clone ID: PAT_TA_20930.pep
DDLYPGPGAGFYPHSGIGSGGSMHVGPNDPRFFPSNPFSAPFGGLGSVPPGSRYDPIGPPDVPGFEPSSFVRRPRRPPGGSTHPDLEFFQQGPDF

SEQ ID NO: 126513 - protein, 177 aa, Triticum aestivum
  unsure (1)..(177): unsure at all Xaa locations
  Clone ID: PAT_TA_20931.pep
QPRAELKAALAQPRAEFTDQPRAEFTDQPRAKFTDQPRAEFTDQPRAEFTDQXRAEFTDQPRAEYTDQPRAEFTDQPRAEFTDXAXSRITDQPRAEFTDQPRAEFTQPRAEFTDQSRAEFTDQPRAEFTEQPRAEFTDQDRLLNWEIKNLKPREVPYGKLGFYLTECYSQAQVSRGR

SEQ ID NO: 126514 - protein, 130 aa, Triticum aestivum
  Clone ID: PAT_TA_20932.pep
MARGVVSAKGGTAAGKKKGSVAFTIDCTKPVEDKIMEIASLEKFLQERIKVAGGKAGNLGESVIISREKTKVTVTCDGPFSKRYLKYLTKKYLKKHKVRDWLRVIAANKDHSVYELRYFNIAENEGEEED

SEQ ID NO: 126515 - protein, 144 aa, Triticum aestivum
  Clone ID: PAT_TA_20933.pep
ARRMATKAAFMAVVLLVLVVGDLAHGHAVPPLGRGRRKGGPPSGVQSSDTASTARQGAISWVDKGRGLCAIALIVFWWYDKKGHRKRSRQRRANRTAASSLAWRKASSSRLCRDSSSRPFPRTLPEKKTSHFTPQGEHACMPWH

SEQ ID NO: 126516 - protein, 104 aa, Triticum aestivum
  Clone ID: PAT_TA_20934.pep
MSEEKHHHHLFHHRKAEEEEGASGEVDYEKKEKHHKHMEQLGQLGAIAAGAYALHEKHKAKKDPENEHGHRVKEEVAAVAAVGSAGFAFHEHHEKKDAKKHAHN

SEQ ID NO: 126517 - protein, 144 aa, Triticum aestivum
  unsure (1)..(144): unsure at all Xaa locations
  Clone ID: PAT_TA_20935.pep
MDSNKRLGLGVQHGHHSHNGTIAKPPPAQPXHHARRKQGRQNGGGGGKGIKVVYISSPMKLTASAEEFRAVVQELTGRDSNVADHEPRPRTAPVTATPPSNASPRGPDTAPGGAAGPASRHTQRRRQRYMRPWRPARSVSYKHT

SEQ ID NO: 126518 - protein, 129 aa, Triticum aestivum
  Clone ID: PAT_TA_20936.pep
MNKGSIHKKETHGTSDDISENTPVEKVRGPNLFERTKEEIEALVAAVHDKMEHHSSPRGKEGELHKDSKEHSKADMHKKTHENETHGTSNDISEDTPVSKVKGPGVFERAKEEIEAIVEAIHPKKESDK

SEQ ID NO: 126519 - protein, 121 aa, Triticum aestivum
  unsure (1)..(121): unsure at all Xaa locations
  Clone ID: PAT_TA_20937.pep
MALRGVWQLQKLVVNYCDWGXGSSRGIRAFMEAHLPAFKEKIPHLEVVTELVRGQHPNLKGIYKNHNERVVCVXKFTAXEEILLQATRLRNSLGRKVVKLRTRHVTKRPSVQGTWTTELKL

SEQ ID NO: 126520 - protein, 153 aa, Triticum aestivum
  unsure (1)..(153): unsure at all Xaa locations
  Clone ID: PAT_TA_20938.pep
MVKAVAVLGSSDGVKGTIFFTQEGDGPTAVTGSVSGLKPGLHGFHVHALGDTTNGCMSTGPHYNPASKEHGAPEDENRHAGDLGNVTAGADGVANINVTDSQIPLXTGPNSIIGRAVVVHADPDDLXGKGGHELSKSPGNAGGRVPCGDHDQG

SEQ ID NO: 126521 - protein, 263 aa, Triticum aestivum
  unsure (1)..(263): unsure at all Xaa locations
  Clone ID: PAT_TA_20939.pep
MEDFYETRIXVLDGQLIGLFGVFDGHGVAKVAEYVKHNLXFSHLLRHPKFMSDTKXVAIDDSYKSTXDSEFLESDSTQNQCGSTASTAVLVGDRLLVANVGDSRAYMFRTRNALPVPKDGKPVQTDERHRIEEAGGFVMWAGKWPVGGVLAVSRAFGDKLLKHYVVVDPEIREEIVDDSLEFLILASDGLWDVVSNEEAVVMTRSMQDPDGAATRPCLEAFLRVSRGDTACGVGRLLLGQRSCGPAVCPWPEFFPSSRGVVVR

SEQ ID NO: 126522 - protein, 283 aa, Triticum aestivum
  unsure (1)..(283): unsure at all Xaa locations
  Clone ID: PAT_TA_20940.pep
EAVDLYNKHYKRDDTRIGLAFDVMGRVPYGTSFLDKQAEERSWDINLGWFLEPVVRGDYPFSMRSLARERLPFFKDEQKEKLAGSYNMLGLNYYTSRFSKNIDISPNYSPVLNTDDAYASQEVNGPDGKPIGPPMGNPWIYMYPEGLKDLLMIMKNKYGNPPIYITENGIGDVDTKETPLPMEAALNDYKRLDYIQRHIATLKESIDLGSNVQGYFAWSLLDNFEWXAGFTERYGIVYVDRNNNCTRYMKXSAKWVKESTPRKSPXMKILPSLKIGAHMWVHP

SEQ ID NO: 126523 - protein, 70 aa, Triticum aestivum
  Clone ID: PAT_TA_20941.pep
SDNYEIIETSMPGHTAYDTIDTELTVHEFPKLVLSPVWGEFWLVCNTLGNSPNLIAIPCAPQLDWSCDIC

SEQ ID NO: 126524 - protein, 136 aa, Triticum aestivum
  unsure (1)..(136): unsure at all Xaa locations
  Clone ID: PAT_TA_20942.pep
MATEVAETPAPLAEAVPETPAEAPAAPAAEGXSLAKAKKASAPKKRANPTHPPYAEMISEAVTSLKERTGSSQYAIAKFVEDKHKDKLPPNFRKLLLGQLKKLVAGGKLTKVKNSYKLPARAPAAAKPKAQXQXPL

SEQ ID NO: 126525 - protein, 122 aa, Triticum aestivum
  unsure (1)..(122): unsure at all Xaa locations
  Clone ID: PAT_TA_20943.pep
IANSTKTNSKPIHHQSSVPSPTATICFASSPPSNSSPMRNRLSELNLSMSWRSEQVXAAASEKKCRHHKSVQPIPARALPKNPVFFQPKSASSAAAIKSGLYEAFTTCEISVIDLHEPDSLP

SEQ ID NO: 126526 - protein, 131 aa, Triticum aestivum
  unsure (1)..(131): unsure at all Xaa locations
  Clone ID: PAT_TA_20944.pep
MPINRIALGSHQEVYHPGALKAAFAEFISTLIFVFAGQGSGMAFSKLTGGGPTTPAGLIAAAVAHAFALFVAVSVGANISGGHVNPAVTFGAFLGGNITXFRGLLYWVAXLLGSTWLLLLPLDGGKHGTSG

SEQ ID NO: 126527 - protein, 84 aa, Triticum aestivum
  Clone ID: PAT_TA_20945.pep
SPAEPPSAEPCGRSASSLLVSLRSTRLGSEMESPPLTAEAIAYTEKKMDMALEDIIKMSKKKNPGGKKPPRQPIKKHPFQEWQL

SEQ ID NO: 126528 - protein, 152 aa, Triticum aestivum
  unsure (1)..(152): unsure at all Xaa locations
  Clone ID: PAT_TA_20946.pep
GDDFMFQLFGKYRDMALAVKNPCHLNMAACLIKLKRFDEAIAQCSIVLTEDESNVKALFXRRGKAKSELGQTESAREDFLKAKKYSPEDKEIIRELRLLAEQDKALYQKQKELYKGLFGPSPEAKPKKESTRCVLAMLVHLPFIWLGSTDHE

SEQ ID NO: 126529 - protein, 77 aa, Triticum aestivum
  Clone ID: PAT_TA_20947.pep
RFKAEYPIFDKVDVNGSNAAPIYKFLKSSKGGLFGDSIKWNFSKFLVDKEGRVVDRYAPTTSPLSIEKDIKKLLGSS

SEQ ID NO: 126530 - protein, 133 aa, Triticum aestivum
  unsure (1)..(133): unsure at all Xaa locations
  Clone ID: PAT_TA_20948.pep
DYVVPKGSAINFMLYDLGMDDATWDRPAVFMPERFLPGGEAEALDITGTKEMKMIPFGAGRRICPGLRIALLLLEYFVANLVATFHWKXVEEGDVDVTTEDAQLTXLMGNRSGAACSKNFAANFFHNQGVVCT

SEQ ID NO: 126531 - protein, 131 aa, Triticum aestivum
  Clone ID: PAT_TA_20949.pep
LPKNSVFSPAPGATRLRNEFSTSSWAKPCSGSPRARCPFPLYATACTAVTRRVVCSSRVMKAVRRKSRKVVGKVALGEIAVYAGCTETWSSSAPRVSVGEEGGRQDVRGHGPYTVPIDLAAWASPAHPICP

SEQ ID NO: 126532 - protein, 164 aa, Triticum aestivum
  unsure (1)..(164): unsure at all Xaa locations
  Clone ID: PAT_TA_20950.pep
MASRLLHLRRLITPPSTVPAASFSTAVSATPRVSALVDEICGLTLLEASSLADALRGRLGVDQLPPLAILTGGGAPLVGGGVGPGAAGEEAKAKEEKMAFDVKLEGFDAAAKLKIIKELKAFTNLGLKEARXXVEKXPAVLKAGVPKRRXEISRENPAPAQDCL

SEQ ID NO: 126533 - protein, 195 aa, Triticum aestivum
  Clone ID: PAT_TA_20951.pep
RTARAVAPEPPRSPVSLPFPPCSSLSLSLSLSLSLSLSLGALIISPPSFVYRSNHGCSAFKVYKADLEWFPRKPLLFPTSRGVLHLDCFLRWQEGFQGGTDSEVQTIQCSSSNTSKAGRGLAVRRRCRTLAGGVRGPRRGGFPAVCVPPVSPSETAHELVPFSVVRPVRHSVCLDAWVAMPCSLVGVPIVGAILD

SEQ ID NO: 126534 - protein, 110 aa, Triticum aestivum
  unsure (1)..(110): unsure at all Xaa locations
  Clone ID: PAT_TA_20952.pep
MKMRAHTHKRSHQTDTNAFLTCVHISTAFYSAVGVPHGHISTMMDAHALQAELAAAADSLEAALTGLEAAEAAARSEQACIXAALLLMALLHMIVVGHVLPTGRIIHPAH

SEQ ID NO: 126535 - protein, 132 aa, Triticum aestivum
  unsure (1)..(132): unsure at all Xaa locations
  Clone ID: PAT_TA_20953.pep
MLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNLTAVLGAXEKADEFKKGVEGCNQFLLNKLKDSNFCW

SEQ ID NO: 126536 - protein, 215 aa, Triticum aestivum
  unsure (1)..(215): unsure at all Xaa locations
  Clone ID: PAT_TA_20954.pep
MSPFGAVITPETLKYMSKYQGREITQVDCAREAMRLIHAEDKNLKAEDSAWELKKKFGNGVSTMVLVYNATGASLSLVDDGKDWMGSVYSSPIPDTFHNGQWIAFLHVKPGSLAQGSQAARVFRGRDVDGRTRDFVVAWXIPWDNIPTRAYTEIGSNKNFESRXNVRHKGLRGTGKVVMVKGXHRAITLSIGGYTTAFCIAVLQHQFQPLPEERE

SEQ ID NO: 126537 - protein, 112 aa, Triticum aestivum
  unsure (1)..(112): unsure at all Xaa locations
  Clone ID: PAT_TA_20955.pep
MGVYTFVCRNNGGEWTAKQHSGEIEASAATPYELQRRLVAAASAADSAYGVQSSFSMVTPSSAVFQVIVGAVGGGAMMVSGGXGGGGAAASGGAAAELRXGEKKEEEKEXXD

SEQ ID NO: 126538 - protein, 230 aa, Triticum aestivum
  unsure (1)..(230): unsure at all Xaa locations
  Clone ID: PAT_TA_20956.pep
MADQANQPTVLHKLGGQFHLRSIISEGVRARNICPSVSSYERRFATRNYMTQSLWXPSMSVSGGINVPVMQTPLCANAPAEKGGKNFMIDFMMGGVSAAVSKTAAAPIERVKLLIQXNQDEMIKSGRLSEPYKGIVDCFKRTIKDEGSLPLWXRGNTANVIRYSXQALNLAFKXDYFKRLFNFKXKDKDGYWXWFAGNLASGWCCWCSPCFCVPWTPKTRWLMTQSSKEE

SEQ ID NO: 126539 - protein, 79 aa, Triticum aestivum
  Clone ID: PAT_TA_20957.pep
STPLWSVSATPNLRRKLHGRTPHKGHYGALSALVMSSHLQMFLTCAAISPSASQIYPCRSINVGRRVQLVAVAQWLSMH

SEQ ID NO: 126540 - protein, 115 aa, Triticum aestivum
  unsure (1)..(115): unsure at all Xaa locations
  Clone ID: PAT_TA_20958.pep
MATGSEASKAAEAVVDWHKHDSKRMLHAVYRVGDLDRTIKYYTECFGMKLLRKRDVPDEKYTNAFLGXLGQENTNFAIELTYNYGVDKYDIGTALAFAIANDDVYKLTENSNPGW

SEQ ID NO: 126541 - protein, 156 aa, Triticum aestivum
  unsure (1)..(156): unsure at all Xaa locations
  Clone ID: PAT_TA_20959.pep
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNXCAIHAKRVTXMPRTSAPRRIRAKRLTPSLLCSFLPILTRKLRLGNL

SEQ ID NO: 126542 - protein, 134 aa, Triticum aestivum
  Clone ID: PAT_TA_20960.pep
SAKRSKAEAQEALQEIDAMKKIAVGKAFYMQSKHVKVNYQLLTRIRSSPGAFADLPRSVLDAAQFYQAEEGSSTEKLFWSQYTGTKHPMPLSDQLKQLVELHKAAEQAMKGLIVRLWPGDAFPNSYFGLVRQLV

SEQ ID NO: 126543 - protein, 104 aa, Triticum aestivum
  Clone ID: PAT_TA_20961.pep
MVLWELTAITAYFLGLRRTYRLALRIQRRLIPPNHPRIRDFVYRRTRDVFNVAVSVHKNIQQERHRGPAARLGSPSLRWLGGSPLYAASPRPRAKFYGKIFFKP

SEQ ID NO: 126544 - protein, 150 aa, Triticum aestivum
  unsure (1)..(150): unsure at all Xaa locations
  Clone ID: PAT_TA_20962.pep
PAARVTPGSNHTDIPAVSAAYGSGGWLSAGATYYGAPNGDGSDGGACGYQTAVGQRPFSSMIAAGSPSLFKGGKGCGACYEVKCDSNPACSGQPATVVITDECPGGVCLAEAAHFDMSGTSMGAMAXPGMADRFARRISNQVKRCLQVSA

SEQ ID NO: 126545 - protein, 146 aa, Triticum aestivum
  unsure (1)..(146): unsure at all Xaa locations
  Clone ID: PAT_TA_20963.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDXNLCAIHAKRVTSCXKDIQLARRAPGERANAQTFCHNAP

SEQ ID NO: 126546 - protein, 166 aa, Triticum aestivum
  unsure (1)..(166): unsure at all Xaa locations
  Clone ID: PAT_TA_20964.pep
FXXXVXIWPRSWRSSYLFFXGELISCHPPKXEMIVFFHRTYVALQDSTDPPSRRGEKKRKRGREKKASIFATSAATIVELEAAGRPAGEGHGEEEDDEVEEDDDELHLEHGEEELHHEHQQQRVEYDRYGHLQGLHCRRRRRPDHQQSKLSSLEWRLVKATRFPLQ

SEQ ID NO: 126547 - protein, 134 aa, Triticum aestivum
  Clone ID: PAT_TA_20965.pep
MTPQAQRIISYFASAAGTPQSEDCLTLNIWSKATPNSARANKPVLVFFYGGRFAIGNTDSPFYNGKYFADAEDIVVITVNYRINIFGFPGAPGETKNLGCATNDCCRWVRDNIWRFGGTFQETRWQLWRLAGYG

SEQ ID NO: 126548 - protein, 158 aa, Triticum aestivum
  unsure (1)..(158): unsure at all Xaa locations
  Clone ID: PAT_TA_20966.pep
MAEQHKEESGVTVLDKISDKLHGRGGGSSSSSDSDDERSSATAAVKAKIYRIFGREKPVHSVLXGGGKPAVLFLWEEQEVSGWGCSAGATAFLXLLFXVMDYNLLNLLXHCLILTLGILFPRPCSLFSSPSPPQVPPRLPNCPALISLPVALSEGLPP

SEQ ID NO: 126549 - protein, 167 aa, Triticum aestivum
  unsure (1)..(167): unsure at all Xaa locations
  Clone ID: PAT_TA_20967.pep
QFIGTKHTHPLFGDGHARMTCPSYSFYRFDSQPMWGASATVSTKMRTRLGRKSMVTGVPTGSTTMSASGLSHRITLLASSRLSPTTSGQDFLAPSSPPVELMVLGCRWRTERARVSVRERARESESARDRETYRPRRLPGPLLXPXKPLPRRXTXAXVPQXXXKXXP

SEQ ID NO: 126550 - protein, 75 aa, Triticum aestivum
  Clone ID: PAT_TA_20968.pep
FTRQCGCCGDLVEDEERREHLEAACDLATHYLCHPCALCQEGRELRRRVPHPGFNNGHSVFVMMPPMEQTMGRGM

SEQ ID NO: 126551 - protein, 150 aa, Triticum aestivum
  unsure (1)..(150): unsure at all Xaa locations
  Clone ID: PAT_TA_20969.pep
AAKGFLRRLVGNPGFXVRRXNDARXRAYTTHIGELVPAPPRFFFFFSLYLSSNPGPTRNWRNPTATVKTDGSVGRSAQDRTHLRKGGVEKEPLLATNLTTTSTLLELEPNRRRNSRSEARDLKGHGSLAVCSRKKTEPGRTEEDERVEVE

SEQ ID NO: 126552 - protein, 125 aa, Triticum aestivum
  Clone ID: PAT_TA_20970.pep
MGAKIFCLLMLLGLSASGATATIFPQCSQAPIASLLPPYLSPAVSSVCENPIVQPYRIQQAIRSRPFSLYPLFPPKTHSPILQLSFGAFSWHKTSRAQQLQQLAASQPSSADSSKAHPFSSIQPN

SEQ ID NO: 126553 - protein, 147 aa, Triticum aestivum
  unsure (1)..(147): unsure at all Xaa locations
  Clone ID: PAT_TA_20971.pep
SXSLYAIXPSLPKFLTXSSYFRIXKHSRHXIXLCXVAVVVGXDRRXPLVXRLXADSGPXXPSARTRTCPPCGGCSDGGGGGGGGRFPMSWSLSRRRIPCYPCRRRRRQLGTAPCSAGGSRGDSRDKRPRCPDALAVAASVQRRLLST

SEQ ID NO: 126554 - protein, 89 aa, Triticum aestivum
  Clone ID: PAT_TA_20972.pep
MAQQQTNPEEVVLGQEVGAARVATLNRPRQLNGISDRVVYLLAQFLEKWEKDENAKFVIFKGAGRAFSAGGDLKMFYEGKSNDSWGAPP

SEQ ID NO: 126555 - protein, 154 aa, Triticum aestivum
  unsure (1)..(154): unsure at all Xaa locations
  Clone ID: PAT_TA_20973.pep
MSSLLLLQALAPAMTVPRHHFLISPLRLASAATVPFARRFSNAASSNKPEPLLSEPDLESGLYLVSTPIGNLEDITLRALRVLKCANVILSEDTRHSGKLLQHYNIKTPLLSFHKFNEREREPTILRRLXEGEXVALISDAGTPGISDPGIGLA

SEQ ID NO: 126556 - protein, 138 aa, Triticum aestivum
  unsure (1)..(138): unsure at all Xaa locations
  Clone ID: PAT_TA_20974.pep
MAKNYPTVSAEYSEAVEKARRKLRALIAEKSCAPLMLRLAWHSAGTFDVSSRTGGPFGTMKCPAELAHGANAGLDIAVRLLEPIKEEFPTLSYADFYQLAGVVAVXVTGGPEIPSTRQEDKPQPPTEGRLLIHKGSDN

SEQ ID NO: 126557 - protein, 87 aa, Triticum aestivum
  unsure (1)..(87): unsure at all Xaa locations
  Clone ID: PAT_TA_20975.pep
MSSSARFDLRASSHQLQPPPSHASMSSDGGAFANAENREHCARYLNQTLVTFGFPASLDLFATDPVSIXRTCNCIYXLLQQRQRDFV

SEQ ID NO: 126558 - protein, 220 aa, Triticum aestivum
  unsure (1)..(220): unsure at all Xaa locations
  Clone ID: PAT_TA_20976.pep
FVPISGFEGDNMIERSTNLDWYKGPTLLEALDQITEPKRPSDKPLRLPLQDVYKIGGIGTVPVGRVETGVIKPGMVVTFGPTGLTTEVKSVEMHHEALQEALPGDNVGFNVKNVAVKDLKRGFVASNSKDDPAKEAASFNSQVIIMNQPGQIGNGYAPVLDCHTSHIAVKFAELITXIDRRSGKDLRRSKVLKNXDAGMVKMIPQAMVVENPRYLPWKLR

SEQ ID NO: 126559 - protein, 123 aa, Triticum aestivum
  Clone ID: PAT_TA_20977.pep
MATIVNTTEEEPMLAVVRFTAELAWADAGPEVADPEVTRLCLEAQEHILAGRWLDMASLMLASADLLLTSPSRVSDKDLECVLSVICSFVTKAGSEDQALRSPNHCAKSPATRDKQAGLKFFS

SEQ ID NO: 126560 - protein, 83 aa, Triticum aestivum
  unsure (1)..(83): unsure at all Xaa locations
  Clone ID: PAT_TA_20978.pep
XKPSALMRASDCXILNRGCTLWALCALWHIFTSIRSRLGCSTRRGGEAEGEPGWAGRTQSTGGRNGGGDADAQVCNQCMCPND

SEQ ID NO: 126561 - protein, 213 aa, Triticum aestivum
  unsure (1)..(213): unsure at all Xaa locations
  Clone ID: PAT_TA_20979.pep
GARRRRGCRQRAPPRGAAPPPARPPGARGVETLVKALCAPALGARHARRGFFAPKPSSGPHKSRECLPLILIIRNRLKYALNYREIISTLMQPHVLVDGKGRTDKTYPAGFMVVISIPXTMENYRLLYDTKGRFRLHPIXRHEDAKCNVGKLSSIHFXQKGIPISDHMQRLHYPLPAPLINCLTTIKATTQQDHLGQQDMWSHSSVRNSHGTA

SEQ ID NO: 126562 - protein, 154 aa, Triticum aestivum
  unsure (1)..(154): unsure at all Xaa locations
  Clone ID: PAT_TA_20980.pep
MRECISIHIGQAGIQVGNACWELYCLEHGIQADGQMPGDKTIGGGDDAFNTFFSETGAGKHVPRAVFVDLEPTVIDEVRTGTYRQLFHPEQLIXGKEDATNNFAXRGHYTIGKEIVDLCLDRIRKLADNCTGSQGSSSERRWWRNGPPGLAPPP

SEQ ID NO: 126563 - protein, 111 aa, Triticum aestivum
  unsure (1)..(111): unsure at all Xaa locations
  Clone ID: PAT_TA_20981.pep
LLRDWYGPPGGKPRRSCXDGGGRWLGILGEPVQQAQNNGGCILVNGCIRXVDETTVGIGVRALSSHPMKANKKGMGEXHVPVNIAGTRICDGEWLYADPDGILVSRTELTV

SEQ ID NO: 126564 - protein, 125 aa, Triticum aestivum
  unsure (1)..(125): unsure at all Xaa locations
  Clone ID: PAT_TA_20982.pep
MAEQEAPVVVEAPTPVLGEPMDLMTALQLVMKKSSAHDGLVKGLREAAKAIEKHAAQLCVLAEDCDQXPDYVKLVKALCAEHNVHLVTVPAAXKTLGEWAGLCKIDSEGKARKVVGCSCVVVRTT

SEQ ID NO: 126565 - protein, 72 aa, Triticum aestivum
  Clone ID: PAT_TA_20983.pep
MTRGNQRDRDRERAAARKPNAKNSQDGLTPEQRRERDKKALEEKAAKKAQQAAAGGTGTSTDNNKNKAGGKK

SEQ ID NO: 126566 - protein, 177 aa, Triticum aestivum
  unsure (1)..(177): unsure at all Xaa locations
  Clone ID: PAT_TA_20984.pep
PFQTTHSLPNLSTLCTLXSLLXQGXSVHHIEPFHKYFARCPRDKLSGRVKKKPGREPAHPSRRDGTGTPPPSAGFASGTAGKAGGDAVRETARSETTGATVAMGGGDGAEPAGEQRTSDLPRDGNTAFPEPRGDVLGLGVCSSSAVSGGDRRRSGGAGGAVDELGQADSAAKQAQIQ

SEQ ID NO: 126567 - protein, 325 aa, Triticum aestivum
  unsure (1)..(325): unsure at all Xaa locations
  Clone ID: PAT_TA_20985.pep
MPSSAQVLLCLAAVLAAAAATTAEAHSQCLDNPPDRSIHGRQLAEAGEVVHDLPGGLRAYVSGAASSSRAVVLASDVFGYEAPLLRQIADKVAKAGYFVVVPDFLKGDYLDDKKNFTEWLEAHSPVKAAEDAKPLFAALKKEGKSVAVGGYCWGGKLSVEVGKTSDVKAVCLSHPYSVTADDMKEVKWPIEILGAQNDTTTPPKEVYRFVHVLRERHEVQHHRPFRRQDRRDGPRLHGQLGQQAPQLNQACTAPTRLNSINHCSAVIFCFDSWLPRLXFVMAKTSTTVISFIFCLFKLSVFFFLLFMIAIKFSRGIPLLFASKKK

SEQ ID NO: 126568 - protein, 127 aa, Triticum aestivum
  unsure (1)..(127): unsure at all Xaa locations
  Clone ID: PAT_TA_20986.pep
MAMDPDAVAKAFVEHYYRTFDTNRAALVGXLTRETSMLTFRGPEVPGAPPPLPGKLGSLPFQACEHQIVTVDCQPSGPQGGMLVFVSXGSIRTGPEEHPIKFSQAFHLLPAAGSFFVKNDMFRLNYG

SEQ ID NO: 126569 - protein, 91 aa, Triticum aestivum
  Clone ID: PAT_TA_20987.pep
RTRGLNQLRGIIYDYDVPSLIFVCFLPDLIKLLQSLSYSSDAERENTGQSVDVISLKVCICNYQRGLLFDDVGACLCEMPKHSYFLIYLEL

SEQ ID NO: 126570 - protein, 163 aa, Triticum aestivum
  Clone ID: PAT_TA_20988.pep
MQWPPPTRWTHEIESPVAAARLFRAGVMDWHTLGPLSSHRTSSPGAHPVEGEGGIGSVRQFNFTSAMPFSLMKERLEFIDADKCECKSTLIEGGGIGTAIETTTSHIKVEPAANGGSVVKVESTYKLLPGVEVNDEITKAKESVTAIFKAAEAYLVANPDAYN

SEQ ID NO: 126571 - protein, 168 aa, Triticum aestivum
  unsure (1)..(168): unsure at all Xaa locations
  Clone ID: PAT_TA_20989.pep
MAAAGPGLYSEIGKKARDLLYKDYHTDQKFTLTTYAANGAAITAASTRKDEAIFNEIQXSQRKHNNVTVDVESNFKNQMLITTITVHXLGTPGLKXILCVPFPLPESAKLTPVFAQHAGVAAXVGLNATLLLLSGFAAKYCAAGRAAFVPAGAYHMSGAELPCTGNAF

SEQ ID NO: 126572 - protein, 164 aa, Triticum aestivum
  unsure (1)..(164): unsure at all Xaa locations
  Clone ID: PAT_TA_20990.pep
MADSKATSAVTLRTRKFMTNRLLARKQFVLEVIHPGRANVSKAELKERLAKMYEVKDPNTIFVFKFRTHFGGXGSPLAFGLIYDNLESAKNFEPKYRLIRNGLATKVEKSRKQMKERKNKXKKIRGVKKTSLVTQEELTSLIRIRLTLGGLYPCIMGLLVPQHY

SEQ ID NO: 126573 - protein, 65 aa, Triticum aestivum
  Clone ID: PAT_TA_20991.pep
PLTCISLFFYCILSKVLHGYHDQILEDWTSTFFSYPPSLILYGFLKKKGGPGTQFRPIVSRITRA

SEQ ID NO: 126574 - protein, 207 aa, Triticum aestivum
  unsure (1)..(207): unsure at all Xaa locations
  Clone ID: PAT_TA_20992.pep
PFEALHGVPLVHESTKLLDEELDRVVEEGVAAHDNLAIGTVIRECGADVFSGLRSLTYCCGRLGNASAAAIVKAFPDIKCTVLNLPRVVEETTTKTITIPPAQAVMLKXVLHFWSDDDCVKILELCXEAIPSRQEGGKVIIIEILLGPYMGPVMYEAQLLMDMLMMVNTKGRQRGEDDWRHIFTKAGFSDYKVVKKIGARGVIEVYP

SEQ ID NO: 126575 - protein, 64 aa, Triticum aestivum
  unsure (1)..(64): unsure at all Xaa locations
  Clone ID: PAT_TA_20993.pep
MEHLTTHLHXPRTTRSPLSFWGDGGIVPFEPFFHAFPGGLEKAAINRTFLILPSFQEEREILFP

SEQ ID NO: 126576 - protein, 81 aa, Triticum aestivum
  Clone ID: PAT_TA_20994.pep
RSPASKLNHHRSRSRVRAHPFLFRRASCCQAKSLGGNEQPHSARRQTPFQLRVPTIHKVVIASWVNPPRMPLVFQLNYLLR

SEQ ID NO: 126577 - protein, 65 aa, Triticum aestivum
  Clone ID: PAT_TA_20995.pep
GNLTLLGSAANLIVCEQARRAQFFGYNLTFWSHLRFGVPSTIIVTAIGFAHPSSSYWKQLKAEER

SEQ ID NO: 126578 - protein, 190 aa, Triticum aestivum
  unsure (1)..(190): unsure at all Xaa locations
  Clone ID: PAT_TA_20996.pep
MAPLLAAAMNHAAAHPGLRSHLVGPNNESFSRHHLPSSSPQSSKRRCNLSFTTRXSARVGSQNGVQMLTPSXEIPQRDWXFPSDFTFGXAATSAYQIEGAWXNEDRKGGNATGNHFCHSHPXERILGREQFKTLGATAYNMFKTXSRLLKEMGMDAYRSRLLDQNTPKGTKKQDYPMDQYYRTHNCAANG

SEQ ID NO: 126579 - protein, 146 aa, Triticum aestivum
  unsure (1)..(146): unsure at all Xaa locations
  Clone ID: PAT_TA_20997.pep
SFLSVPGLLQLFLRARPVLQRRGAFAGRVRVRAEGARGGNSXVVSMRDGQDVADEFRGVPLWWSSVVTAEREEVAWERSRLLRSVLGRRRGGSQRRMRRRWYEASATPSRRPTAAIGEGEFWRQERDAGSLRVTAWADPESETRRG

SEQ ID NO: 126580 - protein, 137 aa, Triticum aestivum
  unsure (1)..(137): unsure at all Xaa locations
  Clone ID: PAT_TA_20998.pep
RKSSEEATPKVVAFSPLEAAIAKPRSSPLTSESSKVRRSEIATQVTFYMIPALLLASKNSISTSLLXVGAVFHQVYMFHKEILXWDYVHHDITRKWAWIYFKLLLLVDGERTPSCSSIRSKPLLPSPHPYSPRPCSR

SEQ ID NO: 126581 - protein, 111 aa, Triticum aestivum
  Clone ID: PAT_TA_20999.pep
STHTNTYDFFEDLLHQQLSTCLPALAATTRPLPAAPAALAASTKFPLPSPTTLGHDYHTRRPLRAMLPGYDTGGHQMRAQASKSGRTGTMERKERNMRHASDGLGTAKFRW

SEQ ID NO: 126582 - protein, 171 aa, Triticum aestivum
  unsure (1)..(171): unsure at all Xaa locations
  Clone ID: PAT_TA_21000.pep
MASKSTMRSLVLIMGLLLLSCSGMSSAARLLEEMAPKEEYPHPEVPELPKPELPPHPTVPELPKPDELPPHPVVPELPKXEVPVHPAVPELPXPEIPPHSTVPELPNPRSGVPNLRCLTPAVPDCRTRLLLTHVPELQSRVPDCKPGRCPPRARSEFSSSGKNGGGVTPVG

SEQ ID NO: 126583 - protein, 85 aa, Triticum aestivum
  unsure (1)..(85): unsure at all Xaa locations
  Clone ID: PAT_TA_21001.pep
CKPWDDETDMKKXEEAVRSVQMXGLTWGASKLVPVGYGIXKKMTIMLTIVXDDLVSIDTLIEDHLTQEPINEYVQSCDIVAFNKI

SEQ ID NO: 126584 - protein, 94 aa, Triticum aestivum
  Clone ID: PAT_TA_21002.pep
MAQQKNAHVPKFGNWDSDGNVPYTLFFENARKGKGAGAAGGRMINPNDPAENPEAFSVAAPSPPPGRHARPSDPPPPMSPNAYYPPGRRTPRRR

SEQ ID NO: 126585 - protein, 223 aa, Triticum aestivum
  unsure (1)..(223): unsure at all Xaa locations
  Clone ID: PAT_TA_21003.pep
MAPSGWRRSAAARVAWRPATVCLWLALAAAALTLAQAKKDLTEVTHKVYFXDIEIDGKPAGRIVMGLFGKTVXPKTAENFRALCTGEKGFGKSGKALHYKGSKFHRIIPSFMLQGGDFTLGDGRGGESIYGLKFADENFKIKHTGPGLLSMANAGRDTNGSQFFITTVDNNXWWDGKHVVFGQGVVLEWMXVFKAEAEGRQSGDPKSKXVIADSRRAAHVTAC

SEQ ID NO: 126586 - protein, 127 aa, Triticum aestivum
  unsure (1)..(127): unsure at all Xaa locations
  Clone ID: PAT_TA_21004.pep
MRGWGLLVLSLHVLSCLVSGVASGRTSSYVRTEFPSTDIPLESEWFAIPKGYNAPQQVHITQGDYDGKAVIVSWVTPEEPGPSEVFYGKEKLYDQKAEGTTTNYTFYDYKSGYIHHCLVDGXEYNTK

SEQ ID NO: 126587 - protein, 191 aa, Triticum aestivum
  unsure (1)..(191): unsure at all Xaa locations
  Clone ID: PAT_TA_21005.pep
LKFVPSRQGRNRAAKERRRWLVRSRPPASPPGAPQLAPARQRRKSPPNGTERLLRPTRPPPRSPGAKAPASRLATKAARKSAPTTGGVKKPHRYRPGTVALREIRKYQKSTELLIRKLPFQRLVREIXAQDFKTDLRFQSHAVLALQEAAEAYFVRLFEDTNLCAIHAKRVTIMPKDIHPRPPQPPAARGA

SEQ ID NO: 126588 - protein, 186 aa, Triticum aestivum
  Clone ID: PAT_TA_21006.pep
FFFTASPAGPGGEGRGGREGSSTGFGECTFGLGASSSPGYVQAPRASEAKQGREGQRGSKINRSSCALSPATAAKNGQQAAESLCSARLSPKRSLRAHADGSGRCREQERTRRRRIWGRRFAAAASAGACASSRVSDSRLGKSGSGAGAAGREVGAGLGAELSQPRWGDGQERERERKRACETTKK

SEQ ID NO: 126589 - protein, 130 aa, Triticum aestivum
  Clone ID: PAT_TA_21007.pep
LSPLQSPFGGLLTDHQDCLLISKGKSSGRSMCLSVLLSSDWTTHSISDFDDAPQVIVRRRRGGGRRGLRRPGSGGRWSPPSMRWPQGDGGGGERAPRNRDRGGQERREERKRWKRRGVGAELRGTPATWP

SEQ ID NO: 126590 - protein, 99 aa, Triticum aestivum
  Clone ID: PAT_TA_21008.pep
MSGAGEEDKKPAEGGAHINLKVKGQDGNEVFFRIKRSTQLKKLMNAYCDRQSVDMNAIAFLFDGRRLRGEQTPDELEMEDGDEIDAMLHQTGGSVPSTT

SEQ ID NO: 126591 - protein, 210 aa, Triticum aestivum
  unsure (1)..(210): unsure at all Xaa locations
  Clone ID: PAT_TA_21009.pep
MLRHAARRLVSRTAAAPTARRALVTAEVPAEAAEDSTFVEAWKKVAPNIEPPTTPLFLMQPRPPTPATIPTKLTVNFVLPYKSEIANKEVDMVIVPTTTGXKMGVLPSHVATIAXLKPGVLSVHEGNDVTKYFVNSGFAFVHANSMADIVAVKVVPVVNFPTTSYPDHSHGIYSQPRLRPLVNWIRRTLSTLWYQCGLMVTTKISPNSFD

SEQ ID NO: 126592 - protein, 199 aa, Triticum aestivum
  unsure (1)..(199): unsure at all Xaa locations
  Clone ID: PAT_TA_21010.pep
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEXEKQFAAEEISSMVXLIKMREIAEAYLGSTIKNAVVTVPAYFNDSQRQATKDAGGIAGXNVLRIINAXTAAAIAYRLENNVYRRA

SEQ ID NO: 126593 - protein, 241 aa, Triticum aestivum
  unsure (1)..(241): unsure at all Xaa locations
  Clone ID: PAT_TA_21011.pep
MATKIFSLLMLLALSACVANATIFPQCSQAPIASLLPPYLPSMIASVCENPALQPYRLQQAIAASNIPLSPLLFQQSPALSLXVQSLVQTIRAQQLQQLVLPVINQVALANXSPYSQQQQFLPFNQLSTLNRAAYLQQQLLPFSQLATAYSQQQQLLPFNQLAALNPAAYLQQQILLPFNQLAAASRASFLTQQQLLPFYQQFAANPATLLQLQQLLPFVQLALTNPAASYQQHIIGGALF

SEQ ID NO: 126594 - protein, 247 aa, Triticum aestivum
  Clone ID: PAT_TA_21012.pep
MSSVQEELNNTQDMLQGYVELYNYSLSYVKTMAIGCAIQLGIPSAIHRRGGAATISDIITETGVDPSKLPYLRRLMRVLTVSSILATTGTDETETESDDSTVYKLTPASRLLVSGAGAPTSCDISPMLDLLMRPTTSVATYFSLEEWFKDAGRHPPRSSRWAHGMSPWSLTKNDALYNKTLNDGCAGGQHLPPWTRPLRDPPPPGIFRAVPSPVHFGGAQRRRCDGIPKASRNPGAAPKGGGPVPIL

SEQ ID NO: 126595 - protein, 170 aa, Triticum aestivum
  unsure (1)..(170): unsure at all Xaa locations
  Clone ID: PAT_TA_21013.pep
MAIKRTKAEKKIAYDKKLCSLLDEYTKVLIALADNVGSKQLQXDIRRGLXRGDSVVLMGKXNTLIKRCIKVYAEKTGXHTFDPLMDXLVGNLGLIFTKGDLKEVPQEVPKYKVGAPARVGLVAPLHVVVPLEHGWSAQTSLKSQQPQHDWTVQGILPSFDGKGDPPPQYI

SEQ ID NO: 126596 - protein, 86 aa, Triticum aestivum
  unsure (1)..(86): unsure at all Xaa locations
  Clone ID: PAT_TA_21014.pep
AKWYRAPPLGPQXVHDGLKEVAPTHMLALQLPEXTRIIYGGSVNGANXCKELAAQPDVDGFLVGGASLKPEFVDIIKSATVKSSSA

SEQ ID NO: 126597 - protein, 130 aa, Triticum aestivum
  unsure (1)..(130): unsure at all Xaa locations
  Clone ID: PAT_TA_21015.pep
MSWQAYVDDHLLCDIEGQHLSAAAIVGHDGSVWAQSXESFPELKPEEVAGIIKDFDEPGYSCTNWLFSVGGTKYMVIQGEPGVVIXRGKKGTGGITIKKTGMSXLLLAVYDEPMTPRQCSWGVGEALAIT

SEQ ID NO: 126598 - protein, 224 aa, Triticum aestivum
  unsure (1)..(224): unsure at all Xaa locations
  Clone ID: PAT_TA_21016.pep
MSKLQSESVKDAISQIVGDAKEKNRKFTETVELQIGLKNYDPQKDKRFSGSVKLPHIPRPKMKVCMLGDAQHVEEAEKMGLDYMDVEALKKMNKNKKLVKRLAKKYHAFLXASEAIIKQIPRLLGPGXLNKAGKFPTLVTHQESLGGGPGAPFASVNFLRRSVAAWVSPVAXXXMEEKQSTDIQMXSTPCSLLKKTAELNALLKTHGERGSISPLSASPDQVYE

SEQ ID NO: 126599 - protein, 82 aa, Triticum aestivum
  Clone ID: PAT_TA_21017.pep
MSCCGGNCGCGSGCKCGNGCGGCSKMYPDMAEQVTTTTQALIMGVAPSKGHAEGGFEAAAGAENGGCKCGGNCQCDPCNCGK

SEQ ID NO: 126600 - protein, 76 aa, Triticum aestivum
  unsure (1)..(76): unsure at all Xaa locations
  Clone ID: PAT_TA_21018.pep
LFMPLRVLLTGKLHGPAMDSTVILVHKAGTSGXVAPQSGFVXLAERFKIXLKEVDWESLQKQQESXPVESAVPAAS

SEQ ID NO: 126601 - protein, 250 aa, Triticum aestivum
  unsure (1)..(250): unsure at all Xaa locations
  Clone ID: PAT_TA_21019.pep
QRYAGNQERIQLETARLYRQAGVNPLAGCFPTLATIPVWIGLYQALSNVANEGLLTEGFFWIPSLGGPTTIAARQSGAGISWLFPFVDGHPPLGWYDTICYLVLPVLLVASQYVSMEIMNPPQSDDPSQKNTLLVLKFLPFMIGYFSLSVPSGLSIYWXTNNVLSTAQQVWVRKMGGAKPVVSEGDRRIITAGRAKRSNAQPXGERFRQAKRRGEHEKINKHRCRRPNASSSTYDMEDEDPVTDKEGPGT

SEQ ID NO: 126602 - protein, 103 aa, Triticum aestivum
  unsure (1)..(103): unsure at all Xaa locations
  Clone ID: PAT_TA_21020.pep
MXGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 126603 - protein, 225 aa, Triticum aestivum
  Clone ID: PAT_TA_21021.pep
MAVKDCGGHKGCECERERLYRRCCAAVVALILLVLFIVLVVWLVLRPHKPRFYLQDLSVLCLNVTPPASTYLFTTMQATVAARNPNERVGVYYDQADAYAEYKGVAITVPTRLPVQYQGPRDASVWSPFLRAPEGGVQLPPQLAVALAQDETAGYVLVDVRVDGWVRWKVGTSWIFGSLTTSASTAPRCSTVNDGKGQLTAPTTGGGTGYFRFQAGGIRRKLNSL

SEQ ID NO: 126604 - protein, 75 aa, Triticum aestivum
  Clone ID: PAT_TA_21022.pep
NSLTRVITTRAEVDLKLIKEAYQKRNSVPLERAVAGDTSGDYESMLLALLGAGVMSRTGCAGAFLTGAVVFVRDS

SEQ ID NO: 126605 - protein, 157 aa, Triticum aestivum
  Clone ID: PAT_TA_21023.pep
MEAAERGGGALPLAVRELIAGGVAGGVARSAVAPLERVKILLQTRRAEFRGSGLVGSFRTIYQTEGPLGFYRGNGASVARIVPYAALHYMAYEEYRRWIILGFPNVQQGPVLDLVAGSIAGGTAVVSTYPLDLVRTKMAYQLQVKDAVNLSLRVPSE

SEQ ID NO: 126606 - protein, 183 aa, Triticum aestivum
  unsure (1)..(183): unsure at all Xaa locations
  Clone ID: PAT_TA_21024.pep
MSRRKTREPKEENVTLGPTVREGEYVFGVAHIFASFNDTFIHITDLSGRETLVRITGGMKVKADRDESSPYAAMLAAQDVAQRCKELGITALHIKLRATXGGNKTKTPGXGAQSALKALARSGMKIGRIEDVXPVPTAKSQKRGGREGWRPPLISLAVANNVGASFANTYFGSLPTFRFRMPI

SEQ ID NO: 126607 - protein, 143 aa, Triticum aestivum
  unsure (1)..(143): unsure at all Xaa locations
  Clone ID: PAT_TA_21025.pep
ATSRDAPIQGQRRPLRQTPPPRVGPLLCFIQGLLRGKSPPPASAPPPNCDSTKGLGGPRVCQLCGSRWGTGPRSVTKRFQRGFLGPPAMTGKVHATLLRQVPMADRPPPQKPQGHTQSYFHGSSRVHGLWGRQSPSPGWGXXS

SEQ ID NO: 126608 - protein, 141 aa, Triticum aestivum
  unsure (1)..(141): unsure at all Xaa locations
  Clone ID: PAT_TA_21026.pep
MASIAGSSALSFARPVKAINTNSLAFSPARKGNTFLRLQPMPMRSVSCAAKKDTTDKVCEIVKKQLXLPDHTEVCGESKFSELGADSLXDTVEIVMSLEEHFDISVEESSAQTIATVEDXADLIDKLVAGKAYFCTSSPLS

SEQ ID NO: 126609 - protein, 152 aa, Triticum aestivum
  unsure (1)..(152): unsure at all Xaa locations
  Clone ID: PAT_TA_21027.pep
MASSLVLIAAALLALASSWQQAIAYDPSPLQDFCVADKNSPVRVNGFPCKDPMAVTPDDFFNAAMIIDKRRDTNNKVGSNVTNVNVESFPGLNTLGISLARIDYAPLGVNRRNQPRATELLTVLEGTXYLGFVTSNPTLSQGGQKRLSSSKA

SEQ ID NO: 126610 - protein, 96 aa, Triticum aestivum
  Clone ID: PAT_TA_21028.pep
LSLPLLRFHPWAVRYYSPCWPLLCSHACFHIQAPAPRPRRHSGNPIHAGRRPLTCCCWLQRPQAKVVIAFRQPVSLGKRRRGEARRRPRPAPAVPH

SEQ ID NO: 126611 - protein, 63 aa, Triticum aestivum
  Clone ID: PAT_TA_21029.pep
VAYDQTHDHQCLTDNSIVSQASKSKQSSTTKTRENKSKLSLSLSKPMIYTFFSPFGSKLPKSS

SEQ ID NO: 126612 - protein, 202 aa, Triticum aestivum
  unsure (1)..(202): unsure at all Xaa locations
  Clone ID: PAT_TA_21030.pep
NAEEIETYQRYKYPTMSKTQGNFKLTVVEGEFTDSQIVVMLGENGTGKTTFIRMLAGLLKPDTVEGTDIEIPEFQCVXYKPQKITPKSQNTXRHLAASKKFRDSLYASAVCVLMWMKPLANXNNSMDQEVVNLSXGESSQRVAICLRLGEPADTYXLIDEPSAYLDSGQRIVASKVTKSHPHXKKRIMLACSHGNILLQGML

SEQ ID NO: 126613 - protein, 64 aa, Triticum aestivum
  Clone ID: PAT_TA_21031.pep
MGWLRSLFSPLRKIMVRAHSARKYRRGMRILYKDVKSCEDEDVHVLWSILVDSHRHPAMVKLKL

SEQ ID NO: 126614 - protein, 160 aa, Triticum aestivum
  Clone ID: PAT_TA_21032.pep
VNDRREALLTASRHALMRGVTTVVDVGSYFPGTSEEQTWQDFSDVYEWAHSMGKMMIRVCLFFPMPTWPRVSDLIHERNRSLSGWIHLGGVKAFLDGSLGLSSAWFYEPYEDAPGDYGLVLVDLDVLLNATLESNASFFRLKLHAYAVLASYMECDTSWY

SEQ ID NO: 126615 - protein, 158 aa, Triticum aestivum
  unsure (1)..(158): unsure at all Xaa locations
  Clone ID: PAT_TA_21033.pep
LMLFEAAERLPLLQVGQIYQKFECKGRSDGGIVRNVVRWSIENLLEEQEGATLMVSAKFDVLSKRNIFLQFEEVAVENIKISEQLQALIPPAILPRSFLSLQILQFPKTFRAQPPSSTPERRSPGRTILLPYLDRDMLXLGRSIGGVVFYFTRDQPLL

SEQ ID NO: 126616 - protein, 37 aa, Triticum aestivum
  Clone ID: PAT_TA_21034.pep
MFDDQDLGFFANFLGIFIFVLVIAYHFVMADPKYEGN

SEQ ID NO: 126617 - protein, 40 aa, Triticum aestivum
  Clone ID: PAT_TA_21035.pep
ILQAIRDESMYDPRERIEMAQRQSLYRPSLLGLPKADAKA

SEQ ID NO: 126618 - protein, 117 aa, Triticum aestivum
  unsure (1)..(117): unsure at all Xaa locations
  Clone ID: PAT_TA_21036.pep
GSLMDIVKVYPLDAVYDSPDDVPEDVKSNKRYAGASNWTVKEVVESVRNDFGSIDIXVHSLANGPEVTKPLLXETSRRGYLAAISASSYSYVSLLQHFLPNNDPGXGLASPLTYIAS

SEQ ID NO: 126619 - protein, 153 aa, Triticum aestivum
  unsure (1)..(153): unsure at all Xaa locations
  Clone ID: PAT_TA_21037.pep
MAPTVEISHLTFTYPGIDGRPPPGAPPLIEDVCFSLDAGQRCPPRGSGGAGETSILKILSGKHMVXPSMVRVLGRSAFHDTALTSSGDLSYLGGEXETHVALLXLQVNIQMDISAXKMILXYSGVXXKRRDSFQILDIDSLAHKQMKELSNKG

SEQ ID NO: 126620 - protein, 172 aa, Triticum aestivum
  unsure (1)..(172): unsure at all Xaa locations
  Clone ID: PAT_TA_21038.pep
MVRRTVLAALLVAAALAGGARAQLKEGFYDYSCPQAEKIVKDYVKAHIPHAPDVASTLLRTHFHDCFVXRGCDASVLLKRRRAAARRRRTPAPNLTLRGSVHRPHQGVLQEGCPGLFLRRISRSPPAIPPGHPRPSGPATGSPRTCHKQEGGNSAPHDLQSHPQKNLTPTLG

SEQ ID NO: 126621 - protein, 264 aa, Triticum aestivum
  unsure (1)..(264): unsure at all Xaa locations
  Clone ID: PAT_TA_21039.pep
MSVQCTANSLRALAALPAPSPSRRLARNEFLMPCRPSRTGALVRAADSSPPAAPASSSGAADDKAVIPDDEFTLAKVSFGVIGLGIGGSLLSYGFGAYFNLLPGXEWSALMLTYGFPLTIIGMALKYAELKPVPCITYSDAFALREKCATPILKQVRSDVTRYRYGDEQHLDEALKRIFQYGLGGGIPRRSAPILQKIQEVTDDGKYCLVLGIRSPNRWQLSDFEKRXQAKFTSFFGPGIKAEIGKGGDDLYEVRLISETTEEE

SEQ ID NO: 126622 - protein, 127 aa, Triticum aestivum
  unsure (1)..(127): unsure at all Xaa locations
  Clone ID: PAT_TA_21040.pep
MAGRGKAIGAGAAKKATSRSSKAGLQFPVGRIARFLKAGKYAERVGAGAPVYLAXAVLEYLAAEVLELAXGNAARDNKKTRIVPRHIKLAVXNDEELTNCLVVHINGGLSQHPQSSQGRQFTVMTIH

SEQ ID NO: 126623 - protein, 165 aa, Triticum aestivum
  unsure (1)..(165): unsure at all Xaa locations
  Clone ID: PAT_TA_21041.pep
MYTARKKIQKDKGLEPSEFEDSVAQAFFDLENGNQELKSDLKDLYINGAIQLDVAGSRKAVVIHVPYRLRKAFRKIHVRIVRDLEKKFSGKDVVIVATRRXRPPKKGSTVQRPRTRXLTAVNDGILEDVVSTLCGNVQYLGRARCCSLAKDARTHTLALTRHRRR

SEQ ID NO: 126624 - protein, 115 aa, Triticum aestivum
  unsure (1)..(115): unsure at all Xaa locations
  Clone ID: PAT_TA_21042.pep
MARIKVHELRGKSKTDLQAQLKELKSELSLLRVAKVTGGAPNKLSKIKVVRTSIARVLTVISQKQKSALREAYKKKNLLPLDLRPKKTRAIRRRLTKXQLSLKTEREKKREKYSP

SEQ ID NO: 126625 - protein, 144 aa, Triticum aestivum
  Clone ID: PAT_TA_21043.pep
SPRPESFPSSRTPGRSSSTGAPPPTRPASVPAQLAPAACGRCDRSPAVGSSVFFCLWAVARGGGKLAVRWVGAEEEAEQRAGGGALGGCALLTAALVISTLVIQGAGGSKQSHAPAVARKVLLSITNWHHTITWMMYSSITSSR

SEQ ID NO: 126626 - protein, 92 aa, Triticum aestivum
  unsure (1)..(92): unsure at all Xaa locations
  Clone ID: PAT_TA_21044.pep
QYETQEEASAAVKNTDKSTILDRVVTVEYAFRDDDGDRDDRYDIPKQGAYDRRGGSPYMRSPSPRYPXGLRPRLWSAWNVTLGYGPRDGSNV

SEQ ID NO: 126627 - protein, 107 aa, Triticum aestivum
  Clone ID: PAT_TA_21045.pep
LNMSTLTWSVVSTAEGRVPLASEGMTLVHSNYNGYDYLISFGGYNGRYSNEVYTLSLKSDFKSTTKEETVSDLGSSNQRLKWVIGVDSADPDLKNSSTVLMKQVNSP

SEQ ID NO: 126628 - protein, 196 aa, Triticum aestivum
  unsure (1)..(196): unsure at all Xaa locations
  Clone ID: PAT_TA_21046.pep
MAEEKKQGLQLLDFWVSPFGQRCRIALDEKGLAYEYLEQDLRNKSELLLRANPVHKKIPVLLHDGRPVCESLVIVQYLDEAFPEAAPALLPADPYARAQARFWADYVDKXLYDCGTRLWNSRGTASASAAEMVEISAPGGPLGDGLLRGTLGSHFPRPRSGPPDTLGGRLKATGPAPRPPPLVHHPPLSLRKKGNM

SEQ ID NO: 126629 - protein, 124 aa, Triticum aestivum
  Clone ID: PAT_TA_21047.pep
MDGAAATWTPRKQVVLYPSPGMGHLVSMVELGKVLAARGLAITIVIVSLPFVDTGARGPFLAGVTAANPSVSFHCFPQVEVPPLDSDHPEAVTYEVAGLSVPHLRGFLAGASPTVPRVDFFCSI

SEQ ID NO: 126630 - protein, 116 aa, Triticum aestivum
  Clone ID: PAT_TA_21048.pep
PSPAPARSPPRPAPASAPRPRPWSRRRPSPSSRPRPRPSRPPPSTASSPPGASPPRSTPSACSSSSPTAPRRPRASPGPPTAPSGPALPLRRPGAPSWSASSGWLESSLSCSANRS

SEQ ID NO: 126631 - protein, 148 aa, Triticum aestivum
  unsure (1)..(148): unsure at all Xaa locations
  Clone ID: PAT_TA_21049.pep
MADQLTDDQIAEFKEAFSLFDKDGDGCITTKELGTVMRSLGQNPTEAELQDMINEVDADGNGTIDFPEFLNLMARKMKDTDSEEXELKEAFRVFDNDXQDGFISAAGLRHVMTNLGEKLTDEEVDEMIREADVDRDGSLRGVLKVYGK

SEQ ID NO: 126632 - protein, 154 aa, Triticum aestivum
  unsure (1)..(154): unsure at all Xaa locations
  Clone ID: PAT_TA_21050.pep
RKHTQLLANPAVSAMHAKMTKPAAIVVAAIAVLSVSLLAGSSCLALARPSGDFSIVGATQKEGTCRRTRAWRRXVRALAVPPPQAVARLDGERPRFQVFKDNLQPHRRDQPQVKQLGREXVHPHEEGHRQAQGLWESTRWLPXQQKLNSDHHSS

SEQ ID NO: 126633 - protein, 105 aa, Triticum aestivum
  Clone ID: PAT_TA_21051.pep
EVKHLCLAKFKDGVVVDDVLKGMTDLAAGMDTVKSFEWGQDVLNQEMLTQGFTHVFSLTFASAADLAAYMAHDSHTAFAATFMAAIDKVLVVRLPVVRRQPPPPA

SEQ ID NO: 126634 - protein, 69 aa, Triticum aestivum
  Clone ID: PAT_TA_21052.pep
MPKQIYEIKDFLLTARRKDARSVKIKRSKDVVKFKVRCSKYLYTLCVFDAEKANKLKQSLPPGLTVEEV

SEQ ID NO: 126635 - protein, 198 aa, Triticum aestivum
  Clone ID: PAT_TA_21053.pep
RPQARRSATDGSVGLPSTAASAPSHRSRACRRRRKTGPCGSLPPFPPAGSKACVAGREPLRRRRQRVTTWIGPCWRETMGERESRKERREARRRTGEGHRPRPARSGPTLVVGGGSIHSWILLLPLPHCLTPGKRAGDRSYRGRSIFIEVFLPAWPAPGPPPPRPGMHPAPLFISFRYPAGANGGSSRLLPPPPSIML

SEQ ID NO: 126636 - protein, 90 aa, Triticum aestivum
  Clone ID: PAT_TA_21054.pep
IVARNYQKSSNVKCSFHVFLRRVYLYVRDVIRQVCSCALQRANQGALVLPVYACFFQYPRLSYYEPPPAPRGLMVPMSRKLSECLLLKKK

SEQ ID NO: 126637 - protein, 102 aa, Triticum aestivum
  Clone ID: PAT_TA_21055.pep
MPKEDYYANFNSWKVMEDRPMLKEEDGGKEGGGGEDQAITKCAGCDEIYSANDGHLWIGCDHCQRWFHGKCVGVTTEMANGIEDYMCPGCSYKATTKASDSI

SEQ ID NO: 126638 - protein, 57 aa, Triticum aestivum
  Clone ID: PAT_TA_21056.pep
MKTFDPWPVFFRREWKRNWPFLTGFAITGFIITKMTANFTEEDLKNSKFVQEHKKKH

SEQ ID NO: 126639 - protein, 70 aa, Triticum aestivum
  Clone ID: PAT_TA_21057.pep
MTTSRRLADRKTAKFQKNITRRGSVPETAVKKGKGNGYAAGPVVLGFFVFVVIGSSLFQIIRTATSGGMA

SEQ ID NO: 126640 - protein, 181 aa, Triticum aestivum
  Clone ID: PAT_TA_21058.pep
PPSYRLACSRPSCGLPSWGSVAWSRPRYCSIGLQIFGGIVYAGNPTLEETDLFNNDYLLFNFNDYPSGMVTLFNLLVMGNWQVWMESYWQLTGNSWSLIYFVSFYLISILLLLNLIVAFVLEAFFAEMELEKGEEVDIQNPTSGGIKKRRSMRVWSKGSCPGGRSNLRWPAFRAGPLSVVV

SEQ ID NO: 126641 - protein, 139 aa, Triticum aestivum
  Clone ID: PAT_TA_21059.pep
RPVPSLTHLQYSSSRSQHAMASLTTITAPHLSPALTRRRNAAVPRRRPSFRCQNRPPTEPPIGGDGGGGGKKRAWWVTMAERAHSGVVKAGMDVRESLSPKQKGDWKDVALMSLSFAVYVYISQKIVCTYCAWVSMMNH

SEQ ID NO: 126642 - protein, 155 aa, Triticum aestivum
  Clone ID: PAT_TA_21060.pep
HGRAQIFIKRKGNSTKSWCSQMVVLISQDKSPQQAITLSCSRESSLKITGKNSLLLDDNADLALVKHVIEGPSLPLLVPVVHLPHASRDQTQGQSNEDLLHHTRALEGGMCNPAACHLLSCLLRSDAKRHAGDGEGPEPPPRGGNRRLGEPNSIR

SEQ ID NO: 126643 - protein, 112 aa, Triticum aestivum
  unsure (1)..(112): unsure at all Xaa locations
  Clone ID: PAT_TA_21061.pep
MALAAIYNLFIINKSGGLIYYKDYGSAGRMDTNDSLRLASLWHSMHAISQQLSPTTGCTGIDLLQAHNFDLHCFQSLTGTKFFVVCETGAPNMEMLLKXIYELXTDFVLKIL

SEQ ID NO: 126644 - protein, 77 aa, Triticum aestivum
  Clone ID: PAT_TA_21062.pep
AVINHHLTLVPIRAARLTRVTRPELKKKLPPEVQGKLLLHRQKQKQSGPSNRSFMPTSRKHICAMVSDILTCFRIGG

SEQ ID NO: 126645 - protein, 104 aa, Triticum aestivum
  unsure (1)..(104): unsure at all Xaa locations
  Clone ID: PAT_TA_21063.pep
MVSKPVVLVFLLVVLIITSQFEWKQQLVNELESTARNQKHVSSREELVKXKIIFTQEKMIQRLNNFVRNLQQQLVQCRGNNRTLIVLELLDILYSEIRCRNDGY

SEQ ID NO: 126646 - protein, 59 aa, Triticum aestivum
  Clone ID: PAT_TA_21064.pep
LIHPSIIGASQSRCRGSQPAGVAPALVLPAPRHGLPGSPPVAVAPAFWVASRPPGVQKK

SEQ ID NO: 126647 - protein, 82 aa, Triticum aestivum
  Clone ID: PAT_TA_21065.pep
TVKPESFLLGHILISLFFLCLWFIYSYCIVPVWICSKRYGWCANVFMYIENVGPVNCYCTFLLLSCIVVSWCILLKKKKKKL

SEQ ID NO: 126648 - protein, 177 aa, Triticum aestivum
  unsure (1)..(177): unsure at all Xaa locations
  Clone ID: PAT_TA_21066.pep
RAGRQNGAPRREAAPRAALLPPPPPCPPPRPARLRRPHAKKPAPGEPPAAPAAGSEAQFLSGHDGDRGGDDEKHGQGRRRRVDVEVNDYQPSGPNNRHDPPKGPGKNWNGGPVSLERRTRAPNNPSPSSSSSHGSTEALLSTPLSSSTAARVYGVEXMVGVSCVVXLXKKFTDXIXX

SEQ ID NO: 126649 - protein, 279 aa, Triticum aestivum
  unsure (1)..(279): unsure at all Xaa locations
  Clone ID: PAT_TA_21067.pep
MATSMGCLVLLCLVSSLLPSAVLGHPWGGLFPQFYDHSCPKAKEIVQSIVAQAVAKETRMAASLVRLHFHDCFVKGCDASVLLDNSSSIVSEKGSNPNRNXLKGFEVIDQIKAAPEAACPSTXSCADIVALAAPDSTAWVGGQYWDVPLGRRDPLGATIKGSNNDIPAHNNTLPTIITTCQRQGLNVVDVVALSGXHTIGMSRCTSFRQRLYNQTGNGMADSTLDVSYAAKLRQGCPRSGXDNNLLPLGLHHPCQVDNXYYKNLLGRQGLLPPDVVPLA

SEQ ID NO: 126650 - protein, 179 aa, Triticum aestivum
  Clone ID: PAT_TA_21068.pep
ARGPRPRAAARRRRRASPVGARRPARPRRGPPPPGAAPPRAAAAPGRPRPRAPPSPRAGGPRRGRPPPRPPAAAPGRRRASGPLAAAPLARGLAPAGCRAAPRAGAPLLASASSRSSGLVRLLAWSCHRTCFCVGGTQDVRWLYFLFPLLMRGGYLLNKCRKRQCPELKCRLNVIIKKK

SEQ ID NO: 126651 - protein, 76 aa, Triticum aestivum
  Clone ID: PAT_TA_21069.pep
MSCNCGSSCGCGSSCKCGKKYPDLEETSTAAQATVVLGVAPEKKAAPEFVEAAAESGEAAHGCSCGGNCKCDPCNC

SEQ ID NO: 126652 - protein, 82 aa, Triticum aestivum
  Clone ID: PAT_TA_21070.pep
KGSQGIHACSVTREYQSSITELYIDLRIHICHGISFCLLQGHSTVASGKGGTASGDMVKTNDYGRYDPTPAFSKPRSKLIPN

SEQ ID NO: 126653 - protein, 55 aa, Triticum aestivum
  unsure (1)..(55): unsure at all Xaa locations
  Clone ID: PAT_TA_21071.pep
PQGGRGGRXRREEAPLLRLIDPPVSSSLXPCATRACESDIERPPCCARVRMYALV

SEQ ID NO: 126654 - protein, 136 aa, Triticum aestivum
  unsure (1)..(136): unsure at all Xaa locations
  Clone ID: PAT_TA_21072.pep
QQPATSLSLLQLSSAQLSKQIVRSIVVDYGRRLLLAATTAPASTRGGLVSPPAECHHQQLGGVRRCKCHEGRTKEALLAVNSALGSPYHFASXWTPDTFCCDWYDVDCDNVTGRVLRLTVFGDGNLTGAIPDAIPT

SEQ ID NO: 126655 - protein, 96 aa, Triticum aestivum
  unsure (1)..(96): unsure at all Xaa locations
  Clone ID: PAT_TA_21073.pep
TRMPCSLVQEKRSVMDSSASSDSYFXEPQGILSDVHHLHRHGPSWISTITNYLKHKVLRSRLDTHAGRXFSTRNHTTSCSASPPPQXTXXDVKMXX

SEQ ID NO: 126656 - protein, 119 aa, Triticum aestivum
  unsure (1)..(119): unsure at all Xaa locations
  Clone ID: PAT_TA_21074.pep
MSDLDVQLPSAFDPFAEANAEDSGAGXGTKDYVHVRIQQRNGRKSLTTVQGLKKEFXSYNKILKDLKKEFCCNGTVVQDPELGQVIQLQGDQRKNVATFLVQAGIAKKETSRSRVLRDL

SEQ ID NO: 126657 - protein, 92 aa, Triticum aestivum
  unsure (1)..(92): unsure at all Xaa locations
  Clone ID: PAT_TA_21075.pep
XGKSDTFWLHTLLAMIGEQFDYGDEICGAVVSVRGKQERIAIWTKNAAXNEAAQVGIGKQWKELLDYKDSIGFIVHDDAKKMDKGLKNRYTV

SEQ ID NO: 126658 - protein, 71 aa, Triticum aestivum
  Clone ID: PAT_TA_21076.pep
RRGVNAGSCFADLLLPLPLLLPLLSPSAPLFQVRTRPAPLMPLWTPLAASDPLHTFATYFTIFCLYPVNCI

SEQ ID NO: 126659 - protein, 133 aa, Triticum aestivum
  Clone ID: PAT_TA_21077.pep
MEGYDREFWQFSDQLRLQTTAFSGLSLGDSIWSPATGAGGRRNNNTDLLAASASAADAGKHNGVGLSLNDGGPGLIGSGKLAFGGSKAGRYNNLPSEKGAPVYNTAAPRLTAATPRATTPAGGVNKMGSTPQQ

SEQ ID NO: 126660 - protein, 118 aa, Triticum aestivum
  unsure (1)..(118): unsure at all Xaa locations
  Clone ID: PAT_TA_21078.pep
MESTFIMIKPDGVQRGLIGEIISRFEKKGFYLKALKLVNVERSFAEKHYADLASKPFFQGLXVDYIISGPVVAMVWEGKSVVTTXGRKIIGRHQPLASXPGTIRGDXAVDIGRNASWE

SEQ ID NO: 126661 - protein, 116 aa, Triticum aestivum
  unsure (1)..(116): unsure at all Xaa locations
  Clone ID: PAT_TA_21079.pep
MGNAGSAPDQPKNSADGAGAADAESRRGPPSTVRFFPDGERHKARQPPPIKLEEEEGVPPPPATEEEMAPRNLWXQVYALGAFXIVLRWAWAKXKENQDRKDSPDAGDGNAPDRST

SEQ ID NO: 126662 - protein, 146 aa, Triticum aestivum
  Clone ID: PAT_TA_21080.pep
MATKILSLLALLALFASATNAFIIPQCSLAPSAIIPQFLPPVTSMGFEHPAVQAYRLQQALAASVLQQPIAQLQQQSLAHLTIQTIATQQQQQFLPALSHLAMVNPAAYLQQQLLASNPLALANVVANQQQQQLQQFLPTLSQLAW

SEQ ID NO: 126663 - protein, 191 aa, Triticum aestivum
  Clone ID: PAT_TA_21081.pep
PTVPRSRSALLSTRRAAGPRHRLLEGPRGQRPPPQAIPGPPRRPPDDSAPIPGRAHGVSGTGGLCAGARQAVLRQHANFPRRRLQHASPSYPRRPPPRSLRWEPALVSAPSRDIAQHDKVPGWIATTTLPCYPGIPSQGHPYVQRTICALSNEIRSPQNRASDSHEGPSYNTSIINCYGLKRNELHWSTTT

SEQ ID NO: 126664 - protein, 146 aa, Triticum aestivum
  Clone ID: PAT_TA_21082.pep
STRKETIAKRRTIQFQLEPLRSILWLWLPRGLGLLLPPLMLRSSSCCSSEDPPPPAPLLLGSSRNCRNSLAAGAAAASSVVVASAGSGSGRRSGREADGQQVLVPLPLAPRPLARGQAAVHRPVASEVVLLVEVLLLDIAAPRRRG

SEQ ID NO: 126665 - protein, 216 aa, Triticum aestivum
  Clone ID: PAT_TA_21083.pep
GYSDFGISHALVLTSPCLTWQLLDPLFSDFMSPFEGTFLEDFIRQSLLPITVPINEETVKMLKDDDRKVVLAILQDESDETSMQLIKVLRSAANANHDLVFGYVGVNQWEEFTEPFHDSKSSQLPKLVVWDKDEEYEVVEGLESLEEGDHGSQISRFLEAYRAGRTIKKTLGRRSPTLLGVNASYILLFLVAVLVVLMFFSGQGEEDRQPTRAHQE

SEQ ID NO: 126666 - protein, 92 aa, Triticum aestivum
  Clone ID: PAT_TA_21084.pep
PSRVVVRRGKRKIIGMDGVANEQDFDKYGDPRIEHDDDDEVAAYTTRRSRTTLPKGRPFHRRTPFAKKKGKKNYDWLIKKLLLSYKKIITFL

SEQ ID NO: 126667 - protein, 125 aa, Triticum aestivum
  unsure (1)..(125): unsure at all Xaa locations
  Clone ID: PAT_TA_21085.pep
MSGNGAKKVVDAAVKAGRTIIDWDGMAKLLVTDEARKEFAALRRAFDDVNHQLQTKFSQEPQPIDWEYYRKGIGSKVVDMYKEAFESIEIPEXTFDTVTPQYKPKFDAVIAELKELRKHPEEPER

SEQ ID NO: 126668 - protein, 78 aa, Triticum aestivum
  Clone ID: PAT_TA_21086.pep
DGAYEYTVRRCTWISQRVLCLRAVAKEVAVLESGSTWRARHRCTGRCSCTTHSGGRRRAPRGSRTTRSGAHRPRLSAP

SEQ ID NO: 126669 - protein, 68 aa, Triticum aestivum
  unsure (1)..(68): unsure at all Xaa locations
  Clone ID: PAT_TA_21087.pep
MGAVAVLXNLSRSQSLPDSKPKRSXRKKYQDSSTXKQKTXNPGPKKQWEKNVSISVSLEGNISSIPNS

SEQ ID NO: 126670 - protein, 111 aa, Triticum aestivum
  unsure (1)..(111): unsure at all Xaa locations
  Clone ID: PAT_TA_21088.pep
ASRTGFFTSGQHGGARTSGRLPQGYQDYRGLSSALEKVFSGFSTGKGAXSEYRKDGEYVLTYXEDKDGDWMLVGDVPWEMFADSCRRLRIMKGSDAIGLAPRAADKSKNRN

SEQ ID NO: 126671 - protein, 87 aa, Triticum aestivum
  Clone ID: PAT_TA_21089.pep
MSAVAVSSSLNPDAPLFIPAALLQVEDFSPQWWDLITTTAWFRDHWSRERAHLDEMAEQIDAAGLLPDDQGPLLRRPARAGPRRRRP

SEQ ID NO: 126672 - protein, 183 aa, Triticum aestivum
  unsure (1)..(183): unsure at all Xaa locations
  Clone ID: PAT_TA_21090.pep
GTCAVGVKGADVVVLGCEKRSAMKLQDTRITPSKIQLLDHHVALAFAGLNADARILVDKARLEAQSHRLSVEDPVTIDYITKYVAGVQQRYTQXGGVRPFGISTLIVGFDNGSDVPPVYQTEPSGIYSAWKENRYPAVQARPVRDFPRAETTRTWTERPPAGLAPAPLLPQMRFLTAHIKISE

SEQ ID NO: 126673 - protein, 85 aa, Triticum aestivum
  Clone ID: PAT_TA_21091.pep
ADLDRSLPFKKRCKMVDHPTVTTTKAVAVDATLKDQDHVVAEDGAMVERLSKADPPAAFTHAFMRDEITNAAMLLMTLSCGLVRS

SEQ ID NO: 126674 - protein, 176 aa, Triticum aestivum
  unsure (1)..(176): unsure at all Xaa locations
  Clone ID: PAT_TA_21092.pep
AESRLLSSRSLSRALFVSAAISGQHRDRAAAAPSLFRARRLRLCFLDLRLCSGAGASGSASLGSASVGSATASASFGLSLSXASTGSGSLATTTSVSTAGAAVSSFGVSTAEAAASWAASSTGAAVGTWTSTAAIGAVQLAGRVCVWTVEQTTKALKLGAKQSAELTSVTMAGWRV

SEQ ID NO: 126675 - protein, 164 aa, Triticum aestivum
  unsure (1)..(164): unsure at all Xaa locations
  Clone ID: PAT_TA_21093.pep
MASMAAVFGEAKPDKSNKDADALLRRPVLFHAHSQGGLRVVATDLHSFAWHRSLDLDGLRDLQDDVGIAGSCSDFLDYLYSSLSSDQVRLFFPAAALGPDTAELVATKAKGLPRITLSLDRVAASALKDVIAXLPLRSYESYKTSQNMHQENKNECPAHGKSRL

SEQ ID NO: 126676 - protein, 178 aa, Triticum aestivum
  unsure (1)..(178): unsure at all Xaa locations
  Clone ID: PAT_TA_21094.pep
MICCCNKMDATTPKYSKARYDEIVKEVGSYLKKVGYNPDKIPFVPISGFEGDNMIERSTNLDWYKGPTLLEALDQINEPKRPSDKPLRLPLQDVYKIGGIGTVPVGRVETGLLXPGMVVXFAPTGLTTESIPWRSPRDDQEALPGETRSTQNLGSRTERATGSTQGDPQGVQLTPGVT

SEQ ID NO: 126677 - protein, 53 aa, Triticum aestivum
  Clone ID: PAT_TA_21095.pep
DTGYPRLVRRPGDIALTGQVSQRCACFQENELDKAGLVVYEGCDYLSQSCKVN

SEQ ID NO: 126678 - protein, 113 aa, Triticum aestivum
  Clone ID: PAT_TA_21096.pep
IKPGRQKCSVHNVNDNQSVAYVPGLDLPAPLLRPRSVASSFRPGVLPGAVPGGRLSGQVGAVRLGISRALQNWEPGLRPYLKAAGYLTRDSRVVERKKPGKAKARKSFQWVKR

SEQ ID NO: 126679 - protein, 58 aa, Triticum aestivum
  unsure (1)..(58): unsure at all Xaa locations
  Clone ID: PAT_TA_21097.pep
KIVDFHQFTTQDVVALDENDMXEDGELEEDNNLIXAENVLPVVEENLADEQHCLPCPL

SEQ ID NO: 126680 - protein, 124 aa, Triticum aestivum
  unsure (1)..(124): unsure at all Xaa locations
  Clone ID: PAT_TA_21098.pep
SITVATXIAVTSIAFSYVXSAGQTQSAXGRWGGSGXEKLSPVIQLGDSEVLTELSGTIGNVDGLTVITSIKFVTSLKTYGPFGAWGDGSDTPFAIPVQQGSAIVGFFARAGIYLDALGVYVRSL

SEQ ID NO: 126681 - protein, 109 aa, Triticum aestivum
  unsure (1)..(109): unsure at all Xaa locations
  Clone ID: PAT_TA_21099.pep
MAVASAENTSSLLPLDGRVALITGGSRGIGREVSSQLATLGARVVVNYASNSARADELVAELASRGQQAVAVXADVSDPDAVHALFDRAEDAFGSPPHIVVCCAGSPSI

SEQ ID NO: 126682 - protein, 198 aa, Triticum aestivum
  Clone ID: PAT_TA_21100.pep
MASANSWTLEIASPVAPQRLFRAAVMDWHTLAPKVASHVVASAQPVEGDGGVGSVRQFNFTSVMPFSFMKERLEFLDADKCECKNTLIEGGGIGVAIETATSHIKVEPAAGGGSVVKVESTYKLLPGVEVKERDSPRQGSVTASSRCQATRCKPKPKLNIDWDNSFLRLLGKGCVDRSPFFPLLFIRQISAWPRRFAA

SEQ ID NO: 126683 - protein, 73 aa, Triticum aestivum
  Clone ID: PAT_TA_21101.pep
PRPDGAGPPWTPPPWPPSATSPRPQGPPTQHPHDVALATHMFSDAATKDYMWFLQWGCLCRSSCSITFQHWTC

SEQ ID NO: 126684 - protein, 168 aa, Triticum aestivum
  Clone ID: PAT_TA_21102.pep
QLSSVFRARLRQTKLPLRSAPTIFLLREVPQPAPRCAPRVCPATSRSPAAARPPSGPSLPGPLPPSGLNIGHFGCESPCGVGHFHNVGSLLGVVLCSKGDAGHIHWTCSRTDKEEGDSKAMLHFTSSFPRIGHCLSYVLNSCHYMQCCDFSWYLKSEDLVSLLGSLRF

SEQ ID NO: 126685 - protein, 137 aa, Triticum aestivum
  Clone ID: PAT_TA_21103.pep
GSIPESLYTNGGLKLRVVWTISSLIAAATRHYLLREIVKEHPTLERVALTDAGGQGTLSMGRDQLREFRDRPLAAAPAAAANRTQVPACNMKLRYAPLLELSDGTRIHGATLVVIKARRRRRRERTRTSGAGAFDGP

SEQ ID NO: 126686 - protein, 123 aa, Triticum aestivum
  unsure (1)..(123): unsure at all Xaa locations
  Clone ID: PAT_TA_21104.pep
LVPNSARADIDMVVNLKLREDVIVEKCLGRKGFCGPNVGKNFNXLACIDVKGENGLPPIYMAPLLPPNNCMSKLITRADDTEEVARNRLQIYNDMSQPVEGFYREQGKLLELXLPGGXPESWQ

SEQ ID NO: 126687 - protein, 187 aa, Triticum aestivum
  unsure (1)..(187): unsure at all Xaa locations
  Clone ID: PAT_TA_21105.pep
LNSIDIQELIIHRPPSWRLRREWAYPSTSPSWRRCSPRRSERSSADYYSETCPQALTTIKLLVGAAILREPRMGASLVRLHFHDCFVNGCDGSILLDDTDDMVGEKTAKPNNNSVRGYDVIDTIKSAVNTICLGNVVSCAXDILAVGARDSLSLWXELVRRALGRRNAXTASMDDANNDIPXXFMEL

SEQ ID NO: 126688 - protein, 152 aa, Triticum aestivum
  unsure (1)..(152): unsure at all Xaa locations
  Clone ID: PAT_TA_21106.pep
GDRAKXTPXISPRSIXLYYACLHAATXLASLLLWMSHLFFFFTCCSLPRLFQAAYLIDLLIIIEIDPIIISAETSSIEVEQDCRPRDPAASIYRRLRSAPNRTTTTSRFLQIWIPEAEHAMLDHQNKTTRTLQARTNRYRIQRGFAESSNQI

SEQ ID NO: 126689 - protein, 229 aa, Triticum aestivum
  Clone ID: PAT_TA_21107.pep
MGGFCCCLSTDDLEVYVHPNNPVYRQCISLRQLFHNMFGGYTAAFQRLDSRPSNPAQGAAPLASTNPSTNITESSLSETFHLVSRPPPYDIDPRYARVQREGLVSRREKSINLTHEESPALRRNGSSSGVEHLAAQKKRSSTDPEGEHKVRRSESTKSLSGRAYNSSYAVITSDDEDVCPTCLEEYTPENPQIITKCSHHFHLSCIYEWMERSDTCPICGKEMEFCESP

SEQ ID NO: 126690 - protein, 174 aa, Triticum aestivum
  Clone ID: PAT_TA_21108.pep
VVKWGGRYQSSECPAASWGIGAGGPAPGRGGKPAGGSAGHSGTIAWLYAGTNVRWFDSTGRRRLDSLTVRVLCPEGPADALFDKGAGPGHLHVVPGEEGQGGRPRGTGRSSPVPGGVRFIARGPRKRTPPPKTRRRKKKPSPPVTGGGKKRKAAPTGEAGGSKKGKNLLPDYAC

SEQ ID NO: 126691 - protein, 185 aa, Triticum aestivum
  unsure (1)..(185): unsure at all Xaa locations
  Clone ID: PAT_TA_21109.pep
HLAVRFGKAFGMKVTVISTSLGKRDEALGRLGADAFLVSRDPEQMRAAAGTLDGVIDTVSADHPVVPLLDLLKPMGQMVVVGLPTKPLQVPAFSLVAGGKRVAGSAGGGVGECQAMLDFAGEHGITADVEVVGMDYXQYRHQXPREERCQVPLRCRRPEQQDWEARHHHALRSRRTCDLLSSRGG

SEQ ID NO: 126692 - protein, 110 aa, Triticum aestivum
  Clone ID: PAT_TA_21110.pep
MAPKKDKAPPPSSKPAKSGGGKQKKKKWSKGKLKEKVNNAVLFDQATYDKLLSEVPKYKQITPSILSERLRINGSLAPEGHQRTMAPWPHSGWSPVHSNPADSTPRATNT

SEQ ID NO: 126693 - protein, 54 aa, Triticum aestivum
  Clone ID: PAT_TA_21111.pep
FFFLNSKDRDHGYLYISINNSSESQRPANTMFTQSPDSTTTQSLAADLKYAPIT

SEQ ID NO: 126694 - protein, 418 aa, Triticum aestivum
  unsure (1)..(418): unsure at all Xaa locations
  Clone ID: PAT_TA_21112.pep
LRLPRALPPLCVPAPDLRRRPARQPPRLVPACVCPGRRFYLYFHAWILGKLIGDDTFALPFWNWDAPAGMTLPAIYANRSSPLYDDXRDPAHQPPVLTDLDSSGTDANIPRDQQIDQNLKIMYRQMISDAKKTLLFLGQPYRAGDQPDPGAGSLENVPHGTVHVWTGDPAQPNLEDMGNFFSAARDPIFFAHHGNIDRLWHVWRRLRPSNTDFTDPDWLDAAFLFYDEEARPVRVXVRDCLDXPALRYTYQDXSSLPWLNARPAKASGGTPAPATTGTLPAXLDSTIRVTVTRPRVSRSRREKDEEEEVLVVEXGIEIADHFNKFIKFDVLVNEPEGGVDGTPATATGYCAGSFAHTPHMVRPEETRKGSVKTVARFGVCDLMDDIGADGDQTVVVSLVPRCGGELVTVGGVSISYLK

SEQ ID NO: 126695 - protein, 147 aa, Triticum aestivum
  unsure (1)..(147): unsure at all Xaa locations
  Clone ID: PAT_TA_21113.pep
MADQLTDDQIAEFKEAFSLFDKDGDGCITTKELGTVMRSLGQEPNRXSSKDMINEVXDADGNGTIDFPEFLNLMXARKMKDTDSEEDSRSFKVFDKDKNGSSLPAELRHVMTTRRELTTRVHKYREATHGMASKHKISRHMQISKPA

SEQ ID NO: 126696 - protein, 193 aa, Triticum aestivum
  unsure (1)..(193): unsure at all Xaa locations
  Clone ID: PAT_TA_21114.pep
LRHPFHPQLFPRCSGRPRREWTASTSATTPRHERRATISTGGPDDEARRCYNRLGRELQPHTGFAGTSDGGKLWGSPRQAAEVTMTSWTRAWRGAAATMDQVCWNWRSVLLEVAPKIASSELFLLDQQIFATIISLICWELPQKKGGARYQFAFVCLAVLRVSTXLEPXXQXXLXNPFPVVYESXXMPSXGXM

SEQ ID NO: 126697 - protein, 257 aa, Triticum aestivum
  unsure (1)..(257): unsure at all Xaa locations
  Clone ID: PAT_TA_21115.pep
MPSRFQVGEGSRKLTTPFESQREDSRKATASYGIQDDEDTRKATTSYGIHGEDPRKATTSYGSQDEKGSRKVIMSYGSNGEDDPRKATTSYGIQDKEYPRKATTSYGVQGDIHHHDHAAVHIHSSGNKLVADVFFFHDXPTPRVRNHADHPTDHHPTTSAASPRGRRAPVLHRALRRHPRHVRADDIRRHGRRDTVDARHLREHAPAPWREGRLRHLPRVSRQDTRRPPRDTQRPRFLRRHAHRFCRNVGEAGAAIT

SEQ ID NO: 126698 - protein, 367 aa, Triticum aestivum
  Clone ID: PAT_TA_21116.pep
MALGGLFGTAAVAVVVSLAVHVALNCPIQPLPSPPPPAARYPPNNLLQGLEKLGEGQLSAPEDVYVDAAAGGTLYTATRDGWLQRMHPNGSWEQWRFVGGTGLLGIAPSADGSVLVCDADKGLLRVEEGRVTILASTVEGSTIRFADEAIEASDGTVYFSDASTRFGFDRWFHAYVESQPTGRLLKYDPRTGKASVALDNLAFANGVALSRDEAFVIVCETGRFKCTRLWLKGDKAGQAETFVDDLPGSPDNIQLAPDGSFWVALIQRSPWLDLVMRWTFTKRVVASFPALLDAVHAAGKGAMVAQVSENGEVLRVLDDSEGKVINFITSVTEFNGDLFFGSLATNFVGKLSLAKVAQAQGQAAASS

SEQ ID NO: 126699 - protein, 93 aa, Triticum aestivum
  Clone ID: PAT_TA_21117.pep
LSRTAAAAVVALRSAVRSAPLTGRVLGAPLPSFASPSAARSARILRRSAAAASAGLETLMPLHSAVAAARLRSCIAVDSSCWCSLSQGLNKRI

SEQ ID NO: 126700 - protein, 158 aa, Triticum aestivum
  unsure (1)..(158): unsure at all Xaa locations
  Clone ID: PAT_TA_21118.pep
MHTRATRYWRRGAMPGMDAFAAVSLLATLFLVRAAAAHPPAAAADAMTPTDYWRAVLPETPMPRAILDLLTTSTVGEGSRKVTTSNGYQGHDLRTVSTSYASQDGDNSWKATMSYGFQSGEGSRKXTTSYPYRGQDLRMVSTSYVSQDEDNSWKSQCI

SEQ ID NO: 126701 - protein, 63 aa, Triticum aestivum
  Clone ID: PAT_TA_21119.pep
MASLKAAKPSGVAAQGKEPAPKLSETATKPSAAKSGGVKKAEQKPRETKRKVKSSKQAAAAKK

SEQ ID NO: 126702 - protein, 187 aa, Triticum aestivum
  unsure (1)..(187): unsure at all Xaa locations
  Clone ID: PAT_TA_21120.pep
MARTKQTARKSTGGKAPRKQLATKAARKSAPATGGVKKPHRFRPGTVALREIRKYQXKSTELLIRKLPFQRLVREIAQDFKTDLRFQSSAVSALQEAAEAYPVGLFEDTNCAPSTPKRVTIMPKDIQLARRSGEKRAERSELSQRRRVGARPGKGSWVLRGKDLNGCLQEKFSGTISAPPERAKNLK

SEQ ID NO: 126703 - protein, 145 aa, Triticum aestivum
  unsure (1)..(145): unsure at all Xaa locations
  Clone ID: PAT_TA_21121.pep
MAAVTKIYVVYYSTYGHVARLAEEIKKGADSVDGVEATIWQVAETLPEEALAKMRAPARSEEHPVISGKQLVDADGILFGFPARFGMMAAQMKGAVRLHGRLWQRQALAGKPXGSSSALGTNGGGKRRRAHGVANSPHAWCPPLG

SEQ ID NO: 126704 - protein, 143 aa, Triticum aestivum
  unsure (1)..(143): unsure at all Xaa locations
  Clone ID: PAT_TA_21122.pep
PCEMKNCTFNGIWNGGGGAGQGSIYVASSFYFVASEVGIVDGNAPSGNTTPGAFGASAEKACQMSVEEAKIEYPNVNDVDVPYLCMDLAYQYTLLVDGFGVERTKEITVVXKVKHGEYYVEAAWPLGSAIEAVSSTKEWRQDN

SEQ ID NO: 126705 - protein, 106 aa, Triticum aestivum
  unsure (1)..(106): unsure at all Xaa locations
  Clone ID: PAT_TA_21123.pep
LAGVSFVIMDVANKVGKQLKFDVSSKADRQRFNTTFIQEIRRELGDTSVMQEAFQLPPQTDTPSFQDLVLIAGESTATLRLRTDNLYVVGSEPSRPVVRVPXRXWG

SEQ ID NO: 126706 - protein, 86 aa, Triticum aestivum
  Clone ID: PAT_TA_21124.pep
LASMECGSKKAAGGVLALLLLQLVLAPTTATARLLQADTSTVVGLDIIAREFGHPVRGILCGETCVFLPCYTAAMGCQCIGQICMM

SEQ ID NO: 126707 - protein, 67 aa, Triticum aestivum
  Clone ID: PAT_TA_21125.pep
VLVVEREEDGHKFPLQKLVYYVSTVLTPYKSWYPHYQKIAYAVFMASRKLRHYFQECLDYSGFQSTT

SEQ ID NO: 126708 - protein, 177 aa, Triticum aestivum
  unsure (1)..(177): unsure at all Xaa locations
  Clone ID: PAT_TA_21126.pep
MAMKLDMSALETNFANLTASAGDDTYFSAEAPDVPSMVLPICDDFDGFQAATKDMVKNKKGTTTLAFIFDKGVIVAADSXRASMGGYISSQTXRKIIEXNPYMLGTMXGGAADSNFWHKDLGSRSLHELSNKQGSIPGLQTLVTPWHGWDGPLASGPGGCLSAVKLNRSGLESPLVS

SEQ ID NO: 126709 - protein, 278 aa, Triticum aestivum
  Clone ID: PAT_TA_21127.pep
LAADYPHRGGGRLGLGPFAAAVFRTDNRRRAIAGGAVLASALLLVATPRLRHSPALHLFADMRNLLGVPNTLNVLTAYPLLLAGVPGLILCLFGGGCFGISLRWEALGWFLFYVGNVGAAFGSAYYHLKPDDDRLIWDRLPMMMSASSLLSILVIERVDERAGLSCLISLLSLLLVSSACERILDDMRLWVVLNLVPCVAIPAMLFLFAPKYTHSRFWFLATGFYLLARFEGLADRKVYSVNRYFISGHSLEHLCFAMVTLILTVMLSFRNIKITRDS

SEQ ID NO: 126710 - protein, 143 aa, Triticum aestivum
  unsure (1)..(143): unsure at all Xaa locations
  Clone ID: PAT_TA_21128.pep
MASEKHFKYVILGGGVAAGYAAREFAKQGVKPGELAIISKEAVAPYERPALSKGYLFPTNAARLPGFYVCVGSGGEKLLPEWYSEKGIELILSTEIVKADLPPKTLTSAXGANFTYEILLIATGSSVISYRFWNKGLIYNILF

SEQ ID NO: 126711 - protein, 93 aa, Triticum aestivum
  Clone ID: PAT_TA_21129.pep
LHLQPKSIHSNSQWILSRTLCLVAPSLMMPPRPTPRTRRTMSIRVLNSSTSRVASTSPATTRRRLPTLPAASTRSRLATRSTLRSLTRERNNV

SEQ ID NO: 126712 - protein, 175 aa, Triticum aestivum
  unsure (1)..(175): unsure at all Xaa locations
  Clone ID: PAT_TA_21130.pep
TKPSYQLDRRHHARPHNSTDAGAPAAAATAVPAGNGQTVCVTGAAGYIASWLVKLLLEKGYTVKGTVRNPDDPKNAHLKALDGAAERLILCKAVLLDYDAICRAVXQGCQGVFHTASPVTDDPEQMVDPAVRGTEYVINAAAEAGTXRRVVFTSSIGALTMDPKRGPHLGLDHSG

SEQ ID NO: 126713 - protein, 196 aa, Triticum aestivum
  unsure (1)..(196): unsure at all Xaa locations
  Clone ID: PAT_TA_21131.pep
MTVLSRPTPGTAQCFGRKKTAVAVAYTKPGRGLIKVNGVPIELIRPEMLRLKAFEPILLAGRSRFKDIDMRIRVRXGGGKTSQIYAIRQAVAKGLVAYYQXKYVDEAXRKEIKDIFTRYDRTLLVADPRRCHPKKFGGRGARAKFRSLPLTGACSSRFLNRCGCSALISNNGLLPGLISCRLQNVNLSPPTLATTK

SEQ ID NO: 126714 - protein, 73 aa, Triticum aestivum
  Clone ID: PAT_TA_21132.pep
KHASDMMGIGRQVPLMDEMDDKVDRANADLKDTNVRLKETVLQLRSSRNFCIDIILLCVILGIAAYLYNVLKK

SEQ ID NO: 126715 - protein, 201 aa, Triticum aestivum
  unsure (1)..(201): unsure at all Xaa locations
  Clone ID: PAT_TA_21133.pep
ADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQXDRRGFPQDQQRLIFAGKRLGGGPHPPCLQCPPRGSPSGCSSSRGSLPSALCSPVSGCLRPAWPSMGVCYVGWS

SEQ ID NO: 126716 - protein, 181 aa, Triticum aestivum
  unsure (1)..(181): unsure at all Xaa locations
  Clone ID: PAT_TA_21134.pep
MDPITRPAAPSFHRPAVATAKHLHQAAATLARRNGVSRRCLLTLLMSTAAIPGGSESRKALLQEYLKKSKENKEKNDKERLDDYNKRNYRDYFGLIRGPXREKTEEERTESEKRILEWLDKNRLSNEQDRMVHGGPAGPTGEILAGSSCSPLTMAPLCNRFPLLLTYVLTSRKSVRLTVIQ

SEQ ID NO: 126717 - protein, 52 aa, Triticum aestivum
  Clone ID: PAT_TA_21135.pep
QSVLTLIYWLWQSHIVSVAIAHVIIGTFTQRETCSEVQPKYHESSGNVLDAM

SEQ ID NO: 126718 - protein, 231 aa, Triticum aestivum
  Clone ID: PAT_TA_21136.pep
MEKTVVLYPGVGVGHLVPMVEVAKLFLKHGLAVTVVLIDPQVESTDFSAAVARARASNPSVAFHVLPTPPADSNSDTAPTNPVVQIFRLLKSMNAPLLDFLRSLPSVDALVLDMFCVDAQDVAAELKLPVYYFYASAAADLALFLNLPTMLAGSKVKELGDSIITSPGVPPLKASDLPEVTHNDEVLKTILGMFDRMPDSNGILINSFESLETRAVRALKDGLCVPGRATP

SEQ ID NO: 126719 - protein, 245 aa, Triticum aestivum
  unsure (1)..(245): unsure at all Xaa locations
  Clone ID: PAT_TA_21137.pep
LCVPGRAMPPVYCIGPLVLGGGDQEHECXRWLDAQPDQSVVFLSFGSMGTFSGQQLQEIASGLDKSGERFLWVVRSPRNPDYKYGDSLPEPDLDALMPEGFLERTKDRGLVIKSWAPQVEVLRHRATGAFMTHCGWNSTLEGITAXGLPLLCWPLYAEQKVNKVHIVEGMKLGVEMRGYNEEVVKAEEVEEKVRWVMASEGGKALRERVAAAKDAAAEALKEGGSSHLAFVQFLNDLDTSTAPTV

SEQ ID NO: 126720 - protein, 222 aa, Triticum aestivum
  unsure (1)..(222): unsure at all Xaa locations
  Clone ID: PAT_TA_21138.pep
DIGVIAKIESIDALKNLEEIIRASDGVMVARGDLGAQIPLEQVPSIQQRIVRMCRQLNKPVIVASQLLXESMIEYPTPTRAEVADVSEAARQRADALMLSXGESAMGRYPEKXLSVLRSVSLRIERWWREEKRQEHWDXSVPSSFSDKISEELHSAAKWQQLRIDPFRYTKVLMAPPHMPPQPRPRLPLGREPMGPFGTSTMDNFKEELFPQQGQNYSRKKG

SEQ ID NO: 126721 - protein, 138 aa, Triticum aestivum
  unsure (1)..(138): unsure at all Xaa locations
  Clone ID: PAT_TA_21139.pep
MPPRRPNTGGGGGTSSAAPPPPPRKVPLRSLLRAASVACGVQFGWALQLSLLTPYVQELGIPHAFASLVWLCGPLSGLLVQPLVGHLSDRIAPANSPLGXRRPFIAAGAAXIALVLTSVSADWGVFGDNSAGQSVAYV

SEQ ID NO: 126722 - protein, 104 aa, Triticum aestivum
  Clone ID: PAT_TA_21140.pep
SQLPSFMPGGECCGLSSMTEPDEGSGDGVVHARARAGIVLLLASLPIGLSTRRSSEVPERRGQRGAYGSGSGGGEGQWGRRMGTVAAEVGGGAEREGSGVAPES

SEQ ID NO: 126723 - protein, 73 aa, Triticum aestivum
  unsure (1)..(73): unsure at all Xaa locations
  Clone ID: PAT_TA_21141.pep
FQLDTAPEIKNLGKRKMGSDSTIDKVPRTDKFITKKTLDNLMVHPESHESIQAAVCVPLQDMAXXASXPQSEA

SEQ ID NO: 126724 - protein, 73 aa, Triticum aestivum
  Clone ID: PAT_TA_21142.pep
YVVSLPCSSLQFMSTRTCMPHECSIHIASLKLYNTSCIIFIDSGSVLWQQYVHMVFLFGVSLSKAIYILVMMI

SEQ ID NO: 126725 - protein, 133 aa, Triticum aestivum
  Clone ID: PAT_TA_21143.pep
MAKLLPAGLAFLLALTAAAALAPSPASALKGAGGLGLGGAAAVVMRRGGRTCRGTVGECMEYFGVDGEGEGEVAAMAGKRRVLQDGSGYIGYDALRRDNVPCSQRGASYYNCQPGAEANPYSRGCSAITQCRG

SEQ ID NO: 126726 - protein, 114 aa, Triticum aestivum
  unsure (1)..(114): unsure at all Xaa locations
  Clone ID: PAT_TA_21144.pep
CDPMTSINAPYPLQVARHLQEARRQEEVLQWNPRRGGREIKTSRVFTLIADACVGVLTAPEXRWELRGXWASRIPYVTXTPLYMGHXFXEXSXPSLXPAPAIQPSGRRERCXAT

SEQ ID NO: 126727 - protein, 100 aa, Triticum aestivum
  Clone ID: PAT_TA_21145.pep
LQRSETVAGGGREEEEMAGCDGAKSSASMEEEACAEKKYGGMAPKKPLISKDHERAYFDSADWVLGKQAANSSSSSTRTAAAVESLKPKLKRTPHHQWRS

SEQ ID NO: 126728 - protein, 192 aa, Triticum aestivum
  unsure (1)..(192): unsure at all Xaa locations
  Clone ID: PAT_TA_21146.pep
TLLGTSLKGTEPGVCVRIPQREGPPWGATEVVATMAINPRRGALRGQRVQGWXSEVRNVGHGDXRDAPCWPAMDXVADLVETCATVVWLSSAYHASISFGQYDYLGFVPNGPSITTRPVPGPDAGAEVTESDFLASVTPVTEALGFMSIASGPMGLKGTEVYLGQRPDTEQWTRERRAAEALAEFRARLEEV

SEQ ID NO: 126729 - protein, 111 aa, Triticum aestivum
  Clone ID: PAT_TA_21147.pep
YKLQIHKQTEAKLHHEQKKIKKSSIATPLGPPDPMCVHRPAASPKTPDRSNAPPLRHVRCFRLHSESVRIPAPSTQFYSGTITTDHRPPTTLQFRLVFCLFLSVRRRLLLV

SEQ ID NO: 126730 - protein, 70 aa, Triticum aestivum
  unsure (1)..(70): unsure at all Xaa locations
  Clone ID: PAT_TA_21148.pep
IGQSMSGKSSPTMRGTACILSSYCFRMGQGPLWGRLGPVENLKDRYLGGGRLIVFDXRVICXPLLSSSST

SEQ ID NO: 126731 - protein, 50 aa, Triticum aestivum
  Clone ID: PAT_TA_21149.pep
PPPRTSQASLPVSPQTRPRGSHPAAMRAKWKKKRMRRLKRKRRKMRQRSK

SEQ ID NO: 126732 - protein, 53 aa, Triticum aestivum
  unsure (1)..(53): unsure at all Xaa locations
  Clone ID: PAT_TA_21150.pep
VAHGIXEEEIHGLQGLSQGYLINLRGASQLLSHMKLSRVNLGVPNPGVKCLLT

SEQ ID NO: 126733 - protein, 144 aa, Triticum aestivum
  unsure (1)..(144): unsure at all Xaa locations
  Clone ID: PAT_TA_21151.pep
RPPNTSSTLATNRPRTTARTLVTSPPPTPWRTTPSRRSWTSTTRRSALRGPGSSTRRTGKARCSSPRTARARGGAGDARGPLPFSGFFNSFDGADFADXDPPEGTAARFGTGCCSVGSQTVLCPSRDGVSKLGIDSAPLGLLDV

SEQ ID NO: 126734 - protein, 118 aa, Triticum aestivum
  Clone ID: PAT_TA_21152.pep
SMALLRVVSTAVLPAACCVVLLLLSTTTAPVAMAGSLRDDCRAFCRPRCEGYGADLCHALVNGFPLLQNVLEATCAERFYEVCQPICMNICTANTSLRQRGRELPRRRRHMRQAILTG

SEQ ID NO: 126735 - protein, 156 aa, Triticum aestivum
  unsure (1)..(156): unsure at all Xaa locations
  Clone ID: PAT_TA_21153.pep
MARQQWSSGGLAVAVLAVLSSVLICSGHPVPGGLPLLPHFYGHACPQMEAIVGSLRGXKAHAEDPRMAASLLRMHFHDCFLQGCDASVLLDARRXAAGSSPEKRSNPNKDSSRGFQVVHILKGALGRPARKLSCAESRXAARXLLXNGGXGWKXPX

SEQ ID NO: 126736 - protein, 239 aa, Triticum aestivum
  Clone ID: PAT_TA_21154.pep
MDPAPATPRWNLERPYLTGRFHQEAKVSAASQAPGSKPFSLDSFSRGAGGGAGSVLGSYAVSVQELLVIDDLLSALVGIEGRYISIKRVRGKEGYVVFQIDSSMDLALQELTRRIFPLCEDFVLASQFVESRSHFKNGLVNHALAAALRAFLLDYQAMVAQLEHQFRLGRLSVQGLWFFCQRMMSSLNALAVLIEKAMSNNTSGSATLNLLHSQAKAMAGDSAVRSLLEKMTDCASAAY

SEQ ID NO: 126737 - protein, 150 aa, Triticum aestivum
  unsure (1)..(150): unsure at all Xaa locations
  Clone ID: PAT_TA_21155.pep
LQSTHSIPLPTRRIHANAHAPTRHIQMMLRVSPSPAAAVPTQLSGAPATPAPVVRCGXRPRGVASPAAGAACRAAGXGEKEVLSGVVFQPFEEIKGGVRLVPKSQTIARARQFVDYXXAALNEKLSGVQRLLAYIPRHFNALAKISSFQG

SEQ ID NO: 126738 - protein, 81 aa, Triticum aestivum
  Clone ID: PAT_TA_21156.pep
LCRKEAHVLWKLNTKRPRGLPYQYSVLLELQLCGDFWKVKGVCISIIHRARSSIGGPITIGHQHCSEAPSCCPCQCTGATF

SEQ ID NO: 126739 - protein, 104 aa, Triticum aestivum
  unsure (1)..(104): unsure at all Xaa locations
  Clone ID: PAT_TA_21157.pep
PWYQSYVCTAIHQPLRQNIIISLPIFNDTLWLVRSLTIGYQNYEYIIYVLFIDRLSLHKYXXQKXDRXXTXPSHVQINWGVKACINPQXXLHTHTHTHTLTSIX

SEQ ID NO: 126740 - protein, 191 aa, Triticum aestivum
  unsure (1)..(191): unsure at all Xaa locations
  Clone ID: PAT_TA_21158.pep
MAFPKPTSRLAALAALAAAMAAAMMAATASAQNTPQDFVNLHNRARAADGVGPVAWDARVARYAQDYAAKRAGDCRLVHSGGPFGENIFWGSAGRAWSAADALRSWVDEKRNXHLSNNTCDPASVRHYXQVVWRKSXRIGCARVSRRQPRVSSSELQPRATQRQRRSNLTGAIKQKPAHHVYHHLLMVEPL

SEQ ID NO: 126741 - protein, 141 aa, Triticum aestivum
  unsure (1)..(141): unsure at all Xaa locations
  Clone ID: PAT_TA_21159.pep
MAEVEQPQDAVKLFNRWTFDDVQVNDISLNDYLAVTAAKHATFLPHSAGRYSKKRFRKAQCAIVERLTNSLMMHGRNNGKKVMAVRIMKHTLEIIHLLTDANPIQXVVDAIINSGPLXDPTRIGSLGVLRRXAVXISPLXR

SEQ ID NO: 126742 - protein, 145 aa, Triticum aestivum
  Clone ID: PAT_TA_21160.pep
KEEGKKQTKGRRRCATATAVPNQSTPTHRECAGAAEQRSAAKSLPPPWSLPSGSGSSSGGSVNVVREEGGHGGPDDGGCDRGGAAGGRRSRRLRGQRHGGRGGDEDGAGDLLHLHPWMRRLISDRRDGGGGMGWRRGSLSLLRRS

SEQ ID NO: 126743 - protein, 375 aa, Triticum aestivum
  unsure (1)..(375): unsure at all Xaa locations
  Clone ID: PAT_TA_21161.pep
MGMYVSDLLVQCKEGHRKFLRQGGWEGKKWLSDVYVMDTMSLEWTELAVTGSAPPPRCGHSATMIEKRLLIFGGRGGTGPIMGDLWALKGITEEDNETPGWTQLKLPGQSPSAGRGHSVTSGGPYLLLFGGHGTGGWLSRYDVYYNECVILDRVSVQWKRLPTSNEPPPPRAYHSMTCHRGXRFLLFGGFDGKNTFGDLWWLVPEDDPIAKRDLVPSVGSDSNHSTVTGDAQQSALKESESQSDESPMLELAKRLGIPLYVEPSASFVDEINDKELMELSSRLIGESLPTTDQLACIQALRDHWRSSPSSSIQLQELGPLLRDYQRLIIRRFVESPSPTFLEREDRRLFHLKNASQLRMDDIPILLGEYRTLLST

SEQ ID NO: 126744 - protein, 161 aa, Triticum aestivum
  unsure (1)..(161): unsure at all Xaa locations
  Clone ID: PAT_TA_21162.pep
MARQLFLHPVLLATACLLVSVVLCNAGVADAAWRWPRWDSLFPSRGQQQHHGGYGYHDNGDGSSKSRVASIVTQELYGEMFKHKDDAACPAHGFYTYASFLARGRAVPGVRRRRDWPPGTRGAAFLAQSXRTTGXWATAPTDLAWGLFKEEYXPXCKRRMP

SEQ ID NO: 126745 - protein, 150 aa, Triticum aestivum
  unsure (1)..(150): unsure at all Xaa locations
  Clone ID: PAT_TA_21163.pep
MGMGPLENAASAAAESAALPEAGAASAAGSYAVLQCGEDSEXYVRQKYGGXYFAVFRALLXEDGEXWRVYGPVRGGLPTDAEAAGFDGFXISGNCSDAHGDSPGFWTRRLSPLKPPETISGRLAKICPGLAAHGGHGGRVTDHPGGAPLP

SEQ ID NO: 126746 - protein, 138 aa, Triticum aestivum
  unsure (1)..(138): unsure at all Xaa locations
  Clone ID: PAT_TA_21164.pep
LEITMPKDRSSRVSSQREPPGSCLPILVSVSMDRAVLHAGXKSLLRPRNQTKLKIGRIFGARPEWTTAQGVLLAGRRTKRVPPLWVXTIXGSXLXHYXKAQRXLKGQEXLTXQXKXNPAPFLGITSXRXXPGVXXKRP

SEQ ID NO: 126747 - protein, 127 aa, Triticum aestivum
  Clone ID: PAT_TA_21165.pep
TRLTCKRRMFRRRRSASQRQAARRDWRRTWRHPGPATLGGSRRRCTLHRIVVVEVEQPLAEALNGPLAPRHYYQLLPPETGSTPSVKAKGRTAGQALPQQLGREPPMRSESKQRGYVGGACGVGEGG

SEQ ID NO: 126748 - protein, 179 aa, Triticum aestivum
  unsure (1)..(179): unsure at all Xaa locations
  Clone ID: PAT_TA_21166.pep
DANHHHGNGKAEAEAEAVLCQPASEFLPVMQEVYAALVAKVERAIPGAKVEDNKFCLSVHFRCVEEACWAALFEQVRAVLRDHPGLRLTQGRKVLEVRPMIRWDKGKALEFLLHALGFAADADRDDVFPIYVGDDRTDEDAXKVLRARGHGAGISCQVPKDTTLLKLPPRRKGSGSRGA

SEQ ID NO: 126749 - protein, 99 aa, Triticum aestivum
  Clone ID: PAT_TA_21167.pep
PPFFSSERGSTTCVHHIRLQIQITNRNPPKGKGERKEGEERINKATNAWMGTWMDGAHQLYDRIDRATLYGNARRAAQERSIATAVAPRRVISNLNDGD

SEQ ID NO: 126750 - protein, 109 aa, Triticum aestivum
  Clone ID: PAT_TA_21168.pep
NHLLEKLHPNLIRGSTLNIFKIPQNLTPKKLRGFQDLEAKKFKKKGLGYFVRMHDPIWDDSQGKQNKPFSNSWRELTPNARELGESHFFHPSISFMNGTRRHCLQGFQH

SEQ ID NO: 126751 - protein, 351 aa, Triticum aestivum
  unsure (1)..(351): unsure at all Xaa locations
  Clone ID: PAT_TA_21169.pep
MAVSTSATAAVSFSLPSYPRRLRRRPSLLRAASTAALPSPDLSIQLSPRPSPRASPPVVPSLARDRAEDLQAESRAMTRAAAATVYTLELLASRYGSQPFQVAMRAAEVLSKLGAFGLKLLLDQQRGESSSSAKRRARAVELRTVLTRXLGPTFVKIGQGLSTRPDLCPTEYLEELSELQDSLPTFPDEEAFACIERELGFPLDSMYSAMSPSPIAAASLGQVYKARLKYSEQLVAVKVQRPGIEDAIGRDFYLLRGLGFLINKYVDIITTDAVALIDEFARRVFQELNYVQEGQNARRFKKLYADKQDILVPDIFWDYTRXXLTMEWXRCKLTTAALKASLPDLETWYQG

SEQ ID NO: 126752 - protein, 188 aa, Triticum aestivum
  Clone ID: PAT_TA_21170.pep
EATTAAIEPPARPLMKRQPVGRREPLVTNIMWRNLFVQAIYQIAILLIFNFSGKKILRLQNESSDNAGKMKNTFIFNTFVFCQIFNEFNARKPEERNVFKGVTKNHLFMGIVCVTTVFQILIVEFLGKFFKIVRLNWSLWLVSVAIGVVSWPLAYLGKFIPVPVRPLQAYFKPCWKSSRRDEEEGRQG

SEQ ID NO: 126753 - protein, 102 aa, Triticum aestivum
  Clone ID: PAT_TA_21171.pep
ANVQTNAALPGPAWRRSTPSPSPRPAPPPPRPPAPRPRPRAPPPRPRRPPPRAAGTPARADFAAPVFLFGCPCEPGASPTTTSAPPGSGARVGPIPPAESVG

SEQ ID NO: 126754 - protein, 158 aa, Triticum aestivum
  unsure (1)..(158): unsure at all Xaa locations
  Clone ID: PAT_TA_21172.pep
LARARHLPRHRHHIIYHISYIDALQAGTAAQPRQRAPPAMRKATIFLMALALTLIPHEQTVATPPQPLPLQLRRSRFLAANNVNFSPPPPPSFYDCSKKPPSICLSPGSPGATCCKGTCVDTEYSXQHCGNCNKDCKLAQAAARELVTPHDKRMRGWA

SEQ ID NO: 126755 - protein, 83 aa, Triticum aestivum
  Clone ID: PAT_TA_21173.pep
DYVYKVSLVVTIRTGASQKRAAVFASPSLEPDKPCCSRQSESRGAKAPLDQRTRQQPQPMKRHIDQKGQTCRHTSKDEQRLDP

SEQ ID NO: 126756 - protein, 84 aa, Triticum aestivum
  Clone ID: PAT_TA_21174.pep
IKCASGGNGGGARCQCARCPMPAAAAACCVLCWLSSCSFCLSISRMAFGYGYGPPPLVLLFVSLCDDMISFNIIIDHPSPQKKK

SEQ ID NO: 126757 - protein, 112 aa, Triticum aestivum
  Clone ID: PAT_TA_21175.pep
MQTAKVKAKDMVSSAKEKVKEGSAKMQGKTGEATAATHGEKEMAKEAARAKKDQANADKHQEKADHRADAATGHHGTRVPLTGPHGHHGAGAAVDPAYPSSGNTYPASGKYI

SEQ ID NO: 126758 - protein, 120 aa, Triticum aestivum
  unsure (1)..(120): unsure at all Xaa locations
  Clone ID: PAT_TA_21176.pep
MAASTFSGDETAPFFGFLGAAAALVFSCMGAAYGTAKSGVGVASMGVMRPELVMKSIVPVVMAGVLGIYGLIIAVIISTGIKPKAKPYXLFDGYAXLSSGSPAARWPAAGMXIGIVGDPD

SEQ ID NO: 126759 - protein, 155 aa, Triticum aestivum
  Clone ID: PAT_TA_21177.pep
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRFRGEGLIPLNIVTKHESWVIVTGAL

SEQ ID NO: 126760 - protein, 82 aa, Triticum aestivum
  unsure (1)..(82): unsure at all Xaa locations
  Clone ID: PAT_TA_21178.pep
MSCSSGKCDCGSSCSCGSSCNCMSPNVETAAASSIKTTVLXAAPTTKASAGGFXRRPPQGGGCDCNTCNCGTSCGCSCCSCN

SEQ ID NO: 126761 - protein, 72 aa, Triticum aestivum
  Clone ID: PAT_TA_21179.pep
SWRRSARRRCSPRPTIPVDRAVIMRRPCHPFFLFSFCVCNYLRGVMDFGSFSFLCGVELTLSGFFVPCFALC

SEQ ID NO: 126762 - protein, 153 aa, Triticum aestivum
  unsure (1)..(153): unsure at all Xaa locations
  Clone ID: PAT_TA_21180.pep
MASPKPSSAALLLLAAAAVLALARADLTHDNCVKNKKVTVQNLCSHDVTLTLEPLANSPPLFAGTYTLHPRSHAEFPVCWWTGRLRAPDAAQVEFHVGVDGGSFYLAPNAHRASASRSPSPARSPLQGRCPPSAAHQGRCPVXQVPTGCARLE

SEQ ID NO: 126763 - protein, 124 aa, Triticum aestivum
  unsure (1)..(124): unsure at all Xaa locations
  Clone ID: PAT_TA_21181.pep
MGRSPCCDENGLKKGPWTQEEDEKLLHYIQKNGHGSWRTLPRLAGLNRCGKSCRLRWTNYLRPDIKRGKFSREEEQTILHLHSVLGNKWSAIATHLPGRTDNEIKNFWNTHLXRKRPIQMGFTP

SEQ ID NO: 126764 - protein, 198 aa, Triticum aestivum
  unsure (1)..(198): unsure at all Xaa locations
  Clone ID: PAT_TA_21182.pep
QKLNHPPPHSRLPPIQQPGQAHPQIRPGQGMHNVPPVAAGPGHHYTKPRGPGGPNRYPPGGIQXGXGYNPNRGGQGGGYGSGPYPQQGRGPPYXGGGMGGTAGPRGSGGSGYGAGGPNYQQGGPYGASGPGRGSNYPRWGPRSPQRLRNCLNVDLGVCICCMHSRLAADPVCLYWCSSPSFKALVAIRRCTAPPYRSH

SEQ ID NO: 126765 - protein, 127 aa, Triticum aestivum
  Clone ID: PAT_TA_21183.pep
MAGKAAAATAARWAEGYPWKEKLAKYKGELGKGVWGYWELGAWKPLGISARKRARLRKEVLLAGEDWSYDPPRGEMRTKRKGHKCDRISAEKRANTVELMKKMPQMLLDYKKRRWEKKMKAEESGKI

SEQ ID NO: 126766 - protein, 193 aa, Triticum aestivum
  unsure (1)..(193): unsure at all Xaa locations
  Clone ID: PAT_TA_21184.pep
MCGGAILAELIPPTRRVASKPVTEGHLWSASSKKAGSGRDKRHQHEYADDDFEAAFEDFDDDFDVHEDDEDGHFVFXSKSALSPALHDGRAASQKKQRGRQFRRIRQRPWGKXWRRRFRDPHKGTRVWLGXXSTAEDAARXYDVXPRSAAQGXVNSRAXPSRRRPRRXGTNHGPGHPTPRLCAGGRAIPPVSK

SEQ ID NO: 126767 - protein, 96 aa, Triticum aestivum
  Clone ID: PAT_TA_21185.pep
VLELMVILVTSSSSSKTEFTRIFYDVFDVGGYAGSSQLEVSLLYLLAYLPCLFLLYYRFLFGSSLCEFWSLWSSWGQAQVHRKRSSLASSMMYSTL

SEQ ID NO: 126768 - protein, 180 aa, Triticum aestivum
  unsure (1)..(180): unsure at all Xaa locations
  Clone ID: PAT_TA_21186.pep
DLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFXRTLKLTTPSLGDSLILINATIVLAPADSPSKAT

SEQ ID NO: 126769 - protein, 85 aa, Triticum aestivum
  unsure (1)..(85): unsure at all Xaa locations
  Clone ID: PAT_TA_21187.pep
LGWSAPSPSKLGEGIGCRAAAPGASSNTLFNDKSSYRXLSEIAEQAKRRAEIARLRELNTLKGHVESVVKLKGLDIDTIQQNYTV

SEQ ID NO: 126770 - protein, 123 aa, Triticum aestivum
  Clone ID: PAT_TA_21188.pep
MAEKKRGAGTRKDEVVTREYTINLHKRLHGCTFKKKAPNAIKEIRKFAQKAMGTTDVRIDVKLNKHIWSSGIRSVPRRVRVRIARNRNDEEDAKEELYSLVTVAEIPPEGLKGLGTKVVEDED

SEQ ID NO: 126771 - protein, 110 aa, Triticum aestivum
  Clone ID: PAT_TA_21189.pep
EAQAQEVPRPVPPTPSWMSSANDASACPIRLWHRNLILDPIEGCNAGIAILETSTDGHRAPRWALVNAARTHALDHPYTAPTRATTNSRRHDSPINGILCKTKGKYYPVQ

SEQ ID NO: 126772 - protein, 102 aa, Triticum aestivum
  Clone ID: PAT_TA_21190.pep
SGGGPPPRSPVRGERAAPGVVPPPLAARGRPPGDPIAAPGRSRLYRFVREELGCVFLTGERLKSPGEECNKVFVGISQGKLVDPMLECLKEWDGKPLPINVK

SEQ ID NO: 126773 - protein, 185 aa, Triticum aestivum
  unsure (1)..(185): unsure at all Xaa locations
  Clone ID: PAT_TA_21191.pep
MAPGLYTDIGKKTRDLLYKDYNTHQKFSLTTCSPNGVAITAAGTRKNESIFGELHTQIKNKKLTVDVKANSESGLLTTITVDDLGTPGLKSIINLVVPXTKRSGKLEFQYLHEYAGVNASVGLNSNPMGNLLVPWNKHTSALIPLLRDSDSLYTLPVPHSLRLTATSNPAPRDRDTPGAPRRVDF

SEQ ID NO: 126774 - protein, 134 aa, Triticum aestivum
  unsure (1)..(134): unsure at all Xaa locations
  Clone ID: PAT_TA_21192.pep
MDLSAVQAALSDKSYSTLASLCDELLLQAASQGFTTDEWPYSVHLLAHLYINDLNSARFFWKSLPQEVKDTRPELAAVWRIGQCLWKRDYAGVNTAAQGFXWGPDLADFITAFLGIGLAWIGMNDIEFPNGMWE

SEQ ID NO: 126775 - protein, 320 aa, Triticum aestivum
  unsure (1)..(320): unsure at all Xaa locations
  Clone ID: PAT_TA_21193.pep
CRFGTREHLNTGWPXWLVTVAPEAVQGWAPLQADSFERLSKIGQGTYSSVYKARDPAPAKIVALKKVRFVNTDPESVRFMAREICVLRKLNHPNVIKLEGIVTSPVSQNLYLVFEYMEHDLVGLAATPELKFTESQVKCLMQQILSGLDHCHSKGILHRDIKGSNLLIDGHGVLKIADFGLATFYDPESQQPLTSRVATLWYRPPELLLGATRYSAAVDMWSTGCIFGELLTAKPVMPGRTEVEQIHKIFKLCGSPSDEYWQKXEVPPTGMFKPLCQYKRCIAENFKDLPPSALVLLDNLLALEPEARGTAASSLQSDFF

SEQ ID NO: 126776 - protein, 127 aa, Triticum aestivum
  unsure (1)..(127): unsure at all Xaa locations
  Clone ID: PAT_TA_21194.pep
MSSSGPLPAGTHQTRNRAGNRRKSGDRADKANYSYNNDGEKSNVPSLKNLPPIVHHETXSAMFKNDYNQTGLVPLEGCSASEASQLLSDPWTAAINMYNDQTIDPQLNRGRCPAHNLLLGAPRLPFA

SEQ ID NO: 126777 - protein, 67 aa, Triticum aestivum
  Clone ID: PAT_TA_21195.pep
TRTRIGTPGYMAPEYVQSDGGETTLKCDVYSFGVTLMETLSGRKNCDTPSLVSEVKTILNCLGRSRC

SEQ ID NO: 126778 - protein, 204 aa, Triticum aestivum
  unsure (1)..(204): unsure at all Xaa locations
  Clone ID: PAT_TA_21196.pep
MSKDKHHKHEHHLRRCCGCMASCLLALVLIVAFVSLVVYLALRPSKPSFYLQDLQLRRPISLGDPSLTASAQVTLASRNPNDRVGIFYKRLDVFVTYRDEAVTVPVSLPXAVQGHRDFXVWSPVLXGESVPVAAYVANAMKQDLAAGFSRSTSSGRPLFEVGTGFRYTLDPPSRPGTRFQRRFSKPPSAFDNLPGRPKGIPETG

SEQ ID NO: 126779 - protein, 94 aa, Triticum aestivum
  unsure (1)..(94): unsure at all Xaa locations
  Clone ID: PAT_TA_21197.pep
MTESLVRNKPGMASIKEMPVVQDGPPPGGFAPVRFARRIPTSGPSATAIFLTTFGAFAYGMYQVGQGNKXRRALKEEKIAARSAVLPMLQAEEG

SEQ ID NO: 126780 - protein, 91 aa, Triticum aestivum
  unsure (1)..(91): unsure at all Xaa locations
  Clone ID: PAT_TA_21198.pep
MALRALYNEIRSMKVRDVPAYLKPRLTWDNVKKSADQAVDRYIEKYIDTSSPDPLYHVCIGGMIFSYFVNLPXERAHLAHLEEMERTGGKH

SEQ ID NO: 126781 - protein, 103 aa, Triticum aestivum
  Clone ID: PAT_TA_21199.pep
VNLTLEAKSSNERPPPSKSRLFFSPPGREKKKEMAREKTRHSECSLSLIDRSGLWPPSRITCWRALPPRPAARARHGAVLERVHIQVRRVSRSQLALLRTVTR

SEQ ID NO: 126782 - protein, 412 aa, Triticum aestivum
  unsure (1)..(412): unsure at all Xaa locations
  Clone ID: PAT_TA_21200.pep
MEAFLAGFRAPPRASAVPTARSPPPSPFFLGTRRRKPSSSASVVCMAEPHLISKLDSTEKAWKEMSIRLGDPDIVSDPSEYQKLAQSVADLGEVATAYRESKECERQIEETKALQKENGDDPDMAEMIASELESLSDQLAELEERLTVLLLPSDPLNSRNILLEVRAGTXXDEAGIWAGDLVRMYQRYCELNNWKFKPVSCSEAEKGGYKTYVMEVKGKQVYSKLKFESGVHRVQRVPQTETMGRVHTSTATVAIMPEADEVDVVIDPKDIELKAAISGGAGWQNVNKVETAIDLIHKPTGIRIFCTEERSQLQNKERAFQLLRAKLYEIKXKEQQESIRTQRLLQVGTGARSEKIRTYNYKDNRVTDHRLKMNFVLSSFLLGDIESAVQSCAALEQKELLEEMATSSAVKA

SEQ ID NO: 126783 - protein, 113 aa, Triticum aestivum
  Clone ID: PAT_TA_21201.pep
PKRPHHRGASIPHNGVKYGCKGGYKWRDTKKANPNILVGAMVAGPDRRDGYKDVRTNYNYTEPTLAANAGLVAALISISDIKTGRFGIDKNTIFSAIPPMFPTPPPPPSAWEP

SEQ ID NO: 126784 - protein, 289 aa, Triticum aestivum
  Clone ID: PAT_TA_21202.pep
MAGWYEEAAGLLLRRPALAEMAVDVLLCAVPIWAAVMIGLFIGWAWRPRWTGLIFLGFRSRLRLLYVPPGLGARRLWLACTALSAFSVAPQLLSSAFRRHGKYQRKDPSNDDTDACGDSGACANGRSIFEVKHGIVTEKDLDHLVQLLDNKESGHTTWQHLMERTTSNMTYKAWRHEPEVGPIMHCSQTIFEDATPELVRDFFWDDDFRLKWDPMLVCFKILDEFPLNGTTIIHWIKKFPFFCSDREYIFGRRIWESGKAYYCVTKGIPYPSLPKKEKPRRVELYFSSW

SEQ ID NO: 126785 - protein, 155 aa, Triticum aestivum
  Clone ID: PAT_TA_21203.pep
CSKKQNVQQKNHVPAKNVSPHGQRISPEPNKFSAGCSKIEGQSRQKLIAGRPVSALVVASDAAFWPAGSQPTNLMVAAPRGRSLHRGCQHRWIGVGHKNTMAISAAPSLLITAWALGGAAGCGVRRRRPCRRSGARWARQQQRGLSSRGEKGWRQ

SEQ ID NO: 126786 - protein, 59 aa, Triticum aestivum
  Clone ID: PAT_TA_21204.pep
KTDLAPAVGADLSVMERDALRMREGGPFVFAQVKHGVGVEGIVNHILQAWEIATGNKRR

SEQ ID NO: 126787 - protein, 93 aa, Triticum aestivum
  Clone ID: PAT_TA_21205.pep
TAVRDAMNVEEEVGRLKEEIHRLGQQQPDGSYKVKFGVLFNDDRCANIFEALVGTLRAAKKRKILTYEGELLLQGVHDNVEITLLPPPAVAAA

SEQ ID NO: 126788 - protein, 90 aa, Triticum aestivum
  unsure (1)..(90): unsure at all Xaa locations
  Clone ID: PAT_TA_21206.pep
MAQPAFLSSLRSRLGSAPPPPPNHRLQPRRGYHVELGAREKALLEEDVALKRFKSYKNSVKQVSKIGEXLTLAVVLACSYELAVLATSTK

SEQ ID NO: 126789 - protein, 66 aa, Triticum aestivum
  Clone ID: PAT_TA_21207.pep
KAAFTFFPCEILKLRICSKEILVTNVFFFFFHLRIHFPSCSLYFTFNFFSCNRSEVEHCSRALFPQ

SEQ ID NO: 126790 - protein, 137 aa, Triticum aestivum
  Clone ID: PAT_TA_21208.pep
MIITTAAFPSVSSFHRPHHRPCPRRAVLQLVRSAASSSSSSAWEEREEARWLREEQRWLREEQRWLREESRWRAEREALLAEITALRLRLRALEPLPPAAKPVPPPAPAARVAPSPPTPAPAARVAPPPSSPTPAAR

SEQ ID NO: 126791 - protein, 182 aa, Triticum aestivum
  unsure (1)..(182): unsure at all Xaa locations
  Clone ID: PAT_TA_21209.pep
MSTVTSCTFLSLGSPVRPAVSSARPAAAAVASRRRPRSLSVCCEAGRKGDHNPKTDLHPFNIPAFVLVHPVAPREERWQLEEDADKVNLWFXVPGQSKDDXTVEIDEDLLVIKEEEGLVGNGALLAVAPNTVASNNRQEGNANGRNSRRQTRQAASVMPDLSGGKRDARPTTRVRPPEYHIT

SEQ ID NO: 126792 - protein, 274 aa, Triticum aestivum
  unsure (1)..(274): unsure at all Xaa locations
  Clone ID: PAT_TA_21210.pep
MSAETEKSAAAPAPAPMRCQRIGCDAMFTDDDNPDGSCHYHPSGPMFHDGMKEWSCCKQRSHDFSLFLAIPGCATGKHTTEKPVTKAVSLNSKATPPKLAPVQSSKQGVETEACSRCRQGFFCSDYGSQPKAQKXPVAVNGTNTXEPVEKCSVPQPKKKVVNINEXPRVCKNKXCGKTYKXEKDIHDAACEYHTGPAVFHDRSRMSXKCCDVHVKEFDEFMEIPPCTKGWHNADAGVSSHHDSCIKSYICCIISWCIRLASCRNLWRSMLGSVT

SEQ ID NO: 126793 - protein, 73 aa, Triticum aestivum
  Clone ID: PAT_TA_21211.pep
VVVHHGHHHHFTGHRHGMDPTPHHMHWFLSTSIQSQSIAGHPGAFSSLGLLSHRGLVLFYLSSFLSIGLIGSP

SEQ ID NO: 126794 - protein, 51 aa, Triticum aestivum
  Clone ID: PAT_TA_21212.pep
AFQRVREIGPEADDPDRRRQRQHRGLRMKQQNHHQPNNLGGRPFQVVISEQ

SEQ ID NO: 126795 - protein, 47 aa, Triticum aestivum
  Clone ID: PAT_TA_21213.pep
TVHGPSYRITRTNSPHKYRKLSLSLSLSHDQRVGTLIHGFILLSMER

SEQ ID NO: 126796 - protein, 120 aa, Triticum aestivum
  Clone ID: PAT_TA_21214.pep
LGDPPPSAPAPPPPRRRRPRGGRAAPPHPPRPGEGPGRASAGPLRGHLGRCACAPRPGLSPTARLLLLACWRSLPGIPWTGLVRTARATPRHSITRLQRWPLLPLDQHGLPRLAGGADAA

SEQ ID NO: 126797 - protein, 188 aa, Triticum aestivum
  unsure (1)..(188): unsure at all Xaa locations
  Clone ID: PAT_TA_21215.pep
GRAVSIADVFLRFLAIVATIGSAVSMGTTNETLPFFTQFIQFEAKYSDLPSFTFFVAANAVVCTYLXVLSIPLSIVHIVRPRAHYSRLILLFFDAAMLXLLTAGASAAAAIRYRAHKGTAPPWARLPHPFLLRRTRVIIGPSPHGLLIASLPASRSPTTDISPHNRDHIEAKDFVPGHCVIQADSRVC

SEQ ID NO: 126798 - protein, 112 aa, Triticum aestivum
  Clone ID: PAT_TA_21216.pep
LLVLPINRAVRRVSSCSCSCLCVSFFFSGRILETGRMAVNGPICRFTPGCHCLFFIFEREHQASSAMNQELSVATCGVVTAGLLLVLLPGLRPPGCSARRGGQSLFFSHQLF

SEQ ID NO: 126799 - protein, 73 aa, Triticum aestivum
  unsure (1)..(73): unsure at all Xaa locations
  Clone ID: PAT_TA_21217.pep
MATKLVVLGIPWDVDTEGLREYMAKFGXPLDDCASMKERSPGRSPGFGYVTFASADEQRMFLDANISGTRTLE

SEQ ID NO: 126800 - protein, 110 aa, Triticum aestivum
  unsure (1)..(110): unsure at all Xaa locations
  Clone ID: PAT_TA_21218.pep
MVATKKTKKSTDNINNKLQLVMKSGKYTLGYKTVLRTLRNSKSKLVIIANNCPPLRKSEIEYYAMLAKXTVHHFHGNNVDLGTACGKYFPVCCLSIIDPGXSDIIKTTPG

SEQ ID NO: 126801 - protein, 188 aa, Triticum aestivum
  unsure (1)..(188): unsure at all Xaa locations
  Clone ID: PAT_TA_21219.pep
PLRCARFPRAVRNLTWPCRRWWSTXVVFPPVARPPGSAGSHFLGGAGVRGLEIGGNFIKFTAIGVYLEDAAVPALAKKWGGKTADELASDAAFFRDVVTGDFEXFTRVTMILPLTGEQYAEKVTEXCVAFWKAAGLYTDAEGSRGEFKEVSSQRLRAGRLTSYASPAGSQRRFSRISVNGRAGKHALR

SEQ ID NO: 126802 - protein, 75 aa, Triticum aestivum
  Clone ID: PAT_TA_21220.pep
FATELNYMVNKTCKFKEIISRQEVNFMVPLGKCTLAPAGLHRRVPAGRAPHTHPLTTEHCRISSSCRLQACRRSR

SEQ ID NO: 126803 - protein, 73 aa, Triticum aestivum
  Clone ID: PAT_TA_21221.pep
KLYCHRSFNMWGLPPILDSQKLRTNVEILLVHPKTLNPICLRAPIPTYGWSRSSSKLSSVQKGIKCPKMQSLC

SEQ ID NO: 126804 - protein, 132 aa, Triticum aestivum
  unsure (1)..(132): unsure at all Xaa locations
  Clone ID: PAT_TA_21222.pep
NGLTSNLAGSRNPSLDYGFKGTEIAMASYCSELQYLGNPITNHVQSAEQHNQXDVNSLGPPSPAKEDRRGDSTSLKLMXSSTYIRGAVPRPWDLRHLRRRTSRRPVKEHRDPKWPRXVLTMNPXGXSSNARF

SEQ ID NO: 126805 - protein, 50 aa, Triticum aestivum
  Clone ID: PAT_TA_21223.pep
GEDAPQQPPPDVAGKMFEPPLRAWAAARPAQEDDSDSGSGKKAPPLLLKF

SEQ ID NO: 126806 - protein, 227 aa, Triticum aestivum
  Clone ID: PAT_TA_21224.pep
GIRHEPPVRKATTILTLSSSPAAAARRSPARATISDPHLRQYPVRTSRLRVAQSLASRPLSSGWRRRRRGSGLVVRAETFGQLTTGLDSAWNKLRGVDVLTKETIVEPMRDIRRALLEADVSLPVVRRFVSSVSEKALGSDVIRGIRPEQQLVKIVHDELVQLMGGEVSDLVFAKPGPTVILLAGLQGVGKTTVCAKLAFYLKKLGKSCMLVAADVYRPAAIDQLTV

SEQ ID NO: 126807 - protein, 101 aa, Triticum aestivum
  Clone ID: PAT_TA_21225.pep
VGAVLRQGRAVVGVLVVLVSSSGSVLKSSCSSRLVEISGSPLTASFVFRNVIRDLFFFVACLCTCTNLSSVTRSNYRLRLVNCFCPISELTDIHRVALPPF

SEQ ID NO: 126808 - protein, 155 aa, Triticum aestivum
  unsure (1)..(155): unsure at all Xaa locations
  Clone ID: PAT_TA_21226.pep
MAAAGSSPSFSSSSKRLEGKVALVTGGATGIGEAIVRLFXTHGAKVCIADIQDEAXWQQLRDALGGDAQGAMFVHCDVTXADDVSRAXDAAAERSGALDVMRNNSGVSGPSDGHPQRGLRAPGAPLNCTLSWDEHPASAERVHSWQLAHRRTAAL

SEQ ID NO: 126809 - protein, 173 aa, Triticum aestivum
  unsure (1)..(173): unsure at all Xaa locations
  Clone ID: PAT_TA_21227.pep
GAAARAPAAVHARRDRRAEPDGHPPHLGRXARRTRPCRGAPSGDTVAIRRPPHGRARRPAQTPSPVGRAXGHLHADSATRXVIXGPHHLLLTGRAFQRHTXFGGRRDRFTTNQGLPVVRGPGSAGSXTSXDTQVXPXSMSGLDCTVVHADKTHTTXLVCIGSINKCRSSFXPX

SEQ ID NO: 126810 - protein, 191 aa, Triticum aestivum
  unsure (1)..(191): unsure at all Xaa locations
  Clone ID: PAT_TA_21228.pep
LRSAKPAETERSPWPASPPLLPTTVVPAAAAPPTPAPTAISSADATDTNPAAIRAFLSRLLDTTRRALSGARPWXELADRSALSRPESLAEATSRLRKNLAYFRVNYAAVAALCLAAALLAHPSPWARCWALLAAWCLXYVLRPADARPSPRSAHFSDRARWLPPLASSLLAGGPYLSAPPGAPCCPASLP

SEQ ID NO: 126811 - protein, 150 aa, Triticum aestivum
  unsure (1)..(150): unsure at all Xaa locations
  Clone ID: PAT_TA_21229.pep
MAGMTVGNKLALAAVLLCAAAAMATAQQASGVRATYNFYNPQQNNWDLNAVSAYCATWDASKPLSWRMKYGWTAFCGPAGPTGQAACGQCLLVTNTATGASITVRIVDQCSNGGLDLDYDTAFKPIDTNGQGFQAGHLTVNYXFVNCGDN

SEQ ID NO: 126812 - protein, 304 aa, Triticum aestivum
  Clone ID: PAT_TA_21230.pep
MGTQAAPATSEIAAVGVIGAGQMGSGIAQLAAAAGCGVFLLDSDPAALSRAAASISSSLGRLVSKGQLSQAACDDSVKRIKCVSDVQELRGVDLVIEAIVESEDIKKKLFVELDRITKPSAILASNTSSISITRLASATGRPSQVIGMHFFNPPPIMKLVEIIRGADTSEEIFSRVKSFSERIGKAGVGPQDYPGFTVNRILMPMINEAFWALYTGVQSGGDLSTRRHRGAARPVCPLQLADFIGLDVCLSVLRLLHNGLGDNKYSPCPLLVQYVDAGRLGKKRGLGVYSYGRSSSSVKPKSSL

SEQ ID NO: 126813 - protein, 97 aa, Triticum aestivum
  Clone ID: PAT_TA_21231.pep
EHGFERGQCRVAGKHGLRETGGEHGDLPFFFFLHACVKGRRRLNRAIQTVYLYGIQRLAADRPKLRPVRRRLAACIHRIRLKRRRGALYRSRADPSK

SEQ ID NO: 126814 - protein, 174 aa, Triticum aestivum
  unsure (1)..(174): unsure at all Xaa locations
  Clone ID: PAT_TA_21232.pep
MATLNPFELLGADDNDDPSLLIAAAAAAAQKAEAKKSAVAPAGKAAQPAATTKFPTKPAPPSQTVRDARGGGSSARGGFGRGERGRGKSGRGYGQNRGFSGDNXNEFKGSYGGXRYGDGAVXGGSKGERETDTRPPYRGGGSRGGCRCVGLPMALGGSTQTLCRLSATGMPVWG

SEQ ID NO: 126815 - protein, 88 aa, Triticum aestivum
  Clone ID: PAT_TA_21233.pep
MRRSYGGAPPSLAHDAAMPGFGLDKVSYHYQPLPLPPYYVGSSSGSSDDASVGSLGLLQADGAPQDGASAGDIWSLDELLMLAAAGAY

SEQ ID NO: 126816 - protein, 147 aa, Triticum aestivum
  Clone ID: PAT_TA_21234.pep
MEPFMSIPVARWLQLACSAACKTIDTVNELHDARPQAAATLTRMLPHLAIVKNAMAIEVQETKKLVMRADEERASRFPNYYTEITEEPKTRPVSEEAMIFGRGSDKERIIAALLCSTEPNITQEHITILPIYGLEGSGEDNLGTNGI

SEQ ID NO: 126817 - protein, 75 aa, Triticum aestivum
  Clone ID: PAT_TA_21235.pep
PVQIFVSNHLIPDDMEFQSGDVPNYTTSDGSVKIQKESEVRLKIIGTRVDATEIFCIGTIKDDFLGVISDPGAAV

SEQ ID NO: 126818 - protein, 104 aa, Triticum aestivum
  unsure (1)..(104): unsure at all Xaa locations
  Clone ID: PAT_TA_21236.pep
RRRLLLATCRPRRPSPAPPLAAPPRSAEASAPPPTTRAGPCWPPPAARGRRREPRPAPGPGRRWAATRHXPPPSPPPSPSPSAMSEGEDDGPPDAWVDPGFRTG

SEQ ID NO: 126819 - protein, 131 aa, Triticum aestivum
  unsure (1)..(131): unsure at all Xaa locations
  Clone ID: PAT_TA_21237.pep
EEDTGAQVAPIVRLEEVAVTTGEEDEDVLLDMKAKLYRFDKDGNQWKERGTGAVKLLKHKQTGKVRLVMRQAKTLKICANHLVXSTTKDAGACGQRHSCVWHAADLPMANLRRIFAIKFGSVENCKNSRIG

SEQ ID NO: 126820 - protein, 165 aa, Triticum aestivum
  unsure (1)..(165): unsure at all Xaa locations
  Clone ID: PAT_TA_21238.pep
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTXYGFGGKSLPHLVANCICVAVAFVCLINVSVLKCPVSVGLYPFCNTTCITMGNLVQKKKRAVPPMVYN

SEQ ID NO: 126821 - protein, 129 aa, Triticum aestivum
  unsure (1)..(129): unsure at all Xaa locations
  Clone ID: PAT_TA_21239.pep
MATMNHRIVPLLLVAATLLAQAAACPYCPTPKPPPPPPPSSSSTPCPPPPYSPSPSTPTGKCPVNTLKLLACVDALXGPVHAVIGTKAKRXCCPLLXGVADLDAALCLCTPSSQGAQRHLVLPSHLGAR

SEQ ID NO: 126822 - protein, 91 aa, Triticum aestivum
  Clone ID: PAT_TA_21240.pep
GCTKCHQYQCLLLGSRASVPMPNPGRPRARRAPWENETAVGTPVAARLEDPSRSLLTPEVGGDGGPGPGPDGHFGDGPGARPRMRAGQRHR

SEQ ID NO: 126823 - protein, 123 aa, Triticum aestivum
  unsure (1)..(123): unsure at all Xaa locations
  Clone ID: PAT_TA_21241.pep
DKMRLGWTLTDLSLDKLGTERTVDTPKGLIDQGDTEAGRAGTTSMIQETSRASKSQGDLFSLHPSTPGGAETPAPAGRSTRPALPRPWCKARGARPMAGGPITTRRGXPTHIPSXPEADYRXX

SEQ ID NO: 126824 - protein, 60 aa, Triticum aestivum
  unsure (1)..(60): unsure at all Xaa locations
  Clone ID: PAT_TA_21242.pep
PPPXPVIVGAVGGGAMMVSGGGGGGAAASGGAAAEAXPKEEKKEEEKEESDDDMGFSLFD

SEQ ID NO: 126825 - protein, 122 aa, Triticum aestivum
  unsure (1)..(122): unsure at all Xaa locations
  Clone ID: PAT_TA_21243.pep
SCRFDPVEYDGKVFVPGQSNNAYIFPGFGLGLVISGAIRVHEDMLLAASEALAAQATQENFDKGSIFPPFTNIRKISARIAAAVAAKAYEPGLXATRLPPPRDLXVKYAQSCMYTPVYRNYR

SEQ ID NO: 126826 - protein, 190 aa, Triticum aestivum
  Clone ID: PAT_TA_21244.pep
LQIQSSPSANPPRLQIPGRQAANQPWSASRRSCSSWASSASTASPRRSSEARTARSSRASRPPSRCPSPRCSSCTSPSRTRSSPTSTPTTRPWTHPPPGTDTQRRLLSRLRLRLARPAPLQVRLPSRALLSPLSVRRSVSVASVSGQARRANFRACLRRARVWRRSPHVLPLSLAKASVSFLSKVGSGPS

SEQ ID NO: 126827 - protein, 104 aa, Triticum aestivum
  Clone ID: PAT_TA_21245.pep
MSGRGKGGKGLGKGGAKRHRKVLRDNIQGITKPAIRRLARRGGVKRISGLIYEESRGVLKIFLENVIRDAVTYTEHARRKTVTAMDVVYALKRQGRTSMLPRLS

SEQ ID NO: 126828 - protein, 146 aa, Triticum aestivum
  unsure (1)..(146): unsure at all Xaa locations
  Clone ID: PAT_TA_21246.pep
MILAVLFANSDGNILVERFHGVPAEERLHWRSFLVKLGSENLKGSKNEELHVASHKSVSIVYTTVGDVCLYIVXGKDEYDELALXAEVIFAITSAAKDVCAKPPTERLLLDKYGRFCLCLDEIVWKGALKTRRKQIRVDKQPVGCI

SEQ ID NO: 126829 - protein, 116 aa, Triticum aestivum
  unsure (1)..(116): unsure at all Xaa locations
  Clone ID: PAT_TA_21247.pep
MTSGPHANVRGDLAKPPFFLYGNVVNITKDAWSEISGFLSGVQPEFINSQLFSALMRREGYLHNLPTERRHVAVPNPPMXTMEDACLPPRHYWATWDTXRKHIGSVTSKVARITLW

SEQ ID NO: 126830 - protein, 254 aa, Triticum aestivum
  Clone ID: PAT_TA_21248.pep
QHLRALSLFVHKLHMPERAVGYCDRVYEEGAQQPSKSNIYFNLLQIYLNPKKAEKEIEQKIIPMASQYPGIQRVNSTNKLRGGRMCRKVVEIEGAEDTRFSPSGPDSGRSDGDGDDVSDGGPIMLNEALELLSQRWDRINGAQALRLLPRDTKLQDLVSFLEPLLRNSSEHRRNYMVIKNLILRANLQIKEDLYKRRQAVVKIDGDSMCSLCHKRIANSAFAIYPNGQTLVHFVCFRESQQIKAVRGANSAKRR

SEQ ID NO: 126831 - protein, 182 aa, Triticum aestivum
  unsure (1)..(182): unsure at all Xaa locations
  Clone ID: PAT_TA_21249.pep
MKTILASETMDIPEGVTVTVAAKLVTVEGPRGKLTRNFKHLNLDFQLQEGGRKLKVDAWFGTRRTMAAIRTAISHVQNLIKGVTKGYRYKMRFVYAHFPINASITNSNTAIEIRNFLREKKVRKVDMLDGVPTPRSERLKDHLILDGNALELLSRXAALINKNSHVDKTHTTTFVSGIYVTV

SEQ ID NO: 126832 - protein, 131 aa, Triticum aestivum
  unsure (1)..(131): unsure at all Xaa locations
  Clone ID: PAT_TA_21250.pep
WIGQKVQIVGDDXLVTNPTRVAKAXINEKTCNALLLKVNQIGSVTESIEAVRMSKRAGWGVMASHRSGETEDTFIPLLAVGPSTGQIKTGAPCRSERLAKYTQLLRXIEEELGDAAVYAGXAKFRAPVEPY

SEQ ID NO: 126833 - protein, 61 aa, Triticum aestivum
  Clone ID: PAT_TA_21251.pep
NYGSFQGRCVICGGVGISDAYYCKECTQQEKDRDGCPKIVNLGSAKTDLFYERKKYGFKKR

SEQ ID NO: 126834 - protein, 88 aa, Triticum aestivum
  unsure (1)..(88): unsure at all Xaa locations
  Clone ID: PAT_TA_21252.pep
FXRDPYELTFTYDSLFVXDWTRLGRPPLGAGWGGPAHGLPFSYNPFMAVAVIGAPPKPKPGARXIMTMCVGAAPARSSREQMLSQQAA

SEQ ID NO: 126835 - protein, 136 aa, Triticum aestivum
  Clone ID: PAT_TA_21253.pep
MAPKAEKKPVATEKAPAGKKPKAEKRPPASKEGGEKKGKKKSKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 126836 - protein, 153 aa, Triticum aestivum
  unsure (1)..(153): unsure at all Xaa locations
  Clone ID: PAT_TA_21254.pep
MPKSKRNRPVTLSKTKKKPGXERKGKVVAEIKDAVDKYSSAYVFXYDNMRNXSSRTSREQLKSSSKDFPRRGRRFCQIPLGRSPADEAKTGLHKLSKFLQGNSGLLFTNLQMMLDFRESGHDLKDRSMLSYVTKKPLDINMRWHSPSRLPYKF

SEQ ID NO: 126837 - protein, 149 aa, Triticum aestivum
  unsure (1)..(149): unsure at all Xaa locations
  Clone ID: PAT_TA_21255.pep
MEGKEEDVRLGANKFSERQPIGTAAQGTDDKDYKEPPPAPLFEPGELKSWSFYRAGIAEFVATFLFLYISILTVMGVSKSTSKCATVGIQGXIAWSFGGMIFALVYCTAGISGGHINPAVTSGCSWRGISSQGGVYTSCMPGRICGAGV

SEQ ID NO: 126838 - protein, 266 aa, Triticum aestivum
  Clone ID: PAT_TA_21256.pep
MAATLFSISPMFLSLPSSSSSFKQAPSAFFPSKTPQHRALASAGWRHPLASLAVSVSSDVETEVAQEFSEDLRVFVGNLPFSVDSAQLAGLFEQAGSVEMVEVIYDKLTGRSRGFGFVTMSTVEEVEEAVERLNGYVLDGRSLKVNSGPPPPRDQSSPRGFREQSGGFRQQSSRGPGGGDNRVYVGNLSWNVDDSALANLFNQQGSVLGARVIYDRESGRSRGFGFVTYGTSDEVEKAVSNLDGSDLDGRQIRVTVAEVRQPRREY

SEQ ID NO: 126839 - protein, 360 aa, Triticum aestivum
  Clone ID: PAT_TA_21257.pep
MASEQTVHMNGGQGDTSYARNSSLQNAEQNKMRPLIEEAIADLLSTGASLPRSMVVADLGCSSGPNALTLVSICVDAIRSQCLRSRQPPVEVCVFLNDLPDNDFNMVVKSLVAFQQSHRSVVTGVMPGSFYGRLFTSGSLHLACSANSLHWLSEAPEELRRNKIPAYDIDEHVRRERRRVVIGAYARQFRKDFTLFLELRAIELAAGGRLVASLAGRRSEEPAAEFTHAWESVALVLSEMASKGMINRAKFDTFYIPIYGPSDEELREIIQAEGSFSIREMQVHEPASNVESTLISPSKMANLLRAGFEPIIVQHFGSSGKIMDEFVRTAERRWSRRGSLEAELARNPRVILVVSLKKKV

SEQ ID NO: 126840 - protein, 153 aa, Triticum aestivum
  unsure (1)..(153): unsure at all Xaa locations
  Clone ID: PAT_TA_21258.pep
MAVAELWETLKQSIVAYTGLSPAAFFTAVAVAAALYHVVSGLFAAPAPXPPRPREEPEAEPLPPPVQMGEGLKRRSSASYDGSDPKKPLLMAIKGQIYDVTQSRMFYGPGGPSPPRAGPHPAEPLRPWPSGLRPARDSPPTPFYSSLRVANYL

SEQ ID NO: 126841 - protein, 150 aa, Triticum aestivum
  unsure (1)..(150): unsure at all Xaa locations
  Clone ID: PAT_TA_21259.pep
NXXCXRSHTEXRVVFNKPNQFNLVYLFSSGGRARVPWYCLNDSDHGSEAPFQQLPHVHQACSFHMKCQENCTMIGFRVSQTNQPANTPLGHLGYLLPKEELVLDGAQEGGGGHVLSPSGAHVGLFSPTSPDVQPLWPFSEKREHRTNRLL

SEQ ID NO: 126842 - protein, 167 aa, Triticum aestivum
  Clone ID: PAT_TA_21260.pep
MIPALARRVAKGRLTVALSPLSGRFAFSAPQRPVRPPRLFLRSSTSGSAAACSASVSAAGVSASSFTSPAAAGSRLRLLLGLFLRLPPGAASGSAAAAGSVSAGAAGSSTLASAAGAASSGTTAGGAGVSTAGASSVATTVGVWTSAVAMGDDQKADDYTTEWLATS

SEQ ID NO: 126843 - protein, 138 aa, Triticum aestivum
  Clone ID: PAT_TA_21261.pep
MTAQAAEELAAQIEQQKLEEQKTEAEEVVVEEDDEDDEDDDDDDKDDDELDGQEGDGSGKSKQSRSEKKSRKAMLKLGMKPITGVSRVTVKKSKNMLFVISKPDVFKSPNSDTYVIFGEAKIEDSAPAADQAAEHSSS

SEQ ID NO: 126844 - protein, 135 aa, Triticum aestivum
  unsure (1)..(135): unsure at all Xaa locations
  Clone ID: PAT_TA_21262.pep
MGIDLVAGGRNKKTKRTAPKSDDVYLKLLVKLYRFLVRRTKSNFNAVILKRLFMSKTNRPPLSMRRLVRFMEGKGDQIAVIVGTVTDDKRXSEVPAMKAARSGSTETARXVINAGGECLTSXLALRAQLGQNTVC

SEQ ID NO: 126845 - protein, 240 aa, Triticum aestivum
  unsure (1)..(240): unsure at all Xaa locations
  Clone ID: PAT_TA_21263.pep
MGAKIFALLALLALSASAATSTFIPQCSQQYLSPVTAAGFQYPTIQSYMVQEAIQASILRSLALTLQQPYALLQQPSLVHLYLQRIAAQQLQQQLLPTINQVVAANLAAYLQQQQFLPFNQLAGVNPAIYLQAQQLLPFNXLVGSPYAFXLQQQLLPFHLQAVANMGAFWTQPQLSPFVPLGAGSLCPLLQRQRALPFFPLNVATLVALLQQQQLLPFSQHALTNPTTLLQPPTIGGAIF

SEQ ID NO: 126846 - protein, 198 aa, Triticum aestivum
  unsure (1)..(198): unsure at all Xaa locations
  Clone ID: PAT_TA_21264.pep
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNXRLNFDAXHGDKDTGLHDGRVLSGMCKAKQTEVSWVQAILAASGGRPFPLGAPRMTSGGHGAVLTTGH

SEQ ID NO: 126847 - protein, 130 aa, Triticum aestivum
  Clone ID: PAT_TA_21265.pep
PCALGRLRVRVPCVLHQAGGDGYVRVVPRTHGGHGLDLHRLQWPTPSACRTRRASSPPISGGDVRTVLLSKKGSRWLVVSLVAPGTGGLPSRCHMRDLRPEDDSLQPCLTPEARSFVRVPPEALSFRVRA

SEQ ID NO: 126848 - protein, 108 aa, Triticum aestivum
  unsure (1)..(108): unsure at all Xaa locations
  Clone ID: PAT_TA_21266.pep
MSSSSSALAKGKSAIGSAAGSAKFEAKGKFSSSSSPAAAATKRGTTTSSSRGRGRGKADKKVYSLPGQKFVPPEEREPLRIFYESLSKQFPPXEMAEFWLMGHGMLSP

SEQ ID NO: 126849 - protein, 83 aa, Triticum aestivum
  Clone ID: PAT_TA_21267.pep
IYDTRRKECRAHVLHAFIHDIIICTAQHLFTLFLTTAKPLRVFFFNLQARRHSTTLPSNIELNVFLLLAGTSLVRARKTSFFS

SEQ ID NO: 126850 - protein, 140 aa, Triticum aestivum
  unsure (1)..(140): unsure at all Xaa locations
  Clone ID: PAT_TA_21268.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLVVDXTTGGLRRYPKDGRPHASCFTLE

SEQ ID NO: 126851 - protein, 142 aa, Triticum aestivum
  unsure (1)..(142): unsure at all Xaa locations
  Clone ID: PAT_TA_21269.pep
MAVSFANLSSEAGLKKLDEYLLTRSYITGYQASKDDLAVYTSFSSAPSSKYINVARWFNHIDALVRLSGITAEGQGVKVESSAXPSTPTPDVAEAQAPVAEEDDDDDVDFLGEETEDEKKXAENVLQLQSSGKKKDLGITVY

SEQ ID NO: 126852 - protein, 173 aa, Triticum aestivum
  unsure (1)..(173): unsure at all Xaa locations
  Clone ID: PAT_TA_21270.pep
MAQFLRGKAAAAAGAAVLRASSPAPWRRTASASYHHTIQAVPRETAGPRAAARERRHGRVPAVLLTLAGAAPGNGIAHRHLLTADRRQLAEMLKQSPYFLSTPVRLQVRAGERSNAILHAGTVLPIKVHRDENSGNILNLVMVKADEGTMLKVDCXCRFKGKDXCPGLKKGGF

SEQ ID NO: 126853 - protein, 103 aa, Triticum aestivum
  Clone ID: PAT_TA_21271.pep
MSGRGKGGKGLGKGGAKRHRKVLRDNIQGITKPAIRRLARRGGVKRISGLIYEETRGVLKILLENVIRDAVTYTEHARRKTVTAMDVVYALKRQGRTLYGFGG

SEQ ID NO: 126854 - protein, 97 aa, Triticum aestivum
  unsure (1)..(97): unsure at all Xaa locations
  Clone ID: PAT_TA_21272.pep
XQGXYSGYXXSXTAXGIXGGGXGGQAAGAWNSNAQGSGSGTGSGSSYANRYWYGSSEAGASANGNGGGTGNSQNGGSGGGSGAGSGFGNAXTPNFYI

SEQ ID NO: 126855 - protein, 102 aa, Triticum aestivum
  Clone ID: PAT_TA_21273.pep
PLVGSGSGIRPGIAPNVKFGGSGSYPDLPWVSTTGAGPNGRTISGVTYNFGRNEVKIVCACHGTHMTPEEFTRHASVDATGQENNATMSAFPVGNQAASAQN

SEQ ID NO: 126856 - protein, 47 aa, Triticum aestivum
  Clone ID: PAT_TA_21274.pep
FTQAVELLLQLCNLTELEWSSEAMLTCPLSVLPSPMSSNHINKSQAL

SEQ ID NO: 126857 - protein, 170 aa, Triticum aestivum
  unsure (1)..(170): unsure at all Xaa locations
  Clone ID: PAT_TA_21275.pep
MWRRLHTLAPALRRATAAAAGGPAVPASSAARAAPLSSAAAGFRRTSPLLSEDKPARVEDVMPIXATGLRAGGARGRLQGKKRFDMDSPVGPXGTKEEXXVIEPYYNKRISVFLVAGVDTYLLVPGLVKDNRMMSVAPILVLKWDVNQMHDMRYATRVIKLEYHQFNEEP

SEQ ID NO: 126858 - protein, 359 aa, Triticum aestivum
  Clone ID: PAT_TA_21276.pep
MAGKGAKATAAKAAEKEKGKKAPGSRSSRACSQEEPVPKKDVYQLFAEKVRDNKQLESRWAVMQETRVEYFRGKDFTTFIKNHPEVGEILGPDKDMEAEDIVNTLLIKNLVIRCDRVWKTVRPGKKKLSSWPAHLEIHQEQVFTENDGFYAWMFLKRRTLWQTILSFIWPVFALAVCLFPVYPYQCKIVVLYSCAGALLFIVSLLLLRAAIFGVLWVLLGKRVWFFPNINAEETTFRELVRFWPVKDEGERPKWTSRLFYATVALLVILLLRHHAPDEAARARYQKKVSNIIDDVLEWSPKLALSGMMDKHTEDNATETSNYTSHATTSTEESTDAAEDEDADETQGAADDTRTRSSEV

SEQ ID NO: 126859 - protein, 82 aa, Triticum aestivum
  unsure (1)..(82): unsure at all Xaa locations
  Clone ID: PAT_TA_21277.pep
LAALRVLLADDPEAVHKHDLNTLMSLDVQVPLGPTVEASALRTVLALCADCSPTLSTQKIMGRPGHPRRWARLLSRNWPSXF

SEQ ID NO: 126860 - protein, 139 aa, Triticum aestivum
  unsure (1)..(139): unsure at all Xaa locations
  Clone ID: PAT_TA_21278.pep
MAAAPAGGGPRALSQREQDIQMMLAADVHLGTKNCDFQVERYVYKRRTDGIYIINLXGKTWDKLQLGRQGHPLPLENPQDIIXVQPASPMARGVLKFAXYTXAHPLLAAIPGNSQPFQLLHEHXSILTDPXXYHPLDLP

SEQ ID NO: 126861 - protein, 119 aa, Triticum aestivum
  unsure (1)..(119): unsure at all Xaa locations
  Clone ID: PAT_TA_21279.pep
MDPKMTEVTQMFARFKAAYARNDLDACVTLLSXQLKVHLTQFPSLPPSFEQTPNAVEELKXARDIYEHAVVLXSVNLEDQGACRRVAAGLXSCFVSCALSPPQPRGVPIXGLNLLKVVG

SEQ ID NO: 126862 - protein, 152 aa, Triticum aestivum
  unsure (1)..(152): unsure at all Xaa locations
  Clone ID: PAT_TA_21280.pep
RLPAVLRCAPPFRLHAADVHHTARSTHPIPPWRRRWRAVAAATTAEDEARLLRLEEQAEHGGGGAWDYLCLARRLRARRPRXVLRVGLALLNNASARSGLASEQWTLYEQVATAAWIASVSXXAKDCIGVLSKAIPWQHRVARLELFCLKRK

SEQ ID NO: 126863 - protein, 192 aa, Triticum aestivum
  unsure (1)..(192): unsure at all Xaa locations
  Clone ID: PAT_TA_21281.pep
MAAAALLRRSPAARALLSPALSSRLVASKPHSSSPTQPPPEAKGASSTKXTFSIYRGGPGXSPSTKPHLXGXYRWDLSDCGXMVLDALLKIXKNDRPPSPPPAARCRRRIARGGAGNAXGXNGFACLTKFPPLPPGSTXXRLPXIFVNQGLVVDMTTFXHXKEVQPXSKRKDXXPXLXRXXQXKATAPRMNP

SEQ ID NO: 126864 - protein, 80 aa, Triticum aestivum
  unsure (1)..(80): unsure at all Xaa locations
  Clone ID: PAT_TA_21282.pep
MADQLTDEQIAEFKEAFSLFDKDGDGCITTXELGTXVMRSLGQXPYRGXSCMDMIXNEVDADXQWAPSPARRFLMPDGWG

SEQ ID NO: 126865 - protein, 133 aa, Triticum aestivum
  unsure (1)..(133): unsure at all Xaa locations
  Clone ID: PAT_TA_21283.pep
MSSMMNALSHWLVNPRRNPLPRLHMHTVSSRLRXKHGLTHHDLYNPYFHLVHHRRPLGGCQGALPDAPIRRRSDRRGTPLMAPYGPPPEGPLSTPGPTHGRHVPDMLVLVDMRASGEKALAPLHSTRAFPLSH

SEQ ID NO: 126866 - protein, 148 aa, Triticum aestivum
  unsure (1)..(148): unsure at all Xaa locations
  Clone ID: PAT_TA_21284.pep
MASVTRFPAVALVLLLAASAFLASEVAACGGCPKPTPPPSPPPPSPTSTPCPPPPSSSGGKCPKNALKLGVCANVLGLVKVSIGKVPTXPCCPLLDGXADLKAAVCLCTALKXNVLGSTRLPVKLTXLLNYCGKSLLKASVRLIYIHW

SEQ ID NO: 126867 - protein, 187 aa, Triticum aestivum
  unsure (1)..(187): unsure at all Xaa locations
  Clone ID: PAT_TA_21285.pep
MACKAFALFLAVNLVVLGVASACSPYCPTPTPTXPTPTTPTPTPSSFGRCPRDALKLGVCANVLGLIKAKVGVPPAEPXCPLLEGLLHLEAAVCLCTAIKGQILRINLNXPIHFNLIXNYCGRTVPTGSIADSTLRSLASYAPHIYDDEQIRLVHSPRPHIPYHSMSIAPPGPLTPINSVNTVSKKK

SEQ ID NO: 126868 - protein, 141 aa, Triticum aestivum
  unsure (1)..(141): unsure at all Xaa locations
  Clone ID: PAT_TA_21286.pep
AQNCRRCTQNQMEQSTQQPQTNMGGSHHTKSYPKRKLLPEFDEEALELPQSKNKEAIRSDRRPHGQHRAANGASHKPARDXHEDSHQKDGQPDLSTGKKASSSKQCNPQFPNTTHTQIXGCRTPLCSPMRXXDMIPXGSNP

SEQ ID NO: 126869 - protein, 91 aa, Triticum aestivum
  Clone ID: PAT_TA_21287.pep
RPINGYVDTIMVATTRESWIPSGALYPRRPQLALRRAGAGDRPGMTLGTISAADSEECLVDCPPCSCSPFKYCLDGQFGASSQWLFKTGIL

SEQ ID NO: 126870 - protein, 81 aa, Triticum aestivum
  unsure (1)..(81): unsure at all Xaa locations
  Clone ID: PAT_TA_21288.pep
MAAAAKASWMVAMSVGAVEALKDQAGLCRWNYALRSVHRAAKAKRSQLRARPGSWRRPAADKGRRXEEGMRTVMFLSCWGP

SEQ ID NO: 126871 - protein, 120 aa, Triticum aestivum
  unsure (1)..(120): unsure at all Xaa locations
  Clone ID: PAT_TA_21289.pep
SVRSGPFGQIFRPDNFVFGQSGAGNNWAKGHYTEGAELIDSVLDVVRKEAENCDCLQGFQVCHSLGGGTGSXGMGTLLISKIQXKEYPVRMMXTFPGFPSPKVSRYVFGPYNATSPLTTR

SEQ ID NO: 126872 - protein, 111 aa, Triticum aestivum
  unsure (1)..(111): unsure at all Xaa locations
  Clone ID: PAT_TA_21290.pep
MANAASGMAVDDDCKRRFLELKAKRTHRFIIYRIDEKKKMVVVEPGGASPCSATDDFAAXLPANECRYAIFDYNSSPRKMAKDKFFFTRLPPDTPALGPSFSHAGNVERAG

SEQ ID NO: 126873 - protein, 201 aa, Triticum aestivum
  unsure (1)..(201): unsure at all Xaa locations
  Clone ID: PAT_TA_21291.pep
EKYALRRGGGSSSGSGLRLFGVQVHVAAGRSTGLGASMRKSYSMDCLQLAVAPSSIVSPSSAASSSVLLSIDEGLERASNGYLSDGPHGRLVQERKKGVPWSEEEHRLFLXVGLEKLGKGDWXRGISRSYVTTPNPDAVASHAQXFFLRQSSMGKKNPSXLFDMVPFCENGSLSXPLTNNSGXLHSLPRYXPDMLIVSTRR

SEQ ID NO: 126874 - protein, 153 aa, Triticum aestivum
  unsure (1)..(153): unsure at all Xaa locations
  Clone ID: PAT_TA_21292.pep
MPAGHGLRSRTRDLFARPFRKKGYIPLTTYLRTYKIGDYVDVKVNGAVHKGMPHKFYHGRTGRVWNVTKRAIGVXINKQVNGRIIRKRIHVRVEHVQPSRCTEXFRLRKVKNDXLKADAKDRGEVINTKRNRWAQACLMVRGYIETSSIRTLA

SEQ ID NO: 126875 - protein, 83 aa, Triticum aestivum
  unsure (1)..(83): unsure at all Xaa locations
  Clone ID: PAT_TA_21293.pep
PPLXGATSGTDPAQPHRRLPTVAASGNEAWFQDEDIFFVDAGNSIVCIYQNGRSNLLIRSLLYPHTYFLSYLIYFVQLFHIEF

SEQ ID NO: 126876 - protein, 56 aa, Triticum aestivum
  Clone ID: PAT_TA_21294.pep
VIPVLGKNKTKPTTVPPARNVVVPAAALMSAIYEENKDEDGFLYMTYSGENTFGLF

SEQ ID NO: 126877 - protein, 139 aa, Triticum aestivum
  unsure (1)..(139): unsure at all Xaa locations
  Clone ID: PAT_TA_21295.pep
MHSTNLLLEEPIRMASILEPSKXSFFPAMTKIVGTLGPKSRSVDTISSCLKAXGMSVARFDFSWGDAAYHQGDARELKLAINSTKKLCAVTVQRWADVVLRRRSPILSPTEGLTRTRPKLSAPAFFHGPKQVNFGRTHW

SEQ ID NO: 126878 - protein, 110 aa, Triticum aestivum
  unsure (1)..(110): unsure at all Xaa locations
  Clone ID: PAT_TA_21296.pep
MAHGVFERVGVQFCHRQHAPASAVTAPCIGWQSLCPNTADEIVIVRSRVPLSAGPQLLLLLSRKHPSAFNLPSKKPXQGGEXLPERRTLWFVQXRWIRPSINQLMGRPDY

SEQ ID NO: 126879 - protein, 42 aa, Triticum aestivum
  Clone ID: PAT_TA_21297.pep
PPPFMTAVLDFRVICFFTFIEIPRSRGGRVHLFLLEVLRRVQ

SEQ ID NO: 126880 - protein, 74 aa, Triticum aestivum
  Clone ID: PAT_TA_21298.pep
TVYSGRSTTQDKSQRSRSMSFSPERVRVRGRSPAFTALAANFESSSNRNLSTPPPVVKKLYPKSVTPDPSEYCF

SEQ ID NO: 126881 - protein, 116 aa, Triticum aestivum
  unsure (1)..(116): unsure at all Xaa locations
  Clone ID: PAT_TA_21299.pep
SQXCTITLQXVKVXCSLCIXXDXXDGTKNGMLLILPHXRNLSERNPGRRLGLSQLGQDSPSKLPTCKCWIFPVGXILPXSGFPNHSHRSXLSRLLXTLKGXISRQEFCQDWSXVIK

SEQ ID NO: 126882 - protein, 120 aa, Triticum aestivum
  unsure (1)..(120): unsure at all Xaa locations
  Clone ID: PAT_TA_21300.pep
MPLVLAMEQQAPAWAQQTIRFLQKGEFLEEQXKAERVARRIYLYQFVDNMLYRRRPNGVKLMCISREEGLRLLAEIHGGICGSRIGSRALAGKAFRQGFFWPTALXDATTLVTKCEVCQF

SEQ ID NO: 126883 - protein, 69 aa, Triticum aestivum
  Clone ID: PAT_TA_21301.pep
STRKQIYTRLMTLFYHQNHTIHDQNNISRGNDASTILLEYISHNTNWRRRNCLLEHRRQQNGTDERFNL

SEQ ID NO: 126884 - protein, 167 aa, Triticum aestivum
  unsure (1)..(167): unsure at all Xaa locations
  Clone ID: PAT_TA_21302.pep
QEALPGDNVGFNVKNVAVKDLKRGFVASNSKDDPAKEAASFTSQVIIMNHPGQIGNGYAPVLDCHTSHIAVNLLXLITKIDRRSGKGSEKXPXSLKNGDAXGMVKMIPTKPMVVGEFSAYLPRGSLPSRDXKQTLLLXHPXFGEEXPTGPKXPXGXKKNIPVRFSMP

SEQ ID NO: 126885 - protein, 111 aa, Triticum aestivum
  unsure (1)..(111): unsure at all Xaa locations
  Clone ID: PAT_TA_21303.pep
MAAAGGVSTDDVPILQAENLTSNVKSVYYSRTFLSIIGGVVAGIWGFTGLMGFVFYFLIMMVASIGLLAKSKFSSXAYFDSWTRISIEGVFGGLMSFVLFWTFAYDIVHIF

SEQ ID NO: 126886 - protein, 136 aa, Triticum aestivum
  unsure (1)..(136): unsure at all Xaa locations
  Clone ID: PAT_TA_21304.pep
MRECISVHIGQAGIQVGNACWELYCLEXHGIQPDGQVPXDKTAGHHDDAFSTFFNQTGXAGKHVPRAXFVDLEPXVIDEVRTGTYRXLFHPEHSSSGKEDPLXFPPGTTQLARICCLCLDRIXNLLKMHGLQGSWS

SEQ ID NO: 126887 - protein, 191 aa, Triticum aestivum
  unsure (1)..(191): unsure at all Xaa locations
  Clone ID: PAT_TA_21305.pep
MLRRIAALRPPSRAAAPLGAIAAPYSSKSTSIPQKQQRVRDHAFDGVMEVQKRVRRFHALHALILYAAAPTAXLPAPGGSGAVSVPFTRLXGXSARRHYASAPLDAGRFXLRHAHAFHXLPQPVQRMLHIXLTPRAAAVLDAEATPRRRIPGLRLSQALSCAPHGVSPQQSTLARLGSAIRQHNTFTSLAT

SEQ ID NO: 126888 - protein, 171 aa, Triticum aestivum
  unsure (1)..(171): unsure at all Xaa locations
  Clone ID: PAT_TA_21306.pep
VAIFSQIERXNASLRQCLPAALRQLTVDHGMPPASDSLVMEKVIEPALQELPADQLDRPASQEVFFQEFKKYLGVIARRLQERPIIVAHTENTFDGAGIRKILSNKFEFEKLLDSVWVDVPKEHKDRTSKKYLRVALDKLAASVNLPPYGAVDHVDAVVNEAFKMANADDG

SEQ ID NO: 126889 - protein, 57 aa, Triticum aestivum
  Clone ID: PAT_TA_21307.pep
FFFFAKTVSLINLSRRQQRRPKYWLKYRADIEVPKEGGKLGIFHSPLNIKLCRTAKG

SEQ ID NO: 126890 - protein, 150 aa, Triticum aestivum
  unsure (1)..(150): unsure at all Xaa locations
  Clone ID: PAT_TA_21308.pep
RRIREKRKMLAATDPMLWHKVAAVSGVAALGLGTYGAHMFRPKNPAYKEVWXTASLYHLVHTAALLXAPITKRPNVFXGGLLTAGICALLWERCYTVGLXERQEFSSTXAPLGXFAFMAAWGTLLLLIKWCFSKENKKIINSPKRGFSRL

SEQ ID NO: 126891 - protein, 400 aa, Triticum aestivum
  Clone ID: PAT_TA_21309.pep
RSQPRPPARLVRLPRTRLRVAAISSSPSPPSRRDRAAAGLERCLAATPAPAFAPPEMKGGRQRGSFGAATLQKAKLDLSQKRLKGVQPELATGGGGGDNGKRIGYGGGNSGDDDGDDDDYFEDSDDGDEESGFFRRRIIIQELFKREFVDAVLQEWYKTMSNLPAGLRQAYEMGLVSSAQMVQYLSLFGRPTKARYFSRAFPDFFSRGLVGRMLADPSFLHKMTFELLATASTSVWWEMKNRKERFQEEWDLVFLNVVTATVCNLAVFCSLAPCRSYMIQKLPNNIFEKSYPMRQFGLLGRTQSLFSKAAELCLGGLIIGSIQGGLSNVLSAGRERRLSMTVPSISNNALSYGAYYGLYANLRYQFLCGLDRSMANHFDVLGVAIFFGTAMRLMNIQIGE

SEQ ID NO: 126892 - protein, 42 aa, Triticum aestivum
  Clone ID: PAT_TA_21310.pep
MESKGGKKKSSSSRSSLMYELPLATASKDIRPAGGIKNSPAA

SEQ ID NO: 126893 - protein, 224 aa, Triticum aestivum
  unsure (1)..(224): unsure at all Xaa locations
  Clone ID: PAT_TA_21311.pep
MASLQVTPTSAFTQWNELKFEGLYLFHTPLGSGANQAQVIDNKAPIGIGATVVNNWAVYDGPGPNAKLVARAQGLHIQAGNWVNSFSLVFVDQRFSGSTLEVTGIVVESGEWAIVGGTGQFAMANGVISKXFHEQRSEGNIIQLTIHAFCPVLGPTXRSSTXFGRSGVRSGGTPTEINAEPSHRTRVTLHTXTPGTAMARSFGHSRLQTDXAPXWGGXGGETEP

SEQ ID NO: 126894 - protein, 139 aa, Triticum aestivum
  unsure (1)..(139): unsure at all Xaa locations
  Clone ID: PAT_TA_21312.pep
RPCPRRPPRRTEPLIKPFGEXAGPRPSPIPQGHLHPSDRTGHPRFRRGPSKPPPPTPPPPPVVPGPAPLAAVSVAQPPQLTWTQTEPGRVGASPSKSSFCRQGRQGTFQGGASLRKARFRQSGTCPQSRHTKPSCQERP

SEQ ID NO: 126895 - protein, 85 aa, Triticum aestivum
  unsure (1)..(85): unsure at all Xaa locations
  Clone ID: PAT_TA_21313.pep
MDAATSTTLLYGALLAAAFLYVATIRRGRGRGEGGLPPGPRGLPLLGKPPXLDPDLHTYFAGLANKYGPIFSIRLGSKLXIVINS

SEQ ID NO: 126896 - protein, 205 aa, Triticum aestivum
  unsure (1)..(205): unsure at all Xaa locations
  Clone ID: PAT_TA_21314.pep
RWDNGYKLLKGDEAGEITRQSLYPMNSLPARARGLVLTLPSGRRPFRTAAXRQDPPRPRAVRQPDPVGPALQMQSTRPDRRTWRSAGAGPTLEAAGDPFPRDRLAIATPASMPSPADAITTGATILRCCLNRLANESRLASYLWFLDMEEEAEVFFLAFLRIYRPAGDDSLDELLLRWESPVERKRFGSCVESVFWPEASRRRLF

SEQ ID NO: 126897 - protein, 155 aa, Triticum aestivum
  unsure (1)..(155): unsure at all Xaa locations
  Clone ID: PAT_TA_21315.pep
MAHEKKLSNPMREIKVQKLVLNISVGESGDRLTRAAKVLEQLSGQTPVFSKARYTVRSFGIRRNEKIACYVTVRGEKAMQLLXESGIKLKEYQLLRXRSFSDTGCFGFGIXEHIDLGIKYDPSNXIYGMDFYVLLELRATFCTRRSEFRVGYHQR

SEQ ID NO: 126898 - protein, 91 aa, Triticum aestivum
  Clone ID: PAT_TA_21316.pep
HAPMLRCLRHGIFPGVSFPWRGESGVSIRVGSIFHACSFRSLDEVSLIIGICCWDNFVLAYTVLSLKNVTTLRRYTVFAMNLKWCPCINGK

SEQ ID NO: 126899 - protein, 151 aa, Triticum aestivum
  unsure (1)..(151): unsure at all Xaa locations
  Clone ID: PAT_TA_21317.pep
RLCRLPRLFPLVSSASASAAPRPHHLPFAVNPNPAPLAPSFSSSSPPAFPGPHRLFSSTSGSSMVVVGSADSFNSIFSKVQDEKLPAVFYYTAVWCGPCRAIAPLVSKLSSQYPKIPVYKVDIELEGLXNKLRDLNICSVPTFTSITRAEN

SEQ ID NO: 126900 - protein, 168 aa, Triticum aestivum
  unsure (1)..(168): unsure at all Xaa locations
  Clone ID: PAT_TA_21318.pep
ASEAAIARAQCLLRFRRWSPLPLLPLPSPPATTRAASCRRSVRMASSDGSAAALPSATVDVPGAGAPVLVVGAPGLPEADFRNAVESSLFKQWLRNLHXEKGVLTYGRLSLTXVLNQGVDXFGKRVGFSNSKADIVDEETKTKEFLARRPRFRVDLWIQWRNYLANEK

SEQ ID NO: 126901 - protein, 155 aa, Triticum aestivum
  unsure (1)..(155): unsure at all Xaa locations
  Clone ID: PAT_TA_21319.pep
PLLTNGQMVDDIPPEQHALVPSYMSGGGGGGKRIHPLPFADPNLPVQPRSMDPSKDLAAYGYGSVAWKERMEGWKQKQERLQHVRSEGGGDWDGDDADLPLMDEARQPLSRKXPISSSRINPYRMIIVIRLVXLGFLLHYRVMHPAKDHCIVAIL

SEQ ID NO: 126902 - protein, 58 aa, Triticum aestivum
  Clone ID: PAT_TA_21320.pep
SQCIIIKQSQCTRPMSNIVSVHNNKTSSPEWHDLKANAILMFQFFWRPLVDENPLCIT

SEQ ID NO: 126903 - protein, 125 aa, Triticum aestivum
  unsure (1)..(125): unsure at all Xaa locations
  Clone ID: PAT_TA_21321.pep
MGSQPGLTVGGEPYVAYGYPNLKSVREVIYQGGYGKLNQRRIPLSNHQVIEEGLGKHNIICIEDLVHEIMTVXGPHFKEANNFLWPFKLKAPLGVLKKKRXHYVEGGDAGNREXNYINELIKRMN

SEQ ID NO: 126904 - protein, 172 aa, Triticum aestivum
  unsure (1)..(172): unsure at all Xaa locations
  Clone ID: PAT_TA_21322.pep
EVGWLLLPHRFVFRFWFVGEREEMAASDVEYRCFVGGLAWATDDHSLNNAFSTYGEVLESKIILDRETQRSRGFGFVTFSTEDAMRSAIEGMNGKELDGRNITVNEAQSRGGRGGGGGGYGGGRRDGGGYGGGGGGYGGGRGXYGGRGGYVVQTAAAVRNNDGNWRNEPWVR

SEQ ID NO: 126905 - protein, 154 aa, Triticum aestivum
  unsure (1)..(154): unsure at all Xaa locations
  Clone ID: PAT_TA_21323.pep
RRGRRRKPRKTKGEARHQQILASLVTGTPRPWPQQTLTATHRTTRGKLRLLNXAXVLPRGCLGPQAAIKAAEQGAAHAGAATLQGARRRLPQFIPDXRRPAIRACLSLAGTIPKLIRFTXFYLWEGSNLPGNXCIXNPVSXLVDNFLPEVVXMG

SEQ ID NO: 126906 - protein, 174 aa, Triticum aestivum
  unsure (1)..(174): unsure at all Xaa locations
  Clone ID: PAT_TA_21324.pep
NAHTARSPISDPRSPRRSKMQIFVKTLTGKTITLEVESSDTIDNVKAKIQDKEGIPPDQQRLIFAGKQLEDGRTLADYNIQKESTLHLVLRLXRGGMQFFVKTLTGKDYHLEVESSDTIRQRQGKVPRQGGIPPGPTPVIFAGKXLQDGRTXADYNIQMRHLHGCSQGRILLEI

SEQ ID NO: 126907 - protein, 174 aa, Triticum aestivum
  unsure (1)..(174): unsure at all Xaa locations
  Clone ID: PAT_TA_21325.pep
MAPKAAPAKKGDAKAQALKVAKAVKSGAGKKKTKKIRTSVTFHXPKTLKEGQGTPKYPKNQALLGRNKLDQXYQILKFPLTXTESAMKKIXDNNTXVFMVDLKARQEKVKAAVXKKMYDIQAKKXNTLIKPDGKKRXYVKLTPDYMPCWATKWDHLSYNWIDIRSTIRHTTDFI

SEQ ID NO: 126908 - protein, 136 aa, Triticum aestivum
  Clone ID: PAT_TA_21326.pep
RGIQLSCARLSDKLLERTEEINQRNQTIIQMTKEASNYLEQLHAASDKIHGLAATALDPTASLSLSTLKQTILAIQDSLVALQSTTAAARASLEEKGMYSEDDVAQPTYDGLPDEETDEDYHQDMDDDYAHYVRSP

SEQ ID NO: 126909 - protein, 120 aa, Triticum aestivum
  Clone ID: PAT_TA_21327.pep
NSVSLNQCTLCIIFHKIDLEQRFSFTAQKARYHASAHRTKLSSRICRNGVASMNHAAEKAIEYMQNKEGKVLVDYNYYQLEQMKMAHTRLSARLLEQSDEINQHSNTIKQITKEACNSLK

SEQ ID NO: 126910 - protein, 134 aa, Triticum aestivum
  Clone ID: PAT_TA_21328.pep
IQKNVLKNKFHMQAARRIILSQEAVSSCWEYGCITTGIQTRMQTAPSTGECHLQNPDVHPVKVITCAWHGCSMAHHGHALPFSSRRWHGIHGEAGLDASAPAARRRSPRFSAVAIAFVFSTGSPPPPVVWCGVV

SEQ ID NO: 126911 - protein, 152 aa, Triticum aestivum
  unsure (1)..(152): unsure at all Xaa locations
  Clone ID: PAT_TA_21329.pep
MSTLRPLRGGCQCGRNRYIIAVPQNGINEAQVLFNTESAHQDTPCNSXLAAYIRVPLSWDHSTTYSFFPXTRXTALIRRVYTHPXQQYSKRHFXCGYCGTPLSYWSQXPHTEAEFINLPRATLRDGDCGIWDVLGRIRNTEAAHPPQAITPI

SEQ ID NO: 126912 - protein, 105 aa, Triticum aestivum
  unsure (1)..(105): unsure at all Xaa locations
  Clone ID: PAT_TA_21330.pep
MDASGAGSKAKKGAAGRKAGGPRKKSVSRSVKAGLQFPVGRIXGRYLKKGRYAQXVGTGAPVYLXAAVLDYLPAEVLELAGNAAKGQXRNRILPRHLLPGDPNDV

SEQ ID NO: 126913 - protein, 150 aa, Triticum aestivum
  Clone ID: PAT_TA_21331.pep
MIGPGLFSGIVVSSATAASSMTNEHSSSGVSTASDCDGTVRSQSMIPPQVLVPRSMMPSWSTEPVDGGREGGHVVPRGEGHGGGSCHSSGGTSRNADLGEPPKLCFSINQFHLFVHKQPRFRLWILMDFPVQINSTSCTGLSIVMVTAML

SEQ ID NO: 126914 - protein, 105 aa, Triticum aestivum
  unsure (1)..(105): unsure at all Xaa locations
  Clone ID: PAT_TA_21332.pep
AEKPLLVRALHGLALCMHKRLEGPTVFEMLEKALQLAVSEERVPEERNIKLLIAQMHVVKGXLVLASREAETLINEDXPRVFRLILCQGICISLPGTXKEEADDI

SEQ ID NO: 126915 - protein, 205 aa, Triticum aestivum
  unsure (1)..(205): unsure at all Xaa locations
  Clone ID: PAT_TA_21333.pep
CFFXXPVWKSLXPVSSFWVLSGSPGVLFFDLCFFWKAGLFRLRAPSSQIFTALDFDLLLYRHGLLRAGHRRGRRRRVLHHHGRALEDRRVDGEEAGEGDVGEEGEAAAGDEPNPELLRLDPAQLLGQPRLPPLAGAGRRLGPARVRRGRHGRSPNPKHHTATLTTDSPDSAREQTKRAHPRGQAPRYIGRPIATPATEPRLCVLF

SEQ ID NO: 126916 - protein, 133 aa, Triticum aestivum
  unsure (1)..(133): unsure at all Xaa locations
  Clone ID: PAT_TA_21334.pep
RVAAILCIPILFAYPYMTYLSEPGLSIVLNIASVIKNNLGVTIITGTFILQNNAVPQDQRGAANGLSMTGMSFFKALAPAGAGIVFSWAQKRQHAFSFPGDQMVSSLLNASSWPGXLLKFKPFLASTRQYDTR

SEQ ID NO: 126917 - protein, 193 aa, Triticum aestivum
  unsure (1)..(193): unsure at all Xaa locations
  Clone ID: PAT_TA_21335.pep
MSKRGRGGTAGNKFRMSLGLPVAATVNCADNTGAKNLYIISVKGIKGRLNRLPSACVGDMVMATVKKGKPDLXRKKVMPAVILRQRKLWRXKDGVYMYFEDNAGVIVNPKGXMKGLPSTGPIGKXCPDLWPXRIAIAANANVLILRLGAGLDILCDPFNLPYSTSWNYLCLRKNLATLNSQCHSYIIRIFDCL

SEQ ID NO: 126918 - protein, 73 aa, Triticum aestivum
  unsure (1)..(73): unsure at all Xaa locations
  Clone ID: PAT_TA_21336.pep
MDPVSQLSGKXITESLPAGREXFASVPCGGGGVAVAAAAPAAGGAASAAEAKKEEKVEEKEESDDDMGFSLFD

SEQ ID NO: 126919 - protein, 46 aa, Triticum aestivum
  Clone ID: PAT_TA_21337.pep
YSAAAIRGAGSSSARSTCADAMRAKWKKKRMRRLKRKRRKMRQRSK

SEQ ID NO: 126920 - protein, 144 aa, Triticum aestivum
  unsure (1)..(144): unsure at all Xaa locations
  Clone ID: PAT_TA_21338.pep
MALSDRSRESLLPSFLYGSSARSFAATGAAARLPVSSPAPAAAGAGGGVPFSIQAPKEKIEMYSPXFYAACTAGRNRQAAGLTHMAVTPLDSSKCNMQIDPTKYKSISSGFGILLKXQGARVSSRGWVPTCWVTCPRGNLLHNS

SEQ ID NO: 126921 - protein, 48 aa, Triticum aestivum
  Clone ID: PAT_TA_21339.pep
RADNPGVWFMHCHLEVHMSWGLKMAWLVQDGSLPNQKLPPPPADLPKC

SEQ ID NO: 126922 - protein, 133 aa, Triticum aestivum
  unsure (1)..(133): unsure at all Xaa locations
  Clone ID: PAT_TA_21340.pep
MAGKASVALFLAVNLAVFAMASACGGNCPTPTPSTPSTPTPTPASFGKCPRDALKLGVCANVLGLIKAKVGVPPTEPCCPLLKGLVDLEAAVCLCTAIKGXVLRIKLNLARRPKLILNNGXKTLPTGIQMPLS

SEQ ID NO: 126923 - protein, 194 aa, Triticum aestivum
  Clone ID: PAT_TA_21341.pep
LLQLPFLYIDETREPRFVQKQAADDSDGYTHCKAVGPGRCALNHGGCWAETKGERTLSACSDTALSGCRCPPGFQGDGHKCEDLDECKDKLACTCPDCHCNNTWGSYECGCRGNQVYIRGEDVCVANSMSRFGWLVALLAVSCAAGLGVAGFIFYKYRLRSYMDSEIMAIMSQYMPLDSQNNEHQPLRQHAPDA

SEQ ID NO: 126924 - protein, 216 aa, Triticum aestivum
  unsure (1)..(216): unsure at all Xaa locations
  Clone ID: PAT_TA_21342.pep
SSSASTSFLPGYAPDFCVFVALRPIKPPATAVANPPASPSPLEEEHRQQAAVPWHSDDPPAPSVPAPLRVGIRRVRQLWDSSSRAACSGRATPCSRLQEPTTLPTAPKHGFASSRSVHXLXQRATXRAAHLQFILFNGKLLPSIPXQKFRPTHLADSLRPGFPASPPRXLPTRSGYLKHRFWAEVXNXGXLPLXXVVPTXDSELTXYNYRXLXEFS

SEQ ID NO: 126925 - protein, 75 aa, Triticum aestivum
  unsure (1)..(75): unsure at all Xaa locations
  Clone ID: PAT_TA_21343.pep
NVIETXVFXTXXDRRLGREGDLXNINAPFKEVYLPPVNCVMDIACNPSCSPCLLKTCCSVFVHSFLCVYVVIYGV

SEQ ID NO: 126926 - protein, 196 aa, Triticum aestivum
  unsure (1)..(196): unsure at all Xaa locations
  Clone ID: PAT_TA_21344.pep
LLQSSQSQDNIFELKRRRQVLLEGLAASLQFVDPLGPSKSGHSSGSALKDDVIFLRIVSLPKGRKFLSXRYLRLLVPGXASLTRIVCMAIFRHLRXLFGGLPSRLLMQQETTVAPCERLFHPCVHHXMXLGCSLNACLAXVVWSVXNNHSAPSLGTPLGDGRPRGNIRTDNYDDASSATNVQTSPAGTMLLGSKRV

SEQ ID NO: 126927 - protein, 146 aa, Triticum aestivum
  unsure (1)..(146): unsure at all Xaa locations
  Clone ID: PAT_TA_21345.pep
QMFRPGWKDIFRMNQSELEAEIXKVSRDSTLDPRRKAYLIQNLMTSRWIVAQQXSPQPSVEGHNGCTRXPGCVPSXYRDPGKQIFGCXEHYKRNCNLLPACCNXYHLQILHDKFSDHTRAIPHHNHHLPPHFPAEELQDSFYIQYN

SEQ ID NO: 126928 - protein, 94 aa, Triticum aestivum
  unsure (1)..(94): unsure at all Xaa locations
  Clone ID: PAT_TA_21346.pep
MSDTDEHHFESKADSGASKTYPQQAGAIRKGGHIVIKARPCKVVEVSTSKTGXKHGHAKCHFVAIDIFNGKXXEDIVPSSHNCDVPHVDRQDIN

SEQ ID NO: 126929 - protein, 160 aa, Triticum aestivum
  unsure (1)..(160): unsure at all Xaa locations
  Clone ID: PAT_TA_21347.pep
VLLVQRISKRXSFALVQILEIFRKEGHINKPSMFVKRLKVWRWSLCNHWMALKCKELRXLGVTYIHAKAGNLVSHYQKKNIASACTPTYLLQHGPGSKEHFPCNLSPTPSMNLVWIFPPATPPMMLDSSYKEGVAHNPPLMPLSLLQKNYLDHFFHLGES

SEQ ID NO: 126930 - protein, 142 aa, Triticum aestivum
  Clone ID: PAT_TA_21348.pep
FLRRHGTFQVQLVKTECWMMDANRGSIKHFTCRVRSHIVLLFNKPRGEQTQCEPGQTDLRAASVRRQSSEGGGGGAAPLDEGRLRRWREAWLAGSGSRRRRRESGSPERTGVFAAGFGGEIGEEEEGYLGRSETRRRMASWT

SEQ ID NO: 126931 - protein, 110 aa, Triticum aestivum
  unsure (1)..(110): unsure at all Xaa locations
  Clone ID: PAT_TA_21349.pep
MADSATNDAPLVASNQPTEEEVTVERAAATEEQEEERLRYLEFVQQAAAQALVLAAAAYAVRQAGRRPLRPGVDXSPGTVKASSARLRPFHAVPLDXQFIXRKVGDSVEE

SEQ ID NO: 126932 - protein, 135 aa, Triticum aestivum
  unsure (1)..(135): unsure at all Xaa locations
  Clone ID: PAT_TA_21350.pep
CFTFALSIFLCQGCIFPDTLXSAFGDRQTRNGQADSSSCTPGHRPVHCRRSRCLTQKDSHGDLQHRRGVFPPPGSSPALAAIRLFSRVTGRCAEDRRREGKPLTPSLESPSLSAAALRAGVPSASKGWSERWSAG

SEQ ID NO: 126933 - protein, 167 aa, Triticum aestivum
  unsure (1)..(167): unsure at all Xaa locations
  Clone ID: PAT_TA_21351.pep
MAESTARTVKDVNPHEFVKAYSAHLKRSGKMELPEWVDIVKTARFKELPPYDPDWXYYIRAASIARKIYLRQGIGVGGFKKIYGGRQRNGXPTHFCKSIGAVARNTLHXLQIMGTSIPIPRWTLINKQGKAGLDXVAGKVPVEPDMSPWNGVFDGKRSILFGRILKT

SEQ ID NO: 126934 - protein, 120 aa, Triticum aestivum
  unsure (1)..(120): unsure at all Xaa locations
  Clone ID: PAT_TA_21352.pep
SHTYIQSMIPAGFSPQIVFQFDXFNPGQGSRSSSIHLIFSFRGKISXQKVLPRYNVQGSIPPNNQIILQQLAFLDGGPQTAGQRYSLSLFLLLPVFLYDSSTSLALPTRLLMSFFMFGTS

SEQ ID NO: 126935 - protein, 125 aa, Triticum aestivum
  Clone ID: PAT_TA_21353.pep
TDPTEYRQWQPAAFPSESSFNFTAGSRRRRRARRRPARRRRPGTRPRRRWWGRAPGPRRRGPRWRRRRRRGRRRRPSSSPSRLDVVCRSRTERRRDRDEEERRARRLISKMDQRMITLAIIGCAL

SEQ ID NO: 126936 - protein, 203 aa, Triticum aestivum
  unsure (1)..(203): unsure at all Xaa locations
  Clone ID: PAT_TA_21354.pep
FSSSYHFTDQYSSCFLQALPPFSLFEMIYLPIVTSLPASETLGLSSMLTEFSGPNGHFLHSRXDCSFFIREKFWTIERCPKITATSFPLNFTSLSSLRVLRISYCPELQSLPAYGPPSSLETLDIIGCHPELSKPRNDLVTNDPGGRPLAPTHATHPSSPPRLRVMVRQPARRPSNPHASLPPLVAPPPPAIDVNYVETCFGT

SEQ ID NO: 126937 - protein, 105 aa, Triticum aestivum
  Clone ID: PAT_TA_21355.pep
QGQQGYGQAPNVQFPPAASPPYGQAPNPHYPPPPAQGYAPNHHHHQQQFPPPPAQGYGAHAPNQQHPPPAHGYGAHAPNQQFPPASPPPAHGYGPHTPPNGHEQV

SEQ ID NO: 126938 - protein, 130 aa, Triticum aestivum
  unsure (1)..(130): unsure at all Xaa locations
  Clone ID: PAT_TA_21356.pep
MSASRFIKCVTVGDGAVGKTCMLISYTSNTFPTDYVPTVFDNFSANVVXVDGNTVNLGLWXDTAGQEDYNRLETTELSVELMFFLPAFSLISXKATYENVSKEWGPQLNHYAXGVPIILVRTNLXLXDDK

SEQ ID NO: 126939 - protein, 52 aa, Triticum aestivum
  Clone ID: PAT_TA_21357.pep
GLAVSMVLASRGVSPQKAMMWSIITSLPQVQFLTSFSELKYEIISSVYCLYS

SEQ ID NO: 126940 - protein, 228 aa, Triticum aestivum
  unsure (1)..(228): unsure at all Xaa locations
  Clone ID: PAT_TA_21358.pep
MCSVARLAFVLALAIAASSITVAESRDFNIFAQGSLPDATKGSSGLAATSGKLCQLCEQYSSEALLYLTQNETQTEILSILHHECASLAPLKQQCITLVDYYVPLFFLEVSMVTPEKFCESMHLCKKGMKISLPPRGRSWGSCRLVAAGFLLIPEVPPMQLGVFDLRAKTCSKAQNYEQQCKRLVLKYIPLILVKXQKFLETTDVCSVIHACKAGTQASMEXCLVCML

SEQ ID NO: 126941 - protein, 84 aa, Triticum aestivum
  unsure (1)..(84): unsure at all Xaa locations
  Clone ID: PAT_TA_21359.pep
LKTSPNPSKWLLSRLLLLASSSELPPLLPTTPLPPTAPPTTPLRLSPPSQPTALVLPLSPTATPSSPQSPLSSTXSTQPRSSPP

SEQ ID NO: 126942 - protein, 209 aa, Triticum aestivum
  unsure (1)..(209): unsure at all Xaa locations
  Clone ID: PAT_TA_21360.pep
KLYGVKLTMFHGRGGTVGRGGGPTHLAILSQPPETIHGSLRVTVQGEVIEQSFXGEEHLCFRTLQRFTAATLEHGYAPSKFRPKPRMACFXWMEMGYRPPQRNTGQSYXEEPRFVEYFPPCNAKRWEYGRMNIRSKPPKRNXSAGINPCAQPLVLAWTQSXPTAGVPGPRASNILDKGIRISDLKNSTWPRDKTVKWVRCLNRLQKLWI

SEQ ID NO: 126943 - protein, 61 aa, Triticum aestivum
  Clone ID: PAT_TA_21361.pep
VLQLKNRTHAIYQWNRNDDGNPVPADTVMFHNQYWTSSTRRRRLKKNHLHLEDLEDLISLL

SEQ ID NO: 126944 - protein, 132 aa, Triticum aestivum
  unsure (1)..(132): unsure at all Xaa locations
  Clone ID: PAT_TA_21362.pep
MATQISKKKKFVSDGVFYAELNEMLTRELAEDGYSGVEVRVTPMRTEIIIRATRTQNVLGEKGRKIRELTSVVQKXFNFPENGVELYAEKXVNRGLCAIAQAEXLRYKLLRGLAVRKAATCSSLVMEMVPRV

SEQ ID NO: 126945 - protein, 173 aa, Triticum aestivum
  unsure (1)..(173): unsure at all Xaa locations
  Clone ID: PAT_TA_21363.pep
MVAVNRPLVSVKALEGDMVTDAPGIALPPVFGAPIRPDVVRFTHKLLSCNKRQPYAVSRRAGHQTSAXSWGTGRAVSXRIPRVPGGGXHRAGKGALEIPAGAHFPPNKIVRRLDRRVKSTPPRAAPRSPQRLPASSKRAARSSSAPCSPGPDHLRLRKLANCRSRPRPPRDRP

SEQ ID NO: 126946 - protein, 46 aa, Triticum aestivum
  Clone ID: PAT_TA_21364.pep
NEEIMEIPKLATAINDLMQSHFSEFLPYSNAYLEVEKLKKSFSIPL

SEQ ID NO: 126947 - protein, 152 aa, Triticum aestivum
  unsure (1)..(152): unsure at all Xaa locations
  Clone ID: PAT_TA_21365.pep
MAKIKIGINGFGRIGRLVARVALQSDDVELVAVNDPFISTDYMTYMFKYDTVHGQWKHHEVKVKDSKTLLFGEKEVAVFGXCRNPEEIPWGSVGAEYVVESTGXVFTDQEKXAAHLKGGAKKVXISAPTRMPHFVVGVTRRIQSDITLSQCN

SEQ ID NO: 126948 - protein, 209 aa, Triticum aestivum
  unsure (1)..(209): unsure at all Xaa locations
  Clone ID: PAT_TA_21366.pep
MGISRDSMHKRRATGGKQKAWRKKRKYELGRQPANTKLSSNKTVRRVRVRGGNVKWRALRLDTGNYSWGSEALTRKTRILDVVYFASNHELVRTQTLVKSAIVQVDAAPFKQWYLTHYGVDIVRKKKXPVAKKDATEGQEVEAIAXEETKKSNHVQRKIEKRPRRRPPDTPIEGHVAGAPLVARFAARPGPCGRPGGYGLLRLELDSRG

SEQ ID NO: 126949 - protein, 145 aa, Triticum aestivum
  Clone ID: PAT_TA_21367.pep
MAAMCIVGGDVEWVTSVGAAARGRRQQGITVENANLQRPRGARLSLIRSAAGRLRAGDGCNDPHSCLSGHPTAARRMLSGLVRQHRRVPARTCRGPRSLSSVLLLLSMPLWTCAMVVSSPPAAMVDLFVSVRVRCKVVVLAVARG

SEQ ID NO: 126950 - protein, 146 aa, Triticum aestivum
  unsure (1)..(146): unsure at all Xaa locations
  Clone ID: PAT_TA_21368.pep
MDEAQVMESKDGTISVASAFAAHQEAVQDRDHKFLTKAVEEAYRGVDCGDGGPFGAVVVRNDEVVVSCHNMVLKHTDPTAHAEVTAIREACKKLGKIQLADCEFTXSCXPCPMSLGQLTLPNXRAGYGXKAEGGIPLGSQLMQSPE

SEQ ID NO: 126951 - protein, 212 aa, Triticum aestivum
  unsure (1)..(212): unsure at all Xaa locations
  Clone ID: PAT_TA_21369.pep
MASSSRSTVFSLLLLVALLLSCSGMSSAARLLEEAPPKEEHPHPAVPELPEPELPPHPTDVVPPELPKPELPPHPAVVPELPKPEVPHPVPEQPKPELTPHPAAVPELPKPEVPHPXSVPELPKQSAAPMPDCQAECTHRHLLTPKPECVPVRTAQPTTGAPAACGPPVAASPDHTPNQPPRSPSPGHARGPAPSTPANRSPHQDPAHARGG

SEQ ID NO: 126952 - protein, 128 aa, Triticum aestivum
  unsure (1)..(128): unsure at all Xaa locations
  Clone ID: PAT_TA_21370.pep
RLSRRPIRYYQAGSSEMFGSTPPPQGEDTPFHPRSPYAAAKVAAHWXYTVNYREAYGVFXACNGVLFXNHEPPRRGENFVTRKITRAVGRIKLGLQTKVFPGQPLGGARTGGFPGDYXEAMWLMLQQV

SEQ ID NO: 126953 - protein, 175 aa, Triticum aestivum
  unsure (1)..(175): unsure at all Xaa locations
  Clone ID: PAT_TA_21371.pep
LVPNSARDRIRIAVEAAGALAYLHSAAAIPIFHRDVKSSNILMDSSFATKVSDFGASRSLSLDETHVVTIVQGTFGYLDPEYYHTGQLTEKSDVYSFGVILAELLTRRKPIFVNDLGGKQNLSHYFXEGLQQGAIMEIVDPQVVNEANXGRDDDISSLAEASLRPKGRDRPTMKE

SEQ ID NO: 126954 - protein, 70 aa, Triticum aestivum
  unsure (1)..(70): unsure at all Xaa locations
  Clone ID: PAT_TA_21372.pep
YSSXIMTXRLISLXRLVFSQQQADHQEECTQSHPHQLINNEAIIRIYKMGIKLNGRNHPINRAKMGRGVT

SEQ ID NO: 126955 - protein, 195 aa, Triticum aestivum
  unsure (1)..(195): unsure at all Xaa locations
  Clone ID: PAT_TA_21373.pep
MNSRISLLCALVLASSLLHCARSDGNDAQLLKGINSYRSSLKVPALSENKNAACLAEQLARQFKGQECTNTTGANTVIGTEQQFPDYPRYLDRCHLXNASVTEDGQVMPACVPGLAPAVVLANYTKSQYNRFLNDSQFSGAGIPKALGPGLLTQHGSGTIAGPPAQWASRGPAVGYAPVRGGGWVFLFMSYLPYN

SEQ ID NO: 126956 - protein, 134 aa, Triticum aestivum
  Clone ID: PAT_TA_21374.pep
DHKLSLVATIIIDLTDLTSIREIIEIPPVVSLYKRFRASSPRSSSLDDQWFVIIPQYAAGSMLGPVGCMGSSSCQTWRCEERSSECNNGFRECSAQRFARETFGAEGVFEAFGFFCFTGFSGAGASSESTSSAE

SEQ ID NO: 126957 - protein, 90 aa, Triticum aestivum
  unsure (1)..(90): unsure at all Xaa locations
  Clone ID: PAT_TA_21375.pep
EALVPIKASESTSXHYXGKCTLLSETAAEFRYDAMPSINPNPNPSPTLPPTNKPKLNYSLHAIRQVHARAHGLQNQMRRKLWCPNDQNRT

SEQ ID NO: 126958 - protein, 505 aa, Triticum aestivum
  Clone ID: PAT_TA_21376.pep
QSLLNELQTVEEMKRQCDEKRELFEVLLNAQKEKGRSKNSKGDPAASQQLKQAQEDYQEEATLFLFRLKSLKQGQFRSLFTQAARHHAAQLNLFRKGVKSLEAVEPHVRLAAEQQHIDHQFSALEDEDYSVEDENDDDYHGSHDGELSFDYGESKETAEAGHASRSPTEDFFDRSNGDYSSFPGERQRPVSQSAPLFPEKKLETAERVKELRRSATRKLHTYVLPTPNDVQATSQTVAGNPTSGSPIESKSVFHSSPLNPSTHMGDLRDNKLPSPARLSNAQSVLKESNTNTAEIRTMLPVVDPALPGYNNLKTSSDNKKVKRGSFSGPIPLRSRSTENIDAAAARHSSAHQPTVHVRVSPSSSPPPISSPRIKELHELPRPPTGASRNTAFSSLVAHSAPLVPNSAPLASRGHSGQDHFNFRARQTPPSAPQTASPLPTPPGPISRSFSIPSRGIRTGISDGKETEDHQDKGAARMSLSSLPSTQTFLEDRQPLPAAAESVSRT

SEQ ID NO: 126959 - protein, 87 aa, Triticum aestivum
  Clone ID: PAT_TA_21377.pep
ERSPVSEPPDPDSGDLPNPMASAGEAPSTLLRFLYFVGAGVICTKAINTYRDYEHKKESTAALAAAESALAAAAAAEPAPATAAAKP

SEQ ID NO: 126960 - protein, 152 aa, Triticum aestivum
  Clone ID: PAT_TA_21378.pep
DLYGLDVLAHGLQDESWNVTRFLLLSKPPSPVAVPVDADAKTSMVVAHRGGSMAVVLKVLSAFSSRNINMSKLEVINNEAGVGEPRPPVMILDTGARGAPTLRAFPHVLYVDCEGAADDPLVREAIKEIEKFAVFVRVLGCYAADTNVYDLQ

SEQ ID NO: 126961 - protein, 122 aa, Triticum aestivum
  unsure (1)..(122): unsure at all Xaa locations
  Clone ID: PAT_TA_21379.pep
RICAVHLTVIHFVFVQGILDPAFSKPRGALTICTCLQKDTRVRNSPPHSGLTAMGPVPTPIRGAFTTAGVVLEMIKDVEAAVSGRKGRSGTAAGDVAFPKGXKENLASVLKRYNRRLPSKGQ

SEQ ID NO: 126962 - protein, 311 aa, Triticum aestivum
  unsure (1)..(311): unsure at all Xaa locations
  Clone ID: PAT_TA_21380.pep
MVNWIQVLRKHLVARLATNAGLRQHAVAVDDAGTVINLWLPDNDDAPDRKQKQRKKHQPVVLVHGFAGDGIMTWVLQVSALANRGYDVYVPDLVHFGGSTSPLPDRSVAFQARCLAAALRKLGVGTADVVGWSYGGFVAFELAAVHPDQVRSVVASGSTVKYTSAMRDDLLRRLGWAQSLTELLVPESVGQLRLLYSXAMHMKPWFPDRLLRDFLKVMYFNQKERAEMIEDIVLGDTEAFAPVFQQSILLLWGENDNMWPIEDAECLKHKLGEKANLRRISKAGHLVQLERPCVFNRNLIEFLAHGNTRSS

SEQ ID NO: 126963 - protein, 109 aa, Triticum aestivum
  unsure (1)..(109): unsure at all Xaa locations
  Clone ID: PAT_TA_21381.pep
MFGLQASGAAASWVVGRMGTDAHLYDDPDDASIPELLDSRFDARQVDALKRLLALIAQGVDVAHXLPAGVQNVASQSLXVKXLVYSTPQYADKRQNNLXXINISRSLSV

SEQ ID NO: 126964 - protein, 172 aa, Triticum aestivum
  unsure (1)..(172): unsure at all Xaa locations
  Clone ID: PAT_TA_21382.pep
MALSSSRPKHLLRPILRGFHASARALARVEPHEFSKPSEYLGSWEPAAEPREAWARLDRLRKGYASEVRELRRQYAYEVQLLQAERQRKADPRPXAARAANKERKAANSPPPDARRRTPRVQEDSQDLMKERRETGDWRRRRTKEEKGIKRTLQENSWVLIDETIKCISTPS

SEQ ID NO: 126965 - protein, 75 aa, Triticum aestivum
  Clone ID: PAT_TA_21383.pep
WRVGDLPKMYSCPTWPIERLQAARAPRALSSTGHAPPSELAPDVVFTVVAAAAGEAEGGALGYMAAASGQCWGPG

SEQ ID NO: 126966 - protein, 118 aa, Triticum aestivum
  unsure (1)..(118): unsure at all Xaa locations
  Clone ID: PAT_TA_21384.pep
FLTSLRWERRRLDVTRGKVSGPCYGEDGPPNRLPWRAAXSGRGVGGSQQLRGLFRGFLRRATDSYGAPEPALLLEQGGLVRPSPTLIWMGLAPVLDGPLLMMASFAGARVVIVLLGSV

SEQ ID NO: 126967 - protein, 96 aa, Triticum aestivum
  Clone ID: PAT_TA_21385.pep
MASLSMSAGWTPKQNKLFEQALAVHDRDTPDRWHNIARAVGGGKSADDVRRYYELLVHDIARIEAGKVPFPAYRPPCPGPGHNASYEADRFDHLNF

SEQ ID NO: 126968 - protein, 134 aa, Triticum aestivum
  unsure (1)..(134): unsure at all Xaa locations
  Clone ID: PAT_TA_21386.pep
MGKEKTHINIVVIGHVDSGKSTTTXGHLIYKLXGGIDKRVIERFEKEAAEMNKRSFKYAWVLDKLKAERERGITIDIALWKFETTKYYCTVIDAPGHRDFIKNMITGTXQADCAVLXIDSTTGGLRRYPKDGKP

SEQ ID NO: 126969 - protein, 93 aa, Triticum aestivum
  unsure (1)..(93): unsure at all Xaa locations
  Clone ID: PAT_TA_21387.pep
RQHGHFPLVVKRNRRESEKWTCGXLTIAWHRSICNPQHLDSYLRKHPAQARLSTERCSQKWHRMLLWMLGNTGSRRYSICPSSFRWTPPSRWS

SEQ ID NO: 126970 - protein, 146 aa, Triticum aestivum
  unsure (1)..(146): unsure at all Xaa locations
  Clone ID: PAT_TA_21388.pep
MGLVKEGIDMEEGTLEIGMEYRTVSGVAGPLVILDKVKGPKYQEIVNIRLGDGTNRRGQVLEVDGEKAVVQAFEGTSGIDNKYTTVQFTGXVLKTPVSLDMLGRIFNGXGKLIDKAPDIPEPTWIPGNSINPMRELPEDMSNRIPL

SEQ ID NO: 126971 - protein, 191 aa, Triticum aestivum
  unsure (1)..(191): unsure at all Xaa locations
  Clone ID: PAT_TA_21389.pep
RQARAKHADCVASATMAMATAKLVLLMVLVAGSSSGGSAWGPLMSRLRMPTARSPVEVAKERLQEDYVVSAAAPLIHALRPLLGSAGDLGRRAGVPCDSWRLAVETYNKRDWTTFPATANATSALNARRALTPGSRVVIDXASPSPRAQTGRXRKGVWSPITKXSQLXMXQXXTTLSTTXHTLXTPXPXXV

SEQ ID NO: 126972 - protein, 136 aa, Triticum aestivum
  unsure (1)..(136): unsure at all Xaa locations
  Clone ID: PAT_TA_21390.pep
PGVHLRIELVGPAVPRPRAGVGARISSYPNCSGESCQCRSSIASENLNCSAVTLRIWKGLYHERYGDIVKDSNPHLILAPNAGVAAYPSWMPTIEMIRGIGVPAIFTDFCEEXAHLXASCCIKLHKLGQPLGTPYT

SEQ ID NO: 126973 - protein, 135 aa, Triticum aestivum
  Clone ID: PAT_TA_21391.pep
MGRPTSGGVQLEQPKLRKGLWSPEEDEKLYNHIIRHGVGCWSSVPRLAGLNRCGKSCRLRWINYLRPDLKRGCFSQQEEDHIVALHQILGNRWSQIASHLPGRTDNEIKNFWNSCIKKKLRQQGLDPATHKPMAA

SEQ ID NO: 126974 - protein, 136 aa, Triticum aestivum
  unsure (1)..(136): unsure at all Xaa locations
  Clone ID: PAT_TA_21392.pep
MAPKAEKKPAEKKPTEEKAEKKPRAEKRVPGKEGGEKKGKKKAKKSVETYKIYIFKVLKQVHPDIGISSKAMSIMNSFINDIFEKLAAEAAKLARYNKKPTITSREXQTSVRLVLPGELAKHAVSEGTRPLQVYSS

SEQ ID NO: 126975 - protein, 154 aa, Triticum aestivum
  unsure (1)..(154): unsure at all Xaa locations
  Clone ID: PAT_TA_21393.pep
MASPARIELDKLSVEQLKGLKEQTDLEVNLLQDSLTKIRTAATRLXENASAALQDLSLRPXKGKKMLXVPLTASLYVPGSTGTTPEKSSSMFRTGYFNPRKPWPKGKEYCXERKFILLKPIFDEWVKWLXKKKXTDDMGLLLQANLXKRHRPSQ

SEQ ID NO: 126976 - protein, 189 aa, Triticum aestivum
  unsure (1)..(189): unsure at all Xaa locations
  Clone ID: PAT_TA_21394.pep
MDAAPPTITKSPPSLVPPAGPTPGGSLPLSSIDKTAAVRVSVDFIQVFPAPTSGKEDRSPSSAIAAMREGFARALVPYYPVAGRIAEPVPGXEPEIECTRGRGCGSVEAEASCSLEEARNLXERPLCIPKEELLXPRPPAGVRXEDTLLLAQVTISLVVAWAGAIRVFTVGLHGQRAARLPAYRRVQLA

SEQ ID NO: 126977 - protein, 127 aa, Triticum aestivum
  unsure (1)..(127): unsure at all Xaa locations
  Clone ID: PAT_TA_21395.pep
MGVVSAAADAIVAVFSLTIVVAAPLLDAQSVLPHTLYPAPLLGTQSAGYAXEFGDYLXVAHPPASSRGLVCLRVPFXXWPPAVATLLRILXRRXWAATTPSMAGVXTLTPFSNLRGEFVLINTNCSD

SEQ ID NO: 126978 - protein, 212 aa, Triticum aestivum
  unsure (1)..(212): unsure at all Xaa locations
  Clone ID: PAT_TA_21396.pep
MATMSLAAASPLASIPRGIAAQAPCAAFLSIRLGGATATRFAGLAVASQPAERRAAAMVAMAKREQELEEIRAMTTEQMEEEVVDLKGELFLLRLKRSARQEFKNSEFSRMRKRIARMLTVKREREIEQGINKRLSRKXDRKWNRHGVRHTSLXGNKEELKPKKRHVKIVMQCSEVLRFNLMLVSIMLHFNMHRSNYCTLVISIFLSRFIKK

SEQ ID NO: 126979 - protein, 236 aa, Triticum aestivum
  unsure (1)..(236): unsure at all Xaa locations
  Clone ID: PAT_TA_21397.pep
MAPLKLYGMPLSPNVVRVATVLNEKGLDFEIVPVDLTTGAHKQPDFLTLNPFGQIPALVDGDESSSSPARFNRYIASNYAXPEGTDLLPATASAANLEVWLEVDSHNFNPNXVAAGLPTAPLAAPPRRXPDAAVVENHAAHLAKVLAMYXRTWPPTTTSPGTIKAPGRLPPPSSSDHPPPPPPASPPPPPLWSHHAARFQXTXPHPFPAPLLGSLPAGPSTDQKSDFDSRHTLKKF

SEQ ID NO: 126980 - protein, 160 aa, Triticum aestivum
  unsure (1)..(160): unsure at all Xaa locations
  Clone ID: PAT_TA_21398.pep
MVAAKHVKIVKKRTKRFERHQSDRFKCVDPSWRKPKGIDSRVRRRFRGTIAMPSIGYGSNKKTRYMTPSGHKAFLXVSNVNDVRLLLMHNRTHAARDCHNVSSRNRVDTIARAKATGCQGTNPKAKLPPRFKRKGIGYWAAYGIIRKGLRYCGLDILHGC

SEQ ID NO: 126981 - protein, 82 aa, Triticum aestivum
  unsure (1)..(82): unsure at all Xaa locations
  Clone ID: PAT_TA_21399.pep
TPLLDDSWPLVMAAAAFSSSEPGADMALPLPPSRCGADCVXXPINPXXASLKVLXGNRXTXYXLKXPFPXXXPKAHVXSKFH

SEQ ID NO: 126982 - protein, 121 aa, Triticum aestivum
  unsure (1)..(121): unsure at all Xaa locations
  Clone ID: PAT_TA_21400.pep
MSPSEPTREESVYMAKLAEQAERYEEMVEFMERVARYAGPPGGGEKNSRLXGXRNLLSVAYKNVIGARRASWRIISSIEQKEEXRGNEAHAASIRAYRSKIEAXLXRICXXSRALDTLHPP

SEQ ID NO: 126983 - protein, 129 aa, Triticum aestivum
  unsure (1)..(129): unsure at all Xaa locations
  Clone ID: PAT_TA_21401.pep
MAEVEQQQDTPKLFNRWTFDDVQVNDISLNDYLAVNATKHAMYLPHTAGRYSKEAVXRKAQCPIRPSASTNSLXMCNGRNNGKKXWLSASIKHTLEIIHLLTDXQPIQVVLDAXINSGPLRIHPMVAGL

SEQ ID NO: 126984 - protein, 150 aa, Triticum aestivum
  unsure (1)..(150): unsure at all Xaa locations
  Clone ID: PAT_TA_21402.pep
MKVLIVALALLALAASAASSTSGGCGCQTPPFHLPPPFYMPPPFYLPPQQQPQPWQYPTQPPQLSPCQQFGSCGVGXSVGSPFLGQCVEFLRHQCSPAATPYGSPQCQALQQQCCHRSASGAAARYRRHTCGPAFLRHQRKANSRAMSHN

SEQ ID NO: 126985 - protein, 187 aa, Triticum aestivum
  unsure (1)..(187): unsure at all Xaa locations
  Clone ID: PAT_TA_21403.pep
SLPLTKEKAAFSPSDPAMQRHVASGRPSGTDGSDFSYRMVVESRYQRVAEGRSRLARLILVQALHLVAGGLLLLLSLSKGAAVNKFAVLSMAAGFLAIVVGELGRXRTMAVLLRLXTSLSSIAVAFSVXCIIRSELFLKVMKQNTEAITSYEMLDAVRVALGILLQMVVIATTTRLLQNMSPPKRAS

SEQ ID NO: 126986 - protein, 64 aa, Triticum aestivum
  unsure (1)..(64): unsure at all Xaa locations
  Clone ID: PAT_TA_21404.pep
PSPRSPSVEESRXHXQXLAVLDPNILWVTPDCALRTRKYTEVKPALTNMVSAAKLIRTQLASAK

SEQ ID NO: 126987 - protein, 60 aa, Triticum aestivum
  Clone ID: PAT_TA_21405.pep
SAQGSGSGVGSGSAYSNRYPYGPRYAGATANGNGGGTGNSQNGGAGGGKGSGSGFGDAIP

SEQ ID NO: 126988 - protein, 91 aa, Triticum aestivum
  Clone ID: PAT_TA_21406.pep
KESTLHFVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 126989 - protein, 185 aa, Triticum aestivum
  unsure (1)..(185): unsure at all Xaa locations
  Clone ID: PAT_TA_21407.pep
HPIRSIQSSPPTISPGNLRSERSEGSLVLLLKMQIFVKTLTGKTITLEVESSDTIDNVKAKIQDKEGIPPDQQRLIFAGKQLEDGRTLADYNIQKESTLHLVLRLRGGMXIFVKTLTGKTITLEVESSDTIDNVKAKIQDKEGIPPDQQRLIFAGKQLEDGRTLADYNIQKESTLHLVLRLRGGQ

SEQ ID NO: 126990 - protein, 305 aa, Triticum aestivum
  Clone ID: PAT_TA_21408.pep
TRHKNRKCKPKDRHNSITGNKLQTTEAQLKPKRDFHPKDTEHQETLVHPVDSSRCRGAAITGPLACDGPARFARECSSIVVVRESEACPQAAGPALQDIRLAPTDPDHGLRASTSRWDGVEGGGSLHGVERDGRGGSRAICMPPGSLRFSGGVWIPPRCRCWARVTPSRALVAIPGDGCCRYRVDVQPRHAPWEVGGVGVVGQSFVVRKGGGGQGAGDCRADLRHIRGAWRVRRSAVRWSWILNIVRWVTGKGPCLLRDLGLERLSIVYRDSPNCEGKGGGPVSGYLTKNLRTTLRRLEDEGLPV

SEQ ID NO: 126991 - protein, 84 aa, Triticum aestivum
  Clone ID: PAT_TA_21409.pep
NDNTADQGVECLKRLSSVEVVQLGWFVNVYMKVFFYLRETPCSSCKLKSVHIYLNVDVVLLFANLPCARIAAWMPCQCVCINNK

SEQ ID NO: 126992 - protein, 137 aa, Triticum aestivum
  unsure (1)..(137): unsure at all Xaa locations
  Clone ID: PAT_TA_21410.pep
LQRVHMRLVLASAMALCFKQKNYATAAHFARMLLENSPQEAQAKKARQVLQACHDKDDSHQLXNYDSRNPSVVXGATYVPIYRGPKXDFPCPYCGSRFVPSXIEGQLCTICELAAVGAXDASGLLCSPYTVQISDGN

SEQ ID NO: 126993 - protein, 118 aa, Triticum aestivum
  unsure (1)..(118): unsure at all Xaa locations
  Clone ID: PAT_TA_21411.pep
XXAPIITSYQFLFSWWLLWWFVLFXGELDTMMALGAFPRPSDHQYGPQRRLRGARXPLKGSGDTGEHRRCGIHKGAMPCPCPQKLPSGTVSALESEKREGIDPKSGRISAPRCREEAD

SEQ ID NO: 126994 - protein, 104 aa, Triticum aestivum
  Clone ID: PAT_TA_21412.pep
GLNYYRCIDRSWELSAAWTGAPIKVPSKFIVGDLDITYNAPGVPDYIHKGGFKASVPNLEDVVVMEGVSHFINQEKPNEVSDHICEFFKQVLIRIGKNLKGAVI

SEQ ID NO: 126995 - protein, 143 aa, Triticum aestivum
  Clone ID: PAT_TA_21413.pep
LSPSHRLRHHRPPPRPGRRGGAPPAPPTTSPPCAIHQRHHLLLLPRIHHHPSTPPLPVPQRFPASRFRHAPTQLHQHAVSALHTCSCEIPRLLPLLLQNLPLRFYSFHTYRSSRSHDKSDVLIPQSEQRMHLSPWLSCSIFVY

SEQ ID NO: 126996 - protein, 134 aa, Triticum aestivum
  unsure (1)..(134): unsure at all Xaa locations
  Clone ID: PAT_TA_21414.pep
RCEPKVVRKGTKPSEPSSLIESGQAKKKLLGEASPTRSNGAREGQDVRRAPASRRPGRGDGGXAQEPRRRLVQRRRRRRRLLLLPALVWTGLLGVGTDHRRVAVVIEPPLCLVHVWIRDGLVGVAVVTGPEAEQ

SEQ ID NO: 126997 - protein, 204 aa, Triticum aestivum
  unsure (1)..(204): unsure at all Xaa locations
  Clone ID: PAT_TA_21415.pep
SRPDNEAIYDICRRSLDIERPTYTNLNRLVSQVISSLTASLRFDGALNVDVTEFQTNLVPYPRIHFMLSSYAPXVISAEKAYHEQLSVAEITNSAFXEPSSXMMAKCDSRHGNXMACCLKFRGDVVPKDLNPAVGTVKTXRTIQLVDRRPTDSSCGINYNPPKVRPRAVIWPSVHRARVYDSTPQCCGGSPRCHRPRRTRPAAA

SEQ ID NO: 126998 - protein, 202 aa, Triticum aestivum
  unsure (1)..(202): unsure at all Xaa locations
  Clone ID: PAT_TA_21416.pep
DAAMGKKSKITRDRDRDISEKIALGMASTGGAKGGEVMYDQRLFNQDKGMDSGFATDDQYNIYSKGLFTAQSTMSTLYRPKKDGDSDVYGXMQDEQLEKVMKTXERFKPDKGFTGCFKRGLGNRDRPVEFDNQEENDPFGLDQFLTEVKKVRNCGEIGGGGTMKAXGGSSMXDDFGGGAGPSPSAPRGPAPGPAKFEASKYS

SEQ ID NO: 126999 - protein, 224 aa, Triticum aestivum
  unsure (1)..(224): unsure at all Xaa locations
  Clone ID: PAT_TA_21417.pep
MAGLAKTAMEWLQDPLSWLFVASVVFVVLPRRQRGKPPPFPPGPNQLPIVGNMSMMDQXLTHRGLAALAKQYGGLLHLRLGKLHAFAVSTPEYAREVLQAQDGAFSNRPATIAIAYLTYDRADMAFAHYGPFWRQMRKLCVMKLFSRRRPETWVAVRDESAALVRAVARRSGESVNLGELIFNLTKNVIFRAAFGAGAXADGDGGKQDEFIAILPEFSKLFGAF

SEQ ID NO: 127000 - protein, 191 aa, Triticum aestivum
  unsure (1)..(191): unsure at all Xaa locations
  Clone ID: PAT_TA_21418.pep
MGKDDVIESGAGGGEFAAKDYTDPPPAPLIDAAELGSWSLYRAVIAEFIATLLFLYITVATVIGYKHQTDASASGADAACGGVGVLGIAWXAFGGMIFVLVYCTAGXSGGHINPAVNFGXFLARKXSLVRALSNPGACSGNCGSALKGSKPYSKVRGGQSPLGFPRPRAPLFGLGRNRFPHHQAEPIRSVP

SEQ ID NO: 127001 - protein, 66 aa, Triticum aestivum
  Clone ID: PAT_TA_21419.pep
VLAPTHSTCDCDSLVCGYDKSVPTPGDLSRQNEHQERKRTLLHWILNFTAALHTCKNRQRVQRLAA

SEQ ID NO: 127002 - protein, 120 aa, Triticum aestivum
  unsure (1)..(120): unsure at all Xaa locations
  Clone ID: PAT_TA_21420.pep
SKFGITVVITARPLPKKXTSLPPGYSVDSCXQPQRAPLLHYRVAGCFPLQGQSFQXANLSKGQWYPEXSSRLPPQKPPRGHPPDTPAAQHPXQRAGXXGTXLEXNFXSXNFXKFQXRLXF

SEQ ID NO: 127003 - protein, 93 aa, Triticum aestivum
  Clone ID: PAT_TA_21421.pep
DARHVLLQTPEACAAVGAMTHSFIKAVECEPQGVTYGRLLTSMKAIMTNAGGCNQQLQGACAPARKVVNFSGVQEPNLSCSEMFDVYRKPFAL

SEQ ID NO: 127004 - protein, 89 aa, Triticum aestivum
  unsure (1)..(89): unsure at all Xaa locations
  Clone ID: PAT_TA_21422.pep
MASRTRRGAGPLPRLCLLLLLVLATGLPRGGALGLKLPFSPGDVLPILPRXVAWAVMNTLHSAVDLLPSFVXPXXXRNLPXRXKRXCFK

SEQ ID NO: 127005 - protein, 65 aa, Triticum aestivum
  unsure (1)..(65): unsure at all Xaa locations
  Clone ID: PAT_TA_21423.pep
MYLQYYINEKGDKVYTTKKESPLGVPTQSAHPARFSPDDKYSRQRYLLKXRDLGLLPTQNPGPKY

SEQ ID NO: 127006 - protein, 539 aa, Triticum aestivum
  unsure (1)..(539): unsure at all Xaa locations
  Clone ID: PAT_TA_21424.pep
PPVRAGAALLVPGPLVGAPPGLPSKEFIDIGKIASIEINHKQVDIMHGLEPQTIESLNLLKSRDAVFIVALNKVDRLYGWKTCPNAPIGKALRQQNDEVKLEFNTRLTDIVTQFKMQGVKTALYYKNKEMEDTFNIVPTSAVSGEGIPDLRLLLVVCSLTPFEEKVVFVLMTMMTGLVGRRDDGPITTVDVVLVNCMLHKGDQIVVCGMQGPIVTTFRAPLTPPPMTVLRVKGTYLHHKKIRAAQGIKISAQGLEHAIAGTALYAVRPDADIEDLKDAVMEXMSRVRNRIDKSGEGVYVQASTLGSLEALTEFLXSPAVNIPFCDFSIGPVHKKDVMKASVMLERKKEYATILAFDVKVMPDARDLAEESGVKIFVADIIYHLFDQFTAYIKNIREEKKKDSAEEAVFPCVLKIMPNCVFNKKDPIVLGVDILEGIAMVGTPLCIPSKEVIDIGKIASIEINHKQVGTATKGQKVAIKIIGSNSDEQQKSLGRHFEMEDELVSHITRRSIDLLKENYRDDLTMDDWKLVMKLKKILSIP

SEQ ID NO: 127007 - protein, 229 aa, Triticum aestivum
  unsure (1)..(229): unsure at all Xaa locations
  Clone ID: PAT_TA_21425.pep
RGRGRGTVYKGQLQDEHATNMAVKKIGKLQQETEKEFMVEVQTIGQTFHKNLVRLLGFCNDGTDRLLVYEFMTNGSLNEFLFGDARPHWSLRVQVALGVARGLLYLHEECSTQIIHCDIKPQNILLDDNFMAKIADFGLAKLLRANQTQTNTGIRGTRAYVAPEWFXNIGITPKVHVYXSFGVILLELVCRRRNVELEIADEERAILTYWPNACHTGSQFLVEAHRKFT

SEQ ID NO: 127008 - protein, 205 aa, Triticum aestivum
  unsure (1)..(205): unsure at all Xaa locations
  Clone ID: PAT_TA_21426.pep
DSPKGVQERLGFFAIAMSTMFYTCSDSLPVFLNERYIFLRETAYNAYRRSSYVLSHTIVGFPSLIVLSFXAFALTTFFXVGLAGGADGFFLXVAIVLASFWAGSGFATFLSGVVTNVMLGFPVGVPTLAYFLXLFSGFFINRDRIPRYWLRVHYLSLVXYPYEGXMQNESATRACSCGLQQRWRLRGVRSITILGEMGSHTRASK

SEQ ID NO: 127009 - protein, 68 aa, Triticum aestivum
  Clone ID: PAT_TA_21427.pep
GDEQSEEDADDGPPELLFVHGGHTDKISELSWNPSEKWAIASVSEDNILQIWEMAESIYCDDLSMQVN

SEQ ID NO: 127010 - protein, 189 aa, Triticum aestivum
  unsure (1)..(189): unsure at all Xaa locations
  Clone ID: PAT_TA_21428.pep
SRLAGTAQLAMAASASCLLSLLVVVVLAALASAQLSSTFYDTSCPSALSTISSGVTAAVGARGSAWGRRCSRLHFHDCFXVQGCDASVLLNDTFRGARTRSRTRLLNPKGFHVLXTHQGQVEXCSRDLSCADXLPVTAKDGWSPPRASWTIPWEDXPLFXXGXTTTPLVNLKNSAAQIQTGASANANVT

SEQ ID NO: 127011 - protein, 88 aa, Triticum aestivum
  Clone ID: PAT_TA_21429.pep
PVERPVEPINLDEPVKCPLPEPSILHDGRIWKEKMSSVSTRVRTDLPVVKEGSQLEPDGSSARSRSAVPRRAILPSVSAPEHNILSAA

SEQ ID NO: 127012 - protein, 43 aa, Triticum aestivum
  Clone ID: PAT_TA_21430.pep
DANHLLLEYINVNSWLILETKHRAKGTIVQPLPFFANNSVTSY

SEQ ID NO: 127013 - protein, 116 aa, Triticum aestivum
  unsure (1)..(116): unsure at all Xaa locations
  Clone ID: PAT_TA_21431.pep
LXXXXXSRXRAFSLVRXVXPAGPCFXPGSPPXCFEGGLTGGQAIXXGLNWFXLRRFGIQLGEWITPLGHRKGGVRLRARRRKAPVEVRQAHRCCLHRRPQGTRQQSSVRERRXRLL

SEQ ID NO: 127014 - protein, 162 aa, Triticum aestivum
  unsure (1)..(162): unsure at all Xaa locations
  Clone ID: PAT_TA_21432.pep
GDSGGSVVSVDVERISFGGKEHHIQTNHGPVSVAVYGDHDKPALVTYPDIALNYMSCFQGLLFCPEAASLLLHNFCIYHISPPXGHELGAAPISPNAPIPSVDDWADQVADVLDFLXLSSVKCFGXTASAYILTLFPAKYKERVQAXPCSPPCKAHLDDGYH

SEQ ID NO: 127015 - protein, 152 aa, Triticum aestivum
  unsure (1)..(152): unsure at all Xaa locations
  Clone ID: PAT_TA_21433.pep
MSAYCGKYADELIKNAAYIGTPGKGILAADESTGTIGKRLSSINVENVEENRRALRELLFCCPGXALQYISGVILFEETXYQKTKDGKPFVDVLKEGSVLPGIKVDKGTXEVVXTDKETQPRHDDXGKRCAKYTRPCPFAIGCVPRWPNNLQ

SEQ ID NO: 127016 - protein, 126 aa, Triticum aestivum
  unsure (1)..(126): unsure at all Xaa locations
  Clone ID: PAT_TA_21434.pep
MAVKVYVVFYSTYGHVAKLAEEMKKGAASVEGVEVKVWQVPEILSEEVLGKMGAPPKTDAPVITPQELXEADGVLLGSPRRXGMMAAQMKXFFDATGGRGASRPGRQAPGSSSTTVQGGGKRHPLT

SEQ ID NO: 127017 - protein, 50 aa, Triticum aestivum
  Clone ID: PAT_TA_21435.pep
VDGGIVLETEGREIAEKVSGHGLEGASSAEQTLVNALTQAREHLAKSLLM

SEQ ID NO: 127018 - protein, 173 aa, Triticum aestivum
  unsure (1)..(173): unsure at all Xaa locations
  Clone ID: PAT_TA_21436.pep
KFQDIYNVDKFVRSLDGVVEVIEDIPDEVSAKKPAVIRVPNRVTESFITGTIQPIFQKNKYLRLAVIFSSXVSLRPKETNNKDMDATACLAMFRWPPSWKHEYSEVAKKNAGIFQEFQESRWEGLGDSFGPTLGKEDFQTTRRAPKKGVIPRIGPVSRRCWSANKHLTKLGKG

SEQ ID NO: 127019 - protein, 208 aa, Triticum aestivum
  unsure (1)..(208): unsure at all Xaa locations
  Clone ID: PAT_TA_21437.pep
YTQSKYARSDSHGSWRIWLPSSRPAPSLDCLQWQLCSSTSLGHSSCARGHACSSRPFQRFQPNCLQCRPYXAVPTTLTLPPMPSIPEVPKMTIPPIPSIPIPKASPATNSCWRNPISPKPGGSNHRTKLFLQSRLPCHNALDSHYLAIHSNYDSNNNPTIPDPSAPLTAHPTTTALKSMSRGLPTCCRRWXXRGVKGXXXSHLERXXG

SEQ ID NO: 127020 - protein, 143 aa, Triticum aestivum
  unsure (1)..(143): unsure at all Xaa locations
  Clone ID: PAT_TA_21438.pep
MVKLAFGSFRDSLSAASLKAYVAEFIATLLFVFAGVGSAIAYSQLTKGGALDPAGLVAIAIAHAFALFVGVSMAANISGGTXEPAVTFGLAVGGTSXILTGILYWVAQLLGAPVACFXLQYSPGXAIPPRVSGITRXRVGDEG

SEQ ID NO: 127021 - protein, 174 aa, Triticum aestivum
  unsure (1)..(174): unsure at all Xaa locations
  Clone ID: PAT_TA_21439.pep
MDVSGAGGKAKKGAAGRKAGGPTKKSVSRSSRAGLQFPVSRVGRYLKKGRYAQRVGTGAPVYLAAVLEYLAAEVLELAGNAARDNKKTRIIPRHVLLAIRNDEELGKLLAGVTIAHGGXLPNIHTVLLPKKVAEKAAKXSPKRAAKSPKKGMCRPSHIHFPSSSYVSNSSHTLQ

SEQ ID NO: 127022 - protein, 182 aa, Triticum aestivum
  unsure (1)..(182): unsure at all Xaa locations
  Clone ID: PAT_TA_21440.pep
LSKHDQMVSGIDWSKSSNKIVTVSHDRNSYVWTQEGSDWVPTLVILKLNRAALCVQXWSPKENKFAVGKPVPKSVCIGYYETRKLTGGISKGLXRKKHDPPVTSLAWHPTIIYLAPSSXTDGKCRVFSXFIKGVXTRGNDFNRKFNPHLSTPLGIGCKWHNGKIGYQDTQIITTPVNWTLIP

SEQ ID NO: 127023 - protein, 160 aa, Triticum aestivum
  unsure (1)..(160): unsure at all Xaa locations
  Clone ID: PAT_TA_21441.pep
NSAIRRHYDVQPESPREPTREXERPRPXSXXGRRRREKGERPEEFETYRIYIFKVLKQVHPXTLVSRHKAMSIMDSFINDIFXEKLAAEAAKVARYXNRKPTITSREIQASVRLVLPGXELAKHAVSEGTQGRYTSLLPLRSPPHGATALFRFLVLLGQC

SEQ ID NO: 127024 - protein, 117 aa, Triticum aestivum
  unsure (1)..(117): unsure at all Xaa locations
  Clone ID: PAT_TA_21442.pep
MEKLPSQQQVVLLASPGAGHLIPMVELAQRLAADHGFAVTLVTIPGMSNPATEAVVLSSXLPSYVLTAVLPAVPLDDLPSGHRLRGPPCSSSSADCSPTSARVMEDANRGPVTALRR

SEQ ID NO: 127025 - protein, 77 aa, Triticum aestivum
  unsure (1)..(77): unsure at all Xaa locations
  Clone ID: PAT_TA_21443.pep
YVGVFRFKLWVPKFAKSITSTWHTHTTFQVTSSPISTKIQTLGGTKRSHTRRSDALITXCSMLSGGWWWPITXGPSS

SEQ ID NO: 127026 - protein, 212 aa, Triticum aestivum
  unsure (1)..(212): unsure at all Xaa locations
  Clone ID: PAT_TA_21444.pep
AVSTAALLAPIRAPTSAFIRRSQLTCHRLHSLKCRRAGSIVPAAAAAAAGSSSPSSAVFHGECFXVVGDNIDTDQFIPGRAPHSGCPPKPDEYRKXXSFAFXGVPSAAYPTPFVAPGEDPPRYXIIVXGTNSGRSSRQEAPFRLGPWTACRGYPFSQSLALERVPPDQGLGLDEERELHVDLQSFYNKLGRLTNHGAPPCEGCTDNRKDLKR

SEQ ID NO: 127027 - protein, 146 aa, Triticum aestivum
  unsure (1)..(146): unsure at all Xaa locations
  Clone ID: PAT_TA_21445.pep
MMAEAWTPVLLPATAPCFWQQDTHSVLWRRGDAWTAEENKLFEKALAQIDRNAPDRWEKVAAVLPWKTVDDVKDHYHXSEKDVGVIQXRRXLPFPRYHXSVPPPSGFALPRTGAARPPFKAPRXPXESRAEKVSPEPEEDTTFLMX

SEQ ID NO: 127028 - protein, 147 aa, Triticum aestivum
  unsure (1)..(147): unsure at all Xaa locations
  Clone ID: PAT_TA_21446.pep
MDLGAPARRRLPIRLLLVSLTVLVVLTARSSAEVITLTEETFSDKIKEKDTVWFVQFCVPWXCKHCKNLGTLWEDLGKVMEGADEIEIGQVDCGXSKPVCSKVDIHSYPTFKVFYEGEELVKYKGPKDVXSLKNFVLNEAEKQAKQT

SEQ ID NO: 127029 - protein, 99 aa, Triticum aestivum
  unsure (1)..(99): unsure at all Xaa locations
  Clone ID: PAT_TA_21447.pep
MSMAAHVEDQISKDILHGNAEFEAKDVVFEGNHMFEXPDGHRMCIIQDEAGFTVKLDPIGKEMMDSGTWYWEYTLDGAHVKLNMVDLCGDGTNCRFLIH

SEQ ID NO: 127030 - protein, 158 aa, Triticum aestivum
  unsure (1)..(158): unsure at all Xaa locations
  Clone ID: PAT_TA_21448.pep
MATVPGDLIWQIVRKNNSFLVKQFGNGNAKVQFTKEPNNLYNVHSYKYSGLXANKKTVTIQPSCWERTPAVASLLPKTKEARTHPPKLNHKSVMRKEFPKMAKAVKNKFGDNYYXPDLTKPALGRRLCVPHLQVAKSGVKKKNRTYPLTCVRLGAILT

SEQ ID NO: 127031 - protein, 167 aa, Triticum aestivum
  unsure (1)..(167): unsure at all Xaa locations
  Clone ID: PAT_TA_21449.pep
MATQRFTAALVACLLLLLALPARGRNITAILAGYKEYKLYNQYLSETKVCDEINSRQSTSMSVLVLSNDAMTTLASDAGDSLXAIKNALRLQXVLDYYDRKKGKKFGAEPPPTLSPATPDAAGTTGCPRGWSVWTRPAPSRPPPGRHVMPPTGAGHRPSCSPLRLTL

SEQ ID NO: 127032 - protein, 356 aa, Triticum aestivum
  Clone ID: PAT_TA_21450.pep
METLASVMRRDNRRFKPPPSSSAAAASASAGRAPLVMAFLACLAWVYVAGRLWQDAQTRAVLSGLLQKSTSNLPKEISVDDKLRDLGCTGIGRKIAEAEMDIAKAKSEGYLWGNGTGGTGTEGSGRKKFLAVIGVYTGFGSRLKRNTFRGSWMPRGDALKTLEEKGVVIRFVIGRSPNRGDSLDRNINEENRKTNDFLILESHEEAAEELPKKVKFFFSAAIEAWDAEFYVKIDDNINLDLAGLIEMLNVRRGSHGLYMGCMKSGAVVSEEEQQWYEPEWWKFGDSRTYFRHAAGSLFILSNNLARYININSASLQSYAHDDISVGSWMMGLNATYVDDDRLCCLSAVQEKVCSFG

SEQ ID NO: 127033 - protein, 78 aa, Triticum aestivum
  Clone ID: PAT_TA_21451.pep
RDELHRMLNEDELRDAVLLVFANKQDLPNAMNAAEITDKLGLHSLRQRHWYIQSTRAATGEGLYEGLDWLSSNIASKA

SEQ ID NO: 127034 - protein, 109 aa, Triticum aestivum
  Clone ID: PAT_TA_21452.pep
WALPVACVPAELAARLLLDAGALLACCRSIALLLSFCIVLLLAAAGLLMLLFTLGNDIPTWDIASLRPYHKDLKRAMDPTNRAVFLSHLTQSIIPCFIVCHFVNYFYIS

SEQ ID NO: 127035 - protein, 69 aa, Triticum aestivum
  unsure (1)..(69): unsure at all Xaa locations
  Clone ID: PAT_TA_21453.pep
MADEEVTDPKALLEDRSKAKCVSQWYDYQKCVKRIEDDETGHKHCTGQYFDYWXCVDKNVAEKLFEMLK

SEQ ID NO: 127036 - protein, 118 aa, Triticum aestivum
  unsure (1)..(118): unsure at all Xaa locations
  Clone ID: PAT_TA_21454.pep
PGGTSQPQSQGPQHRGLYSDPYSQKGIEQYVIPSMCLRMLEDDVEGMAEDEAVLKTSLNLSASLLCGTRQVPLHQHQNSYRSPXGKRTNXCIQGYDDHNRQHSEEPRXSGTAIPLIIP

SEQ ID NO: 127037 - protein, 172 aa, Triticum aestivum
  unsure (1)..(172): unsure at all Xaa locations
  Clone ID: PAT_TA_21455.pep
MAVASNRPATTLLPLAALVAVAGSLFLAGPAAAAGKTGQVTVFWGRNKAEGTLREACDTGTYTIVVISFLNVSAGPGNSPPSLDLSGHXVAGIGADIXHCQSKXIMVFLSLGGRQHPCRAPKPPRTRRYSGYPTSGAGAAPRLRRRSATRTRRLESPQRGAPPPDTQPWRCD

SEQ ID NO: 127038 - protein, 168 aa, Triticum aestivum
  unsure (1)..(168): unsure at all Xaa locations
  Clone ID: PAT_TA_21456.pep
GPTKGKGHVSCSLPSYRXICHVPVWLGNLNGIFHPMFPSQISIATCYLTMHVHSIXFLFTQGIGIGGVSMGVKNTVFRKRMRYSSDADRPRLLPQEPAPPHITQAHTDCTPTQLDREPATPPALGPELTWRGSSYGGGTDQFLHSVAPSAATSTSVGAATALALARTA

SEQ ID NO: 127039 - protein, 266 aa, Triticum aestivum
  Clone ID: PAT_TA_21457.pep
MSKWPGATKKRLKRGLWSPEEDEKLMNHVAQYGYGCWSSVAKIAGLERCGKSCRLRWMNYLTPDREWGAFSQEEEDFIIHLHSIRGNKWSQIAAHLPGRTDNEVKNFWNTIITKKPRPRATNPASPSARPLGPPTTPAPPPPVSRDAVFSEAELILSSPVGGPHMPPLVSAESYVYSRGSMDGAGGVVGGCSDDGSLSSLSGYNNNNQTADFAGYLDADALHGAVIPSVSSSSTLNSMAGVSPGGVANGNATDELCCNNYNKNNPS

SEQ ID NO: 127040 - protein, 176 aa, Triticum aestivum
  unsure (1)..(176): unsure at all Xaa locations
  Clone ID: PAT_TA_21458.pep
MALPNQGTVDYPSFKLVIVGDGGTGKTTFVKRHLTGEFEKKYEPTIGXVEVHPLXDFTTNCGKIRSTAGDTAGQEXFGWLRDGYYIHGQCAIIMFDVTSRLTXYKNVPTWHKDLCKVXENIPIVLRGNKVDVKNRQVKPSSYFHRKKXLQYNEILQDNYNLRNFRTPRNWRDRPHL

SEQ ID NO: 127041 - protein, 59 aa, Triticum aestivum
  Clone ID: PAT_TA_21459.pep
FTFWPLAVYFPVEMYLTRNKVAPWTNQWLAIHAFSLVCLLISAFASVGSAVGVFGSETS

SEQ ID NO: 127042 - protein, 138 aa, Triticum aestivum
  unsure (1)..(138): unsure at all Xaa locations
  Clone ID: PAT_TA_21460.pep
TITTVIKKMMRCAATGGGCVASWSGDRRLPAVNPCSVRMPTGNDGWCAGLRSRAADLAGLEMANLRGGVRGSSGASPRYGRLQAXTAAVDPEDIQLEKXQIKPQGISAIVWLACLGAIRLGYILVWQWPLDTPKVLGC

SEQ ID NO: 127043 - protein, 249 aa, Triticum aestivum
  Clone ID: PAT_TA_21461.pep
EFIAEVVSIGRLRHRNLVPLLGYCRRKGELLLVYDYMSNGSLNQYLYFKDGKPSLNWEERLHIIKGVAFGLFYLHEKWEKVVIHRDVKPSNVLLDSEMNARLGDFGLSRLYDHGTDPQTTHMVGTMGYLAPEYVRTGKASTLTDMFAFGIFLLEVTSGQRPIKQNPFGNKHTLVDWVIERWHNGSLMETVDPRLRGDYNIDDASLVLKLGLLCSHPFTSARPTMRHVMQYLEGDTPLPELTPAHFSFTM

SEQ ID NO: 127044 - protein, 145 aa, Triticum aestivum
  unsure (1)..(145): unsure at all Xaa locations
  Clone ID: PAT_TA_21462.pep
ELLLLLCLNNLCFIWDCWESTLRATRKRHKVRPTACVKRLSGFPVPICHLLGAQKRLVPSEGSALPLDGGTCRTWIQLNNLYPKMALQNMGAQTRMILLQVQEPXRFQDRSRXKGQRQXCEQGDIQXTAKQLHKQILGVAGQIKL

SEQ ID NO: 127045 - protein, 180 aa, Triticum aestivum
  unsure (1)..(180): unsure at all Xaa locations
  Clone ID: PAT_TA_21463.pep
MALAAAVAVPFLLHARLGPRFAPALSPRRLLPCSTTAYEPPHSARPPASKQAEPVSQVPWRAAEAEILRHVEPVVQLIKDILHSXDRYADGECLGPADEIVVAEKILAYHPRAEDKIGCGLDGIMVDRHPQFRKPRCLFVVRTDGVWIDFSXYQKCLREYIRRKYPSHGERFIREHFKRT

SEQ ID NO: 127046 - protein, 167 aa, Triticum aestivum
  unsure (1)..(167): unsure at all Xaa locations
  Clone ID: PAT_TA_21464.pep
MAWSAAAVSRFAAASPPAAPISVRLGAAASRSSLSFSSGRRRPVAASLSTSATVVKEAVQTEKAPPALGPYSQAIKANNLVFVSGSLGLESRDXEFISENVEEQTEQVMKNMGEILKLVGATIXFVKTTIMLADLQDFNKVNEIYGKYSRGNNCTINLQVAPPQLPK

SEQ ID NO: 127047 - protein, 102 aa, Triticum aestivum
  Clone ID: PAT_TA_21465.pep
INGCVLSQRGKNKKDVDSSVECYISEHGVTAEVAFAQISSLIEDAWKTINGARFENSKLLPAVQRVADITASMPLMYGDNKDAFTFSDGLKGLIERLFLNRP

SEQ ID NO: 127048 - protein, 365 aa, Triticum aestivum
  unsure (1)..(365): unsure at all Xaa locations
  Clone ID: PAT_TA_21466.pep
MMASEPVARAVAEEVGRWGSMKQTGVSLRYMMEFGSVPTDRNLLLSAQFLQKELPIRIARRALELESLPFGLSAKPAILKVRDWYLDSFRDIRYFPEVRNRDDELAFTQMIKMIKVRHNNVVPTMALGVQQLKNEQFSSRKLPPGFDEIHGFLDRFYMSRIGIRMLIGQHVALHEPEPQPGVIGLINTKLSPIQVAQIASEDARSICMREYGSAPDINIYGDQNLTFPYVTSHLHLMLFELVKNSLRAVQERYMNSDKDVPPVRIIVADGTEDVTIKVSDEGGGIRRXVGLPRIFTYLYSTAKNLPDMEGPSEGVTMAGYGFGLPVSRLYARYFGGDLQIISMEGYGTDAYLHLSRLGDSEEPLP

SEQ ID NO: 127049 - protein, 181 aa, Triticum aestivum
  unsure (1)..(181): unsure at all Xaa locations
  Clone ID: PAT_TA_21467.pep
LPPRFPFRPYAAASHRRQSSVQNSRSSLPLPRSGPRLQQPPHPSPSHRVRALSPPPPLRATTGWATAALRKVPRTSPISAPEKSAHQIXALKKARWPGGMTMAGGGGLNRSSSKGQLPPQRLLDISAXVLLNVPKEDWXLPRFCSRLDKRLVYEAIRXTXPNSNPLLQGXIPHVKDCTLPA

SEQ ID NO: 127050 - protein, 104 aa, Triticum aestivum
  Clone ID: PAT_TA_21468.pep
MCGGAILSGFIPPSGLAAAAAAAAKKKQQQRCRVTADLLWPGPGSKGAPQDKEEDFEADFREFERGAKMTLTTPKGGTRGQELLRRTSCLHARKILTTSKVRDK

SEQ ID NO: 127051 - protein, 207 aa, Triticum aestivum
  unsure (1)..(207): unsure at all Xaa locations
  Clone ID: PAT_TA_21469.pep
MEAPAAKRVLRVAAISGSIRKASWHSGLIRAAAEVCEDCIPGLRVDHLDVADLPMLNTDLETNGGTGFPPAVEAFRAKVRHADCFLFASPEYNYSITSPLKNALXDWXSKGVNCWADKPAASVSAGGTSAAEVQLHLPKSGVLASFINKPDFLSLSSTRNFREQPDSSTPTKRPLGSAAFAWSAVRGKARHRARIPALKKLGSKNCT

SEQ ID NO: 127052 - protein, 123 aa, Triticum aestivum
  Clone ID: PAT_TA_21470.pep
PEFPRKPCQINNAIGTGGKTASFDPACRPLPTRQSLRRALKHAQRSAPPAATNPARPLHTKTPPFAVLLGQGQSSLDTDRGARESAGAASWHKGCVGMGLRGRGQDKAATKNPVPEMAGGRRQ

SEQ ID NO: 127053 - protein, 271 aa, Triticum aestivum
  unsure (1)..(271): unsure at all Xaa locations
  Clone ID: PAT_TA_21471.pep
RENMGYSHADINYILKLIHILCLPEMKLFLDTIRLLAKHTDNLSDEVCNYIIDGKLIQTAVLLLAAQEQIRGVSSPKKDLNSKPDEFAIITNCVVGKITSIQLEMCQKGKELEPLEAKKKLFDMTLTLVHVISQAGEALDSYIRDHPKLAASFYQDRALTWKVPCIIPISHVEVLEHVSLILKDYGLCSGEGIDIGNLCPYENVVSSEELPRKLGPMARMKAGTDEPCLENVKAKGKKGPRGWELKLARRSFFPYWRSVLTSQFHVXXXIN

SEQ ID NO: 127054 - protein, 97 aa, Triticum aestivum
  unsure (1)..(97): unsure at all Xaa locations
  Clone ID: PAT_TA_21472.pep
NXXYLEXXEIXFKXELXXFFPRMDGXVIXQCPQSCXRIGRLFRSNLRFLGKHRDGSAFLVALFSXVIVLGVLHLSFKLRTSFWYPGTRPVLPGFCCF

SEQ ID NO: 127055 - protein, 182 aa, Triticum aestivum
  unsure (1)..(182): unsure at all Xaa locations
  Clone ID: PAT_TA_21473.pep
GFSWSSTADQVTQGISAAGLTAIVTGASSGIGAETARTLALRGAHVIMAVRSLPAAQAVKDAVLAQAPGAKLDVMELDLSSMASVRAFASQFIDRGLPLNILINNAGVMAIPFALSKDGIEMQFATNHVGHFLLTHLLLGYMKRTLMNXKLEGRIVNVSSEGHRXAYPEGIXFDKITMNQCI

SEQ ID NO: 127056 - protein, 151 aa, Triticum aestivum
  unsure (1)..(151): unsure at all Xaa locations
  Clone ID: PAT_TA_21474.pep
MMMILSPRQWLLLLPPFFLSTLLFSYLYTILWLRPERLRQKLRSQGVKGPKPSFLFGNIPEMRRIQKLATPYQEEGAGPTDRFSSNYVAILFPYFLHWTKXYGSIYWYXLGSIQTLHVIXPDMVKELGNXXSWILXKPXYFKKWSSSWEEF

SEQ ID NO: 127057 - protein, 40 aa, Triticum aestivum
  Clone ID: PAT_TA_21475.pep
LTCEDMDQALNRAGGKAGNKGAEAALTAIEMASLFRHHLG

SEQ ID NO: 127058 - protein, 182 aa, Triticum aestivum
  unsure (1)..(182): unsure at all Xaa locations
  Clone ID: PAT_TA_21476.pep
DLSPLYEHPGKANILEQLFLKLEDSIRDSGCFPGCPQKEPPSTLLWTLFLISQHYDRRGQYDIALNKIXDRLSPHTPTGKXILQHAGNSTAAPALARWKLGPWFLADRYLNSEGVRQMLSGXDKFGLAEKTAVLXFTKDGDQHIPLXDARCGWYGLPAGVSRPGMGAAPGPGKCWIPETYPI

SEQ ID NO: 127059 - protein, 64 aa, Triticum aestivum
  Clone ID: PAT_TA_21477.pep
MAYCCDDGCNCPPDCGCPCDCCNLYPEVETAAASGILAAPTTKASAGGCNTCKCGGTSCNCNCS

SEQ ID NO: 127060 - protein, 170 aa, Triticum aestivum
  unsure (1)..(170): unsure at all Xaa locations
  Clone ID: PAT_TA_21478.pep
MPRKITLVKEGEPQPVDAAQGEPAPAPAAPTAALTEAEVDELPRAIVRRLVKDKLSHVAGGEGAEVIVNKDAMAAFAEXSARIFIHYLSATANDMCKESKRQTINADDVLNAPDDMEFSEFVXXLKTSLQEFRNKNADKRSQAKNNRRKREGINEKSRKNQMGTNQKDDK

SEQ ID NO: 127061 - protein, 72 aa, Triticum aestivum
  Clone ID: PAT_TA_21479.pep
YPTLSMENSMCGLLISSYYLMHKALYLSCLFFYIKTIKPRVANDVKYYMLNTESFICLLNSAYYLMSPINFK

SEQ ID NO: 127062 - protein, 235 aa, Triticum aestivum
  unsure (1)..(235): unsure at all Xaa locations
  Clone ID: PAT_TA_21480.pep
QTQCVIDNQALPCLLNLLTTNHKKSIKKEACWTISNITAGNREQIQAVINANIIAPLVQLLQTAEFDIKKEAAWAISNATSGGTHDQXIKYLVAQGCIKPLCXDLLVCPDPRIVTVCLXEGPENILKVGEAEKNPGASDVNVYAQXMIDDAEGLDKIENLQSHDNTEIYEKXVKISIYXLXEEMIHASGTQDGSLGNNLVTDHLKSIEAHVCQINWELQTVACGRLSIIRICDMR

SEQ ID NO: 127063 - protein, 102 aa, Triticum aestivum
  Clone ID: PAT_TA_21481.pep
VSAAALWTLTVQRASGSGHAQFVGAPFLSSNRPPHPTEGTHITDACLGSRALRRIGLSTMERCTVHEHDCMLLATSYLRVPVHRPCLCTYVWSINKTGWGVG

SEQ ID NO: 127064 - protein, 211 aa, Triticum aestivum
  unsure (1)..(211): unsure at all Xaa locations
  Clone ID: PAT_TA_21482.pep
DPSQTSFFQVLNIPTKINMGTVEIITPVELIKKGEKVGSSESALLAKLGIRPFSYGLQVTXSVYEDGSVFSPEVLDLSEEDLIEKFATGXVSMVASLSLXAISYPTLAAVPHMFINGYKNVLAVAVETDYSYXHADKIKEYSRXPKQFAVXAPVPLGTRRSAAPRKXKGAEPEKDRRNGSPLQDKTRFSNAQFGFFTPQVQIFTITVNTCS

SEQ ID NO: 127065 - protein, 128 aa, Triticum aestivum
  unsure (1)..(128): unsure at all Xaa locations
  Clone ID: PAT_TA_21483.pep
MPPKLDPSQVVEVFVRVTGGEVGAASSLAPKIGPLGLSPKKIGEDIXAKETAKDWKGLRVTVXKLTVQNRQAKVSVXSPPAAALATSPLGGXEKDRKKVXTSQRIGLFSKFDRSPCKDLPEGISLLTW

SEQ ID NO: 127066 - protein, 117 aa, Triticum aestivum
  unsure (1)..(117): unsure at all Xaa locations
  Clone ID: PAT_TA_21484.pep
XFEVMTLEYLHXTIRMCYVLKAIIVGXXFPDXSEVXXFAGPPQAVRHIDTVRPTRSVAXIXGGGIVLPGGHAAAGGARNRRGLAGRRGRACLRSSAPLSHLDYEFTHRPEHALSHEK

SEQ ID NO: 127067 - protein, 89 aa, Triticum aestivum
  unsure (1)..(89): unsure at all Xaa locations
  Clone ID: PAT_TA_21485.pep
VXCATKLNGSIXESRGGGGGRGNKSLHIFTKGRKTSQAANYGVWPCVPFCTLGSLVYVHQTDPEKEYRVNSSTVKDGEKLCSLSHGELT

SEQ ID NO: 127068 - protein, 198 aa, Triticum aestivum
  unsure (1)..(198): unsure at all Xaa locations
  Clone ID: PAT_TA_21486.pep
MAAEAKTPSLAEEYSLPPQEVPVEKAAEEKPSSGTESEAAPSTNDETPPSVEDKNGTSEVQDAAEKPDXEETNTAAEETPAVXEASETAEXEEEAEKPEIKIETAPXADFRFPTTNQTRHCFTPYVEXHXCVAAKXEDAPECDKFAKYYRSRAQLMGDRWNNNXKRNFTSLNQIYRLLNGQLLFGPKKKPFVKTRAPN

SEQ ID NO: 127069 - protein, 142 aa, Triticum aestivum
  unsure (1)..(142): unsure at all Xaa locations
  Clone ID: PAT_TA_21487.pep
MGQALGLIQVDQSTVAIKETFGKFDEVLEPGCHFLPWGIGKQIAGYPSLRVQQLDVRCETKTRDNVFVNVVXSVQYRALPDGALLLLAGLGAPPSKLSVLAVSSGLGSFLTWSSRRLMDPLAFASLYTEQLRYELSNPINCT

SEQ ID NO: 127070 - protein, 131 aa, Triticum aestivum
  unsure (1)..(131): unsure at all Xaa locations
  Clone ID: PAT_TA_21488.pep
LGRTFANKSMDXWQEFQQVVQAGHKGRYGQIRLRKATQSIYTYPAPDCMCQGILLGFKISENQSVLQHMTVEDRRLKCCIVSTFQAATRYASLIFLGHRLCPVSPPPLSLSLSLSLSLSLLSSKSLVQSII

SEQ ID NO: 127071 - protein, 135 aa, Triticum aestivum
  unsure (1)..(135): unsure at all Xaa locations
  Clone ID: PAT_TA_21489.pep
MAPSGDTIALVHSGMDSSNKTLLKSEALYKYVLDTSVLPHEPECMRELRLVTDKHEWGFMQSSPDEAKLLRMLIXLTGARRTLEVGVYTGYXAAGTALALPDDGXSSPSTLTAYYNRALITPGLRQGQSARPPWN

SEQ ID NO: 127072 - protein, 169 aa, Triticum aestivum
  Clone ID: PAT_TA_21490.pep
MTGAAPALLHHHGVSSRGTLPVYHGNCRFVPGSCFLSKSTILGPLTVSLVCGATPNNHRPRNPDISRQQKRGSSSRGKSKPFQERDDSANNDEFDSDTVSHKNGPPISLTSNTFLHPTKAAWENKLLSQGKKNGRHEQARTCGKGREDKKPEPAKSQGERGSVDSLLNL

SEQ ID NO: 127073 - protein, 124 aa, Triticum aestivum
  unsure (1)..(124): unsure at all Xaa locations
  Clone ID: PAT_TA_21491.pep
AVGEXAXXSPGAFXTIVLXRXYNXCFTXFVPXNLVRXRSVTRGGGQSSLPPRRVRLXWVQLLTXALAVFLNSLKFSGEGSSCAARNSARSFQFSSSGRLPVALRAHPRIGRIAESTAACSAILN

SEQ ID NO: 127074 - protein, 146 aa, Triticum aestivum
  Clone ID: PAT_TA_21492.pep
MGGGHDMHGGHSGGVKGFVSSLVGGGKSHGYGGQGHGCDQGYGGHGQQQHGYGGHVQQHGYGSHGQQQGYGGHGQHGYPPPAAGACPPYGGYPAQGYAPAAYPAQPAPHHGGHMGSYHTGHGGGHGHGYSGGKHMGGGKHGGRKWK

SEQ ID NO: 127075 - protein, 144 aa, Triticum aestivum
  Clone ID: PAT_TA_21493.pep
MAASRIPPCHLHPSSSSSSSSSMATICPRPGTRQSSAFRFRASAHGSGSSPNLSSFTAVTGKKVKVFEDQLRGIVCYRDDDGEMVCEGYDEGPGSECGCRRRLLPMACGGSGNGLTNWATSKSSTTTPSPQLNGDKTKAFSIVL

SEQ ID NO: 127076 - protein, 84 aa, Triticum aestivum
  unsure (1)..(84): unsure at all Xaa locations
  Clone ID: PAT_TA_21494.pep
MAWTSRRMVASALVFLLMLLAASEMGTTRVAEARHCTSQXSHRSVGACMSKEQLAXNVCRTEGFPWGECKWHGIERKCHCKRFC

SEQ ID NO: 127077 - protein, 115 aa, Triticum aestivum
  unsure (1)..(115): unsure at all Xaa locations
  Clone ID: PAT_TA_21495.pep
AATEVAALLDLKPHPEGXGFYTETFRDGSITLTTSQXLPPHYKVNRAVSTAIYFLLPARSVSRLQRIPVXNWHFYKGEXLTVLELHDDVTLTYCNGPHXRKQRPNIRATNCGWSS

SEQ ID NO: 127078 - protein, 69 aa, Triticum aestivum
  Clone ID: PAT_TA_21496.pep
VPPFSSGFFRPQPPTGFFCPLFPCKQTLSYYTKSHRSNFPNLFKSTIHLINAICFRKQITDFKETNNRL

SEQ ID NO: 127079 - protein, 190 aa, Triticum aestivum
  unsure (1)..(190): unsure at all Xaa locations
  Clone ID: PAT_TA_21497.pep
RHPIRVRAWPHPDPSELLKAHRILAAVQNAQRSTKRRGAGPARPVIAVTPTTTSALQVPSLTSLAHTLRLVDAQLVWIVVEPGNRTDAVAAXVLSRSNLDFLHITGPXTPTASLRIHALKEIXDEADGRIVVFXRREHILRTELFDKAHKVXNVGAVPSGPGXXTGPSKRTEGITLRKRERTIYAQVDGR

SEQ ID NO: 127080 - protein, 115 aa, Triticum aestivum
  unsure (1)..(115): unsure at all Xaa locations
  Clone ID: PAT_TA_21498.pep
MSTVSRASLDQKLALAKRCSREATLAGAKAAAVATIASAIPTLXASVRMLPWAKANINPTGQALIVSTVAGMAYXIAADKKXLSLAKRHSFEEAPEQLKEHLLQGNGAPNRLLKA

SEQ ID NO: 127081 - protein, 164 aa, Triticum aestivum
  unsure (1)..(164): unsure at all Xaa locations
  Clone ID: PAT_TA_21499.pep
XLVRAPXFFIKGEYNQNQSVTCNVSTTPIHVPRTPFVRQQQPKILPQPDDTTTARSATQSAGNQFPWAPTASAAPVXAPAVPVGSVNGGHDQDAEDHVGDDRGHADLAGDLLHLALREQGLRLDLRHVAPRPPEGREQTKRGRSSTLGDEKPRTNEASDAYPPI

SEQ ID NO: 127082 - protein, 136 aa, Triticum aestivum
  Clone ID: PAT_TA_21500.pep
PPDAPSPSWPAQWTTAPQRWIPRPGPTPSDAGGARSGRGVGAAGAGAQGRAPGRAGTEGGRGGRREGLGGRVGGLSAAEARCGGTGLGGGRTPLLAAWAERFCALEGVKGLIPDVDRLLEYTKARRAVFGLPPLRP

SEQ ID NO: 127083 - protein, 144 aa, Triticum aestivum
  unsure (1)..(144): unsure at all Xaa locations
  Clone ID: PAT_TA_21501.pep
IPPCVRALKGGSQPLGTVNTVHNSAPVLVGIFRQQLEVLDRSPGSKLSGKPLVLKDVLYVPRMSRDLISVSLLLRXGLKLVFESNKVVLSXVWYFLVGKSYESGGLXRLSVLNNHSSYHVNVVCNNDFINDIWHSRMCHVKKKK

SEQ ID NO: 127084 - protein, 156 aa, Triticum aestivum
  unsure (1)..(156): unsure at all Xaa locations
  Clone ID: PAT_TA_21502.pep
RPHKINNTNRIDRATYNGSSGPIHCSSHRRRAAAGTGRSNGETACATSNPWLSSALLSSGIPTAIYSLGGAASLPXPDPLTAPPPRLTFLAGPASGGRRRPPPRVAALGAPCPPLLPHTTVIPPGWDGSLPITSHGPCTFPTHCDVRHYIDLXIDY

SEQ ID NO: 127085 - protein, 178 aa, Triticum aestivum
  unsure (1)..(178): unsure at all Xaa locations
  Clone ID: PAT_TA_21503.pep
NKPIFDAAAVYCLDIGMQCHGCCVLQRCIARSTGEHKEKLVAAIARNGFELAQDAYGNYVVQYVIELKVATANASLXAWSRPRYIHLSMQKFSSNVVEKCLKVFKEADKANIILELLSAPQFERLLLHPYANYVVYAALQNSKGSLHSALTNAIRPHVELLRTSPYCKRIYSRALLKK

SEQ ID NO: 127086 - protein, 116 aa, Triticum aestivum
  unsure (1)..(116): unsure at all Xaa locations
  Clone ID: PAT_TA_21504.pep
TGTNASVAPPFERLPGRMQEPFLAXQGPGRSCPPNVRVERPMALVPPPLEPRTKLSDAASFRPLSGPSRGPCRGCPHGYXKATXLKAGXNTSEPPGXFLPXPSVPPFXXXHXXRXX

SEQ ID NO: 127087 - protein, 138 aa, Triticum aestivum
  Clone ID: PAT_TA_21505.pep
FTLAHLTDKPTPGLTARREVHGAVEQRAAAEPRPLLLLLPRETGAERWPRCPISAPTSAQKLLKGPPPPPGAAPLPTPPPPRPGPGMLIPNAQETPQVQEATTTSPRAPGGDSLEHKRALLHRQGTARSHCQTDAAPQ

SEQ ID NO: 127088 - protein, 151 aa, Triticum aestivum
  Clone ID: PAT_TA_21506.pep
GDKDPPFYLRLLPPLPIHLLRTQAPAPKPALPTSTFSSNVRSGRQVDGLLRHRGPCQKAKEGQILVQRHRAPASRGRGSFSPTPRPHERVVFLPNFLRRTRFPTPPICPGVMFYYVLDFNDLAPNLTSNLGVIVLSKLSLNPPNSGSGSRH

SEQ ID NO: 127089 - protein, 145 aa, Triticum aestivum
  Clone ID: PAT_TA_21507.pep
LSFQMSWLSTQNFSPSTSPLVETLVFSKLLANLQVWWREQVAATNRGRLMAIPREKKKKRTWGKKIGFTARSVSVELTYARPRDFQEAVGGSTTRRRERRRLGALWFSRKDRKSARFRRERTKGRDLGRPGHTTWPSKQIDMGGR

SEQ ID NO: 127090 - protein, 404 aa, Triticum aestivum
  Clone ID: PAT_TA_21508.pep
MGVLSRPEEVPALLRLKLAAGRIRRQIPPQDHWAFAYDMLQRVSRSFALVIQQLGPDLRNAVCVFYLVLRALDTVEDDTAIPNEVKLPILRDFYRHIYNPDWLFSCGANDYRVLMDNFRQVSTAFLELGEGYQKAIEEITRRMGEGMAKFICTEVETIDDYDEYCHYVAGLVGYGLSRLFHATGTEDLAPDHLSNSMGLFLQKTNIIRDYLEDINEIPRCRMFWPREIWSKYVDKLEDLKYEENSEKAVQCLNDMVTNALIHAQDCLQYMSALKDNSNFRFCAIPQIMAIGTCAICYNNVKVFRGVVKMRRGLTARIIDETKSISDVYSAFYEFSSLLESKIDDNDPNAALTRRRVDAIKKTCKSSGLLKRRGYDLEKSMYRMPMLIMIMLLLVAIILGVLYGK

SEQ ID NO: 127091 - protein, 154 aa, Triticum aestivum
  unsure (1)..(154): unsure at all Xaa locations
  Clone ID: PAT_TA_21509.pep
GFEVRFLSHRRGKSHGAVHELHDPVLVVQSSCWASLPPELLRDVIERLETSEDTWPXRKHVVACAAVCKXWREMCTRDLSKTPEFPGKNTFPVSLKQPGPPDGTIQCFXIKRDTSTPIYSPYLSLTPPCLFENGKFLLTAKRNCRATFTEYIIQ

SEQ ID NO: 127092 - protein, 164 aa, Triticum aestivum
  unsure (1)..(164): unsure at all Xaa locations
  Clone ID: PAT_TA_21510.pep
MATGRGLPLLLVRAALLVGLASASSLSSDGVFQAXPDLLAGRTLLQAKRNCPVNFEFQNYTVITSRCKGSKYPPXACCDSIKEFACPXNNYINDESNDCASTMFSYINLYGXKYPPGLFAPECREGKLGLSLRRRPPRKTSVKSGVRKGPQSSSLALDYSQCVD

SEQ ID NO: 127093 - protein, 77 aa, Triticum aestivum
  Clone ID: PAT_TA_21511.pep
AVPTSKGQALADEYGIKFFETSAKTNLNVVQVFFSIARDIKQRLSESDSKPEDRTISINRPDGGEASASQKSACCGS

SEQ ID NO: 127094 - protein, 87 aa, Triticum aestivum
  unsure (1)..(87): unsure at all Xaa locations
  Clone ID: PAT_TA_21512.pep
FTDQDLVRLGICRSSLSDYAPNLVRFTSDDYFAFKGRVRIPPWXPGGCKKQRIDSWRLSLCNKSDILLXVQPNSSXGXXVXXKMPGF

SEQ ID NO: 127095 - protein, 174 aa, Triticum aestivum
  unsure (1)..(174): unsure at all Xaa locations
  Clone ID: PAT_TA_21513.pep
VSLLCHPPLFQLSPCPLSFSYIQVLAAPLFFLVSFDLRAVXVQYSSFPQGTLAAGPSGFLEFLFPGPSSCPRVDPSVRGAHRPHPHVYPHSSSDXTPCSDEAERXPYPPLPLLLRRLPLRVLRLPMKRIAPLQLRDPRRLSPTLSPEKSLRVXXXGPXXQXSPXNPXXXLTSKX

SEQ ID NO: 127096 - protein, 159 aa, Triticum aestivum
  unsure (1)..(159): unsure at all Xaa locations
  Clone ID: PAT_TA_21514.pep
MAAAAAMMVSGGRAALAVAGVLCAVAAMAAAQQASNVRATYHLYNPAQNGWDLNRVSAYCATWDADKPLSXWRQKHGWTAFCRPAGQKGQAACGKCIRVKNXSTGASIVAKILDXCNNGGLDLDYETXFKKITQRQGYQMALNSTTFSPADNRLTRSPV

SEQ ID NO: 127097 - protein, 134 aa, Triticum aestivum
  unsure (1)..(134): unsure at all Xaa locations
  Clone ID: PAT_TA_21515.pep
METAERGITVCVTGAGGFVASWLVKLLLSTGRYTVRGTVRHLGDGKNAHLKTLAHAEERLHLVKADMLVYGSVASAVPGCQGVLHVASPVPSGKSSNPXEXFITPAVTGTLNVLKACYEGKTKKIVGGXSXACQ

SEQ ID NO: 127098 - protein, 194 aa, Triticum aestivum
  Clone ID: PAT_TA_21516.pep
MAMDAERRQAELIAQFSAQAAALSSAPQLAALVLEATSHPALFAFSELLTLPALSKLTGTQYASSLDLLRLFAYGTLNDYKSNSGFLPALLPDQVRKLKQLSVLTLAESTKILPYDQLMQELDVSNVRELEDFLINECMYSGIVRGKLGLAEKVLGGTCSGLGCALTPDYAKLPDWSGLIGGHQIDVASEKTMG

SEQ ID NO: 127099 - protein, 131 aa, Triticum aestivum
  unsure (1)..(131): unsure at all Xaa locations
  Clone ID: PAT_TA_21517.pep
MAAVETVVLKVAMSCEGCAGAVRRVLSKMEGVXEPSDIDLXEQKVTVKGNVKPEXDVFQPVAPPGKRTPYWEGEATAXGRCGGSGAEATPGNAEKRLLLLLRGGQLPSADPDCHPISVMLRNLKSKKTGIG

SEQ ID NO: 127100 - protein, 162 aa, Triticum aestivum
  Clone ID: PAT_TA_21518.pep
MDWAAAAYTAAALLCAAAATVITLGHIYRHLLHYAEPIFQRFIVRIIFMVPVYAVMSFISLILPDNAIYFTSIREIYDAWVIYNFFSLCLAWVGGPGAVVVSLNGRTLKPSWFLMTCCFPAIPLDGRFIRRCKQGCFQLGYSYAILGWLLTFTPFERVIDKN

SEQ ID NO: 127101 - protein, 126 aa, Triticum aestivum
  unsure (1)..(126): unsure at all Xaa locations
  Clone ID: PAT_TA_21519.pep
GNCTSLSTIALYDNNLVGPIPATIVKITNLQKLYLYRNSLNGTIPSDIGNLSLAKEIDFSENFLTGGIPKELADIPGLNLLYLFXNQLTGPIPTELCGLKNLSKLDLSINSLNGTIQVGFQVHEEI

SEQ ID NO: 127102 - protein, 112 aa, Triticum aestivum
  Clone ID: PAT_TA_21520.pep
FPWQEPFAPYLLEVLYEDDDMVALNKPSGLQVLPKGLFQQRTVLAQLQLKDWKMASSCRFKRKDVQSHPVPVHRLGRGTSGLLLCAKTKVAKVRLASYFAERAKNAAKKRVK

SEQ ID NO: 127103 - protein, 73 aa, Triticum aestivum
  Clone ID: PAT_TA_21521.pep
MDGYLNYLSLEYDSVWDTKPAWCQPWTILLTGTVAVACSWVLIHSAVITGVSFFCNMCMGTYFFTPILRHTPI

SEQ ID NO: 127104 - protein, 121 aa, Triticum aestivum
  unsure (1)..(121): unsure at all Xaa locations
  Clone ID: PAT_TA_21522.pep
FSYASYEAMNFDPSSLVYSDVIRRVLAGFSPSDFSVAITIFGGRGFAKSWAKGADIDSYMCGDPVEQELPXGGLLMYQELYCCSFLALYRRGRPLQDGWLGAAMEWRWQNDEMCIWAAGIR

SEQ ID NO: 127105 - protein, 163 aa, Triticum aestivum
  unsure (1)..(163): unsure at all Xaa locations
  Clone ID: PAT_TA_21523.pep
LRQLKSLRLLNVKGIYCGRISESLVQMRHLSLLSVNASDGNEVLLLNVLLPSLQKLRLRGRLAEGALDESPLFQAVGGQNLYELVLSWSQLTKDPXPSLSRLSSLTRLHFTXRAYTGEHLSFLTGWVPKLKXLSLTDLPNLXTLEIQQGAMGPWNIILIRPTT

SEQ ID NO: 127106 - protein, 79 aa, Triticum aestivum
  unsure (1)..(79): unsure at all Xaa locations
  Clone ID: PAT_TA_21524.pep
RPRPPPRRPRPRLPLPTXSSPPMPTEGPAPXPPRRLPQPPAPPSPAPPPPPSGSPPPQPWPPPPPPSTERAGDLRRPLL

SEQ ID NO: 127107 - protein, 194 aa, Triticum aestivum
  Clone ID: PAT_TA_21525.pep
MGGSRRKFKRTRTKVRVGLPRKKPREFKPAFDLPEALAAAAAAEAGGHVPSWDAEGSVVKNYSAFGVVANPNLLGAHSRGTRGLVQSASLQAPDVDALRAPVDEFGPVDTGSDLECDDLKSALGKKRRDGKSAPLEPLTKIQRLCIGRLIEKYGDNYKAMFMDTKLNSMQHSVGTLKKLCERYHVGGKTILYPM

SEQ ID NO: 127108 - protein, 131 aa, Triticum aestivum
  Clone ID: PAT_TA_21526.pep
MDEKAAKMEKLSSAAAFVEGGVQDACDDACSICLEAFCDSDPSTVTSCKHDFHLQCILEWCQRSSQCPMCWQAISMKDPLSQELLEAVEQEKNVQADRSRTTAVFSHPMLGHFEVPVDTDDAELEERLVQH

SEQ ID NO: 127109 - protein, 360 aa, Triticum aestivum
  unsure (1)..(360): unsure at all Xaa locations
  Clone ID: PAT_TA_21527.pep
MDEKAAKMEKLSSAAAFVEGGVQDACDDACSICLEAFCDSDPSTVTSCKHDFPLSTIRPPTRPXDQLYICSQVHLNSXNYSQELLEAVEQEKNVQADRSHTTAVFRHPMLGHFEVPVDTDDAELEERLMQHLAAAAVTRRSHRHGRREGHRGRSGPHGRTQIVVFSTTETTSSDPISSDSPQVGDSEYSPAIISAPVDAMEEASANILVHNNTSSNCPVGSNDRISGDEASPINQDGAGPSDPQSFSNTLKTRLQSVSVKYKDSITKNTRGWKERWLSRSDTISSLGSDVRREVNAGIAAVSRMMERLETRDGSGSGPSSASSDNVSSATNNQGAASSNFCASVNGASSSATCASRSGSQ

SEQ ID NO: 127110 - protein, 90 aa, Triticum aestivum
  Clone ID: PAT_TA_21528.pep
GKPPVVVVPEPETPSKPVTPGKPETPGKPETPGKPETPAKPETPETPAKPETPAKPETPSKPEVPVVTAGAAQKTFAGVAAAIAGLAFVL

SEQ ID NO: 127111 - protein, 112 aa, Triticum aestivum
  unsure (1)..(112): unsure at all Xaa locations
  Clone ID: PAT_TA_21529.pep
GALDGTHVDVRVSALKQGRYRNRKQDVTXTNVLGVCDRNMEFLYVLAGWEGSASDSRVLRDAMSRQDAFRVPHGKYYLVDAGYTNGPGFFAPYRSVRYHLKEWAANGNNPQT

SEQ ID NO: 127112 - protein, 85 aa, Triticum aestivum
  unsure (1)..(85): unsure at all Xaa locations
  Clone ID: PAT_TA_21530.pep
WXFEEXXAFXLPXWXGIXQAXSWXXGFPXEXLKEAIDGVNDSFWGNWYRAPXGVFFNFRRSNNXFVXICLGFPNVYLLXRKRWMA

SEQ ID NO: 127113 - protein, 132 aa, Triticum aestivum
  unsure (1)..(132): unsure at all Xaa locations
  Clone ID: PAT_TA_21531.pep
GGXRLGXGLXXNPSRVNLRKHHLHFGNPFPYVSRXHIKLHVXHSHGGSKRTVVLXXLFRGKRLLQAVTNHICYWFHCHWDCVSLSSGLLVFVSFMMDPRRPRQRTADIGSRTREADPPGDREPQEDGGSHGA

SEQ ID NO: 127114 - protein, 88 aa, Triticum aestivum
  unsure (1)..(88): unsure at all Xaa locations
  Clone ID: PAT_TA_21532.pep
GGWAGAPLGGIFLMVSSKFMVPRCCCYAQLAGXHYGMPLGMGSHGGHMGHAHGVHGQAPLGQQQQADIYLKALLFMIGFXVIASLIAF

SEQ ID NO: 127115 - protein, 146 aa, Triticum aestivum
  unsure (1)..(146): unsure at all Xaa locations
  Clone ID: PAT_TA_21533.pep
PTAAAVSSSSSQRRLSVFRSSLPRHALGTQATAAALRLGLSATVGQSQTRRRRQRLPLPNLANRLAPSPPVLRPTAGDPACALPAPLPPPVGRRRRSTPAAALRAACDRRAAGIQLLLLHLRRLPDLVTLSPKRSVTRPLXAETCA

SEQ ID NO: 127116 - protein, 166 aa, Triticum aestivum
  unsure (1)..(166): unsure at all Xaa locations
  Clone ID: PAT_TA_21534.pep
KVDFREGPALGNLDELLADEANLGAFDFAFVDADKPNYVNYHEQLLRLGARSAAPSVLRQHALGAGPLAMPPETPXSDIDRRFSAAIKDLNVRLSAXDERVEVCQLPIADGVPFPPPPGRGIIAQPWHACPGACPFPSPLSSVRLMVHDASISFPSFVGFFSTDWN

SEQ ID NO: 127117 - protein, 128 aa, Triticum aestivum
  Clone ID: PAT_TA_21535.pep
SFSATLACLSGLAFPPCFDMAYGAGGEAGGRGRETLSWSRDDGGGRLGGERRTVFFFFFFFFSILEFRSSQPSPRACLGLQLLQGLLLIFLLLEVCQVILVVVLLGDLGLLERLGLPSLLRHGGRGRR

SEQ ID NO: 127118 - protein, 146 aa, Triticum aestivum
  Clone ID: PAT_TA_21536.pep
EAQENIADLTSRTTVERNASAVLEPRPAARAARALPRSSRLQLGFSPPPSRLTSAPYAMSKQGGKAKPTKVLPPSSRLSPPSVLPPSSRLQLGFLAPALPPHRRPRPPCRSKEGRPSRSSRPRSPRRTTTRMTWHTSRRRKMSKRP

SEQ ID NO: 127119 - protein, 108 aa, Triticum aestivum
  Clone ID: PAT_TA_21537.pep
EHTIPDTTVKDGTQTVEQNVSYKSTGGFVSSKFPNSSHFTHSSEEVKAYFTTHLAKHGGQAYPRKSMCGGVNLSLAVLHQGPKQDDTQSWAEPELAAAAAVLSVIRGQ

SEQ ID NO: 127120 - protein, 162 aa, Triticum aestivum
  unsure (1)..(162): unsure at all Xaa locations
  Clone ID: PAT_TA_21538.pep
MAFRLSNNLIGVLNFVTFLLSVPILGXGIWLGHRADGTECERYLSAPVIALGAFLLAVSLGGPLGARCRVYSLLRRPRLARSSSSAPLRRCLLAPGLPARPPAERLGPGSRSSPAPLQPGRCAPDTCAARLRGPDGPSDSCRRPDADGQRACKCNLRRCGQR

SEQ ID NO: 127121 - protein, 81 aa, Triticum aestivum
  Clone ID: PAT_TA_21539.pep
GSGVRLSRSVRGQLAAAERLRSVPFDMDVDVPVRLQLGVVRTWAVPLRARCTVAVDRLAADARVVSNSCDVKVRLLSWWRN

SEQ ID NO: 127122 - protein, 125 aa, Triticum aestivum
  Clone ID: PAT_TA_21540.pep
TSAAWEKKVRASARIRRSGGHSVLVTGAAGFVGCHAAAALRRRGDGVLGLDNFNDYYDTALKRGRAALLARSGVYVVHGDIADAELLAKLFDVVPFTHVLHLAAQAGVRHALVDPMSNARPTCRL

SEQ ID NO: 127123 - protein, 147 aa, Triticum aestivum
  unsure (1)..(147): unsure at all Xaa locations
  Clone ID: PAT_TA_21541.pep
MPVPLAPYPAPPAPFTPPNGAQXSQLVCTGCRNLLMYPAGATSVCCAVXCSTVTAVPAPKNXEMAQLSXPEDPHLLNFIRRATXLHVPCCHTVNWXWDNQSPNXNCGNAASAQLSIAAPPLMPVSICYSVGLTGENKTNTELKFLNF

SEQ ID NO: 127124 - protein, 191 aa, Triticum aestivum
  unsure (1)..(191): unsure at all Xaa locations
  Clone ID: PAT_TA_21542.pep
MLGVARRRLGSGCVLAQLAQALRPAAAPARTYSAAAKEITVREALNTALDEEMSADPSVFLMGXEEVGEYQGAYKISKGLLDKYGPRXGLDTPXTEAGFTGXIGVGAAYNGLRPIVEFMTFNFSMQAIDHIINQAAXSNYMSAGQIXVPNVFKGPNGLLLEWCQHSHAINLDQCPGLSPHPRMPVTHRIVV

SEQ ID NO: 127125 - protein, 168 aa, Triticum aestivum
  unsure (1)..(168): unsure at all Xaa locations
  Clone ID: PAT_TA_21543.pep
IIPQDPTLFEGTIRMNLDPLEECTDQEIWEALEKCQLGEVIRSKEEKLDSPVLENGDNWSVGQRQLIALGRALLKQAKILXVLDEATASVDTATDNLIQKIIRSEFKDCTVCTIAHRIPTVIDSDLVXLALSDGKSQESDTPXELLEDKHLCSIQLSIRYPHAGPSWS

SEQ ID NO: 127126 - protein, 132 aa, Triticum aestivum
  unsure (1)..(132): unsure at all Xaa locations
  Clone ID: PAT_TA_21544.pep
CLAANPIYVRPVARGNGHWSLLLALLACTCLQVLQPFAILPGYQVSVPNSPYXESYYNSLAVVLQRXDWENPGVTQLNRLAAHPPFASWRNNEXARTDRPFQQLRXLNGEWRSNFKGIGTTDLIGGDFFPPL

SEQ ID NO: 127127 - protein, 210 aa, Triticum aestivum
  unsure (1)..(210): unsure at all Xaa locations
  Clone ID: PAT_TA_21545.pep
TGSTAKRTSMTQAKTKKHRSRYSLFPSNTPETVVINFRTTESKFQNQSDTTADALCKKKNSGLPPRMHMLDXFPSHRMVVSGDHARWTTLGPCLDARLRPPKYPCPPSXVSPADAGWIPPVRQPQFKGVDSGAPWRPFGRFFPRPTXXFPCLLPTVIPPXYSYPGPXNGXIGGPGXQXLMGRSGKKSHRVXQXRXXPIXYPQALXSTNRF

SEQ ID NO: 127128 - protein, 87 aa, Triticum aestivum
  Clone ID: PAT_TA_21546.pep
YMHLCVEDWKWWWKAFFASGSVAFYVFLYSINYLVFDLRSLSGPVSATLYLGYSLIMALAIMLSTGAIGFLLSFYFVHYLFSSVKID

SEQ ID NO: 127129 - protein, 154 aa, Triticum aestivum
  Clone ID: PAT_TA_21547.pep
GILVLTASTAAAGGRERGAGSGGGRDVRGAAAGGAANAGRRGVREPGLAGPRAGRAAVGGAVREGVGSPASASRNSCSAPSCSLSAASAACTPSPSGPDGGFGVGCGNWHGVRTPGQGRRRGAPWTDDEHRLFLLGLKTYGKGDWRNISRNFVR

SEQ ID NO: 127130 - protein, 87 aa, Triticum aestivum
  Clone ID: PAT_TA_21548.pep
FSSFSLLLRRECCSFSNGEFLKAGLQELEQWCSRTTEEYAGTSWDELQHIRQAVGFLVLHQKSHKTLEEITDELCPVSPEQDKVIDA

SEQ ID NO: 127131 - protein, 183 aa, Triticum aestivum
  unsure (1)..(183): unsure at all Xaa locations
  Clone ID: PAT_TA_21549.pep
SLEDNDYGIVTIKNGKVTTEKEFDLFKSALSKYPMPTGTGGAAKTSHGVACPTSESVWAGRSQLPPXMPSEAEKYMKDGAGKGPGIKRQGIPLRQLTAVPPLPALPWVLHFQQVRLCLDDDDDSGAATLVPVPLYSPAAASLNLFGPLRVMEAASLNGSLVLGMPVANYIRPSWFIQDKFGKT

SEQ ID NO: 127132 - protein, 205 aa, Triticum aestivum
  Clone ID: PAT_TA_21550.pep
PRVRPRVRTGLVMCTGADLVRIFMDENCWSETFPDIVASVSADNIGHGCICQGGVILMKAGLRVLSPGVSSCDVKFVRQCQMIEQGVWAVVDVSLDANGTSELRAWNTGLPGACRVLPSGCLIKDMNNGYCKVAMIVNAEYDKGFMRSPLHPLLSSGHTFSARRWLTSLQRRCEFLAQRLSPAYGISRAGGAITPEGRNNVLELA

SEQ ID NO: 127133 - protein, 162 aa, Triticum aestivum
  Clone ID: PAT_TA_21551.pep
VCPMGRLRFGAESAGRWSNPRRVEQCSRGEVKGEGGQHWAPLNASPREKMLLPRALHGSESNNILARGHRAQRIEGEQSLRSQQPLWPRRGVGIDFPTKETSVGSWLGSTGGMCTAAQYSEVEGVILDLNSSYWGGWVEPMVLRVKSHNILTKLPGVASGVL

SEQ ID NO: 127134 - protein, 149 aa, Triticum aestivum
  unsure (1)..(149): unsure at all Xaa locations
  Clone ID: PAT_TA_21552.pep
CYRDIITLLQDKASRITHQCSERPLGDESDIPFIRRNLGIVVTRHRLLALHGFVVQHRGCRQIDQLQRTEQKSIPSEHAQARRHAPPRGRASTPAPRCLDGRPHGRRFXSDGKTWRYQLIACXXPLPTGVYQXXTMPPXFXLKGRTPXA

SEQ ID NO: 127135 - protein, 172 aa, Triticum aestivum
  unsure (1)..(172): unsure at all Xaa locations
  Clone ID: PAT_TA_21553.pep
MAKRPSSKRSFRLPFMCGQSDVASPRGAAVKRPSSSSSSSLGRGSRSGSSSASSSSSRHGELQRIFQHFDRDNDGKISGAELRAFFXSMGDDMPPSYGDGGYMLGLRRFLALMEKEGKRRTAKGSLFNPIADARLKGVATPSRCKHDSATKRAHSRFKDILSATGFLNLSDQ

SEQ ID NO: 127136 - protein, 514 aa, Triticum aestivum
  unsure (1)..(514): unsure at all Xaa locations
  Clone ID: PAT_TA_21554.pep
MMLVVAVLGMQMLILRGSGGHMWDTLAADLSLVMNEVKDFDDLILVEDSNNPGMKRGYALLEFSTRPEAMDAFRRLQKRDVVFGVDRTAKVSFADSYPEVDDEMMAQVKTAFLDGLPPSWEEDRVKKYLKKYGAIEKVELARNMPAAKRKHVWWINLHTDGNSGGCVDVPACLLNGSRASSATLIARXSRPVQRPPRMKHGLRGNFRIGQSAPRGGRFPYTRPPPRRPLPRLVRPDTRLPPIRRPPLKRPIDIRDRRPVMSIPDRVRRLPPPERSYDRRPPAPVYPKRSPRREYGRRDEPLPPRSRATFADYSRPVPVDRRHTYRDDYSPRESAYSDLAPRSAPRFSDRRAYADDGYVEKIDRPLPTYREGRGRDYDTISGSKRSYVEMDDVPPRYHDISVRQPKARLDYDVGGSSARYADAYTERLGRSHVGYSSSRSVAGHDPVYSSSRHGLSYGGSASTGDAGGNYSSNYSADYMPRGSDVGGSSYSSHYSGRNTGSSSGYFGGSGSSSYY

SEQ ID NO: 127137 - protein, 297 aa, Triticum aestivum
  Clone ID: PAT_TA_21555.pep
FVFTSSPEYKYPIGSTNARVIFSVDIQQVSSLISNLQEQEAILKQCIEQLESVDAARITLISNLKEALSEEEKKSELLRNQLQVGRAEAEHAAQLRQRFGGAHATNGAWSSSSTLMTTIPSEQTAAMMQNAAISPITPQFQPPHPAIPLSATASAADDEPKKTAAAMADKLASLASPEQVLSSILASLAAEQAASMNGGPPSVELSEGPPGFQIPKRPRIENPTQTGDMGAPPFFGQLLQAQQNGAAPTSLGGMQSSMQANQALGAFAPLPPLPPMLPPLLQQFSQNGGGMFGMGPF

SEQ ID NO: 127138 - protein, 180 aa, Triticum aestivum
  unsure (1)..(180): unsure at all Xaa locations
  Clone ID: PAT_TA_21556.pep
APTPMASAASSAAAAGKSLFQGLRRFLKKPWEITGPCASPEYRSALPGALEYRVKCPATVRDDRDKAIVPTSDPETVYDIKYFTRDRRRSRPPVRRTLLRKPDLERYMATKQFDPTKDXPVPYVNTPVEEDDNTVGGGYQNVQGTCRLLGTSGCPVCCAHSSAYFFPFIPLSFRVKYVGI

SEQ ID NO: 127139 - protein, 161 aa, Triticum aestivum
  unsure (1)..(161): unsure at all Xaa locations
  Clone ID: PAT_TA_21557.pep
MAAGLQVFGQPASTDVSRVLTCLFEKKLEFDLVRIDTFKTHHKLPEFIRLRDPNGQVTLKHGDKTLVDSRDICRYVCTQFPNDGNKSLYGSGALKRASIEQWLQAEAQNFGPPSSALVFXLGFVPHLTHLGVRQXPAVIPENEDXLNQVLDVYDEIPPRGG

SEQ ID NO: 127140 - protein, 51 aa, Triticum aestivum
  Clone ID: PAT_TA_21558.pep
GLLFFPLSARFGCEHNAFAKFYLVRHPSTFQILSCTSSFNVSAARGFPSDR

SEQ ID NO: 127141 - protein, 200 aa, Triticum aestivum
  Clone ID: PAT_TA_21559.pep
MLSWLRCFPHDGTVMDEERKPRPGRSATFRKKHCPDAAPSRKRFIRSGTSLTASSSARASFGRHSVDVPNYNHSIVSARSFTFPELAAATDCFSHANLIGEGGFGRVYRGLIGSLAVAVKQLDRTGFQGDHEFLVEVLVLSSLLTHPNLVGLLGYCADGNQRLLVYQLMPLGSLENHLFLPRVPADAAQRPPPPVLPWRT

SEQ ID NO: 127142 - protein, 115 aa, Triticum aestivum
  unsure (1)..(115): unsure at all Xaa locations
  Clone ID: PAT_TA_21560.pep
CLIEWGYPYTCIDPSFPVFISPMLGGPRPESVVETFEKLKKXLEVYEARLTKCKYLVGDSSASPDLNHVSVTLCLFATPYASVLGRLPACEAWWSGLDGEPSVXQKVAALMKPSA

SEQ ID NO: 127143 - protein, 152 aa, Triticum aestivum
  unsure (1)..(152): unsure at all Xaa locations
  Clone ID: PAT_TA_21561.pep
MDAAGARPSAPSAAAAAVAGASVADEPRDARVVRELLRSMGLGEGEYEPRVVHQFLDLAYRYVGDVLGDAQVYADHAGKAQIDADDVRLXAIHAKVNFSFSQPPPREVLLELXRSRNRMPLPKSIAPPGSIPXPPEQDTCWPTTNPAPFNRN

SEQ ID NO: 127144 - protein, 154 aa, Triticum aestivum
  unsure (1)..(154): unsure at all Xaa locations
  Clone ID: PAT_TA_21562.pep
RAPFALFDPSKKTAAEMVYYALLVGAELDGLTNLQPSGGCDDPSFPYYLKLKCENCGEVTAKSTYVTLXEQVDLPKGHGTAHLXVQKCKLCGRDGXQLVMIPGSRGRHFTIEQEPRKXEKTCLMGVXDCRGYEPVEFLLGAGWKXDPVHGPFGN

SEQ ID NO: 127145 - protein, 135 aa, Triticum aestivum
  unsure (1)..(135): unsure at all Xaa locations
  Clone ID: PAT_TA_21563.pep
QSSFLSPAGLVERRARRRRMGRGRGVSYGGGQSSLSYLFGGGGGDEAAAAPAKPAAAAPAPAPVPAAADGEKLKGIPAGVRGNQSQTNNYFRXAHGQNCGNFLTXDRPXTNVXAAXGRRSSPGYPPPRTPGNKVM

SEQ ID NO: 127146 - protein, 191 aa, Triticum aestivum
  unsure (1)..(191): unsure at all Xaa locations
  Clone ID: PAT_TA_21564.pep
MAPSGSNPLEPVFQTVAAFSRRLLIAPDTAPDDHRLRPLLSLSLSPPAPPPPAPPPPPEVLKQKDAKVAPLTKEEVGRATWMLLHTIAAQFPDEPTRQQKRDANELMALLSRIYPCKECADHFKEVLKANPVQAGSQAEFSQWLCYVHNVVNRSLGKTIFPCQRVNARWGKLDCPDRXCDLGGSNDIMPNR

SEQ ID NO: 127147 - protein, 160 aa, Triticum aestivum
  Clone ID: PAT_TA_21565.pep
MGSEGSAPVVVPRNFRLLEELERGEKGIGDGTVSYGMDDADDIYMRSWTGTIIGPPNTVHEGRIYQLKLFCDTDYPDKPPTVRFQARVNMTCVNQETGMVDPRRFPMLGNWKREHTMEDILISLKKEMSTPQNRRLHQPHEGTDDQRVEQKGLAARCVVM

SEQ ID NO: 127148 - protein, 157 aa, Triticum aestivum
  unsure (1)..(157): unsure at all Xaa locations
  Clone ID: PAT_TA_21566.pep
DEVTSITVTGHSLGASLATLTAIDLVANDVNVPPNSKQPPCPVTAILLACPRVGNPTFKSAFDSFHLLRALHVANAKDLVPQNPPSVLLMWYVDCATATIRNLTRTGHPTCFTKYRPTTSSELYLHGAQGVXWRQGGXFKLMVPRQLALGEQDYPPA

SEQ ID NO: 127149 - protein, 159 aa, Triticum aestivum
  unsure (1)..(159): unsure at all Xaa locations
  Clone ID: PAT_TA_21567.pep
LAFLLYPSAPAARVADIRLDRFRVNPPPFPALDFNLALSLRVRNPGFLLPLRYRAVSAAVSYRGRLLGSRXLRAPDXGELAARGFTYASSEVWXDAGRVLDDVIELIGDIAAGSVPLEIVTEVVGAVRLFHFNIPVKGLMSCSVNVSPGTQSIISQDCY

SEQ ID NO: 127150 - protein, 141 aa, Triticum aestivum
  unsure (1)..(141): unsure at all Xaa locations
  Clone ID: PAT_TA_21568.pep
RSRPFRISPSRPVRPFSDWPPPASPSSSTKAHRKRASEPPRPXPPPPSRPHPTPPXPPAWGARAPPPATTPSPPRAPPPPAPFAGGSRGSGLGGFQSPLPHNRIQNPVLDSSYLPFQELPLLASRTSIFDPFDFDSSLPID

SEQ ID NO: 127151 - protein, 134 aa, Triticum aestivum
  unsure (1)..(134): unsure at all Xaa locations
  Clone ID: PAT_TA_21569.pep
DDGSCRRWSPRLHHHAPSSPSPSPWPSLHSRRFLRAAPPPRRHRAQHTFSGTTGGQNPYASCADLPRLGATLHYNYTAATNTVAVAFRAPQARATTVXFAWGINPSGRPGMARPSVVASSVXXSSXLPTLLVPR

SEQ ID NO: 127152 - protein, 133 aa, Triticum aestivum
  unsure (1)..(133): unsure at all Xaa locations
  Clone ID: PAT_TA_21570.pep
MAMAALRREGRRLILSSTVPNPSLGGRXSAVTRSSAVSQPEMAPLGARSISTQILRNRMKSVKXISKKITKAMKMVAASKLPAVQXRTENSRXGLWQPFTALLGDAPNVDVKKNVIVALXSDXGPVVGINPHQ

SEQ ID NO: 127153 - protein, 84 aa, Triticum aestivum
  Clone ID: PAT_TA_21571.pep
CSYASCSDGRMGEVMRPESVPRTQPMRHPASMCSFCGGIVYCRIWRLHYGLKITVHRILKMQCRVSQGTSASADSALRLFIAWC

SEQ ID NO: 127154 - protein, 202 aa, Triticum aestivum
  unsure (1)..(202): unsure at all Xaa locations
  Clone ID: PAT_TA_21572.pep
PDRDSLAHSSCLKVLSVSFVFSSCPASSPVTHSVDGLTHSRSSTGRVHADGSRAPVPHRDLPVGPGGRGARPSARPAAAEAWMKNGHEDVAGAEVQGEAYLHLQPVPRRRGLRRAPATTAPPKEPRLCIVTSPHVRVRVLGPLSVSVCVLXSANNTVAKNKNRIWANNHLDCKGTRVLCQRLXHXKIHXXELVSHLVQXKSP

SEQ ID NO: 127155 - protein, 172 aa, Triticum aestivum
  unsure (1)..(172): unsure at all Xaa locations
  Clone ID: PAT_TA_21573.pep
APYLSPSFHLLPPPSPWALPTSPHPSTSSRAGDPGGRAATGLSGVDWQLRPKMQRSASGAGTSKSWVLPLGCSDARTSTTASCNPSCVKCWEPAISDATTDYAGSWEQTCYFFFATSTSLXDFAPYDFCXXQMRLARRRVFLLEQLHVLXELGKFATXILSRYDGRLRTKKK

SEQ ID NO: 127156 - protein, 130 aa, Triticum aestivum
  unsure (1)..(130): unsure at all Xaa locations
  Clone ID: PAT_TA_21574.pep
MATTAMALSPSSFAGKAVKDLPSSALFGEARVTMRKTAAKXAKPVSSGSPWYGPDRVLYLRPLSGRPPEYXTGXFPGDYGWDTAGCSADPRDFRQRTGTGGIHXRWXMLGVSVLFPELLARNGSIRQAFG

SEQ ID NO: 127157 - protein, 136 aa, Triticum aestivum
  Clone ID: PAT_TA_21575.pep
FLLIYYGHYGVTATTRTKHLSFTSYSPSMATPRTRWKKKGKRVEAKLTREWKRRENNRAESSSLPQGMAPHAPASHPPHKKRKKEKKTHRHGFKPPCPSSTRILPTLPPIATYPSPPAKCPCRSALLPSTLACAPA

SEQ ID NO: 127158 - protein, 71 aa, Triticum aestivum
  Clone ID: PAT_TA_21576.pep
FFFFEIYNASVPAGLYNKDIFLWEETKCVFSLYKMQVQKISTTQVGHNLYCYIFVIYDVKWIKYGLDVEWK

SEQ ID NO: 127159 - protein, 154 aa, Triticum aestivum
  unsure (1)..(154): unsure at all Xaa locations
  Clone ID: PAT_TA_21577.pep
MEKYTKALASLLTMLVLAPLLAMATDPDPLQDFCVADLNGKLSVNGYPCQPPSSAGDQFLFSTKIATGGDPXANPNGSNVTELDVSEWPXVNTLGVSMNRVDFAXPGGTNPPHVHPRATEVRARHPRRLLVGSSGSLDPGTLLPKRPPPGQPVA

SEQ ID NO: 127160 - protein, 392 aa, Triticum aestivum
  unsure (1)..(392): unsure at all Xaa locations
  Clone ID: PAT_TA_21578.pep
MRPPPSPPLLPLLLLLVLLPSPPAVAAAAGPTSLEALRAAAGRRAASPATQERAAAGVLRRLLPSHALSFRFQIDPKGGVCGDSSCFRISNVDGSSKGGAEILIQGNTAVELASGLHWYLKYWCGVHISWDKTGGAQLASVPSPGSLPRVKGTGVKVERPVPWNYYQNVVTSSYSFVWWDWRRWEKEIDWMALQGINLPLAFTGQEAVWQKVFKSFNVTDRDLDDFFGGPAFLAWARMGNLHAWGGPLSQNWLDQQLALQKKILSRMIELGMVPVLPSFSGNVPVAFKKLFPSASITRLGEWNTVDGNPRWCCTYILDPSDALFIDVGQAFIKQQMKEYGDITSIYNCDTFNENTPPTNEPAYISSLGSAIYQAMSRGNKDAVWLMXGWLFY

SEQ ID NO: 127161 - protein, 111 aa, Triticum aestivum
  unsure (1)..(111): unsure at all Xaa locations
  Clone ID: PAT_TA_21579.pep
MEFEDRCHKVQEPKFDCLLFDLDDTLYPLSAGIAGHVKKNIEDYMVEKLGIDETKIENLGNLLYKNYXTTIAGLXGIGTLXLXEYNXFVNGRCRRXIKPDPILKQILGIRN

SEQ ID NO: 127162 - protein, 152 aa, Triticum aestivum
  unsure (1)..(152): unsure at all Xaa locations
  Clone ID: PAT_TA_21580.pep
RFHLVLFQWKFLFPGMYPNFGLIFLLMMVPPXDQKDGPWFYFISSTSLVIXSITALLFRMERRPIISFSGNFPNXNNFNGIFQFLILLCSTLCIPLSVEYIECTEMAITEFLLFVLTATLGGMFLCGANDLITIFVAPECFSLCSYLLSGYT

SEQ ID NO: 127163 - protein, 245 aa, Triticum aestivum
  unsure (1)..(245): unsure at all Xaa locations
  Clone ID: PAT_TA_21581.pep
HERATARCCSPLHSPTAAPRLHPRLRSHAAAAAPQLRFPALSFSASAVSTSSHGPSGGDAGEGEDDKGAYENYLGMSDDELMAQCDMGTFKSSGPGGQHRNKRESAVRLRHHPTGIVAQAVEDRSQHKNRSSALSRLRTLIALKVRRPINLDNYTPPVELLQILPLKSTIRSKDVGSQIGPNNPKFSPGMQALLDLLFAVEGLYQEAAKILGPSTGALSRLSYQDDXLRAAANELRXSKGLEPLR

SEQ ID NO: 127164 - protein, 295 aa, Triticum aestivum
  unsure (1)..(295): unsure at all Xaa locations
  Clone ID: PAT_TA_21582.pep
YASVNTHLGIEQSRRDDLESLGYVLMYFLRGSLPWQGLKAGTKKQKYEKISEKKVATSIEALCRGYPTEFTSYFHYCRSLRFDDKPDYSYLKRLFRDLFIREGFQFDYVFDWTILKYQAXSKLLSAPPRVAGHGAGPSGLTPPVLQNDSQSGAVEGRISGWSAMDRRRAPPPIASVGTSNKQKAPVGNDAPISKDPAISGSNFLGRSSGSSRRAAVSSSRDAVASDTFEPSRSRTTDASPGAFRRTSGAQRSPPVDSAEPQRSSSARHSSNPKNYESALKGIEGLNFDGDERAQY

SEQ ID NO: 127165 - protein, 86 aa, Triticum aestivum
  Clone ID: PAT_TA_21583.pep
FFFFGVGVFTPAVCYKPGTSARTHCGAQPGGARRRRRDRRRPDHLAWGGSDLGRKRPAYLALVSVNVAKREGREGGKKRGDLGRGG

SEQ ID NO: 127166 - protein, 186 aa, Triticum aestivum
  unsure (1)..(186): unsure at all Xaa locations
  Clone ID: PAT_TA_21584.pep
MAQKETNGSNGEHISTRPPPTPSPLRFSKFFXQANLRIPXSLGGAGFIRSAPPLDRLXMENEKHEVIVXDNFSTGSKDNXLKKWFGHPKXELIRHDSTGPLLVEVDQFYHLACPCXQLFYKHNPVXDIKTNVIGPLXMLGLSKRFGPRLLTSTPNYGDHLSTSNEATGNLPMERVCLRGHSKPIIR

SEQ ID NO: 127167 - protein, 161 aa, Triticum aestivum
  Clone ID: PAT_TA_21585.pep
NNLHNKMLLWHGSRLTNFIGILSQARGIAPPEAPVTGYMFGKGLYFADLVSKSAQYCYVDRKNPTGLMLLSEVALGDMHELKKATPMDKPPRGKHSTKGLGKTVPLESEFVKWRDDIVVPCGKPVPASIRASELLYNEYIVYNTAQVKMQFLLKVRFRHKR

SEQ ID NO: 127168 - protein, 47 aa, Triticum aestivum
  Clone ID: PAT_TA_21586.pep
FFFWAIKFLISLLLLLENSTSRYSFDLANYMCNIRPSRLHKAYKFSG

SEQ ID NO: 127169 - protein, 113 aa, Triticum aestivum
  unsure (1)..(113): unsure at all Xaa locations
  Clone ID: PAT_TA_21587.pep
MATRIQFENNCEIGVFSKLTNAYCLXVAIGGSXENFYSAFEAELADAIPVVKTSIGWALRIIRRLCVGNKNGLLLPHTTXTDQELQHPRNCLPDQVGGQRIDERFPALXNALQ

SEQ ID NO: 127170 - protein, 229 aa, Triticum aestivum
  unsure (1)..(229): unsure at all Xaa locations
  Clone ID: PAT_TA_21588.pep
FDSHSHSPFPLSGSHSPPTGYPTHHTQTATPHLPRPPVHVLLLPMSPPLDLDYIGLSPAAAAAAAHDDLKGTELRLGLPGSGSPDRRVVAATATTLXLLPAKGAKRGFSDEAPTPSPGAASGKGKKVAEEEDDKKVAGXPQPVAKAQVVGWXPIRSYRKNTMSTPAEGNKEDAEASRQGFCTQVXMDGAPYSGRLTQDYRTPGLSCPGNVMGSFGGGFLYQGVLLKMNC

SEQ ID NO: 127171 - protein, 193 aa, Triticum aestivum
  unsure (1)..(193): unsure at all Xaa locations
  Clone ID: PAT_TA_21589.pep
MQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGIVTERDYLRKIIVQGRSSKSTKVGDIMTEQAELLPVNPDTVVRRAGQPRTVPRARHTPASVGARRLRPASIGDVXXPVVAEHKED

SEQ ID NO: 127172 - protein, 144 aa, Triticum aestivum
  unsure (1)..(144): unsure at all Xaa locations
  Clone ID: PAT_TA_21590.pep
MAPKADKKPAAKKPAEEPATEKAEKAPAGKKPKAEKRLPAGKSAGKEGGEGKKGKKKAKKSVETYKIYIFKVLKQVHPDIRISSKAMSIMNSFINDIFQKLAXESAKLARYNKKPRVSAREISLPPPPPPGELPCPPSPLAIYL

SEQ ID NO: 127173 - protein, 87 aa, Triticum aestivum
  Clone ID: PAT_TA_21591.pep
FLLIIMVIPMEINLTIIIGNTSALESNIKEFINTPKVFNTSIEEKLNKIDDLSRSVDRIAHDVENLKMKIFVPKVDESIKSLYVSME

SEQ ID NO: 127174 - protein, 392 aa, Triticum aestivum
  Clone ID: PAT_TA_21592.pep
MGIAQAAAPLRLHLGCSGAAPPRPTSLRVGFGFGSHARRKGGRRRSPPRAASSLHPSSNTRAHDHDPALKPPAPAGDVAGRDLNGAADHAPQQRRRAASDLEEEAWALLRESVVSYCGSPVGTIAACDPNDSSPLNYDQVFIRDFVPSGIAFLLKGEYDIVRNFILHTLQLQSWEKTMDCHSPGQGLMPASFKVRVVPLEGDEEGATEEVLDPDFGEAAIGRVAPVDSGLWWIILLRAYGKCSGDLSFHERIDVQTGIKLILKLCLADGFDMFPTLLVTDGSCMMDRRMGIHGHPLEIQSLFYSALLCAREMLTPEDGSADLIRALNNRLMALSFHIREYYWLDKRKLNEIYRYKTEEYSYDAVNKFNIYPDQIPPWLVEWIPSGGGYLIGN

SEQ ID NO: 127175 - protein, 72 aa, Triticum aestivum
  unsure (1)..(72): unsure at all Xaa locations
  Clone ID: PAT_TA_21593.pep
KILQYARECGSVNVWTCPFVPXPFSRACKHVWHSSLSGXLIGLREDPEQQMSIKKRNIYMTSISNHRYTQTE

SEQ ID NO: 127176 - protein, 113 aa, Triticum aestivum
  unsure (1)..(113): unsure at all Xaa locations
  Clone ID: PAT_TA_21594.pep
MATLKDAAARKSILATLRLVVPAXGAARPAPPVGPALXFYRLNLMAFAMDFNAKTQKYKQESPMQXTLTAYKDTLRFAAIASVPGPQEGARAETATSPTTELPPHLRKFTDSN

SEQ ID NO: 127177 - protein, 310 aa, Triticum aestivum
  unsure (1)..(310): unsure at all Xaa locations
  Clone ID: PAT_TA_21595.pep
MVPAGDHLLLFALASLGGAAAAGAGEGFCSAEPSNDCSQSPPLYSKVTSPTLAPVHLQDLPGFTRSVYKKDHALITPESHVFSPLPDWTNTLGAYLISPALGAHFTMYLANMQDGSKSALPPKDVERLIFVVQGSIALSVESGTTHSLLVDSYAYLPANMKHSVISDKPSTLVIFERRYTAVGDYHADLVVGSTDKQPLLETPGEVFELRKLLPTSLPYDFNIHIMDFQPGEYLNVKEVHYNQHGLLLLEGQGIYRLGNSXIYRLGNSWYPVQAGDTIWMAPFVPQWYAALGKTKSRYLLYKDVNRNPLI

SEQ ID NO: 127178 - protein, 152 aa, Triticum aestivum
  unsure (1)..(152): unsure at all Xaa locations
  Clone ID: PAT_TA_21596.pep
KRVLELLEKNYKTMQSLQTVQDAEMGEEKMSADDVALLANMVEDMSMETGYDKEDDEMEMDDADMAXEMGAASFKEKIMGILXQQGDFARKEGPKLSQVDFLYLLSLLQTKPGIHFPVIGGPTSPSIISVPSVLIALPVNFLLLLKTPSALP

SEQ ID NO: 127179 - protein, 140 aa, Triticum aestivum
  unsure (1)..(140): unsure at all Xaa locations
  Clone ID: PAT_TA_21597.pep
SDRPTRPTDHDHELPSGLPTAGPTGLRRASAGVRRATAGVPANGPGRRRGVLRPAADNHHQQASRRRRRFWERCSAAIWRLLRPPHVLPEGYTPFIVTTAKACYLADDRPYXRGCDHTXLXNNCVSLILQSCIIYTXLLX

SEQ ID NO: 127180 - protein, 72 aa, Triticum aestivum
  Clone ID: PAT_TA_21598.pep
MDDRGGGGEAERWPWWAAASAAQAAAGIALFRRGRSGAAVAMPFKAFGIASLFVGSGATAVAAGVLAAGVDR

SEQ ID NO: 127181 - protein, 192 aa, Triticum aestivum
  unsure (1)..(192): unsure at all Xaa locations
  Clone ID: PAT_TA_21599.pep
RSSTERASPSLTHLNNKHSLPPPATSSSPVQLELIRRALPQHPPTFRPIPDPRPCRDSGSSFPRGHGHXRGGGXRRRTGPSKRAGRRPPVGRRHCSTSPSASSWASSRASRLLLXPPGSPPPPPPSXPPXRPGTAPASRGRVPPRPLSPRSADRSAGHVIGTQEERQRLRCGTKSAGTRQCKALAAFGPART

SEQ ID NO: 127182 - protein, 166 aa, Triticum aestivum
  unsure (1)..(166): unsure at all Xaa locations
  Clone ID: PAT_TA_21600.pep
TPRVHATMENAAPAIAKPSLSKKPSPSVPPPERQLNALRLAPRVSTSSDPQRRRRDXPPTRMASGLQAPPAXAPTAPGLEAAVLRVIPRPAPAGSAFNDFDPSNARFGTLLAIPWFXXDDXXRGIXELPVFIRXTLSXRPLXXLKTRCPSXNLXFQDXXXYRRKGG

SEQ ID NO: 127183 - protein, 102 aa, Triticum aestivum
  unsure (1)..(102): unsure at all Xaa locations
  Clone ID: PAT_TA_21601.pep
GPLKPACNERKRKGEAXRNASIGGGEQENTNNGGRKRSLPAEREARLKRKSTEPPPQVKNLVRSTASSRAAAKAAAAAAPSSRAGGAKQQPGGGNKTRGWVR

SEQ ID NO: 127184 - protein, 82 aa, Triticum aestivum
  Clone ID: PAT_TA_21602.pep
KKRLGGDGERGICSISTFGSKSITRRCIEDCSSSSSSCSLLGRRGRRGLPWSSPTHHFLLGPLLAVPFPQQVARDDLALILC

SEQ ID NO: 127185 - protein, 131 aa, Triticum aestivum
  unsure (1)..(131): unsure at all Xaa locations
  Clone ID: PAT_TA_21603.pep
RLGHGHKSSFLGFAMTSNEYTPRLIKNLDGIKIKRIAAGMLHSACIDEKGXGRSNDAPRPSAVEEIQFPEEVACGGYHTCXVTDRGDLYSWGSNENGCLGLGGPGGRPLPGVVRCSPVLRPGSRAPSRWRH

SEQ ID NO: 127186 - protein, 228 aa, Triticum aestivum
  unsure (1)..(228): unsure at all Xaa locations
  Clone ID: PAT_TA_21604.pep
AGDRYKAGEAVRGPPGASGAENEDERFCQKCGVEFVDSRIRXRYQMGYIKLACPVTHVWYLKGLPSYIANLLDKPLKKLEGLVYGDFSFARPSTKKPTFLRLRGLFEEEIASCNHSISPFFSTPGFATFRNREIATGAGAIREQLADLDLRIIIENSLVEWKELEDEGYSGDEWEDRKRRIRKVFLIRRMQLAKHFIQTNVEPEWMVLCLLPVLPPELRPIVYRSGDK

SEQ ID NO: 127187 - protein, 159 aa, Triticum aestivum
  unsure (1)..(159): unsure at all Xaa locations
  Clone ID: PAT_TA_21605.pep
QHTSQFRFLDKAAIVAPSSGEKGATASPWRLCTVSQVEELKTVLRMFPVWVSMVLFFRGHRARCRPPSSEQGETMGQPRGGRSPCPPASLSTFRRHQASWVCIPIYDKALXPLARRATGQXAGLSQLQRWGVRPVPVPGPALRGGGPYHSNILYALMAL

SEQ ID NO: 127188 - protein, 183 aa, Triticum aestivum
  unsure (1)..(183): unsure at all Xaa locations
  Clone ID: PAT_TA_21606.pep
MLAARRLSAATSPLLLRRLSAQTHPTASSAQPPPEVTDSGPGAWAGRAVTLSLLGLTGAVAXSAVSDLSVFLSCSSQGXRRPPRTXQIVNAIGKPIMRGPWYSASIAVNHAKHSVSLHFPXVSGPQGNGLLKLKAVRLGDESWXSYVQPTEWEIRIMVPPLASSSGLTHEVRATIHCRPVRSR

SEQ ID NO: 127189 - protein, 92 aa, Triticum aestivum
  unsure (1)..(92): unsure at all Xaa locations
  Clone ID: PAT_TA_21607.pep
SFFXFXXTKSHFXIXRFFXTXTKVDGXXGKLRXGENFXKSVPXNIIGAITKQIPTGEHESSLLLTPKVLHLILNSDDADAPAEVPRTATDGA

SEQ ID NO: 127190 - protein, 132 aa, Triticum aestivum
  unsure (1)..(132): unsure at all Xaa locations
  Clone ID: PAT_TA_21608.pep
MAAARHLRSGLPLLRAHLASSESAAVAQVSRGFASQAAKPTGKEIKVQRSVWRTGNYASALFLTAXKSNALDKXESEIKAIVEASKKXPLFSQFNKGLSVPKSDKVKAIAEIFADLVFKCYKDSWLPGGNGS

SEQ ID NO: 127191 - protein, 88 aa, Triticum aestivum
  Clone ID: PAT_TA_21609.pep
FCWLRRSQNKRGRVRCISDFSSGVCVRQPATVGLVFQHLSACLREGRGVTDSREGPGHRLLHYEFLMMSYVCTLNQLCMRSHLLSPTE

SEQ ID NO: 127192 - protein, 117 aa, Triticum aestivum
  unsure (1)..(117): unsure at all Xaa locations
  Clone ID: PAT_TA_21610.pep
GGGHSFLLPDKPSRNILKPRLIFSAAQQGARRRCRAAFLGLSGLFPLFFPMTLSIITLCNRSTRRKPSLGVPDGTQSCLGVDGEIIYPGGCLVVAGVVICCETKIDTIGXLVPFGIL

SEQ ID NO: 127193 - protein, 146 aa, Triticum aestivum
  unsure (1)..(146): unsure at all Xaa locations
  Clone ID: PAT_TA_21611.pep
VRIALDVADAMAFMNGYGIAYRDLNARKILLDRQGNACLGDMGIVTPCSNVGEVTEYETSGYRWLAPEIIAGDPETVSETWXMSNVYSYGMVLWEMITXEKEAYSTYSPMQAAVRXAACRLXRPEIPKNCPPXLRSLMNKCWDIPL

SEQ ID NO: 127194 - protein, 148 aa, Triticum aestivum
  unsure (1)..(148): unsure at all Xaa locations
  Clone ID: PAT_TA_21612.pep
MGIDLVAGGRNKKTKRTAPKSDDVYLKLLVKLYRFLXVRRTKSNFNAVILKRLFMSKTNRPPISMRRLVMFMERKGEEHCCXLLGTVTDDXRVQEVPAMKXTALRSTENSKGKIVNAGGXCLTFDQLXLRAPTWRETSSLRGPRSPWN

SEQ ID NO: 127195 - protein, 147 aa, Triticum aestivum
  Clone ID: PAT_TA_21613.pep
MLAMADDTNFLLLVLLLSCSSLCFGTQADIECLKSVQQSVIDPGGVLKSWNFENDTDGYICRFTGVECWHPDENKILSLRLSNLRLQGQFPVALQNCSSLTGLDLSNNNFSGQIPQEISRGGPGCCPRPVKKSGANPNIQGKSEPTP

SEQ ID NO: 127196 - protein, 169 aa, Triticum aestivum
  unsure (1)..(169): unsure at all Xaa locations
  Clone ID: PAT_TA_21614.pep
SPTRRLDLPPASSLQQCERAAAPRPPAPPPPPRPPPPRRPRPPAAPAPXPAARPRRPRRPSRCSPATAPPPGPPVRTPPPSPRPAXPASALPRRAPPVRVVRPPAPARRRPSAVRFRSSAAPLATPPPPPGRHPRPPCPCPLCPSLNFNKKAVCRVGVITNYLTGKKKK

SEQ ID NO: 127197 - protein, 106 aa, Triticum aestivum
  unsure (1)..(106): unsure at all Xaa locations
  Clone ID: PAT_TA_21615.pep
ELQRIRSAAPDGADPEEPAGSRLRPVSMMDIQIDVTLGRARTTAAKEGGFAPCRCRRCGSAXRGSAVHQRLHPAXLLRXFKLTTPGTLDEKNQCYFSKKKEIFCPK

SEQ ID NO: 127198 - protein, 145 aa, Triticum aestivum
  unsure (1)..(145): unsure at all Xaa locations
  Clone ID: PAT_TA_21616.pep
MALALRAPRFQPLPASIPATSTAFASTARPSSSAAATTAICAAASPFTEATSSSRYRRDAWSYTAQDSSSSSSAAAAAAAAASGRRDDEIALQLPELRRLLEALRASRGKGLEREGGGGGPXGRVALVGTGPGDPELLTLKAVRA

SEQ ID NO: 127199 - protein, 67 aa, Triticum aestivum
  Clone ID: PAT_TA_21617.pep
FFFFMNPETRVILYHAVYGKKPLSVKLWNDSFFSSHARKFGSLLAYKQTRQRAGATQGNLVLLLQPA

SEQ ID NO: 127200 - protein, 154 aa, Triticum aestivum
  Clone ID: PAT_TA_21618.pep
MVAHALLTVPHATAGPRLAAPLFTPAATSPSLCRANCRSGSLTNQQQRLRHLHPAAAATKPGAIGSAAEAAAAPAEGLVRSLQGVEVFDLSGKAVRVADLWKDRKAVVAFARHFGCVLCRKRADLLAAKQEAMEAAGVSLVLIGPGTVEQAKAF

SEQ ID NO: 127201 - protein, 300 aa, Triticum aestivum
  unsure (1)..(300): unsure at all Xaa locations
  Clone ID: PAT_TA_21619.pep
STPPPLPAPRPRPTRAAVTAAQPPVGHHPNSTRHRRPPPWWRTRCSPCPPRPPPRVSPPPSSPRRRPPRAPPAPPAGPPPPPPRRHPAAAATLPRPPPSPAPAAAPPALRLGRPLRAREVSALSGKALPVADLWKDRKAVVAFARHFGCVLCRKRADLLAAKQEAMEPAGVSPVLLGPGPVEQAKAVPDQTQCNXEVYADPDYSSYKALEFANGLFSTFTPSAGLKIIXSARRRILPLYREGYRQDWELSFEKNTRTKGGWYQGGLLVAGPGIDNISYIHKDKEAGDDPEMEDVLRACCS

SEQ ID NO: 127202 - protein, 130 aa, Triticum aestivum
  unsure (1)..(130): unsure at all Xaa locations
  Clone ID: PAT_TA_21620.pep
MGEIPEPEVPKPTPEPSSWLSLRVFYLRLSRCEVDESMLDTLTITHAPLTSDTVLEVNGDRXKKHRQQHGHVSCPLRRDRVDAASREASFVSTATVRMAGAWLQGRVGSGEKLLVGIWNMCDVAEEKRRG

SEQ ID NO: 127203 - protein, 129 aa, Triticum aestivum
  unsure (1)..(129): unsure at all Xaa locations
  Clone ID: PAT_TA_21621.pep
MSGRGKGGKGLGKGGAKRHRKVLRDNIQGITKPAIRRLARRGGVKRISGLIYEETRGVLKIFLXENVIRDAVTYTEHARRXKTVTAMDVVYALKRQGRTSTASGGKLPPAPRRRCLVLLHSQLLVWGIC

SEQ ID NO: 127204 - protein, 94 aa, Triticum aestivum
  Clone ID: PAT_TA_21622.pep
VRQRGRAPDEQGGDRRQQQLVYRASVRAIIGDHGARPTWRWRGRIGVDGDADAYGGQLRRLGDQGAGHPRRAHRVGGGGARRCGGECAEGQDGA

SEQ ID NO: 127205 - protein, 154 aa, Triticum aestivum
  Clone ID: PAT_TA_21623.pep
LPPRPPPPPQREKQQCPPPPLLPPKKQQYPPPPLLPPKKQLYPPPLPLPPKKQQHHHPPPPLPTLPPKKRLASPPLLPGKREAVGHLLPVGAAVRAAAGVGSDVRSRGSAKKRSGCRGRRPRPHNPTAARGDKAPLRGRDDRHTPCYTPLSLSI

SEQ ID NO: 127206 - protein, 245 aa, Triticum aestivum
  Clone ID: PAT_TA_21624.pep
ANLLGCIVIFIVTQGFGIMEAMSTVMRHGMGGMNREADVRGRPSILSELETEFGSGPWLLFRGQLPGHLSEANSGFDVFVNGRRGVGMRRADVADYFVGPGLEDLIEQLTHNDRRGPPPASQSSIDAMPSVRITARHLTGDSHCPVCKDKFELGSEAREMPCKHLYHSDCILPWLEQHNSCPVCRYELPTQSSSGASCSRSRSTNQNDSSSSSSSSGRTSGRQRRRNPFSFLWPFRSSSSSTGSR

SEQ ID NO: 127207 - protein, 123 aa, Triticum aestivum
  unsure (1)..(123): unsure at all Xaa locations
  Clone ID: PAT_TA_21625.pep
AVRCFPTSKRCYKGNRYSEPLQGTMELSGNKCLLKFFGGSNFKWTNWTMVLQTGLCCDNIPFCLTVWPKLFARGGFPSRDLPTSRCPPKVLQPGGPLPLPHVGLVALTACLXXXRENWXPXNA

SEQ ID NO: 127208 - protein, 167 aa, Triticum aestivum
  unsure (1)..(167): unsure at all Xaa locations
  Clone ID: PAT_TA_21626.pep
MATLKVPATVPPVADDCDQLRKAFQGWGTNEALIISILGHRDAAQRRAIRRAYAEAYGDELLRSITDEISRRLPRGPWILVXTLGPKRSADAVLANEAARXVXPWNRVLIXXACTRTSPHXRDQAGLSXRVKRXFRKIXAHATGIPQVLVHYRMMAKGNGQEQIMRS

SEQ ID NO: 127209 - protein, 194 aa, Triticum aestivum
  unsure (1)..(194): unsure at all Xaa locations
  Clone ID: PAT_TA_21627.pep
IKNLDFSADCFSLITITIHCSSRAQMDRESAMQGSSGGNPGAATQEEWLYPGGWQPEQAVVDGAFLMELLEDAPVADQPPEDVDRLKPRHPVPWRLRSXGSGQPPSAVADARTAEQVPGRTPYKRAGRTNACCRTLVTSQPLRGRSAVWTLDGVPXPXGMVXALDXERHRSWSVHSQTCFTVHQPTLSKXXPVE

SEQ ID NO: 127210 - protein, 399 aa, Triticum aestivum
  unsure (1)..(399): unsure at all Xaa locations
  Clone ID: PAT_TA_21628.pep
LAPPTSPRPSPPSPASPARGPPPTSPAAPPPAPARGPTPAGSRGGPATPPARPPCPPPGTPGRRAPPGPPPPPXPLSPPAAPNPAPPQPRXQPAHRRRPPVPPGRRRQPPAPGPRAAAPRGPPPLRPPPXPPASASPPRAPPPSPPSSCPRPSAGHWNPPPPGSRPCPGSPASSAPAAPTPPPAPHPRPPPPGPATPATPRPTRLPPTAPPCSPPCTPSPPSPTXPPPARDASPPPPPPHPPPPPPPXRRPPPPTPPPPPPPPPSXPRPPAPPSPLPPSAPPPRPRAPLPRPLPPPGRAPPPRRAPSADASRRTAAPAPPRRPPPPPARTPAAPAXPGPRRPRPARGAGAPPAPRPRAASGRGPGPGGTRPRHAPPSAPTTPAPPPPRPPPTTPPPCRA

SEQ ID NO: 127211 - protein, 57 aa, Triticum aestivum
  unsure (1)..(57): unsure at all Xaa locations
  Clone ID: PAT_TA_21629.pep
WIRFLGFAVVDEWRPWYATGQVAGFTTLYANNLTFATIKXPKECLAMVDRWLSGRPL

SEQ ID NO: 127212 - protein, 230 aa, Triticum aestivum
  unsure (1)..(230): unsure at all Xaa locations
  Clone ID: PAT_TA_21630.pep
TYYASSVGDNHDEIDFEFLGNVSGQPYTFHTNIYANGVGNKEIQFKPWFDPTTGYHNYTISWSPCMIVWYVDSVPIRVFRNYQQSYGVAYPTSRPMHAYSSIWAAEDWATQGGRVKTDWSKAPFXVANYRXIHLDICDCPGGYACSTNCAAAAAPTVGRATQPRAAGAMQTCRKLPIYAMLHPVVQVNQMGLPHYDIHYIRSLSSGLRYTKKPNLKFLNIKFLLVIILKL

SEQ ID NO: 127213 - protein, 97 aa, Triticum aestivum
  Clone ID: PAT_TA_21631.pep
MERGRLGGRLPFPCRIRLPSFLCTAGSIPAQHATQPAAPKLSGGRHGKHASSLHALTPPMMAVRRPVLRSQHLLLLCPSFSSFLDIIRWKLCFTSSV

SEQ ID NO: 127214 - protein, 133 aa, Triticum aestivum
  unsure (1)..(133): unsure at all Xaa locations
  Clone ID: PAT_TA_21632.pep
MTENMSKTGHKLQRHTWGTAPHYHHPPGGGALYLAHVTRKSARGKSQGTATAIGTDTLSHTQXMERNRHVRVVLNSKPVPCRRARAEPSISRPAVRRRSARTAHGLTRWPSRPPPRPARRARGPQGPARPRQR

SEQ ID NO: 127215 - protein, 93 aa, Triticum aestivum
  unsure (1)..(93): unsure at all Xaa locations
  Clone ID: PAT_TA_21633.pep
MTKRTKKAGIVGKYGTRYGASLRKQIKKMEVSQHSKYFCEFCGKFAVKRKAVGIWGCKDCGKVKAGGAYTMNTASAVTVXRSTIRRLREQTEA

SEQ ID NO: 127216 - protein, 145 aa, Triticum aestivum
  Clone ID: PAT_TA_21634.pep
MASKHLVLAACLLLLLPTASVATDVDYCSKKDYPVKVSGVQILPDPVEPGKPATFKISASTDKTIEKGKLVIDVKYFFFYVHSETRDICGETSCPATGDFVLSHQQTLPGFTPPGSYTIYMKIVGDDNEELSCISFGFNIGSRAS

SEQ ID NO: 127217 - protein, 60 aa, Triticum aestivum
  Clone ID: PAT_TA_21635.pep
MAATLKLRILIVAAAVAASLVGTASAAEGPAPAPTSAAASMAAPAVAAASFTALVFGYLF

SEQ ID NO: 127218 - protein, 113 aa, Triticum aestivum
  Clone ID: PAT_TA_21636.pep
TVEDSKAPLNLHQCRLLAFRSITITGRSYRTAWPESIPHLSLQSWRVAPHAAGVPGRVAERRCRQELTVCLVKKPSYPQWLGELASVKKFVIYHCKGIGSLPDSIQQLTKLDI

SEQ ID NO: 127219 - protein, 89 aa, Triticum aestivum
  Clone ID: PAT_TA_21637.pep
TWCYDEVPSATHRVTDCDPVFQLTIAGYVPHHSSLVNWQRNLLRIAELTGQNFCTYLHTTGSRGTNVLGGRVLVQVFAARWLYLSSKCY

SEQ ID NO: 127220 - protein, 137 aa, Triticum aestivum
  unsure (1)..(137): unsure at all Xaa locations
  Clone ID: PAT_TA_21638.pep
LKLQMVQTLISVEGIEINAVNRAGETAFAIADKQGNEELVNILREVGGGTAKEQVNPPNPAKQLKQTVSDIRHDVQSQMKQTRQTKMQFQKIKKRIQKLHIXVGLNNAINSNTVVAVLIATVAFAAIFQLPGNFWRT

SEQ ID NO: 127221 - protein, 138 aa, Triticum aestivum
  unsure (1)..(138): unsure at all Xaa locations
  Clone ID: PAT_TA_21639.pep
MVSSDTIRTAIGVIGNGTALVLFLSPVPTFIRIWKKGSVEQYSPIPYVATLLNCMMWVLYGLPLVHPHSMLVITINGTGMLIQLXYVALFLVYPRGRRAQGSSCWPPSRLRRRPRRAGARLAQSTTEALGSGPDLDGL

SEQ ID NO: 127222 - protein, 100 aa, Triticum aestivum
  Clone ID: PAT_TA_21640.pep
RWPSCRPPPRLPPPPPPPLPPSPPRSPRPRRATGRRHRARRPSARRRSPRPRLQPPSPGHPPAPSAPRLRHLRPAKPTHPARSAMAWPPTPRVLEGPWQA

SEQ ID NO: 127223 - protein, 322 aa, Triticum aestivum
  Clone ID: PAT_TA_21641.pep
VLSLLTSFIKRPHQSLAGIGIAAFVRLMSSAGSVFVDEKWLEVVLSLKEATTETLPDFSYIASGAYLENVPIENGDSSDKREDESQPSEDGTEETSRSRNLYFAIADAKCRAAVQLLLIQAVMEIYNMYRAQLSAQNTVILFEALHTVATHAHKINSDNDLRTKLQELGSMTQMQDPPLLRLENESYQLCLTILQNIFLDRAPDEGSLEVETHLVGLCKEVLEVYLSTARPAHLSGGIQPLGHWLIPVGSSKRRELAARAPLVVSTLQAISGLGDSSFEKNLGQFFPLLAGLISCEHGSGEVQVALSDMFSTWVGPIVLQSC

SEQ ID NO: 127224 - protein, 78 aa, Triticum aestivum
  unsure (1)..(78): unsure at all Xaa locations
  Clone ID: PAT_TA_21642.pep
MGGGNGQKSKMARERNAEKNKGGKGSQLEANKKAMNIQCKICMQTFICTTSXEAKCKEHAEARHPKNDLYQCFPHLKN

SEQ ID NO: 127225 - protein, 255 aa, Triticum aestivum
  unsure (1)..(255): unsure at all Xaa locations
  Clone ID: PAT_TA_21643.pep
MLQLACSSLLQAADRFFDLSGREAPGVGCSVRLALDMFRSKVQEMILRRRSXRSMNGAAQHAGSSPTASCDGGGGNGCCCSCAVVXAPRLLHPAVARAAGRPAPAAPVTQAWPASGIPASYVLAASPAVPSSVAGAGAGGRSRGPWCDGGAGPHGLPDVLDCAHKAQRRTNVLRGALRRRRRPALVRSSSLDRRVEFRVKNKSSWLPLRAARAGAAADEDDGPASEDYTCVISRRPNPRTVHIFGDRVVDSSACR

SEQ ID NO: 127226 - protein, 77 aa, Triticum aestivum
  Clone ID: PAT_TA_21644.pep
GVHAVRRAGPRRAARARGRARRVGLLLVISACDNWTASFLGVVSSARDGPREESTHRAAGVPRVHSFPSVLMHMLLL

SEQ ID NO: 127227 - protein, 150 aa, Triticum aestivum
  unsure (1)..(150): unsure at all Xaa locations
  Clone ID: PAT_TA_21645.pep
XLVAAPGGGSAEREGREGTNGRRSAAKGTGANGGSGRPMHSGQVGLGWWGRHEVRRERERAKAQRETKRCGTRGARTAERREATGQRSRKKERGHESSEKQVGTWNLKCPGQEQVPQDEALGGCCDEFVRGLGRRLPVNFGLLDRCLLIM

SEQ ID NO: 127228 - protein, 141 aa, Triticum aestivum
  unsure (1)..(141): unsure at all Xaa locations
  Clone ID: PAT_TA_21646.pep
MPPRPVPLFSRLRFRLPSCAAVSISTPPSSAAPLHYGHRTPLASPFPLSPPCPRILRAAVAVSSLDLRPITGGFALFSMAAASSATSVHDFTVKDASGKXVDLSTYKGKVLLIXNVASQCGLTNSNYTELSQLYEKYKDKV

SEQ ID NO: 127229 - protein, 126 aa, Triticum aestivum
  unsure (1)..(126): unsure at all Xaa locations
  Clone ID: PAT_TA_21647.pep
PPXAASSPAAPPRALAPPPLRPSPHXTPPTSRRRRCTPCGPSRRSPSVTASAASWPASAPRTAAPPSSRTPPSSAPSAGAAPPLSRPSAPPRRPPTPPPSPPAAPPSPAATAPPSPCPSASCPPPA

SEQ ID NO: 127230 - protein, 186 aa, Triticum aestivum
  unsure (1)..(186): unsure at all Xaa locations
  Clone ID: PAT_TA_21648.pep
SSTKIISMPAQPFALLEPRWANPGEGWFRAAYKWDRDKIYKWMRETADAVRVQPGNQELGTLPCGYSQSRDPSFAREWQSVQGRNKATIIAYCTTGWDSSWEPRMLQHHVGHCQWLVLQAYSTACIGPYAAMVVPLRSTWAFLNLLGTTPGTADKNNSTPLXAVYGRGAPYPGNSTGGNGASIKAR

SEQ ID NO: 127231 - protein, 163 aa, Triticum aestivum
  unsure (1)..(163): unsure at all Xaa locations
  Clone ID: PAT_TA_21649.pep
SQSASAPRARWPSRSPRPHSRISPLPRPRSSAPSPRCCCSRAARRPPPSPSPTAASSRPSRPRNPSSAAADSGAGDGAGGSGGGSTEGGRKGXKEHGGXKKXGXGPVISQKXTSPKPXSSNWWCMGYMKSGXKNLGCRXYNPVLXSNQSNXTVSITXLXNRAX

SEQ ID NO: 127232 - protein, 126 aa, Triticum aestivum
  Clone ID: PAT_TA_21650.pep
MQYMTIVAFLAATVAAGPQIRAYPSIDQITVAQANNACGNNMQVTCCNKVTNTPAGNAVGNGAGILNNLSLFDQCSKLDVNVLAIANGLLNKECQANAACCQNSGGSATGGLVNVALPCIALNSLI

SEQ ID NO: 127233 - protein, 118 aa, Triticum aestivum
  unsure (1)..(118): unsure at all Xaa locations
  Clone ID: PAT_TA_21651.pep
VKFCNSLDVNLPGLAVACCEMRRLFCHAIVSFASQSILSCTRAEFXTSNIPLSVXXEXFXFXLKGLALFGMLHSKGQYXGEPQGCLVXLLIYKXXNHFTXXQFLXRXTLSALSQKXKK

SEQ ID NO: 127234 - protein, 118 aa, Triticum aestivum
  unsure (1)..(118): unsure at all Xaa locations
  Clone ID: PAT_TA_21652.pep
MGLSFGKLFXSRLFAKKEMRILMVGLDAAGKTTILYKLKLGEIVTTIPTIGFNVETVEYKNISFTVWDVGGQDKIRPLWXRHYFQNTQGLIFVVDSNDRELLFKAKDXLHRMLNEDNC

SEQ ID NO: 127235 - protein, 87 aa, Triticum aestivum
  unsure (1)..(87): unsure at all Xaa locations
  Clone ID: PAT_TA_21653.pep
YRAPPRVFERSFSKKDLGEAAYILSIKIYRDRSRRLIXFSMSTYLDKILXSSKWNSQRKSFLTLLQGVKLSKTQSPTTAEDRKRMKV

SEQ ID NO: 127236 - protein, 337 aa, Triticum aestivum
  Clone ID: PAT_TA_21654.pep
MTPRIIDLCKELVHSWWSLDSSCFSISTVSGGITNMLLKVSVKEGSDSESSLPVRLHAPTSDRVIGRGRELQAIPYLSAARFGARLLGVFENGVVSSFIHARALSPSDMKEPRIAAEIAKQLQKFHQVDIPGSKEPQLWNDVFKFLKKASVLKFEDNEKQKRYEMISFREIQDEVKELKDLSDLLHAPVVFAHNDLLSGNLMLNDLEEKLYFIDFEYGSYSYRGFDIANHFNEYAGFECDYNLYPDKDVQYHFFRNYLSDRPSEVQEQDLDALYTETNTFRLASHLYWALWALIQARVSPIDFDYLGYFFLRYGEYKKQREFCFSLAQGFLSSLRSG

SEQ ID NO: 127237 - protein, 130 aa, Triticum aestivum
  Clone ID: PAT_TA_21655.pep
PEEEKNLGPHDRLIHVYHFMKDPNQNQQIQNFGDPFLMVIREGETAAEVMERIQRKLRVPDDEFSKWKLAFISMNRPEYLQDTDVVSARFQRRDVYGAWGTIPWLGSTLIQHPKRSYTSNQESGTPIRTP

SEQ ID NO: 127238 - protein, 77 aa, Triticum aestivum
  Clone ID: PAT_TA_21656.pep
RKHKFFIYIELLRFKKLNFLVLIFSIEENLSFYKHQTSSFFVIRTYWWYSLSNGKRASYVINIELLNYLNFNFQVFF

SEQ ID NO: 127239 - protein, 141 aa, Triticum aestivum
  unsure (1)..(141): unsure at all Xaa locations
  Clone ID: PAT_TA_21657.pep
AHPIFRMLPPSGKEKNFMYCHLHPQIRAYEANPKPVGLAFGXGTIGNERIFLDERLLGSXVRHHAVDKTYQHGSLIPNQGYLPVXELQVLDVEVWGGWVESNETTADIPXKREDIFSRATKKVDPQTFXSWEDPPEKMMMA

SEQ ID NO: 127240 - protein, 223 aa, Triticum aestivum
  unsure (1)..(223): unsure at all Xaa locations
  Clone ID: PAT_TA_21658.pep
QVLHGAMNGKGGRVESTTNGAFNTLSGFEAADRRNSWQYFKLLLSXDKESLLDDLEGENPNQSDSNHVTLAISIEDTGVGIPLQAQDRVFTPFKQADIQLPRNYGGTGIRFKHHQVLPNLGGGAIISTTTLPVWSTFXFSSTLEHPYKXISGHSKXDFPEHYQRLFKGRKHRWWXRPVRYAVSQTPPLLGWSSNLGQISPIDFPLANAPRSLGASFYEFRGLS

SEQ ID NO: 127241 - protein, 106 aa, Triticum aestivum
  Clone ID: PAT_TA_21659.pep
GEVDHPLRSNRVWFQHMDKEEGSDTVYTASRLRGDPAGHQRAGDLEPRGSSSGKTKTKPSRPALRARPEVDRSTQGEHGREVELLRRGVARSKEASVERGMAARHG

SEQ ID NO: 127242 - protein, 305 aa, Triticum aestivum
  unsure (1)..(305): unsure at all Xaa locations
  Clone ID: PAT_TA_21660.pep
LTIRSLGAPAVLLSLAMQGVFRGFKDTKTPLYATVVGDATNIILDPILMFVCHMGVTGAAVAHVISQXYLITMILICRLVQQVDVIPPSLKSLKFGRFLGCGFLLLARVVAVTFCVTLASSLAARDGPTIMAAFQICCQLWLATSLLADGLAVAGQAVLASAFAKNDTKKVIAATSRVLQLSIVLGMGLTVVLGLFMKFGAGVFTKDAAVIDVIHKGIPFVAGTQTINALAFVFDGINFGAQDYTYSAYSMVGVASISIPCLVYLSAHKGFIGIWVALTIYMSLRTVASTWRMGAASGPWAFLRK

SEQ ID NO: 127243 - protein, 132 aa, Triticum aestivum
  unsure (1)..(132): unsure at all Xaa locations
  Clone ID: PAT_TA_21661.pep
MAGGPAAVSFLTNIAKVAAGLGAAASLASASLYTVDGGERAVIFDRFRGVLPETVGEGTHFLVPWAAEAFIFDIRTRPAQXLLQTRGTKDLQMGQLTLRLLSRPDTPHILTPSDPVRHKCPPSATSAKASRH

SEQ ID NO: 127244 - protein, 153 aa, Triticum aestivum
  unsure (1)..(153): unsure at all Xaa locations
  Clone ID: PAT_TA_21662.pep
EFPHHHHHHGHRRDDDEDDRRGPPPPVYGGYGQPPPPDPYGRAPVDPDSXYGRPPPQSAVRLGPGTPTATAAKATRPPPAYGPGAGYGNVVHVAQRGPRREALLRAAAAAVLVAPTEAVAPSTATKGRPHHGGGGPFAATPPPARAAPPAPRL

SEQ ID NO: 127245 - protein, 106 aa, Triticum aestivum
  unsure (1)..(106): unsure at all Xaa locations
  Clone ID: PAT_TA_21663.pep
GTSSGISVWSLLSNECIFNLDCHAPVQDLLFDKNHILXLGAEPLLSRLTINGTVLSTSKMLPLSPAFPVSIHXQLGIAAVXGYGGXVDVDSPEVGSHLCTFRYPGP

SEQ ID NO: 127246 - protein, 242 aa, Triticum aestivum
  Clone ID: PAT_TA_21664.pep
MSAAQAASAILRPSASAPLREVAFFFTDNHNPSPARLCIRRRSAERTFAGLQIAASNFNRSRICHVKSGEADGYPKTEEDKLADEETLQRNLDRAIREEDYARAAKIRDDLRVLHEDTEASVLAANTRFYNAFKNGDFTAMYSIWAKGDHVYVVHPGAGRISGYDVVLQSWEMVCNADYEFPLNIDLKNIEVHVRGDLGYVTCLELVKTKGKSWGKQIATNVFEKIDGTWYICIHHASHIEE

SEQ ID NO: 127247 - protein, 157 aa, Triticum aestivum
  unsure (1)..(157): unsure at all Xaa locations
  Clone ID: PAT_TA_21665.pep
MARSKLSVELLLALLVVLAAGPAMRLVEAASAHLHFYMHDVTGGPSPTAVQVVSGPXATSGNTMVIDDKLTEGTSRSSTTVGRAQGYYMVASVANLRLLRQHECPSYFRAIRRAAPSTVVGPDDVSVPVRDSQWSGGTGIQGWPPVFLWKTSPPRLH

SEQ ID NO: 127248 - protein, 111 aa, Triticum aestivum
  unsure (1)..(111): unsure at all Xaa locations
  Clone ID: PAT_TA_21666.pep
DVPAAPAETSAEVGSSAARAFDLNLPAVPEFVFRCGKPGKMWEEDEEVQSPLRXFKKPRLLMTALKPLRARAAVLISSPVQVFGPQLPSPPVEVEHTIPSFIPYGASSAIV

SEQ ID NO: 127249 - protein, 130 aa, Triticum aestivum
  unsure (1)..(130): unsure at all Xaa locations
  Clone ID: PAT_TA_21667.pep
ATAAAMQVPGRLRRVLRAPPPRILLYRAISSPPPGGGSGVAVKQVTRGNMEEALEKLRGRVREAASVGLDLGDERRHERARERHLSSPTXAERALPQTPATPXEPVRRPNSPASALSDGTCQVRLRCPSA

SEQ ID NO: 127250 - protein, 222 aa, Triticum aestivum
  unsure (1)..(222): unsure at all Xaa locations
  Clone ID: PAT_TA_21668.pep
KPLWLTRSVQSQQESNQNDRCLIAIPAGINQKKSVDALMKKFLAENFTAILFHYDGKVNEWNDLPWSKSVIHIAASNQTKWWXFAKRFLHPAVVSMYKYIFXLWDEDLEVDNFNPRRYLNIVKSXKGWEISQPGXLDPKLPEIHHXITVRKKTGNFHRRVSRANKDCSREGPPSAGRGGALPPPLAFSASQGAWCHPEWAAPCSGYGLHFGPAPGGCTKTLE

SEQ ID NO: 127251 - protein, 109 aa, Triticum aestivum
  unsure (1)..(109): unsure at all Xaa locations
  Clone ID: PAT_TA_21669.pep
ARCPCGYCHISDVETHKQDDHMESFFLAETVKYLWLLFDLAAGPDNIVENGPYKYIFXTEGHLLPVTPEIALEDEHCSYFGAFCNGGADHGYGASASSTKASKWETIPN

SEQ ID NO: 127252 - protein, 73 aa, Triticum aestivum
  unsure (1)..(73): unsure at all Xaa locations
  Clone ID: PAT_TA_21670.pep
AYYSNLKSQKGLLHSDQVLFTGTGGGTNNIVNNFASNPAAFSSAFASAMVKMGNLSPLTGSXGQVRLSCSKVN

SEQ ID NO: 127253 - protein, 241 aa, Triticum aestivum
  unsure (1)..(241): unsure at all Xaa locations
  Clone ID: PAT_TA_21671.pep
MAASASCISLVVLVALATVASAQLSPTFYDTSCPRALATIKSGVMAAVSTDPRMGASLLRLHFHDCFVQGCDASVLLSGMEQNAIPNAGSLRGFGVIDSIKTQIEAICNQTVSCADILTVAARDSVVALGGPSWTVPLGRRDSIDANEAEANSDLPGFNSSRSELEAAFLRKGGLNTVDMVALSGAHTIGQAQCSTFRARIYGGXNINATYAASLRANCPLYSRSGDGSLXDLYTTTPNAF

SEQ ID NO: 127254 - protein, 312 aa, Triticum aestivum
  Clone ID: PAT_TA_21672.pep
MAASASYLSLVVLVALAAVVSGQLSPTFYDTSCTRALATIKSGVMAAVSSDPRMGASLLRLHFHDCFVQGCDASVLLSGMEQNALPNNGSLRGFGVIDSIKTQIEAICAQTVSCADILTVAARDSVVALGGPSWTVPLGRRDSIDANEAAANSDLPGPTSSRSDLELAFSNKGLLTVDMVALSGAHTIGQAQCGTFKDRIYNETNIDTTFATSLRANCPRSGGDGSLANLDTTTANTFDNAYYTNLVSQKGLLHSDQVLFNNDTTDNTVRNFASNPAAFSSAFTTAMIKMGNIAPKTGTQGQIRLSCSRVNS

SEQ ID NO: 127255 - protein, 334 aa, Triticum aestivum
  unsure (1)..(334): unsure at all Xaa locations
  Clone ID: PAT_TA_21673.pep
MAHSSLSTVLLLCLAMAASAQLSPTFYQTSCPNALSTIKAAVTAAVNKENRMGASLLRLHFHDCFVQGCDASVLLSGMEQNAFPNVMSLRGFEVIDNIKAKLETMCKQTVSCADILTVAARDSVVALGGPSWTVPLGRRDSTNANEAAANSDLPPPFFDLVNLTQSFGDKGFTVTDMVALSGAHTIGQAQCQNFRDRLYNETNINSGFATSLRXNCPQPTGSGDRNLGNLDVSTPYSFDGYYRTWTSQALHLAGQILRRHSLTKGSTRATWGASPGGTPSGKGKGGTFKAGSSNRIKLKPTLAHFFQANGPRQNGKGSRGNRETTTAKTFNKAN

SEQ ID NO: 127256 - protein, 155 aa, Triticum aestivum
  unsure (1)..(155): unsure at all Xaa locations
  Clone ID: PAT_TA_21674.pep
MGTRTAAKPATCHRLSHSIPGHDLKPGHFRKQRASLTIRHRWALSGAHTIGQAQCGTFKDRIYNETNIDTAFATSLRANCPRSNGDGSLENLHTTTXNTFHNAYHTNRFSQKRLMSWILHRGHTAGGTPHNDGQPNSQQGNASRVQQAPSASTPW

SEQ ID NO: 127257 - protein, 148 aa, Triticum aestivum
  unsure (1)..(148): unsure at all Xaa locations
  Clone ID: PAT_TA_21675.pep
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFAKSGKXNLCGKARSXTGVGVMMNDMKAGPVMESHFHSGGQQH

SEQ ID NO: 127258 - protein, 108 aa, Triticum aestivum
  Clone ID: PAT_TA_21676.pep
ASILPSPPPQPVLLPSPPLPHGRPPSRSGGLRPDQLLHTTACLAVSPACSPSPSLLRIWQVRTHQGSRASTSPATRSGDEQAVLCLLLKLTSWDCLFLLANGFVVQGD

SEQ ID NO: 127259 - protein, 271 aa, Triticum aestivum
  Clone ID: PAT_TA_21677.pep
TSNRGISFAARAAARFGGRFSYCLVDHLAPRNTSSYLTFGPDANGAASSSRTPLLLDAQVAPFYAVTVDAVSVAGEALDIPAEVWDVKKSGGAILDSGTSLTILATPAYKAVVAALSRQLAGLPRVAMDPFDYCYNWTSPSTGDDLAVAVPELALRFAGSARLQPPPKSYVIDAAPGVKCIGLQEGGWPGVSVIGNILQQEHLWEFDLANRWLRFKDRRWPQSPTGLQAALSSSLLTPSPLGRAFPLPSPCSCRARSSLAGGNEIGHVPSI

SEQ ID NO: 127260 - protein, 113 aa, Triticum aestivum
  unsure (1)..(113): unsure at all Xaa locations
  Clone ID: PAT_TA_21678.pep
MSGRGKGGKGLGKGGAKRHRKVLRDNIQGITKPAIRRLARRGXGVKRISXGLIYEXETRGVLKIFPPECXIRDPVTXTEHPRRKTVTAMDVLFALXKRQGRTPYGFRRLVRCG

SEQ ID NO: 127261 - protein, 122 aa, Triticum aestivum
  unsure (1)..(122): unsure at all Xaa locations
  Clone ID: PAT_TA_21679.pep
MLDKLWDDVVAGPRPETGLEKLRKATTARPLVINKDADGGSYKRAQSMPSTPTTPVTPSSSSSSTTPRGAGNLWXRSVFQPGGSNXATKGMGANLFDRXRXPNPPTVYDWALQATRPRSNHR

SEQ ID NO: 127262 - protein, 77 aa, Triticum aestivum
  Clone ID: PAT_TA_21680.pep
HVECIAEYGEDNELRLTGRHETGSIDSFSWGVANRGTSIRVPRETAAKGYGYFEDRRPASNADPYRVTKVLLQFSMA

SEQ ID NO: 127263 - protein, 102 aa, Triticum aestivum
  unsure (1)..(102): unsure at all Xaa locations
  Clone ID: PAT_TA_21681.pep
MTQKQTLFKGQSKKKTIPPNRHGKAPHVRKGKRAVKPTKFTKDMDAEKELXTKFINQCNEIKAAILLAKRAGDLQHSEGGGEESKSKEIGTQKLKTMLNMPW

SEQ ID NO: 127264 - protein, 189 aa, Triticum aestivum
  unsure (1)..(189): unsure at all Xaa locations
  Clone ID: PAT_TA_21682.pep
MGLAFGKLFSRLFAKKEMRILMVGLXDAAGKTTILYKLXXARXVTTIPTIRFQXVETGLKYKXNITSTVLGMSGGQDKXRPXLWEHYFXQNTQGLIFWWWDNNDRYRVCLKPRDDSQQXMWNEDDLRDAVLLGFAKQASXPNAMNAAEIRTTGLHXLRQRHGTSEHCAWEGLLRLTVRFNRVGPPYVPE

SEQ ID NO: 127265 - protein, 55 aa, Triticum aestivum
  Clone ID: PAT_TA_21683.pep
FAAPFSRLPTWLPPVSRPETLTPNQIKPCCLLHPVAASRRLCPSSSLSLADARSP

SEQ ID NO: 127266 - protein, 165 aa, Triticum aestivum
  unsure (1)..(165): unsure at all Xaa locations
  Clone ID: PAT_TA_21684.pep
GGQTCCWSGCRALGFAASGGHPFCTQLRLKARAAGVGAPRAPXGVXRLLQRQPSCRHPDRRRRYPRSPVRRRRRTRRDLWPSGQPRYHPTVCASSRAVWHAEHYSMAFGMTAPEEYVPLMMDQGHPHQGEQGSLLSPSWGDEAPEVEPFQEPRDGPTGHTGGNDY

SEQ ID NO: 127267 - protein, 140 aa, Triticum aestivum
  unsure (1)..(140): unsure at all Xaa locations
  Clone ID: PAT_TA_21685.pep
MAARAALLQLAVSLVILAAVASASATDCPPPPLPPAPKPPTPGGHHGHGSCPRNALKLGVCANVLGLXVKAKVGSPPYEPCCSLLDGLVDLEAAVCLCTAVKATSSASTLTPHRLSLILNNCGKNCPNDFTARRSSSISY

SEQ ID NO: 127268 - protein, 167 aa, Triticum aestivum
  unsure (1)..(167): unsure at all Xaa locations
  Clone ID: PAT_TA_21686.pep
RRPAVLLADTAPPAAKMPFKRFVEIGRVALVNYGKEYGRLVVIVDVVDQNRALVDAPDMXRCQMNFKXRLSLTDIKXIDIKRVPKEDYTGSKAMXEADVEKQXGENTQWGQELIVXKKRRHHSNDFXQVQRPCWAKIKEGGXIRQDLLXLKXGCCCLNALGGPPSVP

SEQ ID NO: 127269 - protein, 173 aa, Triticum aestivum
  unsure (1)..(173): unsure at all Xaa locations
  Clone ID: PAT_TA_21687.pep
MPKRAVASLGQWAASPPVYDLREFGAAGDGRTVNTAAFESAIAAIXKRGGGRLTVPAGRWLTAPFNLTSHMTLFLAAGAEILGIQDERYWPXMSPLPSYGYGREHKGPRYGSLIHGQDLNIDYNXHNGTINGQVKLVGKIRSLSHKGSLVHSCVKYISFYTLVISFWTLNYAR

SEQ ID NO: 127270 - protein, 166 aa, Triticum aestivum
  Clone ID: PAT_TA_21688.pep
YIGGAQESRPSSPHTAATATTAALLPLVGPKTIQRHITSHGTATRTEKRQGLARALPRTFRASQSAGARARGSTRRSPHEPRTPHLVSPWYVRCAYVIRDEAEQGEGSRGRSGPGVGAGEVSGAEVGGVDGGGPVGGAVVARDGVGHPRALGSGGGGAPGLLGLAR

SEQ ID NO: 127271 - protein, 154 aa, Triticum aestivum
  unsure (1)..(154): unsure at all Xaa locations
  Clone ID: PAT_TA_21689.pep
MADVDVEPEVAAGAPKKRTFRKYSYRGVDLDALLDMSTDDLVQLFPARARRRCQRGLKRKPMALIKKLRKAKKDAPVGENPEPVKTISGNMIIVPEMIGSIVGVXYNGKTFNQVEIKPEMIXHYLAEFSISYKPVKHGRPGIGATHSSRFTPLK

SEQ ID NO: 127272 - protein, 185 aa, Triticum aestivum
  unsure (1)..(185): unsure at all Xaa locations
  Clone ID: PAT_TA_21690.pep
WVLLCLAGAGGXPPRNCSPTFYPRSCPRAXLATIKAPVPPAVAQGARWGPPLLELLSDDCFVQGCDGSXVLLNDTATFTGEQTANPNVGSIRGFGVVDNIKAQVEAVCPALPLPRRPPPPPPPPPPASRRGPRRWGRHPAQLALHPRLPTSLPWVPAVLSPAPPTPCFQKRSTSRPKFGWFLGHI

SEQ ID NO: 127273 - protein, 62 aa, Triticum aestivum
  unsure (1)..(62): unsure at all Xaa locations
  Clone ID: PAT_TA_21691.pep
SCRIRHEIAERRSSNQAHGDMLEALLRSGDDGTREKLSDEQIIDLIITIIYXGYETMSDDLQ

SEQ ID NO: 127274 - protein, 96 aa, Triticum aestivum
  Clone ID: PAT_TA_21692.pep
SPPMAPPPATPPPPATPPPPAAPTPAPSVAPTPPPVATPAASPKSPKTPSPAAATSPAPSLSPAGTPTNEDSGASARAVGFATVVALAGAGLAVLL

SEQ ID NO: 127275 - protein, 79 aa, Triticum aestivum
  Clone ID: PAT_TA_21693.pep
SILEILFLFRLFFVYEMSGIPYLYPMQKKRIQGKGENNKIKISSFSEGLQVFLIVYSAQEKAFFLCRFFLYQNKNPFSS

SEQ ID NO: 127276 - protein, 66 aa, Triticum aestivum
  Clone ID: PAT_TA_21694.pep
FFFSGFYGSNLFNNPPNGMYNVIFRTNITPWEEPISLVCMPKQVAVTTANRYPQPLVCHFPVPTNF

SEQ ID NO: 127277 - protein, 126 aa, Triticum aestivum
  unsure (1)..(126): unsure at all Xaa locations
  Clone ID: PAT_TA_21695.pep
MARIKVHELRGKSKTDLQAQLKELKSELSLLRVAKVTGGAPNKLSKIKIXAHLHRSACSPSSRQKQKSALREAFKEEEASPAPSSXPKKTRAIRRRLNKFQLXLXRLEREKKREKYFPNAEVPIKA

SEQ ID NO: 127278 - protein, 120 aa, Triticum aestivum
  unsure (1)..(120): unsure at all Xaa locations
  Clone ID: PAT_TA_21696.pep
MLPGRHQKSQYILEVDFEGTNQLAYPETWFFMLVVAICVLTQMNYLNKALDTFNTAVVSPIYYVMFTSLTILASIIMFKDWXWSEPXSITSEICGLIVRVVXGTILLHVTKGLRKVPPIE

SEQ ID NO: 127279 - protein, 115 aa, Triticum aestivum
  Clone ID: PAT_TA_21697.pep
LARQCPDTNRLPPDGATVVSRFNGDAPARTEIASARYRKSPSPASWSCPRAPEAPAAPRSDVAKNASHDTGAVAAATRCQTPSKSPTRELAGEDPLGLFGYGNCGARLGIRGERR

SEQ ID NO: 127280 - protein, 51 aa, Triticum aestivum
  Clone ID: PAT_TA_21698.pep
GQTKHVSTESRKLDTVDSVGIPPKPRAHAMETTQFRAQENYWFFTDMEMAS

SEQ ID NO: 127281 - protein, 129 aa, Triticum aestivum
  unsure (1)..(129): unsure at all Xaa locations
  Clone ID: PAT_TA_21699.pep
MARPTRALLLPLLLLVLALAALARASGSGDVPASSLSWDLGVVGRRGEDEEFGFPGGDSVARRVLQGGGYLSYGALRMDNVPCSVRGASYYNCRXPGGQANPYSRXGCTXIXRCPGVSPEASTTETGVL

SEQ ID NO: 127282 - protein, 96 aa, Triticum aestivum
  Clone ID: PAT_TA_21700.pep
RAPSRDGPGLGDEQFLLATTHLTGRRTVHQRVSSLDLRLNRPKSFIKAWFSQPEKKLLQSYINRELFIVLFSVLQCTQDLTGYLYLTFLSLEQLNF

SEQ ID NO: 127283 - protein, 172 aa, Triticum aestivum
  unsure (1)..(172): unsure at all Xaa locations
  Clone ID: PAT_TA_21701.pep
MAAQREKSAAVAVGPAHGAAVSGSPSPSSSSGGPAAASSSGRAVERRIRDLGELGANVDALQKMLXRKAVFVDDDIFSKASLAADQARTIKVLDQRVQSLERELDAAISAAARAPTDXRQAEAAQRAAELRTXEVTKXELENMRGVQLHMEEFRWHRMAAKYLRCVVACRIQ

SEQ ID NO: 127284 - protein, 189 aa, Triticum aestivum
  unsure (1)..(189): unsure at all Xaa locations
  Clone ID: PAT_TA_21702.pep
DPYIDGPIIQASVARALASGTTMDAVLEMLREVTPELSCPVVLLSYYKPIMSRSLAEMKEAGVHGLIVPDLPYVAAHSLWSEAXKNNNLELXVLLTTPTIPXEDKDEGDLPXLQEXSVYLGERXRMTXPRPNVNPQWXIIQEVKKVTNNPXPFGSXIPTQKTLTNAQWGLTGDYPERMVRNWPTVSQQG

SEQ ID NO: 127285 - protein, 73 aa, Triticum aestivum
  Clone ID: PAT_TA_21703.pep
RTAERRPVRLMELMRVTLKPSRGKNASRYIFGHVLLPAVDYITFIPQGVTCQFKRDYNAVITPFVFKYTLISV

SEQ ID NO: 127286 - protein, 82 aa, Triticum aestivum
  unsure (1)..(82): unsure at all Xaa locations
  Clone ID: PAT_TA_21704.pep
MSCCGGNCACTSGCNCGSGCGGCKMFPDVETAGVASVKPTVLAAPATKASAGGFEAAAEXGGCDCNTCNCGTSCGCSCCSCN

SEQ ID NO: 127287 - protein, 95 aa, Triticum aestivum
  Clone ID: PAT_TA_21705.pep
QSTTSATATLGFDGTVPSHLEDGNQFVCLQQNENPAMWMHGAGSRGMPPLAASTMYGYQGQIHQDRLPGRASYLPQYGPAPKASHPAWGPEHPNP

SEQ ID NO: 127288 - protein, 184 aa, Triticum aestivum
  unsure (1)..(184): unsure at all Xaa locations
  Clone ID: PAT_TA_21706.pep
GFGKDGKEVYFRDIWPSTEEIAQVVQSSVLPDMFKGTYEAITKGNPMWNQLTVPEASLYSWDSKSTYIHEPPYFKDMTMSPPGPSTVKDAYCLLNFXGDSITTDHIPPAGSIHKDSPAAKYLXMERGVDPXDFNPYGNRXRGNDEVMAXGTFANIRXXXKFLNXNWQDIMSYWGELRFDAANTI

SEQ ID NO: 127289 - protein, 85 aa, Triticum aestivum
  Clone ID: PAT_TA_21707.pep
MANPRVFLYMTVCRAPAGRILMELYKDSVPGTVENLRALCTCNTGVGNSSKPLHYKGSTLDSVIRDLMCQGGDFTRGNCTGRKSI

SEQ ID NO: 127290 - protein, 98 aa, Triticum aestivum
  unsure (1)..(98): unsure at all Xaa locations
  Clone ID: PAT_TA_21708.pep
KCPFILEESYILVPQILGRGLKLVPQLQKWTXCTLSFFKPDKVHPLVNGFCPSYGGCPHPGFDRSGSALPTSSQVRVLFSNLVSFFKYMNLFKICVLL

SEQ ID NO: 127291 - protein, 125 aa, Triticum aestivum
  Clone ID: PAT_TA_21709.pep
RGGGDAVGPRHGRHQSRLPPSSSGPSWRTSSRPRRTDTTGTRCSPWWAPAIHQSEALLPAQESSGPIRCARVSLLRTFARKKSRIFHSMRKGCCLFFCFSYAFRLSLTTGFPINIFNFYKGKKKT

SEQ ID NO: 127292 - protein, 272 aa, Triticum aestivum
  unsure (1)..(272): unsure at all Xaa locations
  Clone ID: PAT_TA_21710.pep
EFGTSRRRPPRPALLPRGPFCRRPRGRSRRRAAARSAPAAPPSPPSPPAPPGSPFAGSPSPPAFFVRTQLSCTLLWLIGLIVLSGIWRXVLPLNARECCPYVRLILTSVVVQEGVRLVYWRRLKKKKKLLXLWLTDKMLISLAGGLGHGLAHAVFFCLSLLTPXAFGQATFYVERCSRMPFFLVSAIIALGFLVIHTSSMIIAFNGYGERKKRDQIFVPVVHLIAAVMTLINLVPGGCLVGTPLLCVTAAMTLYYSWQVVGQRITEHQHRQS

SEQ ID NO: 127293 - protein, 109 aa, Triticum aestivum
  unsure (1)..(109): unsure at all Xaa locations
  Clone ID: PAT_TA_21711.pep
MARPQQRYRGVRXQRHWGXSWVSEIRHPLXLKTRFWAGAPSETAEDAARAYDEAARXMCXPRXRTNFPEDARRPTDRGNPAATGFLSPRSSPTPTLQPCVRAGGPRQGR

SEQ ID NO: 127294 - protein, 78 aa, Triticum aestivum
  unsure (1)..(78): unsure at all Xaa locations
  Clone ID: PAT_TA_21712.pep
MKLTVKTLKGTHFEIRVQPNDTIMAVKXKNIEEIQGKDSYPXGQTTADFQMGKSLEKMKYIWXENKSXEDGFPIAMLK

SEQ ID NO: 127295 - protein, 89 aa, Triticum aestivum
  Clone ID: PAT_TA_21713.pep
LQCSSITWQTQTTNLTNQQPHKPMAVGCSKHAVLVHRAISGSSIFGHVELDQGSINERLQPLFSCFDPIIVVLKLEEMFVQVCNRQLSF

SEQ ID NO: 127296 - protein, 83 aa, Triticum aestivum
  Clone ID: PAT_TA_21714.pep
VSVNFSTFLVIGTTSPVTYQVLGHLKTCLVLSFGYTLLHDPFTVRNILGILVAIFGMALYSIFSVREGKKKSAGDALPVSQDA

SEQ ID NO: 127297 - protein, 103 aa, Triticum aestivum
  Clone ID: PAT_TA_21715.pep
LDGLGLGLGLGIRTKKACRRHVRHHCPNAKPTHPIIATNLLFFLSSRCCLVLVPMQHALPAPALVLVAVGVGGRRQLRVEAVVQVLLLLPLPGVGALAVVVVR

SEQ ID NO: 127298 - protein, 146 aa, Triticum aestivum
  Clone ID: PAT_TA_21716.pep
HPELLTTFWSRRVLVGDLGAIMSLGTRRSAEAEEPPVHVMLLHQRHRGAARSPRPSSSHRRPEPAAAETPTTCSRRSSGPPLAGSGFSSVLPGSIIPIMDRKLGASRFSGITSLHLKRLRKMPSMPLLSATKLRRNSTTAPTTRAG

SEQ ID NO: 127299 - protein, 111 aa, Triticum aestivum
  Clone ID: PAT_TA_21717.pep
SKWRCASLDGSLSPLATRRLLELSCPRHAATPAAGPRCRPCSLRSDCIPDKPKKIRLLDGTSSVYSLEYFLSISACIYSYSLWSFYSAYKISLKSNFKKFDQFYRKKYLHL

SEQ ID NO: 127300 - protein, 139 aa, Triticum aestivum
  unsure (1)..(139): unsure at all Xaa locations
  Clone ID: PAT_TA_21718.pep
VVQSAFRAFLARRALRALKGIVLLQALIRGHSVRRQTAETLQCMQALXVKAKARVRAXRQVRVALRKSSGTEKDSXEQDDSLRTMFREVRXGWCGSIGSMXEKCKLKHWKRREAAAKRERAMAYXLTHQRQAGSSNKFL

SEQ ID NO: 127301 - protein, 116 aa, Triticum aestivum
  unsure (1)..(116): unsure at all Xaa locations
  Clone ID: PAT_TA_21719.pep
MAATPADAKTEAAKMDLLEDDDEFEEFEIDQEWDEKEEGNEAVQQWEDDWXDDDDVNDDFSXLQLRKELEGSNAQEELKYYSPSLTIDPSNASYFLESGPFSDLVPPGASTPGSKK

SEQ ID NO: 127302 - protein, 73 aa, Triticum aestivum
  Clone ID: PAT_TA_21720.pep
EIDMNIENSAAVTKEAKTEVAKAVKTQKSNSSLICLLMVIFGVLLLLVIIVLGSLGTCNLFPLTELFPREFKN

SEQ ID NO: 127303 - protein, 121 aa, Triticum aestivum
  unsure (1)..(121): unsure at all Xaa locations
  Clone ID: PAT_TA_21721.pep
GCNXQKAFKRXGSPRLXKXPKLVRLWSLHLRSTPSRLKNRERQGNIGGGAAIQNQSLKGVQGAQGTGNSGRSVHPGRHPKVGGPRARKTLRRAKDREKMRLVRPSFVLPVVRDPRNAFKSL

SEQ ID NO: 127304 - protein, 178 aa, Triticum aestivum
  unsure (1)..(178): unsure at all Xaa locations
  Clone ID: PAT_TA_21722.pep
MQIFVKTLTGKTITLEVESSDTIDNVKAKIQDKEGIPPDQQRLIFAGKQLEDGRTLXADYNIPKDPTLHLPALGPPWHPLTLRCQRSVRKYNPRQDDFGRKCYARLHPKAXNCRQENVGHNNHFRAKKKFKTGAAPSSPMALGGCVAWWRFSSLVSLRGPPVALPGVCIHPLCIGRPR

SEQ ID NO: 127305 - protein, 194 aa, Triticum aestivum
  unsure (1)..(194): unsure at all Xaa locations
  Clone ID: PAT_TA_21723.pep
ADQYKLAGSLPEKMSNLSSLELIDLGYNQLTGAIPESIATMGNLGLLDVSNNHILGPLPTQIGTLLSIQRLFLERNKISGSIPXDSIGNLSRLDYIDLSNNQLSGKIPASLFQLHNLIQINLSRNSMVGAPPTDIAGLRQIRPIXVFPSNFWVGSIPDAGGHPNMPNXLILSXNPWEVNSSKSKTPKKPRGSEA

SEQ ID NO: 127306 - protein, 155 aa, Triticum aestivum
  Clone ID: PAT_TA_21724.pep
NLRPDIPRCCPSAFANVMRKCWDANPDKRPDMDEVVQLLEALDTSKGGGMIPDGQSSGCLCFTKAPWSIDTFHGYPFPWATLSPVVKWTGATACSPLARPVPPLTVLQYCLAIMACQTCYSSIHFCRPPATFQYTSVLRYGVPKRIWTRYPLKKK

SEQ ID NO: 127307 - protein, 83 aa, Triticum aestivum
  Clone ID: PAT_TA_21725.pep
MFDGAPPSLLLPADELRRKFQHAGISLDRPIVVTCGSGVTACILALGLYRIGKRDVPVYDGSWTEWEGQSDSDYPKVTAPGTA

SEQ ID NO: 127308 - protein, 152 aa, Triticum aestivum
  unsure (1)..(152): unsure at all Xaa locations
  Clone ID: PAT_TA_21726.pep
SVVYASFGSVTKLAKRQMQEIAGGLRQCGRPYLLVVRRDGVDDDEGGIHGLENDTEMQGMVVDWCDQLEVLSHPAVGCFVSHCGWNSATEAMASGVPIVGVPNMFDQPTNMYLVEEEWGXGVRGERDADGVLTGAELARCIELVMGDGATVA

SEQ ID NO: 127309 - protein, 179 aa, Triticum aestivum
  unsure (1)..(179): unsure at all Xaa locations
  Clone ID: PAT_TA_21727.pep
MKPRPTRRHQGGSALTAAFYLLFDLTRLPVLDTEQTWRVSIDGPVAGHIIHGVSPPSPSFPLDAAAPALAPAAALSLPPRSLLPGAPSAARPCSTPARARAAPAAPPPTAAGAAASALALGAAPRPALSVRAPASXPRGAGTNXPKXXISPGFSLTGKPGYQNPETPSQLKTRAEHSFK

SEQ ID NO: 127310 - protein, 144 aa, Triticum aestivum
  unsure (1)..(144): unsure at all Xaa locations
  Clone ID: PAT_TA_21728.pep
MLDHLVSSYTHRSGGDQPAAPSPCDLASVDDVPGNGGHKPGKAVTASVYRAKIAGHSRVVTVSWSRDFLSHAFSVGISGADGASAECKVELRSWEFWRRAGARRXXELVGXGPRSAXFPFCWDSRRAPFXGGCPTPRFLRWRQV

SEQ ID NO: 127311 - protein, 56 aa, Triticum aestivum
  Clone ID: PAT_TA_21729.pep
DLMYAKRAFVPWYVGEGMEEGEFSEAREDLAALEKDYEEVGAEFDEGEDGDEGDEY

SEQ ID NO: 127312 - protein, 165 aa, Triticum aestivum
  unsure (1)..(165): unsure at all Xaa locations
  Clone ID: PAT_TA_21730.pep
MAAFLRSKCSPVGRTLMGSLGNSLFGAANSSVGAITRPSHCDAISQQIXRTFIQMRTNLKVVXDNSXGAKPVRCIHSXXGKKGXRXGKXXNRFXKEAHPRGKVKKGDVVYGVVVRAAMKKGRSDGSESVRRQRVVLVNKXGXLXXXRVFGPSPQLRKKNTQDLAC

SEQ ID NO: 127313 - protein, 75 aa, Triticum aestivum
  Clone ID: PAT_TA_21731.pep
TTSFLARLVSHKSLIDTGLPQGFPCGWSVYVILPGPFHEFIREHLILTYCNVNSQIHIGVFLRRCSAGQHLCLPE

SEQ ID NO: 127314 - protein, 138 aa, Triticum aestivum
  unsure (1)..(138): unsure at all Xaa locations
  Clone ID: PAT_TA_21732.pep
EIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAXGLLALRERRMKVTHADFKKAKEKVMYKKKEXVPDGLYM

SEQ ID NO: 127315 - protein, 150 aa, Triticum aestivum
  Clone ID: PAT_TA_21733.pep
KEGFAIKAGWPVADTPDPTLRIANKYLQDSIVLMRKLLQKQESGSKKPKKGAAPAPPSEEKKMSIGLIYVNEHYSGWKEQCLRVLQSKFDSQSRSFSPDQGNSRTSEGVPHPGKEMNLEAGQELCMPFIKAGRRTRQGVGLQALGLNFIR

SEQ ID NO: 127316 - protein, 106 aa, Triticum aestivum
  Clone ID: PAT_TA_21734.pep
TNVTTFLPFRDYTLIIRMFHPYDSHYTTTSYSFFHSCALVITVVVRFTSHKHSIQDTVSSQIRSIRPLSLLDTQVTGGREAAADSWFNDEIRCRKHEPVNLKGGSS

SEQ ID NO: 127317 - protein, 97 aa, Triticum aestivum
  Clone ID: PAT_TA_21735.pep
CFPSHECWCRKASAWIRCSFHYYHEQLILIKFQAARDFISLLYFLPSLLCFNQFLIGIVQRSCAPEQDPRYQWHYPLHAAPYMLRREPPFRWALAVG

SEQ ID NO: 127318 - protein, 121 aa, Triticum aestivum
  Clone ID: PAT_TA_21736.pep
PADKVLASSLVEVVDIIREAKDRMAVEFSRFAGEETDQDPFQMTFNYESIYVSDWSKLGFSEVDYGFGPPIFAGPLVNNDFIASVVFLKAPLPLDGTRMLASCVTKEHSEEFARGMKEDLP

SEQ ID NO: 127319 - protein, 67 aa, Triticum aestivum
  Clone ID: PAT_TA_21737.pep
PNNHTLHLHILPTLTTHGDQTKRQGIFFFLLPFRAKRIRQEPTSLARPVSRPGQTCLASQGQGLQGG

SEQ ID NO: 127320 - protein, 154 aa, Triticum aestivum
  Clone ID: PAT_TA_21738.pep
DLQTKPPKTRASIPSPTEAKHATDHRPRRDHLLYNSSSWPCSSSCIGDCGGVEIRADIVRLLRSLPTIDGLTFTNRRVQQGSSSSVSDRDLRVHSGRHLHRQTVRTPPISKRREREAGDGADKFRSKLMSITDLSSDAQPAQCPPRGCRCLSSV

SEQ ID NO: 127321 - protein, 170 aa, Triticum aestivum
  Clone ID: PAT_TA_21739.pep
MAAAALRPAILRRIRLSPSPSLALAAAGTGASHPHALGRWLARPMSSHDAHLTRDEVIDRILDVIKSHPKIDPSKVTPEAHFEKDLGLDSLGHRRGGSWPSRRIQVEGRDMEADKIDHPFWASISSQPTNGCLPQEQFKLLVLFPKAITAGDRNFSSACLTYGIFQMELI

SEQ ID NO: 127322 - protein, 110 aa, Triticum aestivum
  unsure (1)..(110): unsure at all Xaa locations
  Clone ID: PAT_TA_21740.pep
TLSIEDPAVPIRLEVFDKDTFVDDTMGNAEVDIRPLVEIVKMKLQDVADRTVVKKLVPNRQNCLAEESSIYISXGKVKQDMGCTAXRNVESGEIELQLQXGIDLPGSKGV

SEQ ID NO: 127323 - protein, 141 aa, Triticum aestivum
  Clone ID: PAT_TA_21741.pep
LTYVKNGPLVEPAQEKDLPPQMKGLLKWYKGYIKNKNAKEYIYAEVRYEHHFKHYYVQIHLSELFQLFNLRELDKSIISCYVLMKIKECRVRNIHDVGFIDPHIVNGYVLEHHPADMEADLWQFLTKQELKSDILFPYHFG

SEQ ID NO: 127324 - protein, 170 aa, Triticum aestivum
  unsure (1)..(170): unsure at all Xaa locations
  Clone ID: PAT_TA_21742.pep
MASAGAGEGKETAAGSSLHSKTLLKSQPLYQYILESTVFPREPDCLRELRVATATHPMAGMAASXDEVQLLQLLIEILGRXRTPXEVGVFTGVLRCSATAPALPDDGKIXGHRRYPAXSYDQIGXPGXSKKAGVAHKIDFRVRLPLPVLDQXVAXEGNKASPTPVRGRDK

SEQ ID NO: 127325 - protein, 92 aa, Triticum aestivum
  unsure (1)..(92): unsure at all Xaa locations
  Clone ID: PAT_TA_21743.pep
SDEDKERVPFYMSILTTMKFLVKGKSVDFISCEGSSPTSAATTLITSEFLIPLFLPRFFLLPSASKMHXLSHSTLSQRNAXENSMDLILFIE

SEQ ID NO: 127326 - protein, 107 aa, Triticum aestivum
  unsure (1)..(107): unsure at all Xaa locations
  Clone ID: PAT_TA_21744.pep
NRRWGDNGYIRGGRKEARPVNTDVAAGPSRTPKKKEKAASSSASVSVSGPGSGSGSVSKXVAGGXAKRAQKREAADKAAAENTLNTCKRFGAAEIPQTCICRRKFHR

SEQ ID NO: 127327 - protein, 141 aa, Triticum aestivum
  unsure (1)..(141): unsure at all Xaa locations
  Clone ID: PAT_TA_21745.pep
PTARFAGGRPGWYFSMLSALLSRYRRLKQSFFSLSAFWTSSFHHQVSLSSLLLPLDTPNSSEATLRMQVAIFIHTLSASPPSSQRALLNDPLLEHLELPPPWSFHHFXSKRPWHAYPAGHESESGSQQPPTYAGVPRPRPR

SEQ ID NO: 127328 - protein, 161 aa, Triticum aestivum
  Clone ID: PAT_TA_21746.pep
MASAVSSLFFATALVMMALMIMLEGSTTCHAARHLADTTTAPTAAPTAIPAIPAMPKPPVVPTVPAATLPPIPAVPTSTVPALGVPPIPALPKIPAVPPMPAVPALPKVTVTLPPPMPAVVVPKVGALPPMPAVPKLTLPPMPSIPGVPMPFVAPPPPIIN

SEQ ID NO: 127329 - protein, 76 aa, Triticum aestivum
  unsure (1)..(76): unsure at all Xaa locations
  Clone ID: PAT_TA_21747.pep
WEQGEPPITTWAQMKDVMPTYYNCDLFKKLQLLKQGKKSVEEYXKEMEIAMIQANVTEDDEQTMARFLEWPQIILS

SEQ ID NO: 127330 - protein, 57 aa, Triticum aestivum
  Clone ID: PAT_TA_21748.pep
RRLERPSGWWSGSGQRCRWRWGSSDSHANVDQFSESILYWFYPSRVRTAPSVISILR

SEQ ID NO: 127331 - protein, 51 aa, Triticum aestivum
  Clone ID: PAT_TA_21749.pep
KEFFFSFLPCAVAETLNHQHQASTELSDVCSSIHHQCNTTDCNIWNLKDRN

SEQ ID NO: 127332 - protein, 124 aa, Triticum aestivum
  Clone ID: PAT_TA_21750.pep
RLPRRQRLHRTEQFHALLPGILPRKKRCTTSSSVSEAPTLPELAESSSTYAGQRQLCCSSLPSGDGGPRPSFSYEAPRSTINAYRRHAQASPQDRSRDEGEDLLRCCGYLLPTATNFPQQTIAR

SEQ ID NO: 127333 - protein, 112 aa, Triticum aestivum
  unsure (1)..(112): unsure at all Xaa locations
  Clone ID: PAT_TA_21751.pep
LWCISSLGXLLDQXGLPXQTGKFLXWYFSGLIVGYAVAFSLRILRCSLRGRAWSTCVVVPCAMYIWGLLLFFGWLKEVSFMNYGTSGKSPREKILSNEPMTTKIPGKMYSSA

SEQ ID NO: 127334 - protein, 44 aa, Triticum aestivum
  Clone ID: PAT_TA_21752.pep
FKSKQHLFMIKPYAVARIVLGNGEHNWSMKPAQSRLTTQTIQIL

SEQ ID NO: 127335 - protein, 132 aa, Triticum aestivum
  unsure (1)..(132): unsure at all Xaa locations
  Clone ID: PAT_TA_21753.pep
MVRVSVLNDALKSMYNAEKIGKRQVMIRPSSKVIIKFLTVMQRHGYIGEFEYVDDHRAGKIVVELNGRLNKCGXLLSPRFDVGVKEIEGWTARLLPSRQFGXYIVLTTSAGIMDHEEXRRKNVGGKXLGSFY

SEQ ID NO: 127336 - protein, 35 aa, Triticum aestivum
  Clone ID: PAT_TA_21754.pep
AVKANILGINLNLPIDLSLILNNCGKNCPNDFHCA

SEQ ID NO: 127337 - protein, 198 aa, Triticum aestivum
  unsure (1)..(198): unsure at all Xaa locations
  Clone ID: PAT_TA_21755.pep
VVSAGVKSILDIPRTLEYLETEGVTVAAYRTNEFPAFFTEISGCQVPCRVDSPEECAKIIYANKNLRLXSGILIAVPIPKQHATSGKIIESAIQTALKEAGDKRIIGNAITPFMLERVKELTGRISLXANIALGKEQCPMGANIAVALSNLQQERNSRMGRSPCRVRPRWSTQEQFRMELLKERCVRKKVAHLTYSGT

SEQ ID NO: 127338 - protein, 87 aa, Triticum aestivum
  Clone ID: PAT_TA_21756.pep
GREEMMGRWPGSRWLRRSGRRGRGRAVAVVTAEGISDGERRRRGRSRGFGASERSGLNLLKGVGDGGAVGHDGTARGRRWARLLRRG

SEQ ID NO: 127339 - protein, 191 aa, Triticum aestivum
  unsure (1)..(191): unsure at all Xaa locations
  Clone ID: PAT_TA_21757.pep
DCGAGAGNGTAANVCDPSLVHTAITLDEEYLRGSVAAVHSVVQHARCPESVFFHFLVSDPSLGDLVRAVFPQLRFKVYYFDPGRVRGLISTSVRQALXEQPLNYARNYLARPPPSPGVRRXVIYLGSDLVLRRTNVAKLWRHRLGXRTSGAPEYWQPNFTKYXTGGLAGHAPAALPGRGVYLTQQGLLNVR

SEQ ID NO: 127340 - protein, 191 aa, Triticum aestivum
  unsure (1)..(191): unsure at all Xaa locations
  Clone ID: PAT_TA_21758.pep
EFQVGPTVGISAGDQVWVARYLLERITEIAGVVVTFDPKPIPXDWNGAGAHTNYSTXESMRKDGGFKVIVDAVEKLKLKHKEHIAAYGEGNERRLTGKHETADINTFSWVRRAPRLLVLDHLNLSTSRYSDSGSESSEXLQGVANRGASVRVGRETEQNGKGYFEDRRPASNMDPYVVTSMIAETNILWKP

SEQ ID NO: 127341 - protein, 219 aa, Triticum aestivum
  Clone ID: PAT_TA_21759.pep
MSSPLLVAMAAAAIVVACCLAACPVGAGASAGDFYDNFVVKWGTDPDPDRRVEIVDGGRLVTLTLNNVSGAGFQSRDAFLFGEFTMEMKLVPGDSAGTVTTFYLTSKDPTAAGDGHDEIDFEFLGNVSGEPYLMQTNVFAQGVGGREQRSYLWFDPTEDFHNYTILWNPLNIIFSVDGVPVRVFRNHDANGVPYLSRQAMKVHATIWDGDTWATRGGRV

SEQ ID NO: 127342 - protein, 178 aa, Triticum aestivum
  Clone ID: PAT_TA_21760.pep
MYPNDRTTVGLISVPLILDGQGLPTPTKSGSWGGSGGSARDINQKSWRLTSLTVSYKGLIDAFSFSYIDQAGKKQSVGPWGEGYYNDTTKTISFGPAEFVKEVCGAYGNHNGIVIVKFLTFVTNEGTYGPFGTPDHPGPDVSATHFRFVADEGSTIVGFYGRSGRYIDAIGVYTVRVR

SEQ ID NO: 127343 - protein, 94 aa, Triticum aestivum
  unsure (1)..(94): unsure at all Xaa locations
  Clone ID: PAT_TA_21761.pep
MDTQVKLAVVVKVMGRTGXRGQVTQVRXKFLDDQNRLIMRNVKGPVREGDILTLLESEREAKEAALRNFFLHTCLSSGRRMMYCCLLCLLSFFA

SEQ ID NO: 127344 - protein, 67 aa, Triticum aestivum
  Clone ID: PAT_TA_21762.pep
SSGRPGRYSDGSYGVPAGLIYSFPVTCSGGEWTIVQGLPIDEFSRKKMDATAQELSEEKALAYSCLA

SEQ ID NO: 127345 - protein, 92 aa, Triticum aestivum
  Clone ID: PAT_TA_21763.pep
VVAAEVWEFQVGPTVGISAGDQVWVARYLLERITEIAGVVVTFDPKPIPGDWNGAGAHTNYSTQSTHIHPSLASMQRVDRGKKRKLQALVDK

SEQ ID NO: 127346 - protein, 102 aa, Triticum aestivum
  Clone ID: PAT_TA_21764.pep
HHHVHYFMNIDLGVLVAILCYLQYIISYYHNRRKILLRKTKQPLENKSCIACLQLDAGSRLNGHIPVWSKAKILLPKRTTPVMNKAKSLEPILSVNKERTSN

SEQ ID NO: 127347 - protein, 177 aa, Triticum aestivum
  unsure (1)..(177): unsure at all Xaa locations
  Clone ID: PAT_TA_21765.pep
MIRPSSKVIIKFLIVMQKHGYIGEFEYVDDHRSGKIVVELNGRLNKCGVISPRFDVGVKEIXEGWTARLLPSPSVWATSVLTTSAXGIMDHEEARRKNVGGKVLGFSYWSGICESVFQDRCDRMLLKTQGVYFLPCILHPLLCYVGSGNMDFEFKKRGAGTPLYITASRPRTTETYN

SEQ ID NO: 127348 - protein, 112 aa, Triticum aestivum
  unsure (1)..(112): unsure at all Xaa locations
  Clone ID: PAT_TA_21766.pep
MVRVSVLNDALKSMYNAEKRGKXRQVMIRPSSKVIIXFLIRPCKKHGYIGXFXTFDDHSPGNSLFEXNGKLNKFGVIXPPFDVXVFKEFXGWDCRSFLXRXFGYIGNFGWIN

SEQ ID NO: 127349 - protein, 65 aa, Triticum aestivum
  Clone ID: PAT_TA_21767.pep
MDTQVKLAVVVKVMGRTGSRGQVTQVRVKFLDDQNRLIMRNVKGPVREGDILTLLESEREARRLR

SEQ ID NO: 127350 - protein, 267 aa, Triticum aestivum
  unsure (1)..(267): unsure at all Xaa locations
  Clone ID: PAT_TA_21768.pep
LICLIEEQLGLTNYLLCVFCWLQGCDASVLLSGNEQNAGPNAGSLRGFGVIDGIKAQVEAVCKQTVSCADILAVAARDSVVALGGSSWTVPLGRRDHXANAGLANSDIPXGPGSSRAQLEAAFLKKGLDTVDMVALSGAHTIGRAQCSSFRSRIYGGDTNINAAYAASLRANCPQSGGNGNLAPLDATTPNTFDNAYYTDLLSQKGLMHSDQVLFNGDTTDYTVRNFASNPAAFSSAFTTAMIKIGNIAPLTGAQGQIRLSCSKVNS

SEQ ID NO: 127351 - protein, 79 aa, Triticum aestivum
  Clone ID: PAT_TA_21769.pep
VDTLRNPSSVLRACAAFALLQFTMPAGRHAVQHAALLQKAGASRVLRWAAAAATAPIEAKIFARIVLRNLELHQAGPST

SEQ ID NO: 127352 - protein, 180 aa, Triticum aestivum
  unsure (1)..(180): unsure at all Xaa locations
  Clone ID: PAT_TA_21770.pep
MAMRAWRRSAAARAPAHLCLWLALVAATLVLAQVLIHLGKKSNLSEVTHKVYFDIEIDGKPAGRVVMGLFGKAVPKTAENFRALCTGEKGMGNSGKPLHYKGSSFHRIIPSFMIQGGDFTLGDGRGGESIYGTKFADENFKLKHTGPGYLSMANAGXNTNGSQFFITTVTTSWLDGKHVV

SEQ ID NO: 127353 - protein, 74 aa, Triticum aestivum
  Clone ID: PAT_TA_21771.pep
VLGPPKGTFVSRGVYSDGSNGGPAGFIYSFPVTSSGGEWPIVQGLPIDEFSRKKMDPPPQKLSKKKALAYSCLG

SEQ ID NO: 127354 - protein, 263 aa, Triticum aestivum
  unsure (1)..(263): unsure at all Xaa locations
  Clone ID: PAT_TA_21772.pep
MAASASCISLVVLVALATAASAQLSPTFYSVSCPGALAAIKSAVTAAVSSDPRMGASLLRLHFHDCFVQGCDASVLLSGNEXQNAGPNAGSLRGFGVIDGIKAQVEAVCKQTVSCADILAVAARDSVVALGGPSWTVPLGRRDSTGANAGLANSDLPGPGSSRAQLEAAFLKKGLDTVDMVALSGAHTIGQAQCSSFRSRIYGGDTNINAAYAASLRANCPQSGGNGNLAPLDTTTPNVFDNAYYTDLLSQKGLMHSDQVLXN

SEQ ID NO: 127355 - protein, 65 aa, Triticum aestivum; identical to SEQ ID NO: 127349
  Clone ID: PAT_TA_21773.pep

SEQ ID NO: 127356 - protein, 65 aa, Triticum aestivum
  unsure (1)..(65): unsure at all Xaa locations
  Clone ID: PAT_TA_21774.pep
MDTQVKLAVVVKVMGRTGSRGQVTQVRVKFLDXKNRLIMRNVKGPVREGDILTLLESEREARRLR

SEQ ID NO: 127357 - protein, 69 aa, Triticum aestivum
  unsure (1)..(69): unsure at all Xaa locations
  Clone ID: PAT_TA_21775.pep
MAMRAWRRSAAARAPAHLCLWLALVAATLVLAQGKKSNLSEVTHKVYFDIEIDGKAXASRVVMGLFGKA

SEQ ID NO: 127358 - protein, 204 aa, Triticum aestivum
  unsure (1)..(204): unsure at all Xaa locations
  Clone ID: PAT_TA_21776.pep
ATGQLSSTFYDTSCPRALATIKSGVAAAVSSDPRMGASLLRLHFHDCFVQGCDASVLLSGMEQNAGPNVGSLRGFGVIDSIKTQLESICKQTVSCADILTVAARDSVVALGGPSWTVPLGRRDSTTASAALANSDSXPGSSRSQLEAXFLKKNLTRRMVXLKAAHIXKPMSNFPTPIYGGDTTSNCTLPRQRPPTEGNWTRRPN

SEQ ID NO: 127359 - protein, 68 aa, Triticum aestivum
  unsure (1)..(68): unsure at all Xaa locations
  Clone ID: PAT_TA_21777.pep
MDTQVKLAVVVKVMGRTGSRGQVTQVRVKFLDXKNRLIMRNVKGPVREGDILTLLESEREAKEGCAEP

SEQ ID NO: 127360 - protein, 107 aa, Triticum aestivum
  Clone ID: PAT_TA_21778.pep
MAPASSFPIIDMGLLAGEERPAAMDLLHDACENWGFFQVLDHGISTELMDEVEKMTKGHYKRVREQRFLEFASKTLQDGGRAAENLDWESTFFVRHLPEPNIAEIPD

SEQ ID NO: 127361 - protein, 67 aa, Triticum aestivum
  Clone ID: PAT_TA_21779.pep
IHRPLSIRIVHTFTLFITAQKWMEDYLLLLAFNSRWNDDEMKDERTFERLCFVLKKSSLYLPGRPLR

SEQ ID NO: 127362 - protein, 75 aa, Triticum aestivum; identical to SEQ ID NO: 116116
  Clone ID: PAT_TA_21780.pep

SEQ ID NO: 127363 - protein, 233 aa, Triticum aestivum
  Clone ID: PAT_TA_21781.pep
WYGIEQEYTLLQKDVSWPLGWPVGGYPGPQGPYYCAAGADKAFGRDVVDAHYKACLYAGINISGINGEVMPGQWEFQVGPSVGISAGDEIWVARYILERITEIAGIVLSLDPKPIQGDWNGAGAHTNYSTKSMREAGGYEVIKKAIEKLGKRHTEHIAAYGEGNERRLTGRHETADINTFKWGVANRGASIRVGRDTEREGKGYFEDRRPASNMDPYVVTGMIAETTILWNGN

SEQ ID NO: 127364 - protein, 163 aa, Triticum aestivum
  unsure (1)..(163): unsure at all Xaa locations
  Clone ID: PAT_TA_21782.pep
MAASLWREAMGAGAPAADAEFLDYIEFWHQPECAGWLDQQGEHSKAWRRXRWFVLKQGMLFWFKDSDVDHASXVPRGVIFLASCLAVKGAEGVPDRKFAFELSTPGETMYFAADSEEQKEEWINSIVLPLAAPAGTTWDEIFHTVDMLRAGFGAGGLDPSAGE

SEQ ID NO: 127365 - protein, 196 aa, Triticum aestivum
  Clone ID: PAT_TA_21783.pep
MAIPANAAVSLNFPVINMEKLETGERGAAMEVIHDACQNWGFFELLNHGISAELMDEVERVSKAHYAACREDKFKEFAAKTLEAGEKGADVKDVDWESTFFVRHLPASNLADLPDLDHHYRQVMKEFASEIEKLAEKVLDLLCENLGLEPGYLKRAFAGSRGPTFGTKVSSYPPCPRPDLVDGLRAHTDAGGVILL

SEQ ID NO: 127366 - protein, 102 aa, Triticum aestivum
  Clone ID: PAT_TA_21784.pep
KTRPQNRLDLAKETENTKHFAEINQWPPSIEKVESLSVVRRCGRHWLLVAQSSEEEGGLGDHGGDDVGVHVGGRPAVLEVARVRPRTSKGITDLLLPQTSVA

SEQ ID NO: 127367 - protein, 104 aa, Triticum aestivum
  Clone ID: PAT_TA_21785.pep
QLAGGGVRKWRPAWEGAMKRQGRESLPNLLLRWHTPADGSSACAAQRGHAHGSLGAAMRLTSGGAKLRSRPWRWLVLVSGLGNGGRWRWILAGNKERRGGRERE

SEQ ID NO: 127368 - protein, 108 aa, Triticum aestivum
  Clone ID: PAT_TA_21786.pep
QLAGGGVRKWRPAWEGAMKRQGRESLPNLLLRWHTPADGSSACAAQRGHAHGSLGAAMRFDVGWREAPQPSMALAASEGFRLYSFQLPDTNAPGIVIYCHYLPRVRIG

SEQ ID NO: 127369 - protein, 218 aa, Triticum aestivum
  Clone ID: PAT_TA_21787.pep
MAMRAWRRSAAARAPAHLCLWLALVAATLVLAQVLIHLGKKSNLSEVTHKVYFDIEIDGKPAGRVVMGLFGKAVPKTAENFRALCTGEKGMGNSGKPLHYKGSSFHRIIPSFMIQGGDFTLGDGRGGESIYGTKFGDENFKLKHTGPGYLSMANAGRDTNGSQFFITTVTTSWLDGKHVVFGKVLSGMDVVYKVEAEGKQNGTPKSKVVIADSGEVPL

SEQ ID NO: 127370 - protein, 130 aa, Triticum aestivum
  Clone ID: PAT_TA_21788.pep
ELVQSLLPLVDSFEKTNVEITLETEKEQKISASYQGIYKQLVETLKNLGVGVVETVGKPFDPVVHEAIAREESTEFKAGIVSHEVHRGFLLRERVLRPAAVKVSNGPGDQNVSSTSSEEPVEDTKEDAAV

SEQ ID NO: 127371 - protein, 102 aa, Triticum aestivum
  Clone ID: PAT_TA_21789.pep
HGCMSVKDWVCKHACNVVACPEGCKERCLKTTTVIHGSLVLAGGGVSSQRQSSEPKAARAKAETFYIQNSQTCTLIPKRRSAATLAFLLKRSWQQQQPPSKA

SEQ ID NO: 127372 - protein, 200 aa, Triticum aestivum
  unsure (1)..(200): unsure at all Xaa locations
  Clone ID: PAT_TA_21790.pep
MAIPANAAASLSFPVINMEKLETEERGAAMGVIGDACENWGFFELLNHGISHELMDEVERVSKAHYAACREQQFKVFRGADAGGRAKKGADVKDVDWGRAHLSSATSPPSNLXPTCPDFDHHYRQVMKEFASEIEKLAEKVLDLLCENLGLELGYLKRAFAGSRGPTFGTKVSSYPPCPRPDLVDGLRAHTDAGGVILLF

SEQ ID NO: 127373 - protein, 48 aa, Triticum aestivum
  Clone ID: PAT_TA_21791.pep
AGRFGVAKEGVMSLFKGAGANILRGVAGAGVLSIYDQLQVLLFGKAFK

SEQ ID NO: 127374 - protein, 362 aa, Triticum aestivum
  unsure (1)..(362): unsure at all Xaa locations
  Clone ID: PAT_TA_21792.pep
MSPLAELLSLDLSGCTGKIIAEYIWVGGTGMDVRSKARTLPGPVDDPSKLPKWNFDGSSTGQATGDDSEVILCPQAIFRDPFRKGNNILVICDCYAPNGEPIPSNKRYNAARIFGHPDVKDEEPWYGIEQEYTLLQKDTNWPIGWPLGGYPGPQGPYYCAVGAEKSYGRDIVDAHYKACLYAGINIGGINAEVMPGQWEFQVGPSVGISAGDELWAARYILERITEIAGVVVSFDPKPIXGEWNGAGAHTNYSTKSMRSEGGYEVIKKAIQKLEARHMEHIAAYGEGNERRLTGRHETADINTFVWGVANRGASVRVGRDTEKEGKGYFEDRRPASNMDPYVVTSMIAETTILSKAGLSNGK

SEQ ID NO: 127375 - protein, 107 aa, Triticum aestivum
  Clone ID: PAT_TA_21793.pep
RLCSLPAEIHFYLPPFPKPPTSTISSSTAPTTVSFLLPIFLVLYLSPMPYPLPSPSQAPDAMDGRGASRHQTSTASPPQGIRARGRLSRPHARSIRRCVPPQQLVPQ

SEQ ID NO: 127376 - protein, 88 aa, Triticum aestivum
  Clone ID: PAT_TA_21794.pep
SKEGYLPLDYISVTPPYVEVNYSTLLDQLARSPLVGEDCFILVEYPLKTDMPESCGKLIKIADRKFGRTNLLIYGPTWSEKKKGRILR

SEQ ID NO: 127377 - protein, 243 aa, Triticum aestivum
  Clone ID: PAT_TA_21795.pep
MALPANAAASLSFPVINMEKLETEERGAAMEVIHDACENWGFFELLNHGISHELLDEVERVSKAHYACREEKFKEFAARTLEAGEKGADVKDVDWESTFFVRHLPASNLADLPDLDHHYRQVMKEFAAEIEKLAEKVLDLLCENLGLEQGYLKRAFAGSRGPTFGTKVSSYPPCPRPDLVAGLRADAVIFPAPALVEELSEEEAERAGSAVYPRFVFEDYMNLYLLHKFEAKEPCFQAMKADA

SEQ ID NO: 127378 - protein, 189 aa, Triticum aestivum
  Clone ID: PAT_TA_21796.pep
GRDIVDAHYKACIYAGINISGINGEVMPGQWEFQVGPSVGISSGDQVWVARYILERITEIAGVVLTFDPKPIPGDWNGAGAHTNYSTKSMRNEGGYEVIKAAIEKLKLRHKEHIAAYGEGNERRLTGRHETADINTFSWGVANRGASVRVGRETEQNGKGYFEDRRPASNMDPYVVTSMIADTTILWKP

SEQ ID NO: 127379 - protein, 80 aa, Triticum aestivum
  unsure (1)..(80): unsure at all Xaa locations
  Clone ID: PAT_TA_21797.pep
MDTQVKLAVVVKVMGRTGSRGQVTQVRVKFLDXKNRLIMRNVKGPVREGDILTLLESEREAKEAALKNFFLYTCLSWEEE

SEQ ID NO: 127380 - protein, 158 aa, Triticum aestivum
  Clone ID: PAT_TA_21798.pep
EIALVGTSSQGSSKIVKFEGARRLAFKHIEAFVLTFSDPQMFSTAASSSGAAALSQVAEALFIQEAGHLRCSRAEIARFVDTLRNPSSVLRACAAFALLQFTMPAGRHAVHHAALLQKAGASRVLRVAAAAATAPIEAKIFARIVLRNLELHQAGPST

SEQ ID NO: 127381 - protein, 177 aa, Triticum aestivum
  unsure (1)..(177): unsure at all Xaa locations
  Clone ID: PAT_TA_21799.pep
MAMGSASCISLVVLVALATAASGQLSSTFYDTSCPRALATIKSGVAAAVSSDPRMGASLLRLHFHDCFVQGCDASVLLSXGMEQNAGPNVGSLKGFXVIDNIXKTQLGEYMQANVSCADIXNVAARDPLLPLEGLMDCSLGKRDQQRKRLAGEHELLGQAPVKAQARSKKNLHVTWL

SEQ ID NO: 127382 - protein, 99 aa, Triticum aestivum
  Clone ID: PAT_TA_21800.pep
ISSGRPGRSNLEFFFFFFNQVSNCFTLAANVLSCKSSGKRGATSLIHTHLGKPNEKEHASPMCGCSGWRREFLKSGRFHLFKTSRGAAALPMWIYARHE

SEQ ID NO: 127383 - protein, 78 aa, Triticum aestivum
  unsure (1)..(78): unsure at all Xaa locations
  Clone ID: PAT_TA_21801.pep
MGGGNAQKSKMARERNLEKLKGGKGSQLEANKKAMNIQCKICMQTFICTTSEAKCKEHAXEAKHPKSELVXCFPHLKQ

SEQ ID NO: 127384 - protein, 315 aa, Triticum aestivum
  unsure (1)..(315): unsure at all Xaa locations
  Clone ID: PAT_TA_21802.pep
FKVVSKTAALPAAWHGTSQGAQGRSSVAFGSAWRKASSRPARALFAATNNSAPVARVEKQRIDQSQILTLDSIRTSLIRLEDSIIFGLLERAQYCYNADTYDSDSFHVDGFGGSLVEFMVRETEKLHAKVGRYKSPDEHPFFPEDLPETLLPPIQYPTVLHPIADSININKEIWKMYFDEVLPRLVKEGSDGNSGSSALCDTXCLQALSKRIHYGKFVAEAKFQESPEDYTPAIKAQDGAQLMQLLTYETVERAIEHRVETKAKIFGQEVNIGAEAKGMAPVYKIRPSLVAGLYGNRIMPLTKDVQVAYLLRRLD

SEQ ID NO: 127385 - protein, 379 aa, Triticum aestivum
  unsure (1)..(379): unsure at all Xaa locations
  Clone ID: PAT_TA_21803.pep
MVVPVIDFSKLDGAERAETMAQIADGCENWGFFQLVNHGIPLELLDRVKKVCSESYRLREAAFRSSEPVQTLERLVDAERRGEPVAPVDDMDWEDIFYLHDDNQWPSDPPAFKETMREYRAELKKLAERVMEAMDENLGLDKGRMKAAFTGDGLHAPFFGTKVSHYPPCPRPDLITGLRAHTDAGGVILLFQDDKVGGLEVLKDGEWLDVQPLADAIVVNTGDXQVEVLSNGRYRSAWHRVLPMRNGNRRSIASFYNPAFEAAISPAVGEGRAXAYPDYVFGDYMDVYNKQKFNAKEPRSEAVKGAKGSLSLISWRLHDNYLPISWLLFYNEEKKMFPGRWVLQCLVGDLGRFAGDWASMPCFPSRFPLIPSPLSYLLF

SEQ ID NO: 127386 - protein, 120 aa, Triticum aestivum
  Clone ID: PAT_TA_21804.pep
AYAFNTRPLARTPCHKPAVYYLSSARSAEAARGGETTVTRYERWRPANETRPACRWNITDPDAHLDHIVVLKRPDPGIWDRSPRRNCCRVLSSPKVGKEGKKTMTIDVGVCRDGEFSQVV

SEQ ID NO: 127387 - protein, 301 aa, Triticum aestivum
  unsure (1)..(301): unsure at all Xaa locations
  Clone ID: PAT_TA_21805.pep
MAMGSASCISLVVLVALATAASGQLSSTFYDTSCPRALAAIKSGVAAAVSSDPRMGASLLRLHFHDCFVQGCDASVLLTGMEQNAGPNVGSLRGFGVIDNIKTQLESICKQTVSCADILTVAARDSVVALGGPSWTVPLGRRDSTTASASLANSDLPGPSSSRSQLEAAFLKKNLNTVDMVXALSGAHTIGKAQCSNFRTRIYGGDTNINTAFATSLXANCPQSGGNTNLGELDTMTXNAFDNAYYNNSCQKKGLLTRTKCXNNDTXDNTVRNLRQSGGFNNASTXGMXXMGKLXPXTGSK

SEQ ID NO: 127388 - protein, 180 aa, Triticum aestivum
  unsure (1)..(180): unsure at all Xaa locations
  Clone ID: PAT_TA_21806.pep
PTPTRLPSSATCLPALSQPAMALLTDLLNLDLTDSTEKIIAEYIWIGGSGMDLRSKARTLPGPVTDPSKLPKWXNYDGSSTGQAPGEDSEVILYPQASSKDPFKEXGNNILVMCDCYTPAGXPIPTNKRYNAAKSLXNPDVAKEXPWYGIDKSTXLLQKDINGPLGWLLWLPGXQGPYYC

SEQ ID NO: 127389 - protein, 292 aa, Triticum aestivum
  unsure (1)..(292): unsure at all Xaa locations
  Clone ID: PAT_TA_21807.pep
RRIHYGGNLLRLPRRLRRRRKPYQTPPANPNRAGRPTCCSETQPPSPHLPLFPAPQCKRCGRSASLALTRKIVNGEDFPPMNDLIRLYKKAFLDGNDDVVSDIEKAITSMEEERSKATXKLESITAEIASGKNKFLRLNADLENFRKQAXKDRAKFTSNIQVELVQNLLPLVDSFEKTNVEVTLETEKEQKISTSYQGIYKQLVETLKSLGVGVVETVGKPFDPVVHEAIAREESTEFKAGIVSHEVHRGFLLRERVLRPAAVKVSTGPGDQIAGATSSEEPVEDTKEDAAV

SEQ ID NO: 127390 - protein, 54 aa, Triticum aestivum
  Clone ID: PAT_TA_21808.pep
NSLVISVVAAEVSKSRTHHLCSPSVYLKLMDGTEVEMSDMCLLFSLPCRNLIPS

SEQ ID NO: 127391 - protein, 308 aa, Triticum aestivum
  Clone ID: PAT_TA_21809.pep
MERLQRIFSGATGMGQPGSDSPLLDSSEQVYISSLALLKMLKHGRVGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFCLINPQTMMLGQEPRQTTSNVGHLNKPSIQALIHGLNRHYYSIAINYRKNELEEKMLLNLHKKKWTDGLILKKFDTHSKTNEETVQEMLSLAIKYNKAVQEEDELPPEKLAIANVGRQDAKKHLEEHVSNLMSSNIVQTLGTMLDTVVF

SEQ ID NO: 127392 - protein, 280 aa, Triticum aestivum
  unsure (1)..(280): unsure at all Xaa locations
  Clone ID: PAT_TA_21810.pep
MASTLSFPIIDMGLLXGDERPAAMNLLHDACENWGFFQVLXHGISTELMDEVEKMTKEHYKRVREQRFLEFASKTLEDGGKAAENLDWESTFFVRHLPEPNIAEIPDLDDDYRRVMKQFASELERLAERLLDLLCENLGLEKGYLTRAFRGSKGAPTFGTKVSSYPPCPRPDLVNGLRAHTDAGGIILLFQDDRVGGLQLLRDGEWVDVPPTRHSIVVNLGDQLEVITNGRYKSVLHRVVAQTDGNRMSIAFFYNPGSDAVIFPAAALVEAEAAGVDAAA

SEQ ID NO: 127393 - protein, 321 aa, Triticum aestivum
  unsure (1)..(321): unsure at all Xaa locations
  Clone ID: PAT_TA_21811.pep
MAPASSFPIIDMGLLAGEERPAAIDLLHDASENWGFFQVLDHGISTELMDEVEKITKGXHYKRVREQRFLEFASKTLEDGGRAAENLDWESTFFVRHLPEPNIAEIPDLDEEYRRVMKQFAAELERLAERLLDLLCENLGLEKGYLTRAFRGSKGVPTFGTKVSSYPPCPRPDLVKGLRAHTDAGGIILLFQDDRVGGLQLLRDGEXWVDVPPTRHSIVVNLGDQLEVITNGRYKSVLHRVVAQADGNRMSIASFYNPASDAVIFPAPALAEAEAAGGAYPRFVFEDYMKLYVRHKFEDKEPRFEAFKSMESQSTKLIATA

SEQ ID NO: 127394 - protein, 65 aa, Triticum aestivum; identical to SEQ ID NO: 127349
  Clone ID: PAT_TA_21812.pep

SEQ ID NO: 127395 - protein, 137 aa, Triticum aestivum
  unsure (1)..(137): unsure at all Xaa locations
  Clone ID: PAT_TA_21813.pep
KRGNGKNPGVPKLNPFEKNPLFPSWGKKKKAPPNPLSKNLPTLKGKGNPPCTGPLTPGGVGVTPRGTVTFARPLAPVLLVFFLSFFATFAGFPRKVLNGGLLLGFQLXGLTAPHPKKICLGGGFTKGPIPLKNGFSP

SEQ ID NO: 127396 - protein, 235 aa, Triticum aestivum
  unsure (1)..(235): unsure at all Xaa locations
  Clone ID: PAT_TA_21814.pep
SSFASASSTSTILASSCSAALASSSSFTSALSTVFMLPTLHSSALAPMSSLASSSSFTSALSTVFMLPTLHSSALALMSSFASASSTPPSLCFADLVXSSSFATTSSIAAVLESSCSAALAPLPSLASALSPDLTPSVPACFTAPTSSSFASSASSILASSSDEPLAPFSEALLCWLALVFAAATSLLSPASSILVLSFLSEATTSVDVPPFCHSLQLHYWCQVCPGHPGDPYSS

SEQ ID NO: 127397 - protein, 331 aa, Triticum aestivum
  Clone ID: PAT_TA_21815.pep
MAIPADAAVSLNFPVINMEKLETGERGAAMEVIRDACENWGFFELLNHGISHELMDEVERVSKANYTACREGQFKEFAARTLEAGDKGADVKDVDWESTFFVRHLPASNLADLPDLDHHYRQLIKEFASEIEKLAEKVLDLLCENLGLEQGYLKRAFAGSRGPTFGTKVSSYPPCPRPDLVDGLRAHTDAGGVILLFQDDQVSGLQLLKDGAWVEVPPMRHAIVVNIGDQLEVITNGRYKSVMHRVLTRADGNRMSIASFYNPGADAVIFPAPALVAAAGATEKNEGEEGGAVYPKFVFEDYMNLYVRHKFEAKEPRFKAMKADAAPIATA

SEQ ID NO: 127398 - protein, 113 aa, Triticum aestivum
  Clone ID: PAT_TA_21816.pep
CLSPVPHASAPSQPRSTSTSRRSPSRRRAPSQAPPPYLRLLPPAYIPRSLSIPYASSLALSLSGPDAMDGCGASRHPSSAASPPQGIRAHGRLSRPRARSIRPCVPPQQQVRQ

SEQ ID NO: 127399 - protein, 384 aa, Triticum aestivum
  Clone ID: PAT_TA_21817.pep
RSGISGRPTRPDKEAMDCYTEVLGEGSKVRFEAVSYNMVLDALGRNGRLDDAVELFDRMCKEHDPPRRIAVNLGSFNVMVDAYCRVERFQDAIEVFGKMGEKSCTPDALSYNSLIDWLGKNELVGEAEGLYKEMGERGINPDEYTYVLLIESCFRVGNVDDAVGYFNKMFDVGLRPNANAFNKVISGLVKVDRIDEAQRFFDLMPEREVKPNIASYESLLRAYINVARLDDAIKMAKGILLDESIVFTDELKALLYGALQKEGRNGDMTKLYEDVETEKAEAAARAAEEKARAEALAKEEEEKKKAEAKAKEESAARASRAAIDAVLGRKSGAENGESSQEMSVEEAQVVESHSDAVGVAEQNEGDDQKKEFGDAASQVIASSF

SEQ ID NO: 127400 - protein, 137 aa, Triticum aestivum
  unsure (1)..(137): unsure at all Xaa locations
  Clone ID: PAT_TA_21818.pep
IQKRPGNNECFQSKLLAFSRSPPRRAVGIGKKKVNEKDRARGIFFTQDWVSMPGVIPVASGGIHVWHMPALTEIFGDDSVLQFGGGTLGHPWGNAPGAAANRVGFRSLCTKLVTKGRDLARXEGNEIIPKQACKWES

SEQ ID NO: 127401 - protein, 315 aa, Triticum aestivum
  unsure (1)..(315): unsure at all Xaa locations
  Clone ID: PAT_TA_21819.pep
MAMGSASRISLVVLVALATAASGQLSSTFYDTSCPRALATIKSGVAAAVSSDPRMGASLLRLHFHDCFVQXGCDASVLLSGMEQNAGPNVGSLRGFGVIDNIKTQLESICKQTVSCADILTVAARDSVVALGGPSWTVPLGRRDSTTASASLANSDLPGPSSSRSQLEAAFLKKNLNTVDMVALSGAHTIGKAQCSNFRTRIYGGDTNINTAFATSLKANCPQSGGNTNLENLDTTTPNAFDNAYYTNLLSQKGLLHSDQVLFNNDTTDNTVRNFASNAAAFSSAFTTAMIKMGNIAPLTGTQGQIRLSCSKVNS

SEQ ID NO: 127402 - protein, 206 aa, Triticum aestivum
  Clone ID: PAT_TA_21820.pep
NLGPWDHTVVEKRLNENTVSLTTKGSPQLCQLCEQFATETLFYLKENETRIEIIDTLHQACLKFHSLKLECTKLVDYYAALFFEQIDSLSPEEFCVSASLCEEVTYIRLPGHEHACTLCHEVVDEIRAGLEDPEMELKIIEILLKGCNNTESFVQKCKKMIIQNTPVILEDIKKFLKKRDFCDSIRVCGGKIVRPRGGGLRGMYTA

SEQ ID NO: 127403 - protein, 319 aa, Triticum aestivum
  unsure (1)..(319): unsure at all Xaa locations
  Clone ID: PAT_TA_21821.pep
MAPASSFPIIDMGLLAGEERPVAMDLLHDACVNWGFFQVLDHGISTELMDEVEKMTKEHYKRVREQRFLEFASKTLEGGGRAAENLDWESTFFVRHLPEANIAEIPDLDDDYRRVMKQFAAELERLAERLLDLLCENLGLEKGYLTRAFRGSKGVPTFGTKVSSYPPCPRPDLVKGLRAHTDAGGIILLFQDDCVGGLQLLKDGEWVDVPPTRHSXIVVNLGDQLEVITNGKXYRGVLHRVVAQADGNRMSIASFYNPASDAVIFPAPALAEAAGGAYPRFVFEDYMKLYVRHKFDDKEPRFEAFKSMESQSTKLIATA

SEQ ID NO: 127404 - protein, 331 aa, Triticum aestivum
  Clone ID: PAT_TA_21822.pep
MAIPANAAVSLNFPVINMEKLETGERGAAMEVIHDACKNWGFFELLNHGISHKLMDEVERVSKAHYAACREDKFKEFAARTLEAGEKGADVKDVDWESTFFVRHLPASNLADLPDLDHHYRQVMKEFASEIEKLAEKVLDLLCENLGLEQGYLKRAFAGSRGPTFGTKVSSYPPCPRPDMVDGLRAHTDAGGVILLFQDDQVSGLQLLKDGAWVDVPPMRHAIVVNIGDQLEVITNGRYKSVMHRVLTRPDGNRMSIASFYNPGADAIIFPAPALVGAADAAERNEGEEGTAVYPRFVFEDYMNLYVRYKFEAKEPRFKAMKADAAPIATA

SEQ ID NO: 127405 - protein, 259 aa, Triticum aestivum
  Clone ID: PAT_TA_21823.pep
MVTFTGHDVRATLSHSTHEHGLKLVAMDKLFQCDGCRQIGDELRFRCEQCDFDLHICCAQSPTRVEPSMFEGRALTLFQSRPASANNPGGVIPICGVCGDPVCGFLYHNREHDLDLHPMCAFLPKRVRVEEHELELHQAAGHNCGLCGKDGYLGKYMAYRFQDDDGQLAYVHVVCLMEASYSSDGHVVQGTSTTTGELATLRNAPRRSGGFRRFCKVAFRIVRVSYSVATLDPRGSFHSDCKLTSRLAYRIVTIPVIYS

SEQ ID NO: 127406 - protein, 197 aa, Triticum aestivum
  Clone ID: PAT_TA_21824.pep
TKSSVLHSQPKSTVGTPAYIAPEVLLKKEYDGKIADVWSCGVTLYVMLVGAYPFEDPENPKNFKVTIQKILGVQYSIPDYIHIPMDCRNLLSRIFVANPATRITIPEIKNHPWFLKNLPADLMDGPTVSNQYEEPDQPMQNMNEIMQIMAEATIPAAGALGINKFLPDGLDLDDDMDDLDSDLDIDMDSSGEIVYAM

SEQ ID NO: 127407 - protein, 382 aa, Triticum aestivum
  unsure (1)..(382): unsure at all Xaa locations
  Clone ID: PAT_TA_21825.pep
SARGPPHPTRLPSSATLRALSQPAMALLTDLLNLDLTDSTEKIIAEYIWIGGSGMDLRSKARTLPGPVTDPSKLPKWNYDGSSTGQAPGEDSEVILYPQAIFKDPFRKGNNILVMCDCYTPAGVPIPTNKRYNAAKIFSNPDVAKEEPWYGIEQEYTLLQKDINWPLGWPVGGFPGPQGPYYCSIGADKSFGRDIVDSHYKACLFAGVNISGINGEVMPGQWEFQVGPTVGISAGDQVWVARYLLERITEIAGVVVTFDPKPIPGDWNGAGAHTNYSTESMRKDGGFKXVIVDAVEKLKLKHKEHIAAYGEGNERRLTGKHETADINTFSWGVANRGASVRVGRETEQXTGKGYFEDRRPASNMDPYVVTSMIAETTILWKP

SEQ ID NO: 127408 - protein, 132 aa, Triticum aestivum
  Clone ID: PAT_TA_21826.pep
AKNESGRVRRQQYIILLPKTDRYKGRNFLAQPPGLPLGLEQGEDVALTDGPLDVPHDETVLVIKELDSHLGHLTPRPRATHHLDNHRELHLSIHAFLGCWRWGSLLLLRRRRRRRKLLLLQRTEAAARGGRK

SEQ ID NO: 127409 - protein, 155 aa, Triticum aestivum
  Clone ID: PAT_TA_21827.pep
KKKKKKKKKKKKKKKKKKKKKKNHDVAVKGFWEMYDPEGYSLWFCDYKYQEENTVSYVTLNKVGGFLQRMDLCRKYAFGKMLVIGSEAPFKVKGLWLFRGQDIPEFVMNEVYDMELYEWTKVDLSDEAQKKRVEAMIEDLEPFEGQALLDAKCFK

SEQ ID NO: 127410 - protein, 316 aa, Triticum aestivum
  unsure (1)..(316): unsure at all Xaa locations
  Clone ID: PAT_TA_21828.pep
MAMGSASCISLVVLVALATAATGQLSSTFYDTSCPRALATIKSGVAAAVSSDPRMGASLLRLHFHDCFVQGCDASVLLSGMEQNAGPNVGSLRGFGVIDSIKTQLESICKQTVSCADILTVAARDSVVALGGPSWTVPLGRRDSTTASAALANSDLPGPGSSRSQLEAAFLKKNLNTVDMVALSGAHTIGKAQCSNFRTRIYGGDTNINTAFATSLKANCPQSGGNGNLANLDTTTPNTFDNAYYTNLLSQXKGSWHSDQVLFNNDTNDNTVRXNFASNAAAFSSAFTTAMIKMGNIAPLTGTQGQIRLSCSKVNS

SEQ ID NO: 127411 - protein, 130 aa, Triticum aestivum
  Clone ID: PAT_TA_21829.pep
DADEEENEEDEDDGEMGVDDEDQDEVNSLNIQKLVQARGFQLHDEDDDDDDSDDDFSDDEELQTPIDEVDPFIFFVGTIQAVQASDPARFQSLMQTLDFHYQALANGVAQHAEERKVEIEKEKLEKANAQ

SEQ ID NO: 127412 - protein, 331 aa, Triticum aestivum
  unsure (1)..(331): unsure at all Xaa locations
  Clone ID: PAT_TA_21830.pep
MAIPANAAASMSFPMINMEKLETEERGAAMEVIQDACENWGFFELLNHGISHELMDEVERVSKAHYAACREEQFKEFAAKTLEAGEKGADVKDVDWESTFFVRHLPASNLADLPDLDHHYRQVMKEFASEIERLAEKVLDLLCENLGLEQGYLKRAFAGSXGPTFGTKVSSYPPCPRPDMVDGLRAHTDAGGVILLFQDDQVSGLQLLKDGAWVDVPPMRHAIVVNIGDQLEVITNGRYKSVMHRVLTRHDGNRMSIASFYNPGADAVIFPAPALVGAADAAERNEGEEGTAVYPRFVFEDYMNLYVRHKFEAKEPRFKAMKADAAPIATA

SEQ ID NO: 127413 - protein, 288 aa, Triticum aestivum
  Clone ID: PAT_TA_21831.pep
MAATYCAYPAASAAAAANPTRRRLQTLTAPGALPAARKPSRQPPSFLSFRRPNAALPPLRVAGADPQVVNGEDFPPMNDLIRLYKKAFLDGNEDVVSDIEKAITSMEEERSKAASQFESITAEIASGKNKFLRLNADLENFRKQTEKDRAKFTSNIQVELVQSLLPLVDSFEKTNVEVTLETEKEQKISASYQGIYKQLVETLKNLGVGVVETVGKPFDPVVHEAIAREESTEFKAGIVSHEVHRGFLLRERVLRPAAVKVSNGPGDQNVSSTSSEEPVEDTKEDAAV

SEQ ID NO: 127414 - protein, 65 aa, Triticum aestivum; identical to SEQ ID NO: 127349
  Clone ID: PAT_TA_21832.pep

SEQ ID NO: 127415 - protein, 318 aa, Triticum aestivum
  unsure (1)..(318): unsure at all Xaa locations
  Clone ID: PAT_TA_21833.pep
MEFKVASKAAALPAACHGTSQGAQGRSSVAFGSAWRKASSRPARALFAATNNSAPVAKVEKQXRIDQSQILTLDSVRTSLIRXEDSIISVSLGETQYCXNADTYDSNSFHVDGFGGSLVEFMVRETEKLHAKVGRYKSPDEHPFFPEDLPETLLPPIQYPTVLHPIADSININKEIWKMYFDEVLPRLVKEGSDGNSGSSALCDTTCLQALSKRIHYGKFVAEAKFQESPEDYTPAIKAQDGAQLMQLLTYETVERAIEHRVETKAKIFGQEVNIGAEAKGMAPVYKIRPSLVAGLYSNRIMPLTKDVQIAYLLRRLD

SEQ ID NO: 127416 - protein, 320 aa, Triticum aestivum
  Clone ID: PAT_TA_21834.pep
PRNEMKRDMPVGTDAASYRAPAPAPDAATSAAAAQPPPGYVYAQMQPQQQLQQPPQQQLQQQQQLQQQQQLQQQAQQQLPQQIQQQPQQQLPPQLQQQAQQQQAQQQPPQPQQAHQPAPQQYVTAGNQHFIHNPATGTFIPIQSYYQQTVPQQAPQQQQSPAFDPNTGMYYIPMQRPNAPQQYSIPAGAVAPMAAPTLVDSVPKPTVPIPQQYMKPELQQPGMYRTAAPAAPAPGANTAPNYAGMGYHHVMQSHHHPASQPPPTMAGNYGYPEYAADPRAQVFYSQAGAPPASLPPQYQLPMGAPDASGQADMNQNRGGS

SEQ ID NO: 127417 - protein, 329 aa, Triticum aestivum
  Clone ID: PAT_TA_21835.pep
MALPANAAASLSFPVIHMEKLETGERGATMGVIRDACENWGFFELLNHGISHELMNEVERVSKAHYAACREDKFKEFAAKTLEAGEKGADVKDVDWESTFFVRHLPASNLADLPDLDHHYRQVMKEFAAEIEKLAEKVLDLLCENLGLEQGYLKRAFAGSRGPTFGTKVSSYPPCPRPDLVAGLRAHTDAGGVILLFQDDQVSGLQLLKDGAWVDVPPMRHAIVVNIGDQLEVITNGRYKSVMHRVLTRPDGNRMSLASFYNPGADAVIFPAPALVEELSEEEAERAGSAVYPRFVFEDYMNLYMRHKFEAKEPRFEAMKADAAPIATA

SEQ ID NO: 127418 - protein, 311 aa, Triticum aestivum
  unsure (1)..(311): unsure at all Xaa locations
  Clone ID: PAT_TA_21836.pep
MSRPLLAMAAAAIVVACCFAACPVGAGASAGGFYDNFVVKWGTDPDPDRRVEIVDGGRLVTITLNNVSGAGFQSRDAFLFGEFTMEMKLVPGDSAGTVTTFYLTSKDPTAVGDGHDEIDFEFLGNVSGEPYLMQTNVFAQGVGGREQRSYLWFDPTEDFHNYTILWNPLNIIFSVDGVPVRVFRNHDANGVPYLTRQAMKVHATIWDGDTWATRGGRVKIDWAHAPFVASYGTYAASACVSAGRQRRSGRSAVGXCCPGDAPSWMARRLGPDGERAVAWARDKYMVMDYCDDPWNLGRPAECDMDRLASAV

SEQ ID NO: 127419 - protein, 122 aa, Triticum aestivum
  Clone ID: PAT_TA_21837.pep
HASAEGYSLWFCDYKYQEENTVSYVTLNKVGGFLQRMDLCRKYAFGKMLVIGSEAPFKVKGLWLFRGQDIPEFVMNEVYDMELYEWTKVDLSDEAQKKRVEAMIEDLEPFEGQALLDAKCFK

SEQ ID NO: 127420 - protein, 231 aa, Triticum aestivum
  Clone ID: PAT_TA_21838.pep
MSPLADLLSLDLSGCTGKIIAEYIWVGGTGMDVRSKARTLPGPVDDPSKLPKWNFDGSSTGQATGDDSEVILCPQAIFRDPFRKGNNILVICDCYAPNGEPIPSNKRYNAARIFGHPEVKAEEPWYGIEQEYTLLQKDTNWPIGWPLGGYPGPQGPYYCAAGAEKSYGRDIVDAHYKACLYAGINIGGINAEVMPGQWEFQVGPSVGISAGDELWAARYILERITEIAGVV

SEQ ID NO: 127421 - protein, 157 aa, Triticum aestivum
  Clone ID: PAT_TA_21839.pep
AWSRPRYGLHPVEFGGNTGSGSFNGGLNFESIQNGQFKPADPKAASCFLYDSLKPVLLTGNLEGNFLASFLLGWTVTTGAGIASYPLDTVRRRMMMTSGEAVKYKSSFDAASQIVAKEGVKSLFKGAGANILRGVAGAGVLSIYDQMQLLMFGKKFK

SEQ ID NO: 127422 - protein, 312 aa, Triticum aestivum
  Clone ID: PAT_TA_21840.pep
MAMGSASCISLVVLVALATAASGQLSSTFYDTSCPRALVAIKSGVAAAVSSDPRMGASLLRLHFHDCFGCDASVLLTGMEQNAGPNVGSLRGFGVIDNIKTQLESVCKQTVSCADILTVAARDSVVALGGPSWTVPLGRRDSTTASASLANSDLPGPSSSRSQLEAAFLKKNLNTVDMVALSGAHTIGKAQCSNFRTRIYGGDTNINTAFATSLKANCPQSGGNTNLANLDTMTPNAFDNAYYTNLLSQKGLLHSDQVLFNNETTDNTVRNFASNAAAFSSAFTTAMIKMGNIAPLTGTQGQIRLSCSKVNS

SEQ ID NO: 127423 - protein, 392 aa, Triticum aestivum
  Clone ID: PAT_TA_21841.pep
VEMIDKEPNRSFVVEKGRGTPLKDIPSVAQRLTRKKPADLKFLHNVLFGRKGKTVDFKGHILQFSGFVWHESDEKQRAKAKEKLDKCMKDMLVDLCWLLAIPVPKTNIRKEDIVAKLLDFIAEPHAMPDSGLSDDQGSNSRKRKRGGGSSSKTSDITPKRSKKKFADDISPRRKQALEYDTDEDVKSDSEEDADESHDEQEDGYDSAEEKASRKSSEVKYSAGRKKAAAGSTHRTSPPRTASKTAGKTSPSKGSKEKESPDESAKVFSRKKKPIISKHTPSSEKVIEENKSSGKEAMKSKGESAEGGLPSKAELKKTIIGILKKVDFNTSTFSDILKKLDDHYKIDLTARKGAIKIMIQEELTKLSEQEDDDQDKNADAKKKQSRHRAKVTG

SEQ ID NO: 127424 - protein, 158 aa, Triticum aestivum
  Clone ID: PAT_TA_21842.pep
MAASLWRAVMGSSSSPSSGGGDDPAAGGVEFWHGAERAGWLTKQGEYIKTWRRRWFVLKQGRLFWFKDAAVTRGSVPRGIIPVSSCLTVKGAEDVLNRQFAFELSTPAETMYFIADAEKEKEEWINSIGRSIVQHSRSVTDAEVVDYDSRRPAAGGKS

SEQ ID NO: 127425 - protein, 65 aa, Triticum aestivum; identical to SEQ ID NO: 127349
  Clone ID: PAT_TA_21843.pep

SEQ ID NO: 127426 - protein, 65 aa, Triticum aestivum; identical to SEQ ID NO: 127349
  Clone ID: PAT_TA_21844.pep

SEQ ID NO: 127427 - protein, 308 aa, Triticum aestivum
  Clone ID: PAT_TA_21845.pep
MVVPVIDFSKLDRVERAETMAQIADGCENWGFFQLVNHGIPLELLDRVKKVCSESYRLREAAFRSSEPVQTLERLVEAERRGEAVAPVDDMDWEDIFYLHDDNQWPSDPPAFKETMREYRAELKKLAERVMEAMDENLGLDKGRMKAAFTGDGLHAPFFGTKVSHYPPCPRPDLITGLRAHTDAGGVILLFQDDKVGGLEVLKDGEWLDVQPLADAIVVNTGDQVEVLSNGRYRSAWHRVLPMRNGNRRSIASFYNPAFEAAISPAVGEGGATAYPDYVFGDYMDVYNKQKFDAKEPRFEAVKAPKAA

SEQ ID NO: 127428 - protein, 314 aa, Triticum aestivum
  unsure (1)..(314): unsure at all Xaa locations
  Clone ID: PAT_TA_21846.pep
MSSPLLVAMAAAAIVVVCCFAACPVSAGASAGGFYDNFVVKWGTDPDPDRRVEIVDGGRLVTLTLNNVSGAGFQSRDAFLFGEFTMEMKLVPGDSAGTVTTFYLTSKDPTAAGDGHDEIDFEFLGNVSGEPYLMQTNVFTQGVGGREQRSYLWFDPTEDFHNYTILWNPLNIIFSVDGVPVRVFRNHDANGVPYLSRQAMKVHATIWDGDTWATRGGRVKIDWXHAPFVASYGTYAASACVSAAGNDDQEGAPSAFCCPGDASSWMARRLGPDGERAVAWARDNYMVMDYCDDPWNLGRPAECDMDQLQLASVV

SEQ ID NO: 127429 - protein, 95 aa, Triticum aestivum
  Clone ID: PAT_TA_21847.pep
MWIPRAAGIRHQAEAACAAASVVSEAAGESMDTQVKLAVVVKVMGRTGSRGQVTQVRVKFLDDQNRLIMRNVKGPVREGDILTLLESEREARRLR

SEQ ID NO: 127430 - protein, 484 aa, Triticum aestivum
  unsure (1)..(484): unsure at all Xaa locations
  Clone ID: PAT_TA_21848.pep
QHSRSGVPNSGPAEDQRANQQKLAAAARHQHDVQSVPDSPMLDKNSSFGSTSSAPSLSNLPPIRVRPEDRQPVAPPVSVEDHFAQMGISEQQGLPPPVMGYMQPPPQAPIPAMAMQAASSISPSEPPSRAFSDDDRSDHGGRMQQPPKQEVPPTADPNNRAMFYNDMSPRNEMKRDMPVGTDAASYRAPAPAPDAAASAAAAQPPPGYVYAQMQPQQQLQQPPQQQLQQQQQLQQQQQLQQQAQQQLPQQIQQQPQQQLPPQLQQQAQQQPPQPQQAHQPAPQQYVTAGNQHFIHNPATGTFIPIQSYYQQTVPQQAPQQQQSPAFDPNTGMYYIPMQXPNAPQQYTIPAGAVAPMAAPTLVDSVPKPTVPIPQQYMKPELQQPGMYRTAAPAAPAPGPNTTPNYAGMGYHHVMQSHHHPASQPPPTMAXGNYGYPEYAADPRAQVFYSQAGAPPASLPPQYQQPMGAPDAGGQADMNQNRGGS

SEQ ID NO: 127431 - protein, 77 aa, Triticum aestivum
  Clone ID: PAT_TA_21849.pep
MGGGNAQKSKMARERNLEKLKGGKGSQLEANKKAMNIQCKICMQTFICTTSEAKCKEHAEAKHPKSDLVQCFPHLKP

SEQ ID NO: 127432 - protein, 346 aa, Triticum aestivum
  unsure (1)..(346): unsure at all Xaa locations
  Clone ID: PAT_TA_21850.pep
MVVPVIDFSKLDGAERAETMAQIADGCENWGFFQLVNHGIPLELLDRVKKVCSESYRLPRGGVPVVRAGADAGEAGGDGAARRGRWRPVDDMDWEDIFYLHDDNQWPSDPPAFKETMREYRAELKKLAERVMEAMDENLGLDKGRMKAAFTGDGLHAPFFGTKVSHYPPCPRPDLITGLRAHTDAGGVILLFQXDDKVGGLEVLKDGEWLDVQPLPDAIVVNTGDQVEVLSNGRYRSAWHRVLPMRNGNRRSIASFYNPAXEAAISPAVGEGAAAAYPDYVFGDYMDVYNKQKFDAKEPRFEAVKAPKGSLILIKEIKRKLFTLPISWLCFTMKKKIVFLEFIQDA

SEQ ID NO: 127433 - protein, 131 aa, Triticum aestivum
  unsure (1)..(131): unsure at all Xaa locations
  Clone ID: PAT_TA_21851.pep
MVRVSVLNDALKSMYNAEKRGKRQVMIRPSSKVIIKFLIVMQKHGYIGEFEYVDDHRSGKIVVELNGRLNKCGVIXPRFDVGVKEIEGWTRPGCFHLVKFGYIVLTTSAGIMDHEEARRKNVGGKVLGFFY

SEQ ID NO: 127434 - protein, 136 aa, Triticum aestivum
  Clone ID: PAT_TA_21852.pep
AKDKASVQEVDSNAVEFTSEDRKSSRSAQPPGLPLGLEQGEDVALTNRALDVPHDETVLVIQELHPDLGHLTPGAGPAHHLHHDCELDLGIHAFLGCWRRGIAASATTMEAAAQAHDIKLIDTVDLEGGPGTQFAL

SEQ ID NO: 127435 - protein, 64 aa, Triticum aestivum
  Clone ID: PAT_TA_21853.pep
PASQPPPTMAGNYGYPEYAADPRAQVFYSQAGAPPASLPPQYQLPMGAPDASGQADMNQNRGGS

SEQ ID NO: 127436 - protein, 316 aa, Triticum aestivum
  unsure (1)..(316): unsure at all Xaa locations
  Clone ID: PAT_TA_21854.pep
MAMGSASRISLVVLVALATAASGQLSSTFYDTSCPRALATIKSGVAAAVSSDPRMGASLLRLHFHDCFVQGCDASVLLSGMEQNAGPNVGSLRGFGVIDNIKTQLXESICKQTVSCADILTVAARDSVVALGGPSWTVPLGRRDSTTASASLANSDLPGPSSSRSQLEAAFLKKNLNTVDMVALSGAHTIGKAQCSNFRTRIYGGDTNINTAFATSLKANCPQSGGNTNLGEXWDTTTPNAFDNAYYTNLLSQKGXLHSGTKVLFNNDTTXDNTVRNFAXSNAGGFNNAFTTAXSKRGNIAPLTGXQGQXKLNCSK

SEQ ID NO: 127437 - protein, 164 aa, Triticum aestivum
  Clone ID: PAT_TA_21855.pep
EGNSTQFQEYFRRQTGEERKCLAQPPGLPLRLEQGEDVALPDRPLDVPHDETVLVVQELDSHLGHLTPGPGAAHHLDHHCELHLRIHAFFGCWRWGSLLLLRRRRRRRKVLLLVLQRTEAAAQGASACATTDGGGGARCFCLCYNGRRRRHREGGNKDVFEPGR

SEQ ID NO: 127438 - protein, 307 aa, Triticum aestivum
  Clone ID: PAT_TA_21856.pep
MERLQRIFGAGGMGQPPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKKFDAHSETNEQTVQEMLSLAIKYNKAVQEEDELSPEKLAIANVGRQDAKKHLEEHVSNLMSSNIVQTLGTMLDTVVF

SEQ ID NO: 127439 - protein, 308 aa, Triticum aestivum
  Clone ID: PAT_TA_21857.pep
MVVPVIDFSKLHGAERAETMAQIADGCENWGFFQLVNHGIPLELLDRVKKVCSESYRLREAAFRSSEPVQTLERLAEAERRGEAVAPVDDMDWEDIFYLHDDNQWPSDPPAFKETMREYRAELKKLAERVMEAMDENLGLDKGRMKAAFTGDGLHAPFFGTKVSHYPPCPRPDLITGLRAHTDAGGVILLFQDDKVGGLEVLKDGEWLDVQPLADAIVVNTGDQVEVLSNGRYRSAWHRVLPMRNGNRRSIASFYNPAFEVAISPAVGEGAAAAYPDYVFGDYMDVYNKQKFEAKEPRFEAVKAPKAA

SEQ ID NO: 127440 - protein, 803 aa, Triticum aestivum
  Clone ID: PAT_TA_21858.pep
MTGADLAPVMELKAVANGGTSTDVVASDKKDNTKMEEAGESKDVAVANTNANQQNKASENGAKGSSDDDAKMEEAEDAKEDDKAKAAEHDDHRTGGVAAEHKDHRTGGVEDADANEDIGAKAEEFKDGNMNTVDNADAKEDEYANASEHEDAKMVDVDDADAKEDYGTKVAEHEDVKMGAVEDTDAKEDNNTKEAEHQDIIMGAVKHADLKEDNSSNVAERVDVKMAEAETNPGDAELEDKGHKEEMDVNTEVKKGPRDAEKCGSEMHDELNGQGKNGAARQQENTAEEMSDDDSQGEEEVEEKGSSDKKEEGGDGKANENEEKLEKESANKEGKDGKVTEEEASEADKNVEENKEETPKNKRARSSRDRRQGQDKKQHGSKSREAKSLLYTPSPYGIDRPQRERKIVERLVEVIDKEPNRSFVVEKGRGTPLKDIPSVAQRLTRKKPADLKFLHNVLFGRKGKTVDFKGHILQFSGFVWHESDEKQRAKAKEKLDKCMKDMLVDLCWLLAIPVPKTNIRKEDIVAKLLDFIAEPRLMPDSGLSDDQGSNSRKRKRGGGSSSKTLDITPKRSKKKFADDISPRRKQALEYDTDEDVKSDSEEDADESHDEQEDGYDSAEDKANRKSSEVKYSAGKKKAAAGSTHRTSPPRTASKTAGKTSPSKGSKEKESPDESAKVFSRKKKPIISKHTPSSGKVIEENKSSGKEAMKSKGESAEGGLPSKAELKKTIIGILKKVDFNTSTFSDILKKLDDHYKIDLTARKGAIKIMIQEELTKLWEQEDDDQDKNVDAKMKQSRHRAKVAV

SEQ ID NO: 127441 - protein, 307 aa, Triticum aestivum; identical to SEQ ID NO: 127438
  Clone ID: PAT_TA_21859.pep

SEQ ID NO: 127442 - protein, 77 aa, Triticum aestivum
  Clone ID: PAT_TA_21860.pep
MGGGNAQKSKMARERNLEKLKGGKGSQLEANKKAMNIQCKICMQTFICTTSEAKCKEHAEAKHPKSELVQCFPHLKQ

SEQ ID NO: 127443 - protein, 65 aa, Triticum aestivum; identical to SEQ ID NO: 127349
  Clone ID: PAT_TA_21861.pep

SEQ ID NO: 127444 - protein, 129 aa, Triticum aestivum
  unsure (1)..(129): unsure at all Xaa locations
  Clone ID: PAT_TA_21862.pep
MVRVSVLNDALKSMYNAEKRGKRQVMIRPSSKVIIKFLIVMQKHGYIGEFEYVDDHXDKIVVELNGRLNKCGVISPRFDVGVKEIEGWTARLLPSRQFGYIVLTTSAGIMDHEEARRKNVGGKVLGFFY

SEQ ID NO: 127445 - protein, 308 aa, Triticum aestivum
  Clone ID: PAT_TA_21863.pep
MVVPVIDFSKLDGAERAETMAQIADGCENWGFFQLVNHGIPLELLDCVKKVCSESYRLREAAFRSSEPVQTLERLVEAERRGEAVAPVDDMDWEDIFYLHDDNQWPSDPPAFKETMREYRAELKKLAERVMEAMDENLGLDKGRMKAAFTGDGLLAPFFGTKVSHYPPCPRPDLITGLRAHTDAGGVILLFQDDKVGGLEVLKDGEWLDVQPLPDAIVVNTGDQVEVLSNGRYRSAWHRVLPMRNGNRRSIASFYNPAFEAAISPAVGEGAAAAYPDYVFGDYMDVYNKQKFDAKEPRFEAVKAPKAA

SEQ ID NO: 127446 - protein, 95 aa, Triticum aestivum
  Clone ID: PAT_TA_21864.pep
MSPPAYQVSVVMSTIGYVDDHRSGKIVVELNGRLNKCGVISPRFDVGVKEIEGWTARLLPSRQFGYIVLTTSAGIMDHEEARRKNVGGKVLGFFY

SEQ ID NO: 127447 - protein, 433 aa, Triticum aestivum
  unsure (1)..(433): unsure at all Xaa locations
  Clone ID: PAT_TA_21865.pep
MKLTIKRVPTVVSNYQEDAGERPRGGCGRNCLGHCCLPVSELPVYAFKANPTKLPLQEDAVPTDFFINLLLGQWEDRMTQGLFRYDVTACETKVIPGNLGFVAQLNEGRHLKKRPTEFRVDRVLQPFDSAKFNFTKVGQEEVLFQFENSGSDDSYFLRSAAVTVADRAPNVVAINVSPIEYGHVLLIXPRVLDHLPQRIDQESFLLALHMAXAEAARPYFRLGYNSLGAFATINHLHFQAYYLTVPFPVEKAATQRIPLAEGGIKSGVKVSKLMNYPVRGLVFEEGNTLNDLANVVSSACIWLQDNNVPYNVLISDSGRKIFLFPQCYAEKQALGDVSQELLDTQXVNPAVWEISGHIVLKRRDDYEEASEXRAWRLLAVVSLSEARFEEVKAYIFDAACLVQSQVDLEIDDAIYAPVPVGPSAVGEGCLVIP

SEQ ID NO: 127448 - protein, 77 aa, Triticum aestivum
  Clone ID: PAT_TA_21866.pep
MGGGNAQKSKMARERNLEKLKGGKGSQLEANKKAMNIQCKICMQTFICTTSEAKCKEHAEAKHPKSDLVQCFPHLKQ

SEQ ID NO: 127449 - protein, 308 aa, Triticum aestivum
  Clone ID: PAT_TA_21867.pep
MVVPVIDFSKLDGAERAETMAQIADGCENWGFFQLVNHGIPLELLDRVKKVCSESYRLREAAFRSSEPVQTLERLVEAERRGEAVAPVDDMDWEDIFYLHDDNQWPSDPPAFKETMREYRAELKELAERVMEAMDENLGLDKGRMKAAFTGDGLHAPFFGTKVSHYPPCPRPDLITGLRAHTDAGGVILLFQDDKVGGLEVLKDGEWLDVQPLPDAIVVNTGDQVEVLSNGRYRSAWHRVLPMRNGNRRSIASFYNPAFEAAISPAVGEGAAAAYPDYVFGDYMDVYNKQKFDAKEPRFEAVKAPKSA

SEQ ID NO: 127450 - protein, 401 aa, Triticum aestivum
  unsure (1)..(401): unsure at all Xaa locations
  Clone ID: PAT_TA_21868.pep
RNSARGSSAPHFQEHLSLPLLCPLHLHLRLREEEEEVAMSPLADLLSLDLSGCTGKIIAEYIWVGGTGMDVRSKARTLPGPVEDPSKLPKWNFDGSSTGQATGDDSEVILCPQAIFKDPFRRGNNILVICDCYAPNGEPIPSNKRYNAARIFGHPDVKAEEPWYGIEQEYTLLQKDTNWPIGWPLGGYPGPQGPYYCAXAGAEKSYGRDIVDAHYKACLYAGINIGGINAEVMPGQWEFQVGPSVGISAGDELWAARYILERITEIAGVVVSFDPKPIPGEWNGAGAHTNYSTKSMRSEGGYEVIKKAIKKLEARHMEHIAAYGEGNERRLTGRHETADINTFVWGVANRGASVRVGRDTEKEGKGYFEDRRPGSNMDPYVVTSLIAETTILCKAGLSNGK

SEQ ID NO: 127451 - protein, 183 aa, Triticum aestivum
  Clone ID: PAT_TA_21869.pep
EKNISCLTRLDHNRALGQISERLGVQVSDVKNAIIWGNHSSSQYPDVNHATVKTPSGEKPVRELVQDDEWLNGEFIATVQQRGAAIIKARKLSSALSAASSACDHIRDWVLGTPEGTFVSMGVYSDGSYGVPAGLIYSFPVTCSGGEWTIVQGLPIDEFSRKKMDATAQELSEEKALAYSCLA

SEQ ID NO: 127452 - protein, 65 aa, Triticum aestivum; identical to SEQ ID NO: 127349
  Clone ID: PAT_TA_21870.pep

SEQ ID NO: 127453 - protein, 183 aa, Triticum aestivum
  unsure (1)..(183): unsure at all Xaa locations
  Clone ID: PAT_TA_21871.pep
MGIVFTRLFSSVFGNREARILVLGLDNAGKTTILYRLQMGEVVSTIPTIXGFNVETVQYNNIKFQVWDLGGQTSIRPYWRCYFPNTQAIIYVVDSSDTDRLVTAKEEFHSILEEDELKGAVVLVYANKQDLPGALNDAAITESLELHKIKSRQWAIFKTSAIKGEGLFEGLNWLSNALKSGGS

SEQ ID NO: 127454 - protein, 149 aa, Triticum aestivum
  Clone ID: PAT_TA_21872.pep
MASRTFSAACLLALLVANTFLAGDACGSCKHQTPPPASPSPPPPSPSTTPCPPPSSGGGGGTSCPTDTLKLGACANVLGLVNVGVGKPPSGGGDKCCSLLGGLADLEAAVCLCTALKANVLGIVLNIPVKLSLLLNYCGKTAPKGFQCA

SEQ ID NO: 127455 - protein, 320 aa, Triticum aestivum
  unsure (1)..(320): unsure at all Xaa locations
  Clone ID: PAT_TA_21873.pep
MAMGSASCISLVVLVALATXAASGQLSSTFYDTSCPRALATIKSGVAAAVSSDPRMGASLLRLHFHDCFVQGCDASVLLSGMEQNAGPNVGXSLRGFSVIDSIKTQLESICKQTVSCADILTVAARDSVVALGGPSWTVPLGRRDSTTASASLANSDLPGPGSSRSQLEAAFLKKNLNTVDMVALSGAHTIGKAQCSNFRNRIYGGDTNINTAFATSLKANCPQSGGNSNLGEXLDTTTPNAFDNAYYTNLLSQKGLLHSDQVLFNNDTTDNTVXRNFASNAXAAFSSAFTTAMIKMGNIAPLXTGTQGQFRLNCSKVNX

SEQ ID NO: 127456 - protein, 137 aa, Triticum aestivum
  Clone ID: PAT_TA_21874.pep
VDSNAVEFTSEDRKSSRSAQPPGLPLGLEQGEDVALTNRALDVPHDETVLVIQELHPDLGHLTPGAGAAHHLHHDCELDLGIHAFFGCWRRGIAASATTTEAAAQAQVGRKKKKFFFFFFFFFFFFFFFFIFFFFFF

SEQ ID NO: 127457 - protein, 77 aa, Triticum aestivum
  Clone ID: PAT_TA_21875.pep
MGGGNAQKSKMARERNLEKLKGGKGSQLEANKKAMNIQCKICMQTFICTTSEAKCKEHAEAKHPKSDLVQCFPHLTP

SEQ ID NO: 127458 - protein, 348 aa, Triticum aestivum
  unsure (1)..(348): unsure at all Xaa locations
  Clone ID: PAT_TA_21876.pep
MASLADLVNLDLSDCTDKIIVEYLWIGGSGIDIRSKARTVNGPITDASQLPKWNYDGSSTGQAPGEDSEVILYPQAIFKDPFRRGDNLLVMCDCYTPQGVPIPTNKRHNAAKIFNTPKVAAEETWYGIEQEYTLLQKDVNWPLGWPIGGYPGPQGPYYCAAGADKAFGRDIVDAHYKACLYAGINISGINGEVMPGQWEFQVGPSVGIAASDQLWVARYILERXITEVAGVXVLSLDPKPIPGDWNGAGAHTNYSTKSMREAGGYGVIKTAIEKLGKRHAQHIAAYGEGNERRLTGHHETADINTFKWGVADRGGVHPRGPRHGEGRQGLLRGPQAGLQHGPVRPSPP

SEQ ID NO: 127459 - protein, 213 aa, Triticum aestivum
  Clone ID: PAT_TA_21877.pep
MAMRAWRRSAAARAPAHLCLWLALVAATLVLAQGKKSNLSEVTHKVYFDIEIDGKPAGRVVMGLFGKAVPKTAENFRALCTGEKGMGNSGKPLHYKGSSFHRIIPSFMIQGGDFTLGDGRGGESIYGTKFADENFKLKHTGPGYLSMANAGRDTNGSQFFITTVTTSWLDGKHVVFGKVLSGMDVVYKVEAEGKQNGTPKSKVVIADSGEVPL

SEQ ID NO: 127460 - protein, 147 aa, Triticum aestivum
  Clone ID: PAT_TA_21878.pep
MASRTFSAACLLALLVANTFLAGDACGSCKHKTPPPASPSPPPPSPSTTPCPPPSSGGGTSCPTDTLKLGACANVLGLVNVGVGKPPSGGGDKCCSLLGGLADLEAAVCLCTALKANVLGIVLNIPVKLSLLLNYCGKTAPKGFQCA

SEQ ID NO: 127461 - protein, 381 aa, Triticum aestivum
  unsure (1)..(381): unsure at all Xaa locations
  Clone ID: PAT_TA_21879.pep
RGRGRGPTRLPSSATCLPALSQPAMALLTDLLNLDLTDSTEKIIAEYIWIGGSGMDLRSKARTLPGPVTDPSKLPKWNYDGSSTGQAPGEDSEVILYPQAIFKDPFRKGNNILVMCDCYTPAGXPIPTNKRYNAAKIFSNPDVAKEEPWYGIEQEYTLLQKDINWPLGWXPVGGFPGPQGPYYCSIGADKSFGRDIVDAHYKACLFAGVNISGINGEVMPGQWEFQVGPTVGISAGDQVWVARYLLERITEIAGVVVTFDPKPIPGDWNGAGAHTNYSTESMRKDGGFKVIVDAVEKLKLKHKEHIAAYGEGNERRLTGKHETADINTFSWGVANRGASVRVGRETEQNGKGYFEDRRPASNMDPYVVTSMIAETTILWKP

SEQ ID NO: 127462 - protein, 130 aa, Triticum aestivum
  Clone ID: PAT_TA_21880.pep
MVRVSVLNDALKSMYNAEKRGKRQVMIRPSSKVIIKFLIVMQKHGYIGEFEYVDDHRSGKIVVELNGRLNKCGVISPRFDVGVKEIEGWTARLLPSRQFGYIVLTTSAGIMDHEEARRKNVGGKVLGFFY

SEQ ID NO: 127463 - protein, 307 aa, Triticum aestivum; identical to SEQ ID NO: 127438
  Clone ID: PAT_TA_21881.pep

SEQ ID NO: 127464 - protein, 213 aa, Triticum aestivum; identical to SEQ ID NO: 127459
  Clone ID: PAT_TA_21882.pep

SEQ ID NO: 127465 - protein, 130 aa, Triticum aestivum; identical to SEQ ID NO: 127462
  Clone ID: PAT_TA_21883.pep

SEQ ID NO: 127466 - protein, 213 aa, Triticum aestivum
  Clone ID: PAT_TA_21884.pep
MAMRAWRRSAAARAPAHLCLWLALVAATLVLAQGKKSNLSEVTHKVYFDIEIDGKPAGRVVMGLFGKAVPKTAENFRALCTGEKGMGNSGKPLHYKGSSFHRIIPSFMIQGGDFTLGDGRGGESIYGTKFGDENFKLKHTGPGYLSMANAGRDTNGSQFFITTVTTSWLDGKHVVFGKVLSGMDVVYKVEAEGKQNGTPKSKVVIADSGEVPL

SEQ ID NO: 127467 - protein, 354 aa, Triticum aestivum
  Clone ID: PAT_TA_21885.pep
MASLADLVNLDLSDCTDKIIVEYLWVGGSGIDIRSKARTVNGPITDASQLPKWNYDGSSTGQAPGEDSEVILYPQAIFKDPFRRGDNLLVMCDCYTPQGVPIPTNKRHNAAKIFNTPNVAAEETWYGIEQEYTLLQKDVNWPLGWPIGGYPGPQGPYYCAAGADKAFGRDIVDAHYKACLYAGINISGINGEVMPGQWEFQVGPSVGIAASDQLWVARYILERITEVAGVVLSLDPKPIPGDWNGAGAHTNYSTKSMREAGGYGVIKTAIEKLGKRHAQHIAAYGEGNERRLTGHHETADINTFKWGVADRGASIRVGRDTEKDGKGYFEDRRPASNMDPYVVTSMIAETTLLL

SEQ ID NO: 127468 - protein, 413 aa, Triticum aestivum
  Clone ID: PAT_TA_21886.pep
MALVLHSGSGNKNAFKALIAAEYCGVKVELTKNFEMGVSNKTPEFIKMNPLGKVPVLETPDGAVFESNAIARYVARSKGDNLLWGGSLIEYARVEQWMDFGATEVDPNIPRWLYPRLGYMPYNAQSEEFGIAGLKRALEALNTHLASNTFLVGHSVTLADIVMTCNLYHGFARILTKTFTSEFPHVERYFWTMVNQPNFKKVIGEFKQAEVVPPVQKKAAPAKQKEAKKEAPKAAPKPAVVEAPEEEAPKPKPKNPLDLLPPSKMVLDDWKRLYSNTKSNFHDVAVKGFWEMYDPEGYSLWFCDYKYQEENTVSYVTLNKVGGFLQRMDLCRKYAFGKMLVIGSEAPFKVKGLWLFRGQDIPEFVMKEVYDMELYEWTKVDLSDEAQKKRVEAMIEDLEPFEGQALLDAKCFK

SEQ ID NO: 127469 - protein, 354 aa, Triticum aestivum
  Clone ID: PAT_TA_21887.pep
MASLADLVNLDLSDCTDKIIVEYLWVGGSGIDIRSKARTVNGPITDASQLPKWNYDGSSTGQAPGEDSEVILYPQAIFKDPFRRGDNLLVMCDCYTPQGVPIPTNKRHNAAKIFNTPKVAAEETWYGIEQEYTLLQKDVNWPLGWPIGGYPGPQGPYYCAAGADKAFGRDIVDAHYKACLYAGINISGINGEVMPGQWEFQVGPSVGIAASDQLWVARYILERITEVAGVVLSLDPKPIPGDWNGAGAHTNYSTKSMREAGGYEVIKTAIEKLGKRHAQHIAAYGEGNERRLTGHHETADINTFKWGVADRGASVRVGRDTEKDGKGYFEDRRPASNMDPYVVTSMIAETTLLL

SEQ ID NO: 127470 - protein, 83 aa, Triticum aestivum
  Clone ID: PAT_TA_21888.pep
MLTNRIKPQKTALRAHLMMMPRWRKLKGGKGSQLEANKKAMNIQCKICMQTFICTTSEAKCKEHAEAKHPKSDLVQCFPHLKQ

SEQ ID NO: 127471 - protein, 378 aa, Triticum aestivum
  Clone ID: PAT_TA_21889.pep
RHEAPTRLPSSATCLPALSQPAMALLTDLLNLDLTDSTEKIIAEYIWIGGSGMDLRSKARTLPGPVTDPSKLPKWNYDGSSTGQAPGEDSEVILYPQAIFKDPFRKGNNILVMCDCYTPAGVPIPTNKRYNAAKIFSNPDVAKEEPWYGIEQEYTLLQKDINWPLGWPVGGFPGPQGPYYCSIGADKSFGRDIVDSHYKACLFAGVNISGINGEVMPGQWEFQVGPTVGISAGDQVWVARYLLERITEIAGVVVTFDPKPIPGDWNGAGAHTNYSTESMRKDGGFKVIVDAVEKLKLKHKEHIAAYGEGNERRLTGKHETADINTFSWGVANRGASVRVGRETEQNGKGYFEDRRPASNMDPYVVTSMIAETTILWKP

SEQ ID NO: 127472 - protein, 343 aa, Triticum aestivum
  Clone ID: PAT_TA_21890.pep
GTCGARSKGDNLLWGGSLIEYARVEQWMDFAATEVDPNIARWLYPRLGYRAFNAQDEEFGIAGLKRALEALNTHLASNTFLVGHSVTLADIVITCNLYHGFARILTKTFTSEFPHVERYFWTMVNQPNFKKVIGDFKQAEVVPPVQKKAAPAKPKEAKKEAPKAAPKPAEVEAPEEEAPKPKPKNPLDLLPPSKMVLDDWKRLYSNTKSNFHDVAIKGFWEMYDPEGYSLWFCDYKYQEENTVSYVTLNKVGGFLQRMDLCRKYAFGKMLVIGSEAPFKVKGLWLFRGQDIPEFVMNEVYDMELYEWTKVDLSDEAQKKRVEAMIEDLEPFEGQALLDAKCFK

SEQ ID NO: 127473 - protein, 329 aa, Triticum aestivum
  unsure (1)..(329): unsure at all Xaa locations
  Clone ID: PAT_TA_21891.pep
MALPANAAASLSFPVIHMEKLETGERGATMGVIRDACENWGFFELLNHGISAELMDEVERVSKAHYAACREEQFKEFAAKTLEAGEKGDDVKDVDWESTFFVRHLPASNLADLPDLDHHYRQVMKEFAAEIEKLAEKVLDLLCENLGLEQGYLKRAFAGSRGPTFGTKVSSYPPCPRPDLVAGLRAHTDAGGVILLFQDDQVSGLQLLKDGAWVDVPPMRHAIVVNIGDQLEVITNGRYKSVMHRVLTRPDGNRMSLASFYNPGADAVIFPAPALVEELSEEEAERAGSAVYPRFVFEDYMNLYLLHKFEAKEPRFXAMKADAAPIATA

SEQ ID NO: 127474 - protein, 130 aa, Triticum aestivum; identical to SEQ ID NO: 127462
  Clone ID: PAT_TA_21892.pep

SEQ ID NO: 127475 - protein, 130 aa, Triticum aestivum; identical to SEQ ID NO: 127462
  Clone ID: PAT_TA_21893.pep

SEQ ID NO: 127476 - protein, 77 aa, Triticum aestivum; identical to SEQ ID NO: 127442
  Clone ID: PAT_TA_21894.pep

SEQ ID NO: 127477 - protein, 115 aa, Triticum aestivum
  Clone ID: PAT_TA_21895.pep
MLDKLWDDVVAGPRPETGLDKLRRAAATQPLAINTAAGEAIKQSPSMPTTPTTPVTPSSSTPPRGGSVWRSVFHPGSNLATKSLGANLFDRPQPNSPTVYDWLYSDETRTRSNHR

SEQ ID NO: 127478 - protein, 333 aa, Triticum aestivum
  Clone ID: PAT_TA_21896.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERLGVQVSDVKNAIIWGNHSSSQYPDVNHATVKTSSGEKPVRELVQDDEWLNGEFIATVQQRGAAIIKARKLSSALSAASSACDHIRDWVLGTAEGTFVSMGVYSDGSYGVPAGLIYSFPVTCSGGEWTIVQGLPIDEFSRKKMDATAQELSEEKALAYSCLA

SEQ ID NO: 127479 - protein, 65 aa, Triticum aestivum
  unsure (1)..(65): unsure at all Xaa locations
  Clone ID: PAT_TA_21897.pep
AVAVDADDPDHAGDAVVVDAPARRQRVAERFPPREQXLATKSLGANLFDRPQPNSPTVYDWYAGS

SEQ ID NO: 127480 - protein, 333 aa, Triticum aestivum
  Clone ID: PAT_TA_21898.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERLGVQVSDVKNAIIWGNHSSSQYPDVNHATVKTPSGEKPVRELVQDDEWLNGEFIATVQQRGAAIIKARKLSSALSAASSACDHIRDWVLGTAEGTFVSMGVYSDGSYGVPAGLIYSFPVTCSGGEWTIVQGLPIDEFSRKKMDATAQELSEEKALAYSCLA

SEQ ID NO: 127481 - protein, 413 aa, Triticum aestivum
  Clone ID: PAT_TA_21899.pep
MALVLHSGSGNKNAFKALIAAEYCGVKVELPKNFEMGVSNKTPEFIKMNPLGKVPVLETPDGAVFESNAIARYVARSKGDNLLWGGSLIEYARVEQWMDFAATEVDPNIARWLYPRLGYRAFNAQDEEFGIAGLKRALEALNTHLASNTFLVGHSVTLADIVMTCNLYHGFARILTKTFTSEFPHVERYFWTMVNQPNFKKVIGDFKQAEVVPPVQKKAAPAKPKEAKKEAPKAAPKPAEVEAPEEEAPKPKPKNPLDLLPPSKMVLDDWKRLYSNTKSNFHDVAVKGFWEMYDPEGYSLWFCDYKYQEENTVSYVTLNKVGGFLQRMDLCRKYAFGKMLVIGSEAPFKVKGLWLFRGQDIPEFVMNEVYDMELYEWTKVDLSDEAQKKRVEAMIEDLEPFEGQALLDAKCFK

SEQ ID NO: 127482 - protein, 345 aa, Triticum aestivum
  unsure (1)..(345): unsure at all Xaa locations
  Clone ID: PAT_TA_21900.pep
AGSIVGNVFGFKALRALRLEDLRIPPTYSKTFXGPPHGIQVERDKLNKYGRPLLGCTIKPKLGLSAKNYGRACYECLRGGLDFTKDDENVNSQPFMRWRDRFVFCAEAIYKSQAETGEIKGHYLNATAGTCEEMIKRAVFARELGVPIVMHDYLTGGFTANTTLAHYCRDNGLLLHIHRAMHAVIDRQKNHGMHFRVLAKALRMSGGDHIHSGTVVGKLEGEREMTLGFVDLLRDDFIEKDRARGIFFTQDWVSMPGVIPVASGGXIHVWXHMPALTEIFGDDSVLQFGXGGTLGTSLGGNAPGAAANPSGLXKPCVQARNEGRDLAREGNEIIPKQLAKWESLN

SEQ ID NO: 127483 - protein, 152 aa, Triticum aestivum
  unsure (1)..(152): unsure at all Xaa locations
  Clone ID: PAT_TA_21901.pep
LTYYCTVVGKLEGEREMTLGFVDLLRDDFIEKDRXRGIFFTQDWVSMPGVIPVASGGIHVWHMPALTEIFGDDSVLQFGGGTLGHPWGNAPGAAANRVALEACVQARNEGRDLAREGNEIIRAACKWSPELAAACEVWKAIKFEFEPVDTID

SEQ ID NO: 127484 - protein, 155 aa, Triticum aestivum
  Clone ID: PAT_TA_21902.pep
GLFSKLERKGKIEDANKNIVGHFHSQLTQDMDILHRNISTSVSQQESQLKVLEEEMQSFITSKGKVAGGLQNQVREMKESFSSRITELHGFASELNLKSQLSSEKLNAQVSAHTSDLEDCLKGLLADADQLLIGLQNGLSQQEESLTTLVEQQHE

SEQ ID NO: 127485 - protein, 122 aa, Triticum aestivum
  unsure (1)..(122): unsure at all Xaa locations
  Clone ID: PAT_TA_21903.pep
NASSNILLNYLKGERDTVENKIRNIVDVRDVADALLLARVXYENPEASGRYICSSKPVKVSDMISVLKTLYPMYTYPKNFTEVEENTIYSSEKLQNLGWTFRPLEKTLGDSVESYKASGVLN

SEQ ID NO: 127486 - protein, 363 aa, Triticum aestivum
  unsure (1)..(363): unsure at all Xaa locations
  Clone ID: PAT_TA_21904.pep
ASTQRPGIRCPLQRSVKRRGATKLRAAEGTRAGAGRKKAWRRRRRRSVVCVTGAGGFVASWLXVKLLLSKPHYTVRGTVRDPGNAKNAHLKALEXAGERLQLLSADLLDXQALRRRLPDCEGVFHVASPVPSGRSTNPEEEVIAPAVTGTLNVLKACYEAKVKRVVIVSSCAAVFNNPNWPKGKVFTEDSWSDEDLCRKGEDXWYLLSKTRAEREAFAYAAKTGLDVVAILPSLVLGPLMQSTVNASSKILLKYLKGEHETVENRSWNLVDVRDVADALLLAYKNPAASGRYICSPVRIKVSVVISILKTLYPTYTYPKNFTEVEEGNVMSSEKLQKLGWTFRPVEKTLGDSVESYKASGILK

SEQ ID NO: 127487 - protein, 170 aa, Triticum aestivum
  Clone ID: PAT_TA_21905.pep
ARGYLGHVITIIRNAVANADAFESIAEQLKKGRLEELMAAEAKDGSEDTEMIPAVDADSNESNLQLIAAPDVAPTVITNVHTASFCTGNVTSGASLGNLQLDNITPETKSFGALPGATGQADTVIPGNGGGQQQVIKATVQVSKRPTAFGCSVRKTLYRKKAKSISRIFK

SEQ ID NO: 127488 - protein, 197 aa, Triticum aestivum
  unsure (1)..(197): unsure at all Xaa locations
  Clone ID: PAT_TA_21906.pep
MARMISRPAVLLSPLAMIVVAAAVMALAPAPVAATKYNITKILAPYKEYSKFNDMLSKTRLAYDINRRQTITVLAVDNSAMSALDHYSLQTIRHILELHVLVDYYGDKKLKKLAHGSTASSSMFQXTGSASGMSGSVITARTDGTLTCTTERARPSAVRPGSPNRRRIPSDIAVLQVSPSSRPPRRSAGAAPAPLTR

SEQ ID NO: 127489 - protein, 120 aa, Triticum aestivum
  unsure (1)..(120): unsure at all Xaa locations
  Clone ID: PAT_TA_21907.pep
AQNGIKIAIIDFYSHIGYKHKYHKICVGRDSNGQPCMKILIIQSFKVNDKGILSLLELKFRNEMWPQIMTSPTMSMLPRVDILPQXQGNLGLGFLGHGQALPEIILHEHQAVPQDDLGLP

SEQ ID NO: 127490 - protein, 173 aa, Triticum aestivum
  Clone ID: PAT_TA_21908.pep
MPGLLLRHLLSGKRLLSTSKPQGRIAPITAVRCTAARKPTTCTRKPAQQEGNQEQEPTSDEADANPHRIPDDETPPSGTATTSFSVVRRMPSAISTDGRLRRTALTQEEPPNYEIGWKRTKNLPLEKPKGWAIADFLEKLEGLMERGRYGSGALLGTVAGVVTERAREEAEIL

SEQ ID NO: 127491 - protein, 200 aa, Triticum aestivum
  unsure (1)..(200): unsure at all Xaa locations
  Clone ID: PAT_TA_21909.pep
SAHTHNQISPKSTRRHLRFKMQIFVKTLTGKTITLEVESSDTIDNVKAKIQDKEGIPPDQQRLIFAGKQLEDGRTLADYNIQKESTLHLVLRLRGGMQIFVKTLTGKTITLXEVGSSDTIDNVKAKIQDKEGIPXXDQQRLIFAGKQLEDGRTLADYNIQEXENLHLVLPPREACVSGACRIPQEELHRQVQGIPRVLVE

SEQ ID NO: 127492 - protein, 183 aa, Triticum aestivum
  Clone ID: PAT_TA_21910.pep
MARSVVRIVGDGGVTLGAPPGFPVLGFRGPRGLHTCGSPSRHLNPGAFLPGLPARFCSAGPGGEKNRRGGTVDVVVQGRPSASSRPERAVLAQPAVAEGRGGGHPGATTRGRSPPPPAPASPPRSAGRGTAPRKARRAPPRGSASRRCRSQPPSASSCPPSCFARSHALSCCCCTHCRAVVWG

SEQ ID NO: 127493 - protein, 60 aa, Triticum aestivum
  Clone ID: PAT_TA_21911.pep
NKHYTCPESREREREREELESREERQINEKYSLKTHDPSLQNPVNHPSIPKIPDTPEHRP

SEQ ID NO: 127494 - protein, 144 aa, Triticum aestivum
  unsure (1)..(144): unsure at all Xaa locations
  Clone ID: PAT_TA_21912.pep
MARIKVHELRGKSKADLQAQLKEFKSELSLLRVAKVTGGAPNKLSKIKVVRTSIARVLTVISQKQXSRSLREAYKKKKLLPLDXPPKKTRAIRKRLNKHSLLEDREGKERENIPHETYQGLIIERIYLSVLPKLLDRSTPKYKL

SEQ ID NO: 127495 - protein, 58 aa, Triticum aestivum
  Clone ID: PAT_TA_21913.pep
LGVPASPQAAGSGYIDPGTLTGTVIPAIRGIGNYGGIMVWDRFNDVQNNYSSQVKGSV

SEQ ID NO: 127496 - protein, 72 aa, Triticum aestivum
  unsure (1)..(72): unsure at all Xaa locations
  Clone ID: PAT_TA_21914.pep
MLNLGYEIGKTIIHGPVFNWYPVVHFGLEGICVQNGGFDCCWLNLLTTQVLISSGYVSHGXSHVEDGIFRSY

SEQ ID NO: 127497 - protein, 185 aa, Triticum aestivum
  unsure (1)..(185): unsure at all Xaa locations
  Clone ID: PAT_TA_21915.pep
MAGGKEAHGWAARDVSGHLSPYHFSRRVQRDDDVTIKVLFCGLCHTDLHVIKNEXWATPSTPSFPGHEIVGVVTDVGSRRHKLQTPGDTVGVGYFVHSCRKLRHAASKGVRRLLPPARGGPPAVPGPPTARGPNAGRRRPSPQRRFSARPAAAPPAPPPGPGVRTHGLNPKTGRSGLLLPRFDKP

SEQ ID NO: 127498 - protein, 120 aa, Triticum aestivum
  unsure (1)..(120): unsure at all Xaa locations
  Clone ID: PAT_TA_21916.pep
RXXFCLCXPLXLXLXLRSLTIYFELLCLPGAFWTVQPHCLALQIQTVGLLAAAAAWNCARNEDCCCCCCLLLKPNPNGLGFRLLLLLRGGVHKPAVRSVLAAAALEVPAELLPPVHRRER

SEQ ID NO: 127499 - protein, 139 aa, Triticum aestivum
  unsure (1)..(139): unsure at all Xaa locations
  Clone ID: PAT_TA_21917.pep
MASEKKQSNPMREIKVQKLVLNISVGESGDRLTRAAKVLEQLSGQSPXVFSKARYTVPFLWLQXVMKKIACXGTVRGEKAMQLLESGLKVKEYELLRRNSVTQGALGFGIQEHIDLXIXYDPSTGIYXMGFYVSLERAG

SEQ ID NO: 127500 - protein, 260 aa, Triticum aestivum
  unsure (1)..(260): unsure at all Xaa locations
  Clone ID: PAT_TA_21918.pep
IPWGSILRLSPSVIRGAGRGRLPWAATASSSSAAAAAAAALLHASPLPASHRAALPRYRPSPSLPPPLSVAFRSPARALPRGGDAFWEEPDDGSGGDEEDDGKQATQRRSSPFPPPFPLSRLVATRQQERQEQDLRREIELLLAPDXRAILDQNETADVTKISSPKWHPLHTYALALQIPLMDKLLDNGVDIDLVDKDGFTPLHKAIIGKKEAVISHLLRKGANPHVTDRDGATPLHYAVQVGALQTVKLLIKYLPGRPL

SEQ ID NO: 127501 - protein, 161 aa, Triticum aestivum
  unsure (1)..(161): unsure at all Xaa locations
  Clone ID: PAT_TA_21919.pep
HCFSCLQVRIGAIYLLSGFSGSVLSALFLRNSYISVGASXGALFGLLGSMLSELLMNWTIYSXTXAAAILTLLFSIALNLGYWGYYLNVDNFGSTLGGFPTGFPLGFGPGWXRPQFTWMGMSWSGHTLTTFQQSFPVLWGGGGPAVVGLFTGFKTDGAIGA

SEQ ID NO: 127502 - protein, 96 aa, Triticum aestivum
  unsure (1)..(96): unsure at all Xaa locations
  Clone ID: PAT_TA_21920.pep
XTSXNXEXWGAXISPLEGIAQGISCYAGFSXPAFKRRHWXGYXLPMGNWYGPPWDFFXFLWEPXLQVNFXAHKHVHSSITGHSIFIIAPSQLPQDP

SEQ ID NO: 127503 - protein, 147 aa, Triticum aestivum
  Clone ID: PAT_TA_21921.pep
HVDGHPVSSEAERRRVVQCLEAAVERRTADGLELEVRTDDRAGLLSDVTRIFRENGLTIRRAEISSEDGEAVDTFYLSDPQGHPVEAKTIEAIRAQIGEAALRVKNNPLADDGGSSSDVAAGSTAFLFGNLFKFYRPFQNFGLIKLY

SEQ ID NO: 127504 - protein, 126 aa, Triticum aestivum
  unsure (1)..(126): unsure at all Xaa locations
  Clone ID: PAT_TA_21922.pep
IVFYGLGYLLCVPEEVSQFXCXWPRNXVHSTNKDASKCLFGIXVGQVEXGLLPKEEGLAFAQERGCLFVESSAKTRENRGKXFEELALKILXVPSLLEEGSSAVKRNTLTLKQKQENANRSGGCCQ

SEQ ID NO: 127505 - protein, 156 aa, Triticum aestivum
  Clone ID: PAT_TA_21923.pep
TCCSGLPATPRRQAGHHTLPLPAACGLALAPEFGSYGRRGRPPPLCCTSTARTRVVASCSVPRRNVVTTLLSASTLLLLGPRQITLAETTGGAFREYIDTFDGYSFIYPKGWIQVKGAGADIFFRDPVLLDVNMSVDISSPSSSAYKTVEDLGPPE

SEQ ID NO: 127506 - protein, 112 aa, Triticum aestivum
  Clone ID: PAT_TA_21924.pep
SFAYRVGDGPIPGSSAYGDDEVGACGATGDGDIMMRFLPCYQVVESMRLGMEPRDAAVDAISRIARKYPDFVGAVFALNKKGVHAGACHGWTFQYSVRNSSMLDVEVITVTP

SEQ ID NO: 127507 - protein, 380 aa, Triticum aestivum
  unsure (1)..(380): unsure at all Xaa locations
  Clone ID: PAT_TA_21925.pep
MARSNPGLLLGLLLLRLTWCVAVDGGGVEEGGFVFPVVVSTWPFREAVRAAWDVVKTGGAGGSAVDAVVAGCSACEELRCDGTVGPGGSPDENVVTTLDALIMNGXNWQKTMEIGAVAAMRYVKDAIMAAKLVMEHTGHTLLVGEKATSFAISMGLAGPPDLSSXESIEKWPNWTQNNCPPNFWKHVAPAGNCGPGHPINIPKDPVKSAVWENQGITCQEWLENDNLLEPTNSHFNSVNRHNHDTISMAVIDKMGHVAVGTSTNGATFKIPGRVGDGPIPGSSAYGDDEVGACGATGDGDIMMRFLPCYQVVESMRLGMEPRDAAVDAISRIARKYPDFVGAVFVLNKXGVHAGACHGWTFQYSVRNSSMXNVEVITVTP

SEQ ID NO: 127508 - protein, 142 aa, Triticum aestivum
  unsure (1)..(142): unsure at all Xaa locations
  Clone ID: PAT_TA_21926.pep
KRLPPSNRGIHRHQGDRGSLSRPCRSCXLRLVPXKLAGAVLFNRRMARGXLVYRQYSIVHRGGSKVAHGVCHKWRGKWSGHRRFPALGLSPNLLGGRSGSSGANSSSNSWQQTPCVGYDSGALWRRSFHVLLGKEHFNPLFT

SEQ ID NO: 127509 - protein, 38 aa, Triticum aestivum
  Clone ID: PAT_TA_21927.pep
KESIVLIIIHVLTKISPPSCKTTFNTMHPHLSQPTYMR

SEQ ID NO: 127510 - protein, 77 aa, Triticum aestivum
  unsure (1)..(77): unsure at all Xaa locations
  Clone ID: PAT_TA_21928.pep
SCRFRGTGTRVRYDAEVTAYVEDGRMKRMTGVRSKQVMLWVPIVEMSLDGDKRDKIYFKSNVGIXGRSFPPSAFADA

SEQ ID NO: 127511 - protein, 81 aa, Triticum aestivum
  Clone ID: PAT_TA_21929.pep
QEREGVEMIVTNEEPVAEARIRKGRTSHKGATQNEDIKLMLVNGYPIPTPTIALREVITPTPNILKDDGVADLALGVNQLL

SEQ ID NO: 127512 - protein, 134 aa, Triticum aestivum
  unsure (1)..(134): unsure at all Xaa locations
  Clone ID: PAT_TA_21930.pep
MGLAFGKLFSRLFAKKEMRILMVXGLDAAXGKTTILYKLKXSGEIVTTIPTIGSNVXETVXXTKNITSTAWDVRGARTGLAPSWEFSPHNTRXLRWGVGYNDXXRFVLXQRXLHRMLNEDXYLCFLLFPTFLMP

SEQ ID NO: 127513 - protein, 144 aa, Triticum aestivum
  unsure (1)..(144): unsure at all Xaa locations
  Clone ID: PAT_TA_21931.pep
XWPRAVWSRRXETDKSRPGGTRRGASGSRRAPPGSRGAPVLRSPCMEHPGPPLNANCQTRRYHAIVEERGALTVGLENKGRTVVRVPGFVGRSLARGHQGWRRGRGRRRRGSHSRISCPRSHLPSSGYLPAARPGPGGCTGFRR

SEQ ID NO: 127514 - protein, 109 aa, Triticum aestivum
  unsure (1)..(109): unsure at all Xaa locations
  Clone ID: PAT_TA_21932.pep
MESKGGKKSSSSRSMMYEAPLGYSIEDVRPAGGVKKFHSPVLLLALLPPSPALCSDSPAPMAVLSAADASPVSXAIGFEGYEKRLEXTFSEAXVFVDPQGRGCVPLKAK

SEQ ID NO: 127515 - protein, 203 aa, Triticum aestivum
  unsure (1)..(203): unsure at all Xaa locations
  Clone ID: PAT_TA_21933.pep
LRYIDIGKREGATLVTGGKPCGDKGYYIEPTIFTDVKDDMTIAQDEIFGPVMALMKFKTVEEVIQKANNTRYGLAAGIVTKNIDVANTVSXRSIRAGAIWINCYFAFDPXDAPFXGGYKMSGFXGKDIGHGRAPTSTLQTKTVVTPLVQHSHGPDRPHPVPMNSSHQQTRRHTSVSSPPRDRACTVPLTPACVICLHQDIKSR

SEQ ID NO: 127516 - protein, 123 aa, Triticum aestivum
  unsure (1)..(123): unsure at all Xaa locations
  Clone ID: PAT_TA_21934.pep
DNHKDQANMASSLSIHLARSSGGCSWAPSLLEPVVDGGGVLAAAGPKSWRPCPWWASCSPGGKTCATFPXRRACPHPHXTVLXQGHAPXLARSXIHGAWXFXFPGXHXQRXYPXAXXLXGTWX

SEQ ID NO: 127517 - protein, 232 aa, Triticum aestivum
  Clone ID: PAT_TA_21935.pep
MKKIFGAKKSQDPPPSIQDATDRIYKRGDTVDEKIKKLDAELARYKEQIKKTRPGPAQEAVKARAMRILKQRKMYEGQRDMLYNQTYNLDQVAFASEGIKDAQQTMTAMKAANKELKGMMKTVRIEDIDSMQDEMMDLMDVSNEIQETLGRSYNVPDDIDEEELMGELDALEADMDFESNSVPSYLQPDKETDLDSELNLPAAPSGHAAVPANRQQEDELGLPTVPHASIRT

SEQ ID NO: 127518 - protein, 206 aa, Triticum aestivum
  Clone ID: PAT_TA_21936.pep
SDGGEIVKKEEIQELADVASDGGAVVKKEEIQVLADVASDGGAVVKKEEIQVFADDASDGGAIVKKEEIQVFAGVVRARLDVLQGRIDSRSQKNPPPPPESARRVVVYLTSLRGIRQTYEDCWAASTILSSYGVHVDERDLSMHAGYKEELRDALGAGAPAASTGVLPQVFVDGWHLGGAEEVRRMHESGELAEALEACEPAPGAA

SEQ ID NO: 127519 - protein, 87 aa, Triticum aestivum
  unsure (1)..(87): unsure at all Xaa locations
  Clone ID: PAT_TA_21937.pep
LGTXTPAXXTGVHSLGXTLRQRSAXFSQWKGVSQGVSGXQFSSXXXKRRHXAVXAXIXDWYRPPLGVFXFFKRKYSCSHLPXPCTYT

SEQ ID NO: 127520 - protein, 129 aa, Triticum aestivum
  unsure (1)..(129): unsure at all Xaa locations
  Clone ID: PAT_TA_21938.pep
LDLPAPRSLGPPGSGRPFCAEGFLHXEESSASSPSLPGVPVPAQCSGRVXPRKQPYKFSNQELRGLGCSSRPVSXSRFTDTVKDLQEKGHLPVLGERTTDGGRRTRMPPRPEMQQGGIAIRALRGRCHT

SEQ ID NO: 127521 - protein, 155 aa, Triticum aestivum
  unsure (1)..(155): unsure at all Xaa locations
  Clone ID: PAT_TA_21939.pep
TCAYLKDERGCDICDIXIVDHAPTVTAHPFRRSTAFLFGNEGTGLSQKECEVCDFFVYIPQYGGGTASLNVTVAASIVLHHFGVWAGFPERGREGNKFVVAEKPRGQSRGLYCSDSIEDLIEERKARRENACDIFEENGSNHPQESNGLGMMFTD

SEQ ID NO: 127522 - protein, 153 aa, Triticum aestivum
  unsure (1)..(153): unsure at all Xaa locations
  Clone ID: PAT_TA_21940.pep
MAATSPFDCVLLDLDDTLYPGDTGIGAALRRNIDEFLQAKLGVSGRRRPPPRAPSSSAAHGSSLAGLIALGYDVXPDEXHNYVHGRLPXYDRIARDPXLARCCRHPATQMLFNNSGPRMDRRRTAGLDKALRRRRCSRHDPTVPGQRGTARLG

SEQ ID NO: 127523 - protein, 161 aa, Triticum aestivum
  unsure (1)..(161): unsure at all Xaa locations
  Clone ID: PAT_TA_21941.pep
PYLPMEPAKLAAFLAVAAVAYAVAVAPAAAGILRRRDRPRKLPDANHVLHQLPXPVDEIRGQCCSVVQEPRVPLPPEAGGGAALQPASPPSTQMLQGRVASTVGEAGRAAAPPMLQDTQVLGAVTSSYFCFVYVCFCLFHNCSLLXLIQSACYGCRNCAVR

SEQ ID NO: 127524 - protein, 178 aa, Triticum aestivum
  unsure (1)..(178): unsure at all Xaa locations
  Clone ID: PAT_TA_21942.pep
LYSPSVFRSAGITGDNKLLGVTCAVGVTKTLFILVATFLLDRVGRPPLLLTSTGGNXISLISLRDGAHRPXGHHPGRQDPVRSSLLCIASTLAFLAFLSTGLGPTTGVYNPEISPLQLARAGLCRXAXACNRVTSPVSSLPASPSHTSGGGRSPRSPPGAPPPAAGPRHPAPGSSDQQ

SEQ ID NO: 127525 - protein, 52 aa, Triticum aestivum
  Clone ID: PAT_TA_21943.pep
VGQNFALVEAKMALSSILQHFSFALSQSYTHAPFPVSTLQPEHGAHLMLKKL

SEQ ID NO: 127526 - protein, 116 aa, Triticum aestivum
  unsure (1)..(116): unsure at all Xaa locations
  Clone ID: PAT_TA_21944.pep
CEGYYPCQIVFIAGRQVRXRSQAICGQLVGEPLRRSSVAAVDQEEERVSFGAGRRRRTRLGRSSRKTPRRRPSSTSTSFVLGSRAATVVRRLHLTCAARVGYLVVVLVSTPPRMNE

SEQ ID NO: 127527 - protein, 109 aa, Triticum aestivum
  unsure (1)..(109): unsure at all Xaa locations
  Clone ID: PAT_TA_21945.pep
LLAHALQDPENQHFVLLSESCVCVPLHNFDYIYSYLMETNVSFVDCFDDPGXPHGAGRYSDHMLPXEMVKKDGRKGAQGFXVKRQHAVLILADTLLLMGSPSVTGKPRK

SEQ ID NO: 127528 - protein, 173 aa, Triticum aestivum
  Clone ID: PAT_TA_21946.pep
MEAARHAGKKRGPDDEAEAEVHHTFRGAANALSQLYAQAVANQKASFIAGERHAMERTHRWISSQHEEASGVSVADVLAYLQNEIESRGGMAGSSQHPTPQPAYGLPSANVQINSFSFGNVAAALDSQLYQTDQTRTAGISNVFSSPSQQNSHSNHLVLCSGPGPARPPPSGS

SEQ ID NO: 127529 - protein, 51 aa, Triticum aestivum
  Clone ID: PAT_TA_21947.pep
TCAGKIEAGAVDQSGRSFLDDAQQEEGYVLTCVAYPKSDCVIHTHKEGDLY

SEQ ID NO: 127530 - protein, 278 aa, Triticum aestivum
  unsure (1)..(278): unsure at all Xaa locations
  Clone ID: PAT_TA_21948.pep
HASGEKSVLAKDSSMPINRVTWSPDGDLIGVAFAKHLIHLYAYQQPNEARQVLEIEAHSGGVNDIAFSRPNKQLCVVTCGDDKLIRVWDMHGQKIYXFEGHEAPVYSICPHHKETIQFIFSTSIDGKIKAWLYDNAGSRVDYDAPGKWCTTMLYSADGTRLLSCGTSKEGDSHLVEWNESEGSIKRTYSGFRKKASGVVQGVVQFDTAQNHILAAGEDNQIKIWDVDNTNMLTFIDADGGLPGLPRLRFNKEGNLLAVTTVDNGPSEFASTDGLRTLR

SEQ ID NO: 127531 - protein, 153 aa, Triticum aestivum
  Clone ID: PAT_TA_21949.pep
MSTCTFATSCVLLGNARTTDVPQKALKSRVSFLGRGALQLPSLRSSSKKKLDVSAAATYKVKLVTPEGEEHEFEAPDDAYILDSAETAGVELPYSCRAGACSTCAGKIEAGAVDQSDGSFLDDAQQEEGYVLTCVAYPKSDCVIHTHKEGDLY

SEQ ID NO: 127532 - protein, 449 aa, Triticum aestivum
  unsure (1)..(449): unsure at all Xaa locations
  Clone ID: PAT_TA_21950.pep
NLWRRAGEEGRGGGGGFPCLLLVLLACVPSCLVVGGRPRWRRLDRRPRISEEKPDKXAKPWELMEVLNPQQFRVATLPETPDQASKVARLLYTNSGVGLLALGSSAIQRLWKWNRNEQNPSGQATASVVPQHWQPNSGLVMANDIGETPPEESVPCIALSKNDSYVMSACGGKVSLFNMMTFKVMTTFMPPPPASTFLAFHPQDNNIIAIGMEDSTIHIYNVRVDEVKIRLKGHQKRITGLAFSNSLHILVSSGADAQLCVWATDSWEKKKSVAIQMPAGKTPSGDTRVQFNSDQNRLLVVHETQIAIYDASKMERIYQWIPQGTLSAAISHASYSCNSQLVFAAFTDGNVAIFDADNLRLRCRIASSAYMSTTAINSNPPVYPFVVAAHPQEPNQFAVGLSDGSVKVMEPLESDGKWGTPAPVENGVANGRAPASSATSNLATDQNQR

SEQ ID NO: 127533 - protein, 131 aa, Triticum aestivum
  unsure (1)..(131): unsure at all Xaa locations
  Clone ID: PAT_TA_21951.pep
ADSEEDETRGPWLRSCSTARSTPPSSEAESLSNPAPAPLGGAPKFIPQACGRVRGHRWVSGKGATKDICHRPSRXEXPFSGRPGLSPNDPXNLRXYXLPXLTARHGADSLQRXDXTXIXLAQXGSLXPVXR

SEQ ID NO: 127534 - protein, 141 aa, Triticum aestivum
  unsure (1)..(141): unsure at all Xaa locations
  Clone ID: PAT_TA_21952.pep
MARKKIREYDSKRLLREHLKRLRRHPTSRSSPRRSTQSNGFHWSWQTKEPWLSSMKLXLVKPGHALLGKRGKSXGLVASNLDSCPKSANLSKDRWEFESQMGGCKLPIYNFIVEHLCHMTKXLLSIVSEXLGNIISQKVED

SEQ ID NO: 127535 - protein, 86 aa, Triticum aestivum
  Clone ID: PAT_TA_21953.pep
GLFPQYKSEEQEDGWFGQWFGWCSLKGGLKTTLSCLLKGRTKTKEAKRNNNKKACKNRQLNPGGKKRFSGSLFFLLANRSSSSFLA

SEQ ID NO: 127536 - protein, 121 aa, Triticum aestivum
  Clone ID: PAT_TA_21954.pep
ATVPMSWSWLVPQYVMVGVADVFIIVGMQEFFYDQMPSELRSLGIALYCSVIGIGGFISGTLISLIDRITCKGGGDSWFSDNLNRAHLDYFYWLLAGLSAGELALYICFARAYTYKDKRDF

SEQ ID NO: 127537 - protein, 111 aa, Triticum aestivum
  Clone ID: PAT_TA_21955.pep
SASTATSCSSSTRRSPPTTASRSASSPSATASPSAAASSENMAWPGLPHHRHRRRRRPHPHSNHNRRPAALIIHRLFFWALSCPCNLSPPLPSWELSAAVSIRKSRDRVIQ

SEQ ID NO: 127538 - protein, 63 aa, Triticum aestivum
  Clone ID: PAT_TA_21956.pep
MLCSTLFVRAFSAFQGLLSCALNINPMTSCRGQDLCVCVCCDPNYVWMLGFIYKAGRKPFSGN

SEQ ID NO: 127539 - protein, 156 aa, Triticum aestivum
  unsure (1)..(156): unsure at all Xaa locations
  Clone ID: PAT_TA_21957.pep
FGGGGGGGDEAAAAGVLVQCGAEAGRGPSPAVPAPVGRRPEHGHRRPHSGMGRHSPRAASSCALPPAMSGRSSPVLRRQQRNGTGSWNNTVVISIFLQLTPRHLVLPSSFPRKHPPGSNVNTREGNTRRLXTPTKTSSRETSFCGSYQRGGVRPPS

SEQ ID NO: 127540 - protein, 103 aa, Triticum aestivum
  Clone ID: PAT_TA_21958.pep
DIHVDAVLNVTQAILGGTVQVPTLAGDVVLKVKPGTQPGQKVVLRGKGIKTRNSYSYGDQYVHFNVKIPVNLTQKQRMLLEEFEKEEKGEDDKDAEKAAGASG

SEQ ID NO: 127541 - protein, 172 aa, Triticum aestivum
  unsure (1)..(172): unsure at all Xaa locations
  Clone ID: PAT_TA_21959.pep
MIINRYWXSLLSWDAALVMIPSLYLSLVGKLILKLSAVYGPGQGMFRQDLFFCLNCQLFTEEGRSFYYKFLNKEYLTSLRKPTVFFRCTFSMYCCTLSTHCLALPLVCHNEDAGCIFDPTEITLMVTITHRNGNFADSRLNPYNFPSISLPQSFVGTKTPQLQRLSHISPSI

SEQ ID NO: 127542 - protein, 80 aa, Triticum aestivum
  Clone ID: PAT_TA_21960.pep
LLTAACGQQCRMRFAGWYLKIAVGGAAIGAAMELFMIHTGFYEKVTVLESEKRAWESSPEAQAMREALNPWHKRDEQEKK

SEQ ID NO: 127543 - protein, 153 aa, Triticum aestivum
  unsure (1)..(153): unsure at all Xaa locations
  Clone ID: PAT_TA_21961.pep
MAATSSSSSSTVVALAALLFLLLVTCGSVRRRPASFNASDXTADPNWXAAPGTWVRLRPPAPGLDDDGGAWWFQNVNLPPSPAMTXCXGNDPLLKDGKGASCYQIRCXNNQPAPGNPETVITTDMTIPRGQIXFDSNGRVRAMATRTNSSQAG

SEQ ID NO: 127544 - protein, 189 aa, Triticum aestivum
  unsure (1)..(189): unsure at all Xaa locations
  Clone ID: PAT_TA_21962.pep
PPTWHVVRQRNFRARGLPDESFRERMARRTDGSAARPPWGRQMDDNGHRWQGQLGQHGTGRRALAATARTPWGPLGMGGSVILGHGDRGHGRHGWPCHLWHLAAPLARSAQRGGQGRHPAAAGAAAVSXQVACRVAVVAGQECARHDHGHQEARSVSHTASTSSSLKLSLETACCTLVMLLLLQEEARS

SEQ ID NO: 127545 - protein, 57 aa, Triticum aestivum
  Clone ID: PAT_TA_21963.pep
MGKAKRASIFIRLVSAAGTGFFYVKRKNPRRITEKLEFRKYDPRVNKHVLFTEAKMK

SEQ ID NO: 127546 - protein, 326 aa, Triticum aestivum
  unsure (1)..(326): unsure at all Xaa locations
  Clone ID: PAT_TA_21964.pep
MERITTNPFYTSGIPVTVPSPLPSTTMDESFARLPDAQNVXLERELRRTPLPPHQSTVAPICGQFHPSTGXSVGPLRSPPAVRFSSVPNPEQYNGANPYISQTPSTGSSSAMIYGSHHEGFEPTFNDFPRDVGPTWCPDPVESMLGFSDDVPVGNNLAGISPIAATDELAKQTEWWTDFMNDDWKDIADNAGAAKTQPQAGPPVQSSISVHQSASQQAGTTSVHQPALQQIVTTQPIESSVVAAPSPSASSNTSKTRMRWTPELHERFXWDAVNLLGGSXKATPKGVLKXLMKADNLTXLHVKSHPXKXRTADIDRISEGHRKVGG

SEQ ID NO: 127547 - protein, 160 aa, Triticum aestivum
  unsure (1)..(160): unsure at all Xaa locations
  Clone ID: PAT_TA_21965.pep
MPVEGRKKGVPALGWWLMLVGSLRLASVWFGFFDIWALRVAVFSQTDMTDVHGRTFGVWTLLTCTLCFLCALNLENRPLYLATFLSFVYAXLGHFLTEYLIYHTMAAANLSTVGFLAGTSIIWMLLQWELSCESPWCPSCEAMIDAWAVSFMWPGGRRGP

SEQ ID NO: 127548 - protein, 92 aa, Triticum aestivum
  unsure (1)..(92): unsure at all Xaa locations
  Clone ID: PAT_TA_21966.pep
KRAGEGRRTPGDPTQKWGAADGGYGSFNSELFPHLTVFSHLSPYTQTISSYLSALLSQLGHVDILLPRHIDKRTNLLLARGCVSGAGELRXL

SEQ ID NO: 127549 - protein, 287 aa, Triticum aestivum
  unsure (1)..(287): unsure at all Xaa locations
  Clone ID: PAT_TA_21967.pep
MIGEMDADSVVGYFRGKSILITGSTGFLGKVLVEKILRVQPDVKKLYLLIRAPDAESAKLRIQTEIIGREIFHVLKEKHGVRFNNFIEEKICPLVGDIIYENFGLDSAQLGELSKDVDVIVNGAATTNFFERYDVAFDVNVLGVKHVCAFAAKCPKLKMLLHVSTAYVAGEQEGIIPEKPILMGETLKVGTHLGHPIRVNLVKETXRELKASCSTEKAXERKTMKGAWASKRARHFPGGPNTLCLXTKGMGEMMMGEPTNNFPVVTXAPSIIXTLKRPLPGWMGRTR

SEQ ID NO: 127550 - protein, 166 aa, Triticum aestivum
  unsure (1)..(166): unsure at all Xaa locations
  Clone ID: PAT_TA_21968.pep
GSTRSLIGARLRSIDWDCRVRAAAVRDRSIHPSIDWVLLVVRRYSFGSMGRLLLGEPPGDGRRHLPLQALRHPPRLTTPTSSQGRPAAKNGKAYSSTRXLNVNVGTKEEDRMMTTGLHTVVRHLRLPXGXTRXKXSXLXXXRVKEXXNPKAXLGTXXDPCXXKXNS

SEQ ID NO: 127551 - protein, 237 aa, Triticum aestivum
  unsure (1)..(237): unsure at all Xaa locations
  Clone ID: PAT_TA_21969.pep
RRLLELRGQEAAEEEEERWSFLALLFELLRKSLLGCRTVGGGEGEHGGCGMEIGLPTDVQHVAHVTFDRFHGFLGLPVEFEPEVPRRAPSASASVFGVSTESMQCSYDXRGNSVPTILLMMQEXLYEQGGSSRQKVSSRINARKYQEDLVRDQLNSGLSQDXFDVHXLAGLIXTWXFXRMXXGVLGPTQPEQGDACXPXRDCLEPNAPTTEFAGLPDGRVTKKTHKDDDICMGSTNM

SEQ ID NO: 127552 - protein, 165 aa, Triticum aestivum
  unsure (1)..(165): unsure at all Xaa locations
  Clone ID: PAT_TA_21970.pep
TPAAAALAAQTNQTHTTVAVVVVGVRVALLSEPVRERNQSTRPWRACCRSCTGPSSTSASGGQSAHPATPSSATTPPPESAAGRRTTTSAPPPAPTCPASSPPXARGYYDRGLRARPDQERPWPGRASRNPPCALQLLFQMWVSSLSSGWGLESPPLPLLSPWDK

SEQ ID NO: 127553 - protein, 115 aa, Triticum aestivum
  Clone ID: PAT_TA_21971.pep
RSSRQCTSFLFGSLFWNELLDHLFRERRQVVISKKPRRGNLESRKPSALLCRRKVNEQCSNCSALCLFKLFCCLEVIPFLRWGLGILFRHKPSQVGINKMVCIKSTSWDTVKGYY

SEQ ID NO: 127554 - protein, 117 aa, Triticum aestivum
  unsure (1)..(117): unsure at all Xaa locations
  Clone ID: PAT_TA_21972.pep
MHPSAVSFDSGRRAAXGGAQMLLFXGGGGSANSNGFFRGVPDGGPGAWTTRRAWGKRPFFXTTHEELLXEEEYYDEQAPEKKRRLTAEQVQLLERSFKKRTAGXERKTNWXXLGMXP

SEQ ID NO: 127555 - protein, 107 aa, Triticum aestivum
  unsure (1)..(107): unsure at all Xaa locations
  Clone ID: PAT_TA_21973.pep
APSDPTPPASSSSSSMATTSTPRLATLLVLLAAASPLLSAAQKAAPXGSGGRRRLAPGPAASSVVRRGRGGRGPSHRREQGAQGRPVQRVQASCCTPRAWTRRSTRS

SEQ ID NO: 127556 - protein, 223 aa, Triticum aestivum
  unsure (1)..(223): unsure at all Xaa locations
  Clone ID: PAT_TA_21974.pep
ATLEEISESSIIVHLADISHPLAQQQIGAVDKVLKELDIDSVPKLVVWNKIDNTDNPLRVKEEAEKQGIICISAMNGDGLEEFCNAIQAKLKDSLGAHRSFCSRNDKGDLLNDIHKVGMVXKTEYMENGTXLIKAHVPLPPCKASHAVAAAGGCSSMIIPFPARVHHRPPVVLWLAAPCSVGGWRVHVACSLASPLPPPGPLFHTKNFTKYEIWHITLFLCSK

SEQ ID NO: 127557 - protein, 101 aa, Triticum aestivum
  unsure (1)..(101): unsure at all Xaa locations
  Clone ID: PAT_TA_21975.pep
MKGSSEPGETSKQAPLGSSRGVSKGVSVLDXYFRFIAIIRHPPLAPLQWGTTNETLXFFTHSSGSKAQYSDFPTLXFFRPGDSIVCAYLTLSXPLSIVHII

SEQ ID NO: 127558 - protein, 130 aa, Triticum aestivum
  Clone ID: PAT_TA_21976.pep
CDVLVPCALGGVLNKDNAPDVKAKFIIEAANHPTDPEADEILAKKGVVVLPDIYANSGGVVVSYFEWVQNIQGFMWAEEKVNDELEKYMSSAFQHMKAMCKSLDCDLRMGAFTLGVNRVARATLLRGWEA

SEQ ID NO: 127559 - protein, 421 aa, Triticum aestivum
  unsure (1)..(421): unsure at all Xaa locations
  Clone ID: PAT_TA_21977.pep
MGSTALGGAAPARAGLAPKNGVLGSTFKPCGVVKLKTTPKVGRSSVCVRASIASSPQKQYSPKTPAVQSGEEVRIAVLGASGYTGAEIVRLLANHPQFRITVMTADRKAGEQFGSVFPHLITQDLPNLVAIKDADFSDVDAVFCCLPHGTTQEIIKGLPRPIPTGPNXKCVTLDSXDLRRDINEYAEWYGHAHRAPELQEEAVYGLTEVLRDEIRNARLVANPGCYPTSIQLPLVPLIKAKLIKLSNIIIDAKSGVTGAGRGAKEANLYTEIAEGIHAYGIKGHRHVPEVEQGLSEAAESKVTISFTPNLICMKRGMQSTMFVEMAPGVTVSDLYQHLKSTYEGEEFVKLLNGSNVPHTRHVVGSNYCFMNVFEDRIPGRAIIISVIDNLVKGASGQAVQNLNLMMGLPENMGLQYQPLFP

SEQ ID NO: 127560 - protein, 159 aa, Triticum aestivum
  unsure (1)..(159): unsure at all Xaa locations
  Clone ID: PAT_TA_21978.pep
MSSPPPVKLIGFFGSPYAFRAEAALCLKGVPYELILEXTCSGSKSELLLHHNPVHKKVPVLLHGDGRAISESLXVIAEYVEXAFEPAPLLPADPYARAXRRFLGRLNPDKSTTFFMALGWRRQTPVRKEARTPCAGGAGKSFPRATTCPSPRPGQLIKD

SEQ ID NO: 127561 - protein, 324 aa, Triticum aestivum
  Clone ID: PAT_TA_21979.pep
MRHKTQPLNLTTRPPPTPLLPRVRMAGRLLAAPLLLLVLLQLPVPSQVHAYPLAAAHSGRCRRPEERPPPFLQGLRRTCRTATEGHPAEEVNGEELIRELGGKEYTAVLFYASWCPFSHRMRPIFDDLSSMYPHIKHLAVEQSNVMPTVLSRYGVRSLPSILIAHESYAFWPLVAKDLNSLVNFYSAVTGQEPVAYLGPRKWNTTERSTQYVKLWNGSVSESVKSEPYLAFSILFICLRIFSFFFPKFFACIKGLWAQYFRHANFGVLAKLTQLLECVPHAVDVRKMWSKWRLMFGAINMRVWASSLASVSLGGQSSPRAARLD

SEQ ID NO: 127562 - protein, 191 aa, Triticum aestivum
  unsure (1)..(191): unsure at all Xaa locations
  Clone ID: PAT_TA_21980.pep
FFFFFLGKNGRWSLYCTVAPSWALSYSKDNQTVVAKNGALSSKITVAGRPIATRRVSVPASPSHGCSIPRSRSQHLAPPDAARRGRRIRLAGCSKTGSRFQHCHWDALRRVATRAVAVAGCDGSPQHRQAPQRSSRGRPAGRDGLAAASVVEPCTCSGGAKLKASCNLXLXVQXLXGXCESTKXGARXNPP

SEQ ID NO: 127563 - protein, 187 aa, Triticum aestivum
  unsure (1)..(187): unsure at all Xaa locations
  Clone ID: PAT_TA_21981.pep
MPEDVQMNDSEPQPAAPAPAAAAAPALSTLHHLKEIASVIEAGSLSKEVRRISRAFRLTVALRXRRLAARXVSAFLAFALPGVLRSLPAPQSPWVPKGDDTEMDVDAVAPXTQDSIKHGXPEIEXYCYLLXLIFLMXKXKYMXVKYXKRLSPKNLNGEEAWIRTYLGESKEPGVEEDHQNLLPFIIV

SEQ ID NO: 127564 - protein, 63 aa, Triticum aestivum
  Clone ID: PAT_TA_21982.pep
FCRKCVHVNGANSLRIQFVFYFIGRDPFSIGIQILYASFLIYTFKKHNKDLLPIYIKYDLQMQ

SEQ ID NO: 127565 - protein, 105 aa, Triticum aestivum
  unsure (1)..(105): unsure at all Xaa locations
  Clone ID: PAT_TA_21983.pep
ILEPPLGXSRSTNIWSFFKSXSFKHGLCSFAVTGQYXLEKIEDVVGGDGGLHGRTWARMRRNPNATRAMNAAAAAATPIRRPSNATIVIPPPDAGEVEMQVQGYF

SEQ ID NO: 127566 - protein, 83 aa, Triticum aestivum
  Clone ID: PAT_TA_21984.pep
EVLRRRGHQDAPRPHQVLQALVDYILVQRDALRFSFVVAACSWQIVLSIATVTSVRLSYGSHFMLCLPNKPSFPQIQSMHVPK

SEQ ID NO: 127567 - protein, 100 aa, Triticum aestivum
  unsure (1)..(100): unsure at all Xaa locations
  Clone ID: PAT_TA_21985.pep
LRGKLXGLHXSVCFPCPSGRQQLSFGVLPSFVRVFLEKNRCQSGVGAPLGSPSRWQGEIIEHAIGVKTGRSRVGGXKLCVLRINSNNGEGTQCLPRFWPS

SEQ ID NO: 127568 - protein, 123 aa, Triticum aestivum
  Clone ID: PAT_TA_21986.pep
WIGFEFILYMVQMIPSSTKATAANSSKANKKRGYRINPSTLHITVFSFRIVSLRLIKGSMATLTQAKHEDSSVKSTQFGLLLPPDLAAASLPSTSWERRPKYHIPRNHSGHDGAGRRRGNESR

SEQ ID NO: 127569 - protein, 68 aa, Triticum aestivum
  Clone ID: PAT_TA_21987.pep
WRSHPNYYRDLIPPRDGVDHFPIGGRSQAMTSHPKPKLKGLLRMELTSHHWNIYPRIDRNFKLLQILV

SEQ ID NO: 127570 - protein, 292 aa, Triticum aestivum
  unsure (1)..(292): unsure at all Xaa locations
  Clone ID: PAT_TA_21988.pep
MATKRSVGTLGEADLKGKKVFVRADLNVPLDDAQKITDDTRIRASVPTIKFLLEKGAKVILASHLXGRPKGVTPKYSLKPLVPRLSELLGVEVVMANDCIGEEVEKLAAALPEGGXVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATA

SEQ ID NO: 127571 - protein, 197 aa, Triticum aestivum
  unsure (1)..(197): unsure at all Xaa locations
  Clone ID: PAT_TA_21989.pep
NLIYFDLYQSTRLEKFVTAYGQFLKANGEQPVTWKRASSMEEVLREADVISLHPVLDKTTYHLINPERLAMMKKEAVXLVNASRGPVIDEVALVEHLRANPMFRVGLDVFEDEPYMKPGLAEMKNAVVVPHIASASKWTREGMATLAALNVLGKIKGYPVWGNPNAVEPFLDEKAAPPPACPSIVNAKQLGLPSSKL

SEQ ID NO: 127572 - protein, 215 aa, Triticum aestivum
  unsure (1)..(215): unsure at all Xaa locations
  Clone ID: PAT_TA_21990.pep
EFGTSSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAXELSKKGVTTIIGGGDSVAAVEKVGVADVMSHISTGGGASLELLEGKELPGVVALDEGVMTRSVTV

SEQ ID NO: 127573 - protein, 481 aa, Triticum aestivum
  Clone ID: PAT_TA_21991.pep
MASTAAPPAALVARRAASASAAAAPLRRAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVSV

SEQ ID NO: 127574 - protein, 480 aa, Triticum aestivum
  Clone ID: PAT_TA_21992.pep
MASTAAPPAALVARRAASASVAAPLRGAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVTV

SEQ ID NO: 127575 - protein, 401 aa, Triticum aestivum
  Clone ID: PAT_TA_21993.pep
MATKRSVGTLGEADLKGKKVFVRADLNVPLDDAQKITDDTRIRASIPTIKYLLEKGAKVILASHLGRPKGVTPKFSLKPLVARLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 127576 - protein, 386 aa, Triticum aestivum
  unsure (1)..(386): unsure at all Xaa locations
  Clone ID: PAT_TA_21994.pep
MAKPISIEVWNPSGKYRVVSTKSMPGTRWIKLLTDNDCRLEICTEKKTILSVDDILALIGDHCHGVIGQLTEDWGEVLFSALKRAGGTAFSNMAVGYNNVDVDAANRNGIAIGNTPGVLTETTAELAASLSVAAARRIVEADQFMRAGLYDGWLPHLFVGNLLKGQTVGVIGAGRIGSAYARMMIEGFKMNLIYFDLYQSTRLEKFVTAYGQFLKANGEQPVTWKRASSMEEVLREADVISLHPVLDKTTYHLINPERLAMMKKEAVLVNASRGPVIDEVALVEHLRANPMFRVGLDVFEDEPYMKPGLAEMKNAVVVPHIASASKWTREGMATLAALNVLGKIKGYPVWGNPNAVEPFLDEKAAPPXACPSIVNAKQLGLPSSKL

SEQ ID NO: 127577 - protein, 401 aa, Triticum aestivum
  Clone ID: PAT_TA_21995.pep
MATKRSVGTLGEADLKGKKVFVRADLNVPLDDAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLPVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 127578 - protein, 401 aa, Triticum aestivum
  Clone ID: PAT_TA_21996.pep
MATKRSVGTLGEADLKGKKVFVRADLNVPLDDAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADLYVNDAFGTAHRAHASTEGVTKFLMPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 127579 - protein, 470 aa, Triticum aestivum
  unsure (1)..(470): unsure at all Xaa locations
  Clone ID: PAT_TA_21997.pep
MAAKGDGPAIGIDLGTTYSCVGVWQHDRVEIIANDQGNRTTPSYVAFTDSERLIGDAAKNQVAMNPINTVFDAKRLIGRRFTDSTVQSDIKLWPFKVVAGPGDKPMINVQYKGEEKQFAAEEISSMVLIKMREIAEAFLGSTVKNAVVTVPAYFNDSQRQATKDAGVIAGINVLRIINEPTAAAIAYGLDKKASSVGEKNVLIFDLGGGTFDVSLLTIEEGIFEVKATAGDTHLGGEDFDNRMVNHFVQEFKRKNKKDISGNPRALRRLRTACERAKRTLSSTAQTTIEIDSLYEGIDFYTTITRARFEELNMDLFRKCMEPVEKCLRDAKMDKSTVHDVVLVGGSTRIPXRVQQLLQDFFNGKELCKNINPDEAVAYGAAVQAAILSGEGNEKVQDLLLLDVTPLSLGLETAGGVMTVLIPRNTTIPTKKEQVFSTYSDNQPGVLIQVYEGERTKTRDNNLLGKFELSG

SEQ ID NO: 127580 - protein, 130 aa, Triticum aestivum
  unsure (1)..(130): unsure at all Xaa locations
  Clone ID: PAT_TA_21998.pep
MAKDIEASGPEAGEFSAKDYTDPPPAPLIDAEELTQWSLYRAVIAEFIATLLFLYITVATVIGYKHQTDASASGPDAACGGVGILRIAWAFGGMIFILVYCNAGISSGHIXPGVTFGCSWPRSFLVRALL

SEQ ID NO: 127581 - protein, 100 aa, Triticum aestivum
  unsure (1)..(100): unsure at all Xaa locations
  Clone ID: PAT_TA_21999.pep
NLSLKVQGMERMLKLRACLGYCPPTQVAVCLARHRPQPDGAELDADGHAGPHGERHEPGRPLLQQLRRDGAVEPRLPREREPGARGAVARYNXGXALQXR

SEQ ID NO: 127582 - protein, 67 aa, Triticum aestivum
  Clone ID: PAT_TA_22000.pep
TWPRVCICQYATVSSNHSYYCLQGGTVFDFYFPCAMLNLGQEVQSLSHCFPVRAKQYQMENLIFAGT

SEQ ID NO: 127583 - protein, 89 aa, Triticum aestivum
  Clone ID: PAT_TA_22001.pep
MSSQRPGRHQRRASQSVFVLPENLASLDVDAAADAGAKAGGPEGAGAGAEQQARPPAGRHHRRAMSVAAAVASKELELIKEDLGSTTTG

SEQ ID NO: 127584 - protein, 79 aa, Triticum aestivum
  unsure (1)..(79): unsure at all Xaa locations
  Clone ID: PAT_TA_22002.pep
GAVEERKGTHVTRXLEKRKEGXTLDPHIEEQFGSGRLLXACISSRPGQCGRADGYILEGKELEFYMKKLQRKKGKSAVA

SEQ ID NO: 127585 - protein, 141 aa, Triticum aestivum
  unsure (1)..(141): unsure at all Xaa locations
  Clone ID: PAT_TA_22003.pep
MIFFGQYMYGDLQTTERIDQSPLPLLKQQASRKTRERERERERERERLPVEXSHTVCSSCMYTAREQLRLNSXQNGTHGVMEIGLVAPAKQHDDAAAENVEPSPFLPQGSVEPPLSSSELHGLIERRFGAGKMSAELGYLR

SEQ ID NO: 127586 - protein, 83 aa, Triticum aestivum
  Clone ID: PAT_TA_22004.pep
QERRTTVGFTQITEHLMADALELSFPHNPRIILLITHKYTYTHNQHTEISSGDKTTELEQNLTDTNTRCGQRAKADGIANTTC

SEQ ID NO: 127587 - protein, 81 aa, Triticum aestivum
  Clone ID: PAT_TA_22005.pep
RNKIGHSIARKVPAAHITLLVPDCQRIVNLSIRTLAITPAKVAATVAEEKLAIHKTNPTHMSLQWHQINNNPRTSCFCHDV

SEQ ID NO: 127588 - protein, 98 aa, Triticum aestivum
  Clone ID: PAT_TA_22006.pep
WLMAEAVCGPPASMGLHFPQEQLTRITPIFARLLPPLRRSRGCHRNAPLQASNLAKTIARDKPGTTFERCRKHHPHGFNITRDNHALKYSMIITSVTK

SEQ ID NO: 127589 - protein, 67 aa, Triticum aestivum
  unsure (1)..(67): unsure at all Xaa locations
  Clone ID: PAT_TA_22007.pep
TIDDVIRRSSLXSWICLIFLLLVVVDEDRRRKRRKILALRKKILKNYCAVIPLWLASSSIIVVPLDG

SEQ ID NO: 127590 - protein, 112 aa, Triticum aestivum
  unsure (1)..(112): unsure at all Xaa locations
  Clone ID: PAT_TA_22008.pep
GGXXYXVXRDSQDSWXQVSRXRLKTXVARYRXXXAIXPAPLGSRRALTDLQVCRPXEEEWARGTGCGTSIRCCLRRRPKKENGQMNEGNKCVMLIRRRNNNGSTDNSGSVDL

SEQ ID NO: 127591 - protein, 93 aa, Triticum aestivum
  Clone ID: PAT_TA_22009.pep
NSIQKLVLQSNPHFYCSQKSEINPEYSLGPWAHLPKQKYCMTFCNSFAIENSFSSGPKIPVCTTSTFFLGSFGPGSFRSLTTLLRKLNPKRSA

SEQ ID NO: 127592 - protein, 141 aa, Triticum aestivum
  Clone ID: PAT_TA_22010.pep
SIPSLLFRELFSSRYTTQSFALKNHHHKNALHRAPRPGHGQLGRCPVHHWPLLQHHHSHGDWYCHHWHRCHWVLRPPVPLPAHLLAALATLTASTSSDASLLRTASLGFTQAYSSEENDPDRCAQCLLGAPASSVSNDNSC

SEQ ID NO: 127593 - protein, 186 aa, Triticum aestivum
  unsure (1)..(186): unsure at all Xaa locations
  Clone ID: PAT_TA_22011.pep
MKLKQLEGLLGGLTQFSDPKLELEQYATGPHIASRMLYMAENSFNDITGKVVADFGCGCGTLAVASALLDAEHVLGXDIDPQSLELAQENAADLEXDIDLIWSDIKNLNLKXLHVDTVVMNPPFGYTKGMGANMESLPXXLASCFQAVYSXHKTXTREHIKKEPCWNASCGGHPTAIYADYSQKNI

SEQ ID NO: 127594 - protein, 64 aa, Triticum aestivum
  Clone ID: PAT_TA_22012.pep
TNSHIYFQCDARHMLIQLHVVFDLFVLCLAFRYVCLFEIFKNLCQGAHISADYSSKSIDRKKKK

SEQ ID NO: 127595 - protein, 281 aa, Triticum aestivum
  Clone ID: PAT_TA_22013.pep
CFCREARRTKPETTVEHREREGENKSGSGPARSRIFAAGDAGWRGDGGGARCSIAASRCSSSFSLEEFGLVPEIGVMPMRILLPARPSRVRWFLAILLLVVAVGSLLLEGGALESSEISSMSSLVCRNPLRLLSPTAVTMVVVKSTGTGMKTALATGSRANHRWCLSFGAPGGQPACSAAAPPNPLAKGRPNLFLLALKLYGRQCYSSSMFTACCGEELVGPSGDVPGAGEFGVDREWLGPDCVPLQIFGVLSAYFRDCFVIFSLLCVLLLWLVLPYCNIK

SEQ ID NO: 127596 - protein, 97 aa, Triticum aestivum
  unsure (1)..(97): unsure at all Xaa locations
  Clone ID: PAT_TA_22014.pep
MREIISIHIGQAGIQXVGNACWXELYCLEHGIEPDGNMPSDTSVGVPHDAFXTFFXEXGSGKHVPXXIFVDLEPLSLIXSTGXYATLQPEXXLGKED

SEQ ID NO: 127597 - protein, 69 aa, Triticum aestivum
  Clone ID: PAT_TA_22015.pep
FFFSNNTHPIKRLLNSSVTTQTRKHGDLINLQVQRSTVGGNRSKTSTTQSHERSTTFALFADMKLHCSK

SEQ ID NO: 127598 - protein, 177 aa, Triticum aestivum
  unsure (1)..(177): unsure at all Xaa locations
  Clone ID: PAT_TA_22016.pep
MSMDRMARRSVSLLLALALLAAAASADSWLYEKFTTEGNVRADYNAQGQQVTSLILTQQSGGAFSSXQKYLYGEFSIQXMXLIPGNSAGTVTSFYCRPGDGPGTTDXHGFMGNANGHPGANNNFWXNGAGRRHILLWFNRRRFKLISDHRLSQDTLRANVPDCVRRNQSCPTWPIRA

SEQ ID NO: 127599 - protein, 56 aa, Triticum aestivum
  Clone ID: PAT_TA_22017.pep
VEQTSASPSKAKLFHKHRKNPISTCRLLDCVWYKQMNIIKVLIRCSCHHHNLTRHH

SEQ ID NO: 127600 - protein, 127 aa, Triticum aestivum
  unsure (1)..(127): unsure at all Xaa locations
  Clone ID: PAT_TA_22018.pep
MAPKRGGRAPVPAKKKAVVTNPLFEKRPKQFGIXGGALPPKKXDLHRFVKWPKVLRIQRQRRILKQRLKVPPALNQFTRTXDKNXATNLFKMLLKYRPEDKAAKKERSCRXQAENEGKTVESKKHLL

SEQ ID NO: 127601 - protein, 193 aa, Triticum aestivum
  unsure (1)..(193): unsure at all Xaa locations
  Clone ID: PAT_TA_22019.pep
MARRRKTDAPPRLDEADRTLYSTFCGAANSLSQLYAQXAMAQQEVNFHAGERHALRKVYQWFLXRKHDEEARXTVAEIMSHIQHEIDYVRYGCNVSPKSTQHPPVCNPFAFNFPNLDWFCMGINTGFXPXPMFTDNSXDXIPQSLTXPXARLQNSYNQXAXNGGRSXQTTGQIRGNQPTHFLVGTIHIFIFHK

SEQ ID NO: 127602 - protein, 67 aa, Triticum aestivum
  Clone ID: PAT_TA_22020.pep
KMSTALVAFERPPGQVPLSIYVLSLPLPYMPGGTSLSTSFLVGAAVLVLGLLLYNLPQNSADQVKTE

SEQ ID NO: 127603 - protein, 154 aa, Triticum aestivum
  Clone ID: PAT_TA_22021.pep
RTCLGKDLAYLQMKSIASAVLLRHSVELVPGHKVEQKMSLTLFMKNGLRVHVKPRDLAGYVVAPEEAPQLGAFVISDHNCSSCISLHVPAHITRFFRAEFLPYASACQIISFLRSPSFIKLLVVGAPASGVRGPGCCGRWRRSAGRGVQSRRFP

SEQ ID NO: 127604 - protein, 77 aa, Triticum aestivum
  unsure (1)..(77): unsure at all Xaa locations
  Clone ID: PAT_TA_22022.pep
ENAERDERAKKSVSINEFLKPAEGERYYGGRGRGRGRGDRGGXLRGGYGGGIQSVAXAAAAPSIEDQAQFPSLGWES

SEQ ID NO: 127605 - protein, 92 aa, Triticum aestivum
  unsure (1)..(92): unsure at all Xaa locations
  Clone ID: PAT_TA_22023.pep
LNLQELCVRAALAGLCFHGYQKLSYMILARVSPXVTHSXVANCVKRVVXVILSSLLLPPRTPISPVCTGGLGPALARVYLYPRLQESKAKDS

SEQ ID NO: 127606 - protein, 227 aa, Triticum aestivum
  unsure (1)..(227): unsure at all Xaa locations
  Clone ID: PAT_TA_22024.pep
QVKATENALVDEPEMHKNAGSPRTXAEKLRGQGAEPTSSKIKIWLNNRKAKLARIAKERGVPYEGEGADKSSTPATSQLGDSSESAGEESYLPPSRVLNALGLSNSKGSSRLVTPDSSEPSTQDMMTSRPFTRSLSFEPGRPVLLIDNEGNEIGRGEIFQVDGRAQGKSLAESHICIIDVTELKVEKWRELPHPSEASGRTFQEAESRHGGVMRVAWDVVRLTPVAT

SEQ ID NO: 127607 - protein, 109 aa, Triticum aestivum
  unsure (1)..(109): unsure at all Xaa locations
  Clone ID: PAT_TA_22025.pep
MSEAAVRVIGLWPSPFVIRVLIALKLKGVEFEFVEEVVGRKSELLLRSNPVHKKIPVLLHHGKPISESLIIVQXYIDEVWSSGAPXFLPVDAHARAVQRFWGAVRRTTR

SEQ ID NO: 127608 - protein, 134 aa, Triticum aestivum
  unsure (1)..(134): unsure at all Xaa locations
  Clone ID: PAT_TA_22026.pep
MADFSKESCPSVKNILLLDSEGKRVAVKYFSXDDWXTNASKLAYEKLFLLKTXLKTNARTXEAEITLFXDGYIAVYKFXVHDLHFFXSTAGDDEKXTQPYKCXQGFPDPVGLLPRGDVXKAAXLXNLVLILPAP

SEQ ID NO: 127609 - protein, 123 aa, Triticum aestivum
  unsure (1)..(123): unsure at all Xaa locations
  Clone ID: PAT_TA_22027.pep
WVTFVPAVVGTLCDTFADGFCTGNANDPAFCPPACAGAMQXTLVTGCTAGMHHTLPLQXVPSLCAALLGDLLAPPSYRCILCAPRRLCPQALPSLHASLAATLFLSXAPWLPTIPITRXMTSA

SEQ ID NO: 127610 - protein, 135 aa, Triticum aestivum
  Clone ID: PAT_TA_22028.pep
RMLGGVESCSTEIRNMVYLFSTGDKVASEHEAAELKLMMIEMGPSMLSAGNGTLEVEEEKEEVAGIHCEKLAIIVGISNSPHFRSIRIIKTARMCNHCHTFAKLVSEKYGRQILIKDPKYLHKFENGNCSCEDYW

SEQ ID NO: 127611 - protein, 261 aa, Triticum aestivum
  Clone ID: PAT_TA_22029.pep
RDCRRNVIREFKELKELKRIRREPRCTSWFCVADYAFQCEVFEDSVIVDWRQSISETDGSYHHFEWAIGTDEGQSDVFGFENVGMKTQVQRSGIDLDQFEDYFITLRAWKLDGRYTEMCVKAHALKGQSCVHHRLVLGDGFVTITKGESIRSLFEHAEEAEEEDEDDAMERDENDLDGDGSHPQKHAKSPELAREFLLDAAAVIFKEQVEKAFREGAAQQNAQSVFVSLALKLLEERVHVACKEIITLEKQNKLLEGGPYP

SEQ ID NO: 127612 - protein, 98 aa, Triticum aestivum
  unsure (1)..(98): unsure at all Xaa locations
  Clone ID: PAT_TA_22030.pep
QLNIPAMFPXKHNAMFLCTLKMPNRLDLPMRSQPSQEAPSEDEDEDDGESHAEPTFGHLKSGQFVSPWDPSXXRXSXFRERNLXHXGXVXXVXXNXXL

SEQ ID NO: 127613 - protein, 155 aa, Triticum aestivum
  Clone ID: PAT_TA_22031.pep
FTRIPLVTASEPGTDQRRGKESASRSNRANGDDDPKREKKMVMPTDPMLWHKVAAVSGVAALGLGTYGAHMFRPQNPRYKEIWQTASLYHLVHTAALLGAPMTKRPNIFGGLLTTGIVLFSGTCYTVAYLEDRKFSSPAPIGGFAFIAAWASLLF

SEQ ID NO: 127614 - protein, 124 aa, Triticum aestivum
  unsure (1)..(124): unsure at all Xaa locations
  Clone ID: PAT_TA_22032.pep
MGGLSVIAPPARDTASPQHRRARRAFLVSNYLILGCASGCGFLTLSLRLGPLRXDGFLLILLHALTVGRRRGGCRPSSAAPDRRAGRCYTAHMXRQRRSCQSCKGAAAVLAFSRNSGFLPAGPV

SEQ ID NO: 127615 - protein, 92 aa, Triticum aestivum
  Clone ID: PAT_TA_22033.pep
TELSHFQVDIWSCMSCKTYSLPSHNIRTFLTLSVMSKTFLYYGTVVVVCWQSLLRLCPAVSNVRRCYKPSHYSHQTHGFTAPSVLSSPKYQG

SEQ ID NO: 127616 - protein, 123 aa, Triticum aestivum
  unsure (1)..(123): unsure at all Xaa locations
  Clone ID: PAT_TA_22034.pep
FEVKSGSCGTVVRNAELKIVDPDTSASLGRNQPGEICIRGEQIMKGYLNDPXEATKNTIDKDGWLHTGDIGXXDDDDEIFIXVDRLKEIIQYKGSKYLPAELEPFSSHNPEIQGSRCLSSNER

SEQ ID NO: 127617 - protein, 176 aa, Triticum aestivum
  unsure (1)..(176): unsure at all Xaa locations
  Clone ID: PAT_TA_22035.pep
PTTALRLSPILSAPGLRETSSLKTLAPRIGSHRPPERGTPPPAAMEMGGMSDAERLFFFEMACKNSEVAYEQNPNDADNLTRWGGALLELSQVRTGPDSLKLLEDAEAKLEEALQIDSNKSDALWCLXGNAQDSHGSSLQDNAIANDSFXKATGFSKKAVDVEPANDCTGISKLVR

SEQ ID NO: 127618 - protein, 133 aa, Triticum aestivum
  Clone ID: PAT_TA_22036.pep
MARTKQTARKSTGGKAPRKQLATKAARKSAPTTGGVKKPHRYRPGTVALREIRKYQKSTELLIRKLPFQRLVREIAQDFKDGPPLQVHAVLGLQEAAKGTRRAVQGHNLCAIQAKGVTSCQRHQLAAASWPKG

SEQ ID NO: 127619 - protein, 144 aa, Triticum aestivum
  unsure (1)..(144): unsure at all Xaa locations
  Clone ID: PAT_TA_22037.pep
FLTCLARGKDVLTCRIGTSGSLXWQQRLVIQGKIAPKNXEAILRGYINEDVICNGCKGPDTILSQXNRLFFPFACXEQCGSPRSVAPIXKAGFVAXSWSGGRPKRKPNWSFALPALFWSCISCFFSCHVNAAEVRFMIVLSLCG

SEQ ID NO: 127620 - protein, 72 aa, Triticum aestivum
  Clone ID: PAT_TA_22038.pep
YPAVVEPPTGFRRGWAPSVAAVGRPPPELHHGFSVKPDRRGGGKEPAAENAAMPAPDEVGEELKRALEARRR

SEQ ID NO: 127621 - protein, 176 aa, Triticum aestivum
  unsure (1)..(176): unsure at all Xaa locations
  Clone ID: PAT_TA_22039.pep
FKXXIWNIPNQILXXPXLFLFEXPFFXMEXIXLXKSFFXQFAGPGVGIQNHNGNLATEWAAGGTKGTTPSTTKVERQQGRHRRRPGTGRVWRGRERGGPGGRRGRRRSWSRAVWPAPGPHMNGCRWXRRSWAKLPPLGLVCATSSGRGVPQHVCFPVFPAIFERQCSALRIRPFTM

SEQ ID NO: 127622 - protein, 171 aa, Triticum aestivum
  unsure (1)..(171): unsure at all Xaa locations
  Clone ID: PAT_TA_22040.pep
WTEDISDLDIEVFRSVISTVRASRLLPPPLIGEALHVYACKHLVDPLHVASDAGLTANGEKLVAMQRRVLESIVTMVPGEXGPVTGRFLLRLLRXGNYVXASSSTRAQLIRQAGXQLDEAXAADLLIPLHRTRTRTTSDEPSFWPFKRPREQQRVYHGKSKISQYWGGRSE

SEQ ID NO: 127623 - protein, 83 aa, Triticum aestivum
  unsure (1)..(83): unsure at all Xaa locations
  Clone ID: PAT_TA_22041.pep
MALSRRMAAPVLVLMLLLXVATELGTTKVAEARHCLSQSHRFKGLCMSSNNCPNVXTTVSRPGGEGKAPAPSRCCFCQKIPGL

SEQ ID NO: 127624 - protein, 43 aa, Triticum aestivum
  Clone ID: PAT_TA_22042.pep
MARDCPSGGGGGGGRFGGGGGGGGDRSCYNCGEAGHIARDCPT

SEQ ID NO: 127625 - protein, 590 aa, Triticum aestivum
  unsure (1)..(590): unsure at all Xaa locations
  Clone ID: PAT_TA_22043.pep
MANASSISRSLRRSLAPDDLHRLLLQRSRAFVTAECHRPVVLHKRGPDILHDPWFNRGTAFSMTERDRLGLRGLLPPSVVSSQQQIDRFMGDLKRLEQNARDGPSDTYQLAKWRILNRLHDRNETMYYKVLIDNIEEYAPIVYTPTVGAVCQNYSGLFRRPRGMYFSAEDRGEMMSMVYNWPADQVDMIVVTALVLVHSLIWYSVVQLFKCVLKGVVLAFELSVTPSPSPIPSPRGTQRWVRTPIGSFVAVVLAIEPPLPSPSPSPRGTQRWARTPCNHHDLRCNSWSSWSCKSTRKANDXDSQTKDVVAGAGSAGIGVVNAASRTMARMLGNNEVAFESARSQFWIVDAHGLITEERVDIDPDARPFARRKSELTHQGLNEGASLIEVVKKVKPDVILGLSAVGGLFSKEVLEALKDSSSSRPAIFAMSNPTKNAECTPEEAFSIIGEKVVFSSGSPFDDVDLGDGKIGHSNQGNNMYLFPGIGLGTLLSGARIVSDGMLQAAAERLASYMKEEEVLQGIIYPPTSRIRDITKEVAAAVVREAVADDLAEGYRDMDARELARLSEEETVDYVKNNMWNPVYPTVVYKKD

SEQ ID NO: 127626 - protein, 102 aa, Triticum aestivum
  Clone ID: PAT_TA_22044.pep
RAEQAGGSGRAKASSISSYRSCRRSRAMERAVPVRKPHTNTADLLSWVRPRALTHLPRPAASSRPSLKPAAGIYPAISAAPATEQGAEVLSKSERNFAPGQI

SEQ ID NO: 127627 - protein, 187 aa, Triticum aestivum
  unsure (1)..(187): unsure at all Xaa locations
  Clone ID: PAT_TA_22045.pep
MARRIAVAAAFLALAVVAPAALAQAPGPAATPSGPPNVTAILEKGGQFTMFMRLMKETQQDTQLNSQAEQXYASSGGGYTVFXAPTDNPFNNLXKPGTLNSLTQQQQVALVQGHSXPQFYSMDSFQPPAXPVRTQASGRDGPYTLNITQRQQQATSPGAPGTSPAPKALTRSPSLFGKGPPFKEQKG

SEQ ID NO: 127628 - protein, 140 aa, Triticum aestivum
  Clone ID: PAT_TA_22046.pep
ATEATEPPMPEPPPAPPTTVNEESAEELRERAPPPESSPLITQAREGDGERVVVVPPPPASPPLIKPALGGVVPAAFSSSPALPRPPGYAASESDSDLDHDPFANPSDEVRWRIRFKMTGGWRSGGMVSCRCIRAQVGRR

SEQ ID NO: 127629 - protein, 360 aa, Triticum aestivum
  Clone ID: PAT_TA_22047.pep
AYRQDQIVSVWLLQSTTFFSIWIKQHLQSIVHIFYSEGTDHSYSWYLQLRNLVWATSKHDVYMAQNNSVMHWSSLLQRGTEVLHVAGQVVPKQKAHGARTLSRVQISSMALKDNLMVAGGFRGELIFKYVDKPGVAFCTNAADNKNSVTNAVDVYESTSGATRVTAANNDCTVKFLDAERCSLLSRFTFPWSVNNTSVSPDGKLLAVLGDSSDCVITDAQSGEEIATLKGHLDYSFSSAWHPGGHVLATGNQDKTCRLWDTRNLSAPFAVLGGRIGAVRGLRFSSDGRFLAAAEAADFVHVYDARAGYGAAQEIGLFGEIAGVAFSPDADALFVGVADRAYGSLLEFGRRGRHAYLDSYL

SEQ ID NO: 127630 - protein, 353 aa, Triticum aestivum
  unsure (1)..(353): unsure at all Xaa locations
  Clone ID: PAT_TA_22048.pep
MAGGFAGVEAGGGRAEQYEGRITPYFILACIVGSFGGSLFGYDLGVSSGVTSMDDFLIKFFPDVYDRKHAHLHETDYCKYDNQVLTLFTSIRXXAAGRVSTFGASYVTKRHGRRGSIMVGAVSFFLGGAVNAAAVNVAMLIXGRVLLGVGIGFGNQAVPLYLSEIAPFKIRGAVNQLFQLTTCLGILVAHVINYFTDRIHPWGWRLSLGLAVLPATAIFVGALFLPETPNSLVERGRLEEARRVLEKVRGTHKVDAEFEDLKVASEAARAVRGTFRNLLAVRNRPQLIIGALGIPAFXQLSGMNSILFYXPVIFXNLGFGSSGGLYSVHQGVHGRRCPVVVDRGAAGCPQWAG

SEQ ID NO: 127631 - protein, 55 aa, Triticum aestivum
  Clone ID: PAT_TA_22049.pep
ECTPCWVQEVDLRVLKRLSSGLRHWGEDELAVALLRRAGPEAMGTAAEMILGREL

SEQ ID NO: 127632 - protein, 129 aa, Triticum aestivum
  Clone ID: PAT_TA_22050.pep
ARTSRWPSTPWTRCRSPTSCSGRSRPPRRPPRPRPPPSPSPRRRRSPPGSPRRPRPTTPPPTTTPRSPPPRPSPASPGGPPSSVPPSSAPCSDPIREEQHMVVWWCHLSCSVRDRVALADGSIGGSLYR

SEQ ID NO: 127633 - protein, 142 aa, Triticum aestivum
  Clone ID: PAT_TA_22051.pep
SSPPATTSTAPPASRATTCSSAASSARTSRWPATPWTRCRSPTSCSARSRPPRRPPRPRPPPSPSPRRRRSRPGSPRRPRPTTPPPTTTPRSPPPRPSPASPGGPLYSVPPSSAPCSDLIRSDPIREERHKVVVVPSFLHCA

SEQ ID NO: 127634 - protein, 200 aa, Triticum aestivum
  unsure (1)..(200): unsure at all Xaa locations
  Clone ID: PAT_TA_22052.pep
MHRPTPSQHPLPGQEIGRRAATAGTEGRGATPAKARTAGCSGSSTRIASWDSGASAMPADRVLAAAPGSGAVVAGVPFMGLGDEEAVGGEGGAEAVAESEGVQGGRCHEKQDPMLVLKFIWXEKNIGXALDQDGWVVVAGFPLSPLLLLAGGKDAWEELKSEXWEEKEWISQKQMIILXQPGPPDIINXLWQQGGGSLST

SEQ ID NO: 127635 - protein, 143 aa, Triticum aestivum
  Clone ID: PAT_TA_22053.pep
MASLPEEEEAFEHTLLVVREVSVFKIPPRTTSGGYKCGEWLQTDKIWTGRLRVVSCGDRCEIRLEDPGSGDLFAACFVLPGQRDSAVETVLDSSRYFVLRIEDGRGKHAFVGLCFGERNEAFDFNVALSDHETYVKREQDQET

SEQ ID NO: 127636 - protein, 232 aa, Triticum aestivum
  Clone ID: PAT_TA_22054.pep
RRPPGAAAPPPPRTFHPSIPRLLLLYLFFPSRTQSKPQLRTKIPRDSPRGFILRQDQTQNPPLPAGFEVRAVAFEEGVALSDQEKYVKREQDKETGGEEADDSQIDIHPAVNRRLKEGETIRINVKNKPSTGSGMLSSAGLSGGATEKPKASMLLAPPPGATGKLRSPLPPPPNDSASARMILVPNAGTRASKEPTKKSIDPFSDISALGRSLPSSTELGQTKSTGAGWAAF

SEQ ID NO: 127637 - protein, 89 aa, Triticum aestivum
  Clone ID: PAT_TA_22055.pep
VFFLSLYCTMIRRLMPMKLPCSSPLSKISSMFRRLSRSSSTPGSNHQLSRRLKTIKKSKQLGHSKHHVARLSRLLFFPVRIIHMSSDTG

SEQ ID NO: 127638 - protein, 236 aa, Triticum aestivum
  Clone ID: PAT_TA_22056.pep
MASASRLLPPFPPPAAPTSRHTTLRAVPRSCSLAIPSLRCRASAPAAVDAGSPLLLEDRAGAVSIREFVTLDELHAAVRLRVRTFYEYARDTVGAEDHRKGLAEREYEALQNRISGNMINFRRVSCINGTVPLLPSLMSAEELCSTCKFIEDGEERIVVGSLDLNQCLWLPDELTGKEPRVTESSHTRAYLSNVCVAKELQRCGLGYALVDKSKKLAPQWGITDCGHVATTTGPNS

SEQ ID NO: 127639 - protein, 82 aa, Triticum aestivum
  unsure (1)..(82): unsure at all Xaa locations
  Clone ID: PAT_TA_22057.pep
SLEPDWSMDPQTLIPLGLLFTAPGEASTNASSQSPPRPLSQSPLKSXTGEPTTQPSRRRQPPRVTSQRPHLMISLVPQRSTT

SEQ ID NO: 127640 - protein, 124 aa, Triticum aestivum
  Clone ID: PAT_TA_22058.pep
LNVVYCSWINHPDGGSKVAKSTAGTTHPGGGCSAPNTLRATVRSGAAHTAGAAPRAAVSAGAPPTAGGETRAGLSARLLSAADGDIRGRGGALGGCQGGGDGAWRAGEGAGGRETKRPGREEVG

SEQ ID NO: 127641 - protein, 167 aa, Triticum aestivum
  unsure (1)..(167): unsure at all Xaa locations
  Clone ID: PAT_TA_22059.pep
MSSPHHTQAYLDADKGPTILGLVITVSILSTIFVAGRVYTRKRIIGALHLDDWFTIVAVIFEWVXVGVTVVAVKNGNGRHFDLLNVTQQAECHSIHYLGASRLASWPLGFPKLAVVALITRLMNPGRLHXIFLGVLAGCCMMGLIGVSSIQLPKLPGRPMDVNTDAS

SEQ ID NO: 127642 - protein, 62 aa, Triticum aestivum
  Clone ID: PAT_TA_22060.pep
GAFFFFFFISYAQFYFELSELCHNVPGKRIQLHGIICYIVWTNIHSKFWFSAKFPDFVVMLC

SEQ ID NO: 127643 - protein, 157 aa, Triticum aestivum
  unsure (1)..(157): unsure at all Xaa locations
  Clone ID: PAT_TA_22061.pep
VITKHQLICHDLSHLILRFRLLQTYTPTPPAVVPAGRADGRPAERRPDGPPGLLALLPHWNTTFGSLRANCTPATHSSHGMALRVTCGREAGGASAIGVFGGTLPPSPAAAATVIVPLPAARPRAPQPGGSAGPGPAAAPVELQLLFPLVGXRSRKX

SEQ ID NO: 127644 - protein, 94 aa, Triticum aestivum
  Clone ID: PAT_TA_22062.pep
MAMGSLAFATALVFVFVFAIAVPAVAAAAQAPAPAPTSDGTSIDQGIAYLLMIMALVLTYLIHPLGRLRPVTSSSERADFLLHFWVGFCSGSLE

SEQ ID NO: 127645 - protein, 89 aa, Triticum aestivum
  unsure (1)..(89): unsure at all Xaa locations
  Clone ID: PAT_TA_22063.pep
IKGLFISMSMHLLRKSFCDVGVGFLGPVLMIAIRYHEARRGEQGPPLRLLPSDRQLLRKEVVRKGQRPPVAGREVKLTFVRAYMXEVSP

SEQ ID NO: 127646 - protein, 49 aa, Triticum aestivum
  Clone ID: PAT_TA_22064.pep
LRKKYKNCSETILTHLIGRDCDQDEQEYESMWTFIVERDYIARVLFVLG

SEQ ID NO: 127647 - protein, 114 aa, Triticum aestivum
  unsure (1)..(114): unsure at all Xaa locations
  Clone ID: PAT_TA_22065.pep
SFEQKCDELMDSYATLLFAKITEIKPXAFCKQYGLCRGTALFSGVTSDSTCVFCHHLLDEVMSKLKDPDAEFEIIQILIKECNKIEGHVQQCKRLVLQYIPLILVNGENSPRGG

SEQ ID NO: 127648 - protein, 119 aa, Triticum aestivum
  Clone ID: PAT_TA_22066.pep
GKSAGKEGGVDKKGRKKAKKSVETYKIYIFKVLKQVHPDIGISSKAMSIMNSFINDIFEKLAGEAAKLARYNKKPTITSREIQTSVRLVLPGELAKHAVSEGTKAVTKFTRPKLLSSSP

SEQ ID NO: 127649 - protein, 390 aa, Triticum aestivum
  unsure (1)..(390): unsure at all Xaa locations
  Clone ID: PAT_TA_22067.pep
MSTDADAVPVAVAPAKRPPINKYAFACALLASMNSVLLGYDISVMSGAQLFMKEDLKITDTQIEILAGIISIYSLLGSLMAGLTSDWLGRRYTMVLAAAIFFTGALLMGLAPNYAFLMAGRFVAGIGVGYALMIAPVYTAEVAPTSARGFLTTFPEVFNNFGILLGYVSNFAFARLPVHLSWRAMFLVGAVPPVFLGFAVLAMPESPRWLVMRGRIEDARRVLLRTSDSPEEAEERLLDIKKVVGIPADATDADDVVAIVRANEAARGQGVWKELLINPSRPVRRMLVAGLGLMFIQQATGVDCVVMYSPRVFEKAGMKNRTNSLGASMAVGXCKTFFIPIATLLLDRVGRRPLLLASXAGMAIFLFTLATSLLMLDRRPESEGEGAGAR

SEQ ID NO: 127650 - protein, 213 aa, Triticum aestivum
  Clone ID: PAT_TA_22068.pep
MATAKPILYGAWISSCSHRVRIALNLKGVDYEYKAVNPRTDPDYEKINPIKYIPALVDGDFVLSDSLAIMLYLEDKYPQHPLVPKDIKTKGLDLQIANIVCSSIQPLQGYGVIGLHEGRLSPDESLEVVQRYIDKGFRAIEKLLDGCDSKYCVGDEIHLGDVFLAPQIHAAINRFQIDMTKYPILSRLHDAYMEIPAFQAALPQNQPDAPSAK

SEQ ID NO: 127651 - protein, 355 aa, Triticum aestivum
  unsure (1)..(355): unsure at all Xaa locations
  Clone ID: PAT_TA_22069.pep
MASYDKQFKVLEVPPIVQELVGAGVQEPPSQYVLPEQDRPAAAVSEMPEPIPIIDLSRLSAGSAEEFDKLRSALENWDLFLAVGHGMEPSFLAEAMKATREFFNLPLEEKQKYSNIVDGEKLGMDGYGNDMVVKENQVLDWNDRLNLLVEPEALRTYRLWPTQPPSFRDILSEYTVRCKAAANLVFRNMAKILNLQEEHLVNMIGENSITQAIFNYYPQCPRPDHVLGLKAHTDGSIITVNFADAEGLQLQRNGVWYNVPIVPNALIMNVXDIMEILSNGFFKSLVHRVVTNAEKERLSLVLVYTLELETELEPVSDLVDDKRPARYMKIKLHDYMEKYHDTYATGTLAIDGVKI

SEQ ID NO: 127652 - protein, 260 aa, Triticum aestivum
  unsure (1)..(260): unsure at all Xaa locations
  Clone ID: PAT_TA_22070.pep
MNNPFSGSPYREICQTIQGSPGTSDRGRGERRSSQPVAAAKPILXGAWISSCSHRVRIALNLKRVDYEYRAVSPRTDPDYVKINRIEYIPALVDGDFVLYDFLTNRXLFSEDEYSQLPSPSLKISKSKCLDXGMMNIDGTSNELHLWLESNFRSIXTLREGRLKPDQSLEGVQRNIDKSFRAIEKXLLDGCDSKYCVGDEVHLGXDVCLAPQIHAAINRYQHDMTKXPNIVATSRTSYMKIPAFXQAALPQNQPDAPSAK

SEQ ID NO: 127653 - protein, 90 aa, Triticum aestivum
  Clone ID: PAT_TA_22071.pep
GYTRNQLTNLRCLIATWLTFATLRMATRYTYYLQLYMQYFFALLPFICNISFLSVVAFHLQYFSVRFTKKYLRRCIDPKLYGLPIKSGDG

SEQ ID NO: 127654 - protein, 120 aa, Triticum aestivum
  unsure (1)..(120): unsure at all Xaa locations
  Clone ID: PAT_TA_22072.pep
MFAPGPTRFWIVPXGFKCGITTSPPKFVACGDLAQVAARXVCMISNSTXSVVEVFSRIXDHKFDLMYAKRALVHXWYVGEGMEEGEFSEAREDLAALEKDYEEVGAEFDEGEEGDDGDEY

SEQ ID NO: 127655 - protein, 210 aa, Triticum aestivum
  Clone ID: PAT_TA_22073.pep
LRHEVDFCLSLLVAGYETTSVLMTVAVKFLTETPAALAQLKEEHENMTKMKGENQPLEWVDYKSMTFTQCVINETLRVANIIGGVFRRANTDIHFKGYTIPKGCKIFASFRAVHLNNEHYENARTFDPWRWQSNNKLQNEVGANLFTPFGGGPRLCPGYELARVVISVFLHHLVMRFSWEAAEEDRLVFFPTTRTLKGYPINLRRRSESV

SEQ ID NO: 127656 - protein, 144 aa, Triticum aestivum
  unsure (1)..(144): unsure at all Xaa locations
  Clone ID: PAT_TA_22074.pep
GIEAESKGAVERVTSSSSRVSQSAAMATRAAARFLQRRFLSSGGKVLSEGGRKAAENVYIKKVEQEKLEKLARKGPSSGEQPSSTTGSAPSDVXADAGPTESASASVSTDKNKNYAVLASAXAALGGLGWYLMLKPKKSEEVVD

SEQ ID NO: 127657 - protein, 127 aa, Triticum aestivum
  Clone ID: PAT_TA_22075.pep
RTPSIAGAGGLVSPESGVRTDQSAGMQEGYKKCTSDRSADDARVGVLLGVEEVARVRQRVTVRRAPRRDVLGVAVLPLLLVAIRLIAFLLLVPIPPLLLGPGRRRPSAPCRSACAACGRRRRGRPCP

SEQ ID NO: 127658 - protein, 281 aa, Triticum aestivum
  unsure (1)..(281): unsure at all Xaa locations
  Clone ID: PAT_TA_22076.pep
FKSKLCDLDASSVYSVLPPDMKLXRTEVEAIKKFKKALGLDDVDAANMHMAIGRRLYRERLDAFQKLIFVSNLVFGDASDFILPWKHLFGITDYQIDIAMRENAKILYALELKSIGRGLDIGTLIEVRRVQLAYKLFDEVAADMFKEHAKKLVQENISSALSILKSNTSAGNIPTEVISEVNSILAFNKLLTVLSKFPQGDRFARGLGPISLAGDFDHDKMVGDLKILYAAYTTEVLSDGRLDDEKLGPLNELRNIFGLGKREAEAIIEGVMSDVKSQVPA

SEQ ID NO: 127659 - protein, 358 aa, Triticum aestivum
  unsure (1)..(358): unsure at all Xaa locations
  Clone ID: PAT_TA_22077.pep
MANPLAGLQDHLKHARDYALEGLYDTSIIFFDGAIAQINKHLANLDDTFIRTKWMNCKKAISEEVEIVRQLDAQLKSFKEAPGTMRSSSPPIRSNNKSFLFQPLDEYPTSSPSTFDDPDVWAPPRDTNTPNRRSARGQSSARKSSQDGAWARGPSKTGTPSRGAKPSGSKASSAVRSSTASSTGGRKGKSSSSKADSASSDAEEGKSKKAQYEGPDGDLAAMLERDVLDSTPGVRWDDVAGLSEAKRLLEEAVVLPLWMPEYFRGIRRPWKGVLMFGPPGTGKTLLAKAVATECGTTFFNVSSATLASKWRGESERMVRCLFELARAYAPSTIFIDEXXSLCTSRGASXEHESSXXXK

SEQ ID NO: 127660 - protein, 168 aa, Triticum aestivum
  Clone ID: PAT_TA_22078.pep
HPDFRHDQLIENFTAKGFTAEELVTLSGAHSIGTSHCSSFTDRLYKYYNNGAYGTDPAIPAAYAARLKKKCPPSTAAHNDTTMVQLDDVTPFVMDNQYYKNLLAGTVAFDSDMALMDDPETAALVDLYAREPSDYWTKRFAAAMVKVSEMDVLTGSKGEIRLNCSKVN

SEQ ID NO: 127661 - protein, 347 aa, Triticum aestivum
  unsure (1)..(347): unsure at all Xaa locations
  Clone ID: PAT_TA_22079.pep
MGGSSTFMLAPAMATTALILLLVLSSSPAVVAWKDSGLSVGFYRELCPKAEKVVRRVVTKAFKKEPGTPGDIIRLFFHDCFVRGCDASVLLESTPGNTAERDSKPNNPSLDGFEVISDAKEILEKLCPQTVSCADILALSARDGAFLASGLDYAIPTGRRDGLVSKADEVLPSVPHPDFHHDQLIGNFTAKGFTAEELVTLSGAHSIGTSHCSSFTDRLYKYYNDGAYGTDPAMPAAYAERLKKKCPPETAAHNDTTMVQLDDVTPFVMDNQYYKNLLAGTVAFDSDMALMDDPETAALVELYAREXPTTATERFAAAMVKIXKMDVLTGNEGEIKAELLQGELVIG

SEQ ID NO: 127662 - protein, 263 aa, Triticum aestivum
  unsure (1)..(263): unsure at all Xaa locations
  Clone ID: PAT_TA_22080.pep
MAAGGMSREERWSLAGATALVTGGSKGIGHAIVEELAGHGARVHTCARSAAELEECRRRWEAKGLPVTVSVCDVSLRAHREQLVETAKQVFDGKLDILVNNAAQILAKAGVEWTSEEYSHLMATNLESCFHLSQLAHPLLLGASIAGGGSIVNISSLGGTLGFPGLTIYSMTKGXINQLTRSLATEWAHNKIRVNCVAPGATKSDMLNSVPPEIKENELAKNPMRRAGEPEEVAAVVSFLCMPAASFVTGQVITVDGGRTISA

SEQ ID NO: 127663 - protein, 143 aa, Triticum aestivum
  Clone ID: PAT_TA_22081.pep
HKITTPTQGETGTQSTQPHDCYFYYLTKAKTIEQGSALTPNPAASHHVDGSAYCTRPPATRMKKTAEQATARTDAAAPAAAPVSGAGAGGTPRSISCADAAANSTAATATSSTATRDAIASRATREQGRRECVAAAAKLSEAE

SEQ ID NO: 127664 - protein, 254 aa, Triticum aestivum
  unsure (1)..(254): unsure at all Xaa locations
  Clone ID: PAT_TA_22082.pep
TSIRLRASPSTVSSPSTSAISSPPPPPSARHSRKHLAGRGDAPARPSKGRVFFLDVNPICFRGSQRSLSAFARWLALFFTHVSLRDPVVAVFDGAGGNEYRRRLLPSYKAHRTRGVGTGADSRVVDVLRECNVPVVQVDGYEADDVVATLTEQVLQKGYRVVIASPDKDFKQLISEDVQLVMPIPEIGRWSFYTLKHYVAQYXCDSTVXFSLKCLXGDEAXXVPGINIWPWFGPKXXVKLLNKHGHXKLLIXCT

SEQ ID NO: 127665 - protein, 115 aa, Triticum aestivum
  unsure (1)..(115): unsure at all Xaa locations
  Clone ID: PAT_TA_22083.pep
LDAGTPRRTSSENRPSPEPPPRCSARARGPLPLPRSSSNAAATSPSAPATTTAAPTSSSXPLSSGXAPPRRCDATPPSSSPPHQRSPFPSSSSTDSVKPRRPRSSTRPPRRPLPL

SEQ ID NO: 127666 - protein, 57 aa, Triticum aestivum
  Clone ID: PAT_TA_22084.pep
PPPLDSISISLSVISISLSVTLLFSYISNRMSCISRIHQYIHLRAPYSGVETLPSIF

SEQ ID NO: 127667 - protein, 123 aa, Triticum aestivum
  unsure (1)..(123): unsure at all Xaa locations
  Clone ID: PAT_TA_22085.pep
MARLNSKAVAAAVVLAAVVLMMAGREASAALSCGQVDSKLAPCVAYVTGRASSISKECCSGVQGLNGLARSSPDRKIACKCLKSLATXSIKSINMGKVSGVPGKCGVSVPFPXNMSTNCNNVN

SEQ ID NO: 127668 - protein, 300 aa, Triticum aestivum
  Clone ID: PAT_TA_22086.pep
MAGFFSTCAASDHYCLQLRSGSAHHELIRPNKYRRTMIRCCSTAKGKTRRDYYQVLGVATHSTPQEIKEAYRKLQKQHHPDIAGDKGHDHALLLNEAYEVLMRSSSRKADGFGKSRGGFGSGYTGDGYSSWNGPIRSQALFVDENKCIGCRECVHHAGETFAMDDVLGSAHVEVQFGDVEQQIQVAVESCPVNCIHWVGSEELPVLEFMARPQPKEGHGVFGGGWERPKDVFAAARNFSRKLEKQERQESSRGANGGEDMEAETAAQAEARRHAGQELRWKSLFDVWNGLGDWRKSGTDR

SEQ ID NO: 127669 - protein, 107 aa, Triticum aestivum
  Clone ID: PAT_TA_22087.pep
ARAARVSIDKDNAPKWNPTTLEEVKYEDIDRLFQPFSPELELQVPSDDSNRWSGKYENTVYGRASQLTVYKDPPAFWYFHPEPLHLRNIQFAAPVYFECLGCATFNV

SEQ ID NO: 127670 - protein, 57 aa, Triticum aestivum
  Clone ID: PAT_TA_22088.pep
LGGAMCACTWHFFYNSESLEVLVALQGALTVIGNITMCIAAYRIYKGSQESTNSNSP

SEQ ID NO: 127671 - protein, 153 aa, Triticum aestivum
  Clone ID: PAT_TA_22089.pep
LTLPSHIQQRARPSEFKPMATKSLLLAALLVLAISLAPHGCGRRASSLHWGLVTGVVPCSAGELHHRPAAVPPFPERRRPDGVPPGCDGEYQRLTAAERTPSTCGPATSSAARPSAAGASARWWVAHPPGRRSNASRATVTRTLNRTVQTPKC

SEQ ID NO: 127672 - protein, 141 aa, Triticum aestivum
  unsure (1)..(141): unsure at all Xaa locations
  Clone ID: PAT_TA_22090.pep
RSXXIVARGXQXGLLXXCPVAXWRDHCCGTXRCVMSPXXAARVLHLAAAPPGMKSGGVSGSADGRKPRRHSWFNFSPSGLPYLPSCSWLDGSDLPAGAGERGEEGLGDGQDGKENQTKYQQRSEWGRLGAIRSRQRPASEL

SEQ ID NO: 127673 - protein, 266 aa, Triticum aestivum
  unsure (1)..(266): unsure at all Xaa locations
  Clone ID: PAT_TA_22091.pep
DRSGKIPVRRKPTVVSLFVEAKHSELRKVHNRSQGPSARVQHQKGLTSFRSLPLRSGSTPAYGFSFKCDERAEKRREFYSKLEEKIHAGRRXEISNMQAKSKETEEAELKMLRKSLKFKATPMPSLPPPPPPPLVELPPTRAKSPKLGRSKNKSGLEAEESTTPGHPIRMSLDEKAIQNGAKKVTPSNSVKKPQRKSLPKHSRKSHQPQEAPQPQSTEDLNAGNKQESGSPAKQLQETEPKESNAQEPIRPEVTPDDVELDEQASV

SEQ ID NO: 127674 - protein, 110 aa, Triticum aestivum
  unsure (1)..(110): unsure at all Xaa locations
  Clone ID: PAT_TA_22092.pep
GTQWFSWIHLDDLVDLIYESLRNPAYTGIINGTAPNPVRLSELCDRLGQVVGRPSWLPVPGLAIKALLXGEGATVVLXGQKVLPAKAXKLGFSYRYPYVRDALKAIAKQL

SEQ ID NO: 127675 - protein, 218 aa, Triticum aestivum
  Clone ID: PAT_TA_22093.pep
IHHHDANMRHMIELTCKAQPFPTVSIKLYYRVVHICLRATTRIAGLLEARISQRHSLDSYRPIGAVHGRLDVHVEHHVGEDGQDKNCQSRERHVGRGHFWELITWASSLYYHIAVHERIRGRRGRRRPHLGLLQPLQLGVELRQPPQRLFRRAKLAALLLRRGVARVATYLLPSLRHRPRNSGKEAPSGHGARGEREGAQLHPLCRARSGGRVGGRVG

SEQ ID NO: 127676 - protein, 95 aa, Triticum aestivum
  unsure (1)..(95): unsure at all Xaa locations
  Clone ID: PAT_TA_22094.pep
MAGIGRNMXAPLLXVLNLIMYIIRHRLRRAGNLNHFINGQDQTTPAWAGNGAXTFYFLGVPPILAGGVGXPASKLAGVHHFPAWRHDSLXTNAAS

SEQ ID NO: 127677 - protein, 111 aa, Triticum aestivum
  Clone ID: PAT_TA_22095.pep
NDIFSAPTAMASLYHSSLPLSPPSSSCHGVLSLAPRTAAPFVCLCRAPPQDDHDAELLGALQSNGNGSLLREQHPASAKVLESASAELGDGGGGRRSSQAQLRARDCARRS

SEQ ID NO: 127678 - protein, 107 aa, Triticum aestivum
  Clone ID: PAT_TA_22096.pep
EKLVSHRLFIKPHCSQGINPGKIIIKPISLSCNDPLKRLRAATLEPSLRQRGITSPEKTNYPHDTHCRFFPRLLLAEFSVIFFSICCVLLTFKSIIFLVFVACYLLF

SEQ ID NO: 127679 - protein, 146 aa, Triticum aestivum
  unsure (1)..(146): unsure at all Xaa locations
  Clone ID: PAT_TA_22097.pep
AAIYLDLFYLIKISEQAAAFFCFDPSPLVFLLAGVSFNCLLSSAASICSETLLIYLCCCCSRSSSQGTNTLYFLDLKNSDSISWISDGLHARTTTPAQPATPRKNAPSFPRPPAPPQAPRAKEPQPHKMAVAPEPPEEGGAGXWTX

SEQ ID NO: 127680 - protein, 156 aa, Triticum aestivum
  unsure (1)..(156): unsure at all Xaa locations
  Clone ID: PAT_TA_22098.pep
RAVAADLGVEPEALQDAFTGKRQSMAVHHYPPCRQREKVMGITPHTDGLGLTLLLHVDDTPGLQIRRGGRWFPVRPLPGAFVVNVADILDVLTNGAYTSVXEHRVLPDAERARTTVVRVPRRLRPGXVAPLPGLLDHQGARARYKSIEIEDTSRAT

SEQ ID NO: 127681 - protein, 127 aa, Triticum aestivum
  unsure (1)..(127): unsure at all Xaa locations
  Clone ID: PAT_TA_22099.pep
MARLNSKAVVSAVVLAAVVLMMAXKGKATALSCGQVDSKLRAVRVLLTXGKGALRFSKECCSGVQGAETAWPAAAPDRKXIACKCLKDLXPTSINSINMAKSPGVPGNXASSLPFPIXISTNCNNVN

SEQ ID NO: 127682 - protein, 183 aa, Triticum aestivum
  unsure (1)..(183): unsure at all Xaa locations
  Clone ID: PAT_TA_22100.pep
MAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLXDLTCQTVADMIQGQTXRRISQDFNIKNDFTLXEEEEIXRXENXWPSNKEVWY

SEQ ID NO: 127683 - protein, 93 aa, Triticum aestivum
  Clone ID: PAT_TA_22101.pep
NCATVGAAAIGERNATSLPAPTRPAATSPASSSVVLSGAPNNPSSFLTASQGWGLKTVAVSWGWGLFQAAASNWDDGGFQGSQRTMHKKKHHH

SEQ ID NO: 127684 - protein, 111 aa, Triticum aestivum
  unsure (1)..(111): unsure at all Xaa locations
  Clone ID: PAT_TA_22102.pep
FLCHSLAICFLNQASFLINTSACLFSSSADSDAAVLGLPLPPTRDYIGDVLGARLHPQPRRQQALLRPGCPPGXGSSAGSXLSXSPRXXGPQXPKAPXFXKXHWAKXDXFS

SEQ ID NO: 127685 - protein, 146 aa, Triticum aestivum
  unsure (1)..(146): unsure at all Xaa locations
  Clone ID: PAT_TA_22103.pep
GPRGGSGFAGLQVACVVAALCLLLPTGSRAQLQVGFYNTSCPNAEALVRQVVTAAFANNSGVAPGLIRLHFHDCFVRGCDASRAPVREPRRAAKRSVSPRQRPELRRFHVXDAASAAGGLPXTCXRXXSRSRPRNVTLRLSQRGEA

SEQ ID NO: 127686 - protein, 181 aa, Triticum aestivum
  unsure (1)..(181): unsure at all Xaa locations
  Clone ID: PAT_TA_22104.pep
LDGVFAFVLYDTRDRTYVAARDAIGVNPLYIGWGSDGSVWMSSEMKALNEDCVRFEIFPPGHLYSSAAGGFRRWYTPHWVPRSRCPGTPXYQAAPSLREASEKAGYQRGHDRLPFRGLLSRRLDPPFVASVNKAPLRPRPTPPESGQTPSFVVRSRGPLTEGRTRVPDTRDTTRFLTKTDH

SEQ ID NO: 127687 - protein, 169 aa, Triticum aestivum
  unsure (1)..(169): unsure at all Xaa locations
  Clone ID: PAT_TA_22105.pep
VLCTPTTTERESRRGKGEKRPRRQTLAPRKRPWGSSTPPRRPPSPFRDMADSPRRRYSRSPSYSRGHPKGRSRSQSPXRSQSRSPVPDPRSQARSXSRXXXNGXKDAVNRXNTLYVTGLSSRVTEXDVXDYFSKHGRVVGCHVVLEPIHVFPWFAXVNMALKRLHKYLI

SEQ ID NO: 127688 - protein, 134 aa, Triticum aestivum
  Clone ID: PAT_TA_22106.pep
MEEVTEGVKNLAVTEPHKKNRIQVSNTKKPLFFYVNLAKRYMQMHNEVELSALGMAIATVVTVAEILKNNGLAVEKKIMTSTVDVNDESRGRPMQKAKIEIVLGKTENFDELMAAAAEEGSRSCRGRRGAGLIN

SEQ ID NO: 127689 - protein, 142 aa, Triticum aestivum
  Clone ID: PAT_TA_22107.pep
GFGTGRGTREIEKVTEGVRNMAVTEPHKKNRIQVSNTKKPLFFYVNLAKRYMQMHNEVELSALGMAIATVVTVAEILKNNGLAVEKKIMTSTVDVNDESRGRPMQKAKIEIVLGKTENFDELMAAAAEEREVAAAEEGEEQG

SEQ ID NO: 127690 - protein, 160 aa, Triticum aestivum
  unsure (1)..(160): unsure at all Xaa locations
  Clone ID: PAT_TA_22108.pep
MNKERLMKMAGAVRTGGKGTMRRKKKAVHKTVTTDDKRLQGTLKRVGVNTIPAIEEVNIFKDDLVIQFLNPKVQASIAANTWVVSGSPQTKKLQDVLPGIINQXLGPDNMEHLKRIAEEMQKQVAAAGCGTQVKEDNDDDVQELVPGETLKNNSRGQSLI

SEQ ID NO: 127691 - protein, 74 aa, Triticum aestivum
  Clone ID: PAT_TA_22109.pep
KTRGHRVAETVVTTENDVPRRTLRSSWKLMLLTFSIACCTNKGSLASRTFTILACFRHLILFLYSLRRLWGRFV

SEQ ID NO: 127692 - protein, 325 aa, Triticum aestivum
  Clone ID: PAT_TA_22110.pep
MGEASSPAIAKDVTELIGNTPLVYLNKVTDGCVGRVAAKLESMEPCSSVKDRIGYSMITDAEEKGFIVPGKSVLIEPTSGNTGIGLAFMAAAKGYRLVLTMPASMSMERRIILKAFGAELVLTDPLLGMKGAVQKAEELAAKTPNSYILQQFENAANPKIHYETTGPEIWKGTGGKIDGLVSGIGTGGTITGSGKYLKEQNPNIKLYGVEPTESAVLNGGKPGPHKIQGIGAGFIPGVLDVDIIDETIQVSSDESIEMAKSLALKEGLLVGISSGAAAAAAIKVAQRPENAGKLFVVVFPSFGERYLSSVLFHSIKKEAESMVVE

SEQ ID NO: 127693 - protein, 133 aa, Triticum aestivum
  unsure (1)..(133): unsure at all Xaa locations
  Clone ID: PAT_TA_22111.pep
MSTATAPRLPAPRSGASYHYQTTAAPAANTLSFAGHARQAARASXGPRLSSRFVASAAAVLHKVKLVGPDGTEHXFEGPDDTYILEXAAETAGWELPSPCRAGSRLLRPRRMXAGKSTIRGVFLXXGKCQGYS

SEQ ID NO: 127694 - protein, 129 aa, Triticum aestivum
  unsure (1)..(129): unsure at all Xaa locations
  Clone ID: PAT_TA_22112.pep
MADVHEPLVRRKRKKVLXVDYLVKFRWILVIFVVLPISTLIYFNIFLGDMWSAMKSEKXRQKQHDENVQKVVXKRLKQRNPKKDGLVCTAKEAWIAVGMRNVDYKACEDFEVDXSPFXKSLRSTKERMV

SEQ ID NO: 127695 - protein, 151 aa, Triticum aestivum
  unsure (1)..(151): unsure at all Xaa locations
  Clone ID: PAT_TA_22113.pep
MQIFVKTLTGKTITLEVESSDTIDNVKAKIQDKEGIPPDQQRLIFAGKQLEDGRTLADYNIQKESTLHLVLRLRGGMQIFVKTLTGXKTITLEVESSXDTIDNVKAKIQXDKEGIPPEQQRLIFAGKQLEDGKTLLTTTSKKGSNLHLVLL

SEQ ID NO: 127696 - protein, 65 aa, Triticum aestivum
  Clone ID: PAT_TA_22114.pep
PSLCVGISSLKSWCHIKVVPLLLKNTPLHTYVWATRMKWLSSGTSYLRDYWRASPSPGSHGRPSL

SEQ ID NO: 127697 - protein, 151 aa, Triticum aestivum
  Clone ID: PAT_TA_22115.pep
TNRVVGTYGYMAPEYALRGQYSIKSDIYSFGVLMLEILTGRKNSDSYNSDQSVDLPSLIWEHWTMKSVMEMMDPYMSGDSSQDEILRCVHIGLSCVQEDPADRPTISTINIMLDSNTVPSQPPLKPAFYVRDGWRHCLKTCYSQSYPRRCQ

SEQ ID NO: 127698 - protein, 78 aa, Triticum aestivum
  unsure (1)..(78): unsure at all Xaa locations
  Clone ID: PAT_TA_22116.pep
MEMKLTIRRVPTVVSNYQEDADKPRAGCGRNCLGDCCLPASKLPLYAFKLTPAKGSQEDAASTKLLVDILLNEXGGGG

SEQ ID NO: 127699 - protein, 103 aa, Triticum aestivum
  Clone ID: PAT_TA_22117.pep
SQASKEEIGEFLLEGGNGGSGDEATIAAAAGFMAKKHVLLLHAGGDSKRVPWANPMGKAFLPLPYLAGDNPDGPVPLLFDHILAISSSARQAFNNQGCSPRQN

SEQ ID NO: 127700 - protein, 153 aa, Triticum aestivum
  Clone ID: PAT_TA_22118.pep
STATKIAALSPTSPDQSESSITGVQEAAWLTTSSHRRNGTGSRTGPRLLLGRSPARSCRGGKLARHRHLLQQRRRRGGRRIRNRRRRRHPRGAGGGVPDPPAQPQPTRLSSRPSPSPSRAQPLSPIREPTLQRHRLPKSTSSFSSSSYRAWCS

SEQ ID NO: 127701 - protein, 97 aa, Triticum aestivum
  Clone ID: PAT_TA_22119.pep
MASEEDVAVKEPLDLIRLSLDERIYVKLRSDRELRGKLHAYDQHLNMILGDVEEIVTSIEIDDETYEEIVRTSKRTIPYLFVRGDGVILVSPPLRTV

SEQ ID NO: 127702 - protein, 110 aa, Triticum aestivum
  unsure (1)..(110): unsure at all Xaa locations
  Clone ID: PAT_TA_22120.pep
MPWGVASAGEEIAVEEPLGPATPSLDKRIYVKLRSDRELRGKLHAYDQAFEHKPREMLEEIATTVEIXAEEAYEEIVPTPRRSIPCLFVSXGDGVILVSPASANGVSHEV

SEQ ID NO: 127703 - protein, 147 aa, Triticum aestivum
  unsure (1)..(147): unsure at all Xaa locations
  Clone ID: PAT_TA_22121.pep
VAFLYMRQKQTRVASNEPAEQVEQVEQVERVEQVEQVDQVETLSDSGSSQGHVVAKGSLFHSPGVEASGPSQYSSSLSSGLGRRRNTKGEGLEPVVSRRDSTAQSTSSYGSFTTYXKIPAKKGNKEDEAMTQSGRSSKLRNVKTPES

SEQ ID NO: 127704 - protein, 71 aa, Triticum aestivum
  Clone ID: PAT_TA_22122.pep
ETGECNLDPHFSWCDAGHHGVGDPCGASESCLVPVISTLASLGAMPVTMASAIPVVRVSALICILPVMPMV

SEQ ID NO: 127705 - protein, 85 aa, Triticum aestivum
  Clone ID: PAT_TA_22123.pep
MAAAPADAKAEAAKMDLLEDDDEFEEFEIDQEWDDQEEGNEAVQQWEDDWDDDDVNDDFSLQLKEELGRKQRPEELKYYFSTLYK

SEQ ID NO: 127706 - protein, 166 aa, Triticum aestivum
  unsure (1)..(166): unsure at all Xaa locations
  Clone ID: PAT_TA_22124.pep
FLGRPVFTLTRRCAPCVRSAKTSWLFDLSYRYVVFFGSGVLVPGRARLWGLRCRSSSAGALARGSRLLPPSAPQGAPAASSPRGAGAGGSGLCSLGLRPACALEGSGFARRPLAPPACGCAWSPWLCPFLLLTCXSPSRKRIRDLKXLKFLXXGSKPNYLCPKFIF

SEQ ID NO: 127707 - protein, 98 aa, Triticum aestivum
  Clone ID: PAT_TA_22125.pep
QQRSSASPSQSIASISMDLSIITKWLFRKRLTLTSLSLRRPIALYIASSTSLAWMASEMMAGSCQGNLHMVIMVSLDASWLKYLGRDHANHSWLHGLY

SEQ ID NO: 127708 - protein, 145 aa, Triticum aestivum
  unsure (1)..(145): unsure at all Xaa locations
  Clone ID: PAT_TA_22126.pep
MANPLAGLQDHLKLARDYALEGLYDTSIIFFDGAIAQINKHLTTLXDDALIRTKWMNCKKAISEEVEIVKQLDAQLKSLKEAPGTRRSSSTPIRSNKSFXFQPLDEYPTSSTAPLDDSDVGLPPGDTQTRKTTRGNLMQGSSQDG

SEQ ID NO: 127709 - protein, 135 aa, Triticum aestivum
  unsure (1)..(135): unsure at all Xaa locations
  Clone ID: PAT_TA_22127.pep
MSTAVISAEDALEPSLQSLLDQRSLRWIFVGGKGGVGKTTTSCSLAIQLAKVRRSVLLISTDXAHNLSDAFSQKFGQRGRLVNGFDNLSAMEXDPNGSIQDMLTGKAKAMMSTLRLVVSGMMQIWNRILVSTGSL

SEQ ID NO: 127710 - protein, 198 aa, Triticum aestivum
  Clone ID: PAT_TA_22128.pep
PGSGAVQWPKAKLLPFQGSKEEETPSDYQIVPGFRVRIIPVLGTIPAIFGQVMASYVVTQLAQLDFQTEPIVNLDLDHYRVLHHRLLEHEELIYGSAEQVLVDAEEVMYIVKELWRGRSARDQNMKDTGRKMWRSVNELMLVRWDKSKSAGVSNLILLKFSEADAHESTTLDQIKDEEPEFHAMVSRVLKRAETEFAL

SEQ ID NO: 127711 - protein, 194 aa, Triticum aestivum
  Clone ID: PAT_TA_22129.pep
MGQALRRLFDSFFSTKEMRVVMLGLDSAGKTTILYRLHLGEVLQTVPTVGFNVEKVQYKNVAFTVWDVGGQEKLRQLWRMYLSNSDALIYVVDSLDRERIEDARQEFQTIIRDPLMANSIILVLANKQDLKGSMSPEEVIEGLGLHDLKNRIWHIQGTCALRGEGLYDGLDWLASTLKQLQETGHATSIAGPSI

SEQ ID NO: 127712 - protein, 118 aa, Triticum aestivum
  Clone ID: PAT_TA_22130.pep
NSPRPLGSLSIVLLVTEAYVYVEAEGVGGSSPWLRSVNNLLGRQVWEFDPELGTPEERAEVEKARREFAEHRFERQHSSDLLMRMQAMAASSKVDLPVVKLGEHEDVTEEATWSSLKR

SEQ ID NO: 127713 - protein, 225 aa, Triticum aestivum
  Clone ID: PAT_TA_22131.pep
MAAADEHHEEASPLLAPPANEKLPPAQDPVKGCADGVPVVMGEPVTAPAGAEPRESWDSGILSCLGRNDEFCSSDLEVCLLGSVAPCVLYGSNVERLAAAPGTFANSCLPYTGLYMLGNSLFGWNCLAPWFSHPTRTAIRRRYNLEGSFEAFTRQCGCCGGLAEDEERREHLEVACDLATHYFCHPCALCQEGRELRRRVPHPGFYGRSVVVMMPPTEQTMGRTM

SEQ ID NO: 127714 - protein, 90 aa, Triticum aestivum
  unsure (1)..(90): unsure at all Xaa locations
  Clone ID: PAT_TA_22132.pep
KRLRCGRDNETEFRSITKAPLTRTHSNPSAKKLGTHPSRLLPARGEQQSVQQRIAVDCTLKPRNQDARSRVPQADXERRIVPQQNEQRAX

SEQ ID NO: 127715 - protein, 113 aa, Triticum aestivum
  Clone ID: PAT_TA_22133.pep
DLGEACRCIRDLGMPFFNHEVVKKALVMAMEKQNDTSILVLLQECFGEGLITINQMTKGFARVKEGLDDLILDIPNAQEKFGRVCGSWATERGWAAADLRLRSLSIHHWRYLP

SEQ ID NO: 127716 - protein, 71 aa, Triticum aestivum
  Clone ID: PAT_TA_22134.pep
KCRGSRPPRRPGGFVFERPAPGRSQYSRAEEVRIVCVCHGSFLTPAEFVAHAGGSEVTHPMRHIVVNPPSL

SEQ ID NO: 127717 - protein, 59 aa, Triticum aestivum
  Clone ID: PAT_TA_22135.pep
GPRRPTPRRRHPRRRFAAPGTPRAQTCSRAAPPPRRPPRRRPPPPPEEEETRPSSPRSP

SEQ ID NO: 127718 - protein, 90 aa, Triticum aestivum
  Clone ID: PAT_TA_22136.pep
EKNTQGSCWSSRQEVLRNISYHESMVPIFSNVPVEVLLAPWETVDVCKVVKSRLMLKIDFGASPLPLVGNINIKGSIGDQSIGSYFNEDG

SEQ ID NO: 127719 - protein, 147 aa, Triticum aestivum
  Clone ID: PAT_TA_22137.pep
IDVVGNVKASMRLRAACEKAKKVLSANAEAVVNIECLMEEKDVRGMIRREDFEKLCAELLERVVEPCKRAMADSGIGLDKLQSVELVGSGSRVPAIARVLAGFFRREPSRTINVSECVARGCALQCAMLSPTFRVREYEVQDVIPAS

SEQ ID NO: 127720 - protein, 110 aa, Triticum aestivum
  unsure (1)..(110): unsure at all Xaa locations
  Clone ID: PAT_TA_22138.pep
GSHEHRSSGVNSXEVQSEDVDTQKGHKLRQLPDGQSASRASSVASPAVSSLLLPSLKEATGDKFDRPAVHAFLDSLMDLERDIPGSCEVLVGRLLHRLGSSKDSSSPSPE

SEQ ID NO: 127721 - protein, 171 aa, Triticum aestivum
  Clone ID: PAT_TA_22139.pep
MTDESRKNAKSLTQTYTSNTSLVAILIATITFAAAFTLPGGYSNDAGSEGLPIMSRNFAFQAFLISDVLAMCSSFAVAFICIIARWEDYEFLVYYTSFTKKLMWFAYVTTTTAFSTGLYTVLAPRVHWLAIAICVMVALLPILTKLLGEWPILKLRLKLGKDFNSDFLDMV

SEQ ID NO: 127722 - protein, 222 aa, Triticum aestivum
  unsure (1)..(222): unsure at all Xaa locations
  Clone ID: PAT_TA_22140.pep
GPLXVGQAXLCLSRSIGDTDVGEYIVPVPHVKQVKLSNAGGRLVIASDGVWDALHFQEALNYTRGPHASAHASGIVKEAVSSKGLRDDTTCIVVDILPPEKLSPPLKRHGKGGIKALFRWRPSDELSEEQTDNGCFEPDVVEELYEEGSAMLAQRLNVNYPAGNMFKLHDCAVCQLEMKPGEGVSVHGNMPKHHSRVAPWRGPFPGSSRPVSLGAVEGTLHL

SEQ ID NO: 127723 - protein, 145 aa, Triticum aestivum
  Clone ID: PAT_TA_22141.pep
VNLIITDYCMPGMTGYDLTRPVKGSSSLKDIPVVIMSSENVPARISRCLEDGAEEFFLKPVKLADMKKLKSHLVRRKQPQLQPQPQEKPQAKSQQQQPNKPQAEQQLPKKAEQAPAEPTEEVAAKVSSTGMTSDCGGGSRKRKAA

SEQ ID NO: 127724 - protein, 131 aa, Triticum aestivum
  Clone ID: PAT_TA_22142.pep
MTVVDAEARFHVLAVDDSVIDRKLIEMLLRTSSYQVTMVDSGSKALEVLGLRDEGDDDSSSPSSSAPDHHQEVGVNLIITDYCMPGMTGYDLLRRVKGSSSLKDIPVVIMSSENVPARISRYHVTVLSTLL

SEQ ID NO: 127725 - protein, 65 aa, Triticum aestivum
  Clone ID: PAT_TA_22143.pep
TCELYKNDKMVISQTVNNACTVHLSRIMILSFLCNSHGYLFQHQNLHMCKTHPYKCVDLFSEFKI

SEQ ID NO: 127726 - protein, 176 aa, Triticum aestivum
  unsure (1)..(176): unsure at all Xaa locations
  Clone ID: PAT_TA_22144.pep
MAGALVFVAVLLAASVGATTATTLTIHNLCPHPVWPLVTPSSGFPSISTNTARLGPNALLSLSFPPTFCPGXGVAARTGCDAAASGCWTGTTPPATVVQVTVHDGGNLDQXTYSVSLVDGFNVPMVVSPQAVGGGXCPALGCPSSTAMPSQNRRPGGAAAAGVLKERCRSQDKPTT

SEQ ID NO: 127727 - protein, 177 aa, Triticum aestivum
  Clone ID: PAT_TA_22145.pep
MQRTVDFKLPHFFNYPPYFTLQPVRETREKQVHLWKELILDYCRSQKMYIISLEEDFPLFSNPKIERSLSYEAKEVFLAALVSEGRAEWIDKSHKKCLILWLRIQDWANYILHFVKENGLEVTTIEDIRSGIETHGTELAGIDRGVLMRALRLLEQKGKAVIFKGSSADDEGVQFSV

SEQ ID NO: 127728 - protein, 267 aa, Triticum aestivum
  Clone ID: PAT_TA_22146.pep
AKRVLLACNGGGDAVSRGVAVGLARHGCRLVLVGDEGALAATAEEARRCVAQGASAVAVVGLDFAACDEAAVGAAVEAAWRCFGDGGLDALVNCCSYEGEVQDCLSVTEDEYNKTMKVNAITPWLLIKAIAKRFRDAQSGGSVVCLTQIIGAERGLYPGAAAYGTSLGAVHQLVRLSAMELGKHKIRVNAVCRGLHLGDKFPVSVGEEKAEKATREVMPLRRWLDPEKDLASTVLYLVGDDSRFMTGTTIYVDGAQSIVRPRMRSFL

SEQ ID NO: 127729 - protein, 170 aa, Triticum aestivum
  unsure (1)..(170): unsure at all Xaa locations
  Clone ID: PAT_TA_22147.pep
VFSFGVILMELITGRKALDETRPEDSMHLVTWFRRMQLNKETFRKAIDPVIDLDEETYASVSTVSELAGHCCAREAHQRPDMGHAVNVLSTLSXVWKPTDPDSDDSYGIDLNMTXPQALKRWQAFEDNSHFDGATSSFRCKFGITLKTSIXPTXPPGFAXSVNSADGXKR

SEQ ID NO: 127730 - protein, 205 aa, Triticum aestivum
  Clone ID: PAT_TA_22148.pep
RTRPISSPPPSPFIHSFVPGGPGGDDWERRAGVRAPRRCFWSWSWWRWRAGAGACGRGPPPPAAAAAVRWLSQPRPRPPAAGAFAAAPAHPVIVVQAQALAPPAPSPVARRGRHRRPGAPPPPRSPLFPHLPRCASEHGGVTAGAIRGAFGAAEVDFLHEVRQAWPKRPRMAAVGSCCLLGAIARDTLYVANLGDSRAVLGRRVV

SEQ ID NO: 127731 - protein, 273 aa, Triticum aestivum
  unsure (1)..(273): unsure at all Xaa locations
  Clone ID: PAT_TA_22149.pep
TPLVLVDSHILPEDAGTAVARADARRITSAVSRILAAHPGPFRCVHLTSCYMEEFNGLLRRWLQILADKGIEELILVNRPMPLGCLLHSTFFLPSTFLGMTTLTCLYLGLWKFPDTADVKRATFFPNLRELGLCTVLMESKDLDFILDRSPVLETLCVGSNIFKLGLRLXSQSIRCVKIILSFFEEIAVVDAPCLXERLILSGGWTKDGVCTKGKIGHAPEFALPWGYXGXQKNQCPRSSANTVIKAGAQTGPAPSVPGVRSRALEVRCGVRS

SEQ ID NO: 127732 - protein, 175 aa, Triticum aestivum
  Clone ID: PAT_TA_22150.pep
MATISAALSISLLPPAARRAVSTATSSPPRVKRAARFRCCAEPPSPEQQETSAPLPSPPALPSSLWGVSTSAWTAGVAGLGLLETGYLSYLKLTGSEAFCPVSGGGCGDVLDSDYSVVFGIPLPLVGMVTYGVVTALSLQENGEELLPGLDDLDIRLTLLLLATSLATASAYFLF

SEQ ID NO: 127733 - protein, 129 aa, Triticum aestivum
  Clone ID: PAT_TA_22151.pep
YKLIKTPVRRPADHPNPYPFFFVTTRKHPTRRHCSHSHRARTARVYHARTHQTKKHIPAVLHHRLRGPSGRSARGSSAYRSCMRRRAGFFLRKPTSEASSTSGPQSVPSGFKLVERCSGRRRGCRWRWP

SEQ ID NO: 127734 - protein, 158 aa, Triticum aestivum
  Clone ID: PAT_TA_22152.pep
MASSSALEFTVRRKLAVLVPPAAPTPRELKRLSDIDDQDGLRFQVPIIHFFRQHDGWDDDPAPVLRGAIAAVLVHYYPFAGRLRELEGRKLAVDCTGEGVLFVEADADVRLDQFDAALGPPFPCLDELLFDVPGSCGILDCPLLLFQVTRLACGGFVM

SEQ ID NO: 127735 - protein, 238 aa, Triticum aestivum
  Clone ID: PAT_TA_22153.pep
MQAFLAYSILTNPCSRSFFPRPATRPQFLLSSVPAARTGAAATARRCGGPGRSVVTAASSSPAVATAATDVPGTMKAWAYEEYGDASVLKLDEAVSVPAVGEDQVLVRVAAAALNPVDSKRRMGKFKATDSPLPTVPGYDMAGLVVKVGSQVKSLKEGDEVYGHISEKVLEGPKQFGSLAEYTAVEQKLVTSTSRKPPASARITAHEASKQVSRRQSSFPPAGRIRTLSTNWQTIYAS

SEQ ID NO: 127736 - protein, 173 aa, Triticum aestivum
  unsure (1)..(173): unsure at all Xaa locations
  Clone ID: PAT_TA_22154.pep
CWLSTAIRRTCCKLRAPGDPCLLLLKFTGCVEDWTKEMRMQHLKRSHKKMHRSPRLKNKRSPKKSAKKPEKRAVSQRLVTHRTVHSTCPVCTGTVRWDNRTVCAERPNQALSGCYTGTVRCAEPSDSTVDCYNCQRPLXLRAPDTHSNCPVDTAVPVNRHXKCCFFNGNLGGX

SEQ ID NO: 127737 - protein, 127 aa, Triticum aestivum
  unsure (1)..(127): unsure at all Xaa locations
  Clone ID: PAT_TA_22155.pep
MAGMADMPMRPARPGPPMQHRGPPPMARLRPEPIDREKTCPLLLRVFTRVAGHHQNEEFAXXEGKEPKDEVQIYTWKDATLRELTDLVKELLFQQGKGTEASFNCIPDKNGLLFQTGFTSLWHGKVY

SEQ ID NO: 127738 - protein, 68 aa, Triticum aestivum
  Clone ID: PAT_TA_22156.pep
LKLDDGWNNIQLNLADLTKRAYGTNYVETLRVQVHANCRLRRIYFSDRLYSEEELPPEFKLYLPIQKS

SEQ ID NO: 127739 - protein, 150 aa, Triticum aestivum
  unsure (1)..(150): unsure at all Xaa locations
  Clone ID: PAT_TA_22157.pep
MSGSKVYTLEEVAKHNTKDDCWLVIGGKVYNVTKFLEDHPGGDDVLLSSTAKDATDDFEDVGHSSTARAMMDEYXVGEIDAATIPTKVKYTPPKQPHYNQXDKTQEFVIKILQFLVPLXAILGLAVAVRMYTKPDLPSLLSSTLQTSFTN

SEQ ID NO: 127740 - protein, 234 aa, Triticum aestivum
  Clone ID: PAT_TA_22158.pep
PRSRNIGAPPARVPSPCRHAWRAAAGEGASPLPTRRPCAPAPSARPASPDKGARPTPPPLPDRREFPFDFASRPPARPSLRRQQKCGRGRRDPIALNSTEGGRRDPRGLASLTRASPRQGLKRISKSDARHYLPSGTQMEDYFERIVNLAWQLRQHLTQFIENVFGCIDWIPQCHEVQFSAYYGGSLPDTERYVHGQSSALSISNTTEELSISSTTEEQTAHRISEITIFRNGV

SEQ ID NO: 127741 - protein, 85 aa, Triticum aestivum
  Clone ID: PAT_TA_22159.pep
FLEPYDNCTRCLKSAFLYGRLRHHPKLKTLNMSFSSFLKFLSFPNSSTLQCLRSFRCCSFFEYIYEFKSSTASLKCIFQVVSSTK

SEQ ID NO: 127742 - protein, 81 aa, Triticum aestivum
  Clone ID: PAT_TA_22160.pep
GLLADACTYVTPRWYQLQMPNCLLLYYDCIINCEHCPCAYAPQIFCPTACHHDHIVVHGTQGGPVPFAYGHLFPPHSTARN

SEQ ID NO: 127743 - protein, 239 aa, Triticum aestivum
  unsure (1)..(239): unsure at all Xaa locations
  Clone ID: PAT_TA_22161.pep
MSSRFSVKHFRMIYNRSANTHVPRTVTTMALAAGVLKIVAPQPGAIYPIHLLLAIVVLTITTTIYLALCRKTVYLVDYACFRPSFNLRCPKATFLEHAHLSSLLDDSTVNFIGTVLKRSEMSDETYVPPVLHYIEPYCGLYDARAEAESIVFSVIDDLLAKTCINRDAIGVLITTSSIFCPIPSIADMIVNRYKLRGDLRVMNLSGMACSASVXAVGLASNMLQVMPWGSHALIVSTET

SEQ ID NO: 127744 - protein, 193 aa, Triticum aestivum
  Clone ID: PAT_TA_22162.pep
MAAATARQLLVHRITSSCSSGTLPKHSSSSHGRSAYSSMCFNKAEKLPSFRARVSVKPPHAVPGKGGIVPADDDGVSLGTVKLPANIDVARFEGLLFQWGNSLCQGAMLPLPVPIKVDKVEGGIRLGFIGIDDGATSLLAYIDCLVSPATDGSGFVFRAIRNGAMKDMEPPGEPRIMRSLLMALQKSIQIAQV

SEQ ID NO: 127745 - protein, 46 aa, Triticum aestivum
  Clone ID: PAT_TA_22163.pep
LLEAKMALCMILQRFEFGLAPSYAHAPHTMITLHPMHGAQLKLRAI

SEQ ID NO: 127746 - protein, 180 aa, Triticum aestivum
  Clone ID: PAT_TA_22164.pep
MPEDAAPIAPAPASDLTAGSSDDEITVEDAPFARTELPQDGSAPPVVTTDMEVLHDKVKKQVIKEGHGKIPSKFSTCFVHYRAWVQSSMHKFEDTWQEQHPVEIVIGKEKKQMSGLGIGVGHMKSGERALLHVSWELGYGKEGSSSFPNVPPSADLIYEVELIGFDDALVGNPRLAECIK

SEQ ID NO: 127747 - protein, 72 aa, Triticum aestivum
  Clone ID: PAT_TA_22165.pep
DKPPAICTVHELCAGDAPPPSAGSPICAPRTQTSWRRSEPINPCPMKTATSTSILWVGFQKKELKEDSENSP

SEQ ID NO: 127748 - protein, 98 aa, Triticum aestivum
  unsure (1)..(98): unsure at all Xaa locations
  Clone ID: PAT_TA_22166.pep
ALASRVEMFKACNGPFNYCMLRGFNGEYTYNGEQYDALAPPQGAAYVKCREDVTKALKLNXPCETNNCTFNGRWWSGGXRVAGPGSDLYITTMLLLHG

SEQ ID NO: 127749 - protein, 197 aa, Triticum aestivum
  Clone ID: PAT_TA_22167.pep
DSSGGGSVLTDTQKTTVLKLQVGLLGMARSFQKELDQIAEKADTSTPVVAAEVLTETTLALLRHPDCCISAYSTVDVKRSMDDGEKRFNQLSIEERGKFDEETLVNVNSIKRQKAGTQRSSGFSNEYIVITILVAAEGVYKLPTINSSSDLKTALQMLGGVPSSKIMAVEVLWTPQNENDTLSERELLEDYPLLRPL

SEQ ID NO: 127750 - protein, 174 aa, Triticum aestivum
  unsure (1)..(174): unsure at all Xaa locations
  Clone ID: PAT_TA_22168.pep
LLYLXINYKIRVCLQSNPIKFPGKXLNLLDFRSSDRKKQEHTHRNSEEGTRNAGLAAGAVGGRHGGPDGGRRQNDRRRRRRCGPIGGPHRRRRRGRNGGPPAGQRARGQQEQEENRGAQRQQWGRGRRHLHTPTSLLTSRSLSFALPLSLSGNPTGSGGRAQESWRRCGEAAWE

SEQ ID NO: 127751 - protein, 464 aa, Triticum aestivum
  unsure (1)..(464): unsure at all Xaa locations
  Clone ID: PAT_TA_22169.pep
LGRRLGPRLLGRGEDGSMRLVRDLYRMLDEINSEEVPVDLKLLESFDDFIWDTKNNDYDLKSFALRLKATMETMDKELRSSRLSEQLNKHYAAIAIPKGLYCLSLRLTDVYSSNALARKQLPPPELVPRLSDNFYFHFVLASDNILAASVVVRSTVRSTLKPERIVFHIITDKKTYPAMHSWFALNPVYPAIIEVKGVHQFEWLTKENGPVLEAIEIQHIARSRYHGNHLARTTAGDSPRVFAAKLQAGSPTYTSVLNHIRIYLPELFPSLSKVVFLDDDVVVQRDLSSLWDIDLAGKVNGAVETCRGGDSWVMSKRFRNYFNFSHPLIATNFDPLECAWAYGMNIFDLAAWRKTTIKDKYHHWVKENLKSNFTLWXGLGTLPPGLSAVRPHVHPIDPSWHLLGLGYQEKTDISSVRKAAVIHYNGQSKPWLDIGFKHLQPFWTKHVNYSNEFVRNCHIMEPQL

SEQ ID NO: 127752 - protein, 130 aa, Triticum aestivum
  Clone ID: PAT_TA_22170.pep
MVKTSVLNDALNAMNNAEKAGKRQVLIRPSSKVIVKFLTVMQKHGYIGEFEEVDDHRSGKIVIQLNGRLNKCGVINPRYPVQLRDLEKWATQLLPSRQFGYVVLTTSAGIMDHEEARRKHVAGKLLGFFY

SEQ ID NO: 127753 - protein, 285 aa, Triticum aestivum
  Clone ID: PAT_TA_22171.pep
MGWLNKIFKGSVNRVSRGHYDGHWHEGNQSEHTRDAYDESDSEDIARAIALSLAEQDPNKGKAIDPDYSLEEDEQLARALQESLNTESPPHQNAPVENVPTESIPAREPHQHVLPSSGFRTCAGCRKPIGHGRFLSCMDEVWHPQCFKCYACNKPISEYEFAMHEDQPYHKSCYKDFFHPKCDVCKNFIPTNQNGLIEYRAHPFWMQKYCPSHEDDGTPRCCSCERMEPTDIKYITLDDGRKLCLECLTSATMDSPECQHLYMDIQEFFEGLNMKVEQQVPLLLV

SEQ ID NO: 127754 - protein, 129 aa, Triticum aestivum
  Clone ID: PAT_TA_22172.pep
LELEMAAGKLGQQLMTRLHLARTRPSATADVPRGHLAVYVGEGRKRLVIPTACLSHPAFVTLLKRVEDEFGFDHRCGGLNIPCASETEFAIVGAAAARDGNNITDDCVRAAPIDRIRSGRVIIIPFSTN

SEQ ID NO: 127755 - protein, 68 aa, Triticum aestivum
  Clone ID: PAT_TA_22173.pep
LDWCRSGCLATLKMTRVPRDSVTHGHGYGKGHREARTHVKLNLLFVVLIKFWMWLHLSRQRLNEVSVN

SEQ ID NO: 127756 - protein, 220 aa, Triticum aestivum
  unsure (1)..(220): unsure at all Xaa locations
  Clone ID: PAT_TA_22174.pep
AIRCSSKTSRRXKALQNYLLYGKSTPHIQDGSMGSFANSHDIPRFKTFRKKQDHISTKPRQGVHHQRKDKKDKEKFFNFFYETRYVKLDXLSQQSQAPNMMEGXLCSHASWEGFHFRASSFGFRRAGESRRQRVESESEDESDDDDTGETAGVGSHAHRVTLGLPPRGPLTLDDVKTAFRASALRWHPDKHPGSSQAVAEEKFKLCVNAYNSLCAVLKAA

SEQ ID NO: 127757 - protein, 203 aa, Triticum aestivum
  unsure (1)..(203): unsure at all Xaa locations
  Clone ID: PAT_TA_22175.pep
MAQESWKEAEDTGVHAPEAPIMCINNCGFFGNRMTENMCSKCYRDTVKAKTMALLVEYKTAAAVASSPTPMSRAEGHSTAAAGRPGSRKDARGPRSTPEMSSPRKAGMTGFKCACADTFCSMQRXADAHDCKFDYKQAGREQIAQQNPVVKADKVTQDSRWRFWLQEPSSSFISSMMMMMMLGPSGLPEELCVYDPPGNVLCR

SEQ ID NO: 127758 - protein, 103 aa, Triticum aestivum
  unsure (1)..(103): unsure at all Xaa locations
  Clone ID: PAT_TA_22176.pep
PPRPPRGPXXPCRVLPWSAGXVHPCHAXRGRALPRGLRAPRGGPHRRRPHRRRLGTRRSSPAPGPADRSSSIGPACTFRLAMAQTGPKKKPLLLLSFLFLFLA

SEQ ID NO: 127759 - protein, 145 aa, Triticum aestivum
  Clone ID: PAT_TA_22177.pep
PDHFPWYIYNANFEGLYETVSLSGSSNLNEGQQNQTDGISVTLCSQERHIIGGVLGGALVAASTVQVVLGTFVQAGSKSKSKKAAKPPAFGPDSLTGAGPDVASPSSGHNQNLTSPPSVVSTGGWPSSGIFDTRSSSIDINSSRG

SEQ ID NO: 127760 - protein, 381 aa, Triticum aestivum
  Clone ID: PAT_TA_22178.pep
MSPLESSINLFFIYILPFVETKQSTEGKWSHGKTMPVKNVQALAADAAELTEEAIKRYIRPARADDVVVAAHGDNSSQSIPVIDLGRLLDPRSYQLEAARLRSACEEWGFFQVKNHEIPDTVLENMRNDLEHFFRLPLDEKNRFGQLPGDLQGYGQAFVESEHQTLDWCDRLYLVTQPPHDREMRPWPTTPVSFRESIESYSSELMRVTGSLMAIIARNLGVDLPSDTYVSQALRMTYYPACPVAHDKVLGISPHSDISMLTLVWELNMVGGLQIKRQDAWVPVKPHPKALVVNVGDFLEIMTNGKYQSIEHRVTVNPHKERMSISAFHLPKFDMSVGPLSEIVGAELKKYKTLRVDEVAKVVFSSKLDGKKTKDYAMLRV

SEQ ID NO: 127761 - protein, 240 aa, Triticum aestivum
  Clone ID: PAT_TA_22179.pep
DGAPAGRTLDLASSLEAGSTTLQASGGADDCNLRSVLTIAFQFPYEMHLQDSVATMARQYVRSIVSAVQRVSMAISPSRSGLNAEQKIISGFPEAATLARWICQSYRFHLGVELFRQADEAGESLLRMLWDHEDAILCCSFKEKPVFTFANEMGINMLETSFVALQDLSLDKIFDEAGRKALYSEIPKLMEQGFVYLPGGVCLSGMGRHVSFESAVAWKVVGEDNNVHCLAFCFVNWSFV

SEQ ID NO: 127762 - protein, 180 aa, Triticum aestivum
  unsure (1)..(180): unsure at all Xaa locations
  Clone ID: PAT_TA_22180.pep
AFGSSAPGNFLTGFGFYEPFWLVDIGNVCIVVHLVGAYQVFCQPIYQFVEGCARSRWPDSAFLHAERVLRLPAVLRGGEFPVSPFRLGLXRTAYVVLTAXGGMLFPFFXNDFLGLXIGAVSVLALTVYSPVECYMAQASSPVLADLTWLLXVPALPCLSVLXATGSXQGSSRTRKDNLQS

SEQ ID NO: 127763 - protein, 128 aa, Triticum aestivum
  Clone ID: PAT_TA_22181.pep
MAVTFSDLHTADGLKALEAHLAGKTYISGDGITKDDVKVFAAVPVKPSAEFPNAARWYDTVAAAVASRFPGQSSGVSASSAPAAAAPAASKDEDDDDDMDLFGDETEEDKKAAAEREAAKPEKKKKKR

SEQ ID NO: 127764 - protein, 218 aa, Triticum aestivum
  Clone ID: PAT_TA_22182.pep
MAVTFSDLHTADGLKALEAHLAGKTYISGDGITKDDVKVFAAVPVKPSAEFPNAARWYDTVAAAVASRFPGQSSGVSASSAPAAAAPAASKDEDDDDDMDLFGDETEEDKKAAAEREAAKPAKKKESGKSSVLMDIKPWDDETDMKKLEEAVRSVQMEGLTWGASKLMPVGYGIKKLQIMLTIIDDLVSVDTLIEEVLCEAPINEYVQSCDIVAFNKI

SEQ ID NO: 127765 - protein, 416 aa, Triticum aestivum
  Clone ID: PAT_TA_22183.pep
SSSPTHLLGFLPHGDGIARRPPIPSIPTPRCGLSLPPPPSRRRGSLLPAALVPSPAAAPWAAARRFATQPATSSLRDSSPNWSNRPPKETILLDGCDFEHWLVVMEPPPGDGANPDVTRDEIIDGYIKTLAQVVGSEDEARMKIYSVSTRHYFAFGALVSEELSYKLKELPKVRWVLPDSYLDVRNKDYGGEPFIDGQAVPYDPKYHEEWVRNNARANERSRRNDRPRNFDRSRNFERRRENTQAYQSGPPNQMPPHDAAPPSRGAQGPPPPSGAPPNYQPHAPNPQAGYAAGGGPNYPNAPPPPGYRGAPAPGYQAGNQGYQGNPGGNMHNGPGPAYHSNNPGYQGGAPGGNPPPPFAGGNQPPPYHGGGPSYGGGAPDYQGQPGGNPGYQGGGNYSNAAPPPYEGRDGPGRNYQ

SEQ ID NO: 127766 - protein, 218 aa, Triticum aestivum
  Clone ID: PAT_TA_22184.pep
MAVTFSDLHTADGLKALEAHLAGKTYISGDGITKDDVKVFAAVPVKPSAEFLNAARWYDAVAAAVSSRFPGQASGVSASSAPAAAAPAASKDEDDDDDMDLFGDETEEDKKAAAEREAAKPAKKKESGKSSVLMDIKPWDDETDMKKLEEAVRSVQMEGLTWGASKLMPVGYGIKKLQIMLTIIDDLVSVDTLIEEVLCEAPINEYVQSCDIVAFNKI

SEQ ID NO: 127767 - protein, 260 aa, Triticum aestivum
  unsure (1)..(260): unsure at all Xaa locations
  Clone ID: PAT_TA_22185.pep
IPPPVRRPAVHAAGACAMKRRSAVPYAALAHPLAGVFPCRREISSGSHLPAAHASPAVAGGTVLYLRQRSAGPAAVAGATQRRPAVPAGTQRKTSIKTPGRRPLSRLPFPCRAPLSGLARRRAVSRGCDPAGARTGGSPQVGRGRPGARTRLTAGPARPVRSHRFGSGPRFSGLGPNGPVPRCSSLPVXSGLXTDRPVQPTPATLVRPTDXPAPDGRTXTSPXIQPCXGXXTNVXPPLXXXSIASRFPPKKXHLSRXXNS

SEQ ID NO: 127768 - protein, 176 aa, Triticum aestivum
  unsure (1)..(176): unsure at all Xaa locations
  Clone ID: PAT_TA_22186.pep
MATTANPTTDLFSRLSFRRAVSPSPLRLPSLPTPTPRISVAIVALHKRNPKRLKYDSQRQFTRGDGGMLRVQVEPSGEDFWKLDPVVDLINSGAVGVIPTDTVXYSIVCDLSNNRLYLSRLRRXSKGIXNSKPLSVLCRSLRDIDTYTTGFPLGTNQGQANIFRAVKRILPGPYTF

SEQ ID NO: 127769 - protein, 477 aa, Triticum aestivum
  unsure (1)..(477): unsure at all Xaa locations
  Clone ID: PAT_TA_22187.pep
QLXVTTFMWEEGPRLKMTLKLFPNNTILFNSREVQRLRYMFTGWLIADSDIFGPYELINFDPGWYENVLQRGTKKSPRTGAIVGIVIAAFAAAAVLSSLITLILLRRRSRQFSKKRTAKRIPMKIDGVKDFTFEELSNCTNDFSESALIGQGGYGKVYRGVLADGKVAAIKRAQEGSLQGSREFFTEIELLSRLHHRNLVSLLGYCDDVDEQMLVYEYMPNGTLRDHLSAKARESPSFPMRLRIALGSSRGILYLHTEADPPIFHRDIKASNILLDSKFVAKVADFGLSRLAPLPDTEGSAPGHVSTVVKGTPGYLDPEYFLTHKLTDKSDVYSLGVVFLELLTGMQPISHGKNLVREVVAANQSGMILSVVDLRMGAVPGECVERFAALGLRCCRDETDARPSMAEVVRELETIWQMTPDTDGVPSESVAMDPTHTPASSSTATGSRMGHEQYDMSTSDVSGSNLLSGVVPSINPR

SEQ ID NO: 127770 - protein, 108 aa, Triticum aestivum
  Clone ID: PAT_TA_22188.pep
KRLPVCFSFYGPMIVISPFSCDEFFKQSLVHRFLPGTTGTTTWYARPIPHNPRISHEHNQHDGASTHSATKSHLSTKQEPPSSISSKHVGPSAKHFMAKVHVTHPRVR

SEQ ID NO: 127771 - protein, 144 aa, Triticum aestivum
  Clone ID: PAT_TA_22189.pep
IQILQRCITVALDKTNITSHLIQILQNPRTKTTNISIWPTPNGKEKKMKMSIRARAEDLYSITDYLVQLSLPLDCWPNSKTLVWQDILLPGTAEPTRALEVLREDGGVDQPLSCYLPDDKMQINSAEAYTLNYETYNYRSKTVA

SEQ ID NO: 127772 - protein, 182 aa, Triticum aestivum
  unsure (1)..(182): unsure at all Xaa locations
  Clone ID: PAT_TA_22190.pep
ARGQTPTKIPFQKGLAQNYVQPSGSGIDLGFFSLDELSNPSEEVYPLVVYAEASPSPEEGGQTVNSTRAQIARAGPGKHNDDLQVKVVKQILWINGVRYELKEIYGIVNSTEADVPDADDDGMGKECVICLTEPRDTAVFPCRHLCMCSECAQALRLQSNKCPICRQPVEKLMXIKVRSSEP

SEQ ID NO: 127773 - protein, 57 aa, Triticum aestivum
  Clone ID: PAT_TA_22191.pep
KTNGIYYYIYLGIYTARLLWVCDEQLVFYYFLFKITKNLFCINSLIVRRSNEMKGCA

SEQ ID NO: 127774 - protein, 272 aa, Triticum aestivum
  unsure (1)..(272): unsure at all Xaa locations
  Clone ID: PAT_TA_22192.pep
MACRGFFECVLKLLNLVLMAVGLAMAGYGAYLLVLWLQLLPPSPPAPPPSGDLVHLGRPMLLLIDVSISDGTSEKLISAWFIFAFIGVGVILFITSIFGCAGASARSGCCLSTYSFLIILFILVELAAGCFIFFDHSWKDVIPCXDKLANLDMSYKFPETKIGETAKWVALGAVVFEGSATRFLQRKQLVNKQTATDPGVLNLEYRRLESVRXVNKQTATDPRVPNLDYRPIRNDAWSQRMRDKYGVDSFDPNRFQQATISPAEQRNRCTIL

SEQ ID NO: 127775 - protein, 179 aa, Triticum aestivum
  Clone ID: PAT_TA_22193.pep
MATNTSATDYSSAGTQPQIDRRLLEAATSGDPRRVKELVSRNPSIILGTTPQGNSCLHISSMHGHKEFCEDVLEIEESLLLNANFESFLSKLNLQGETPLVTAVTHGHAFVASFLVGRCHRLGLRQVILQQDKTGCNALHHAIHSGHKELALELIAAEPALSRDVNKFKESPLFLAVMR

SEQ ID NO: 127776 - protein, 390 aa, Triticum aestivum
  unsure (1)..(390): unsure at all Xaa locations
  Clone ID: PAT_TA_22194.pep
MGYVGSHGVATLRKYKYSGVDHSIVAXKYILQPFWSRFVNVFPLWFPPNMITLTGFMFLLTSAFLGFLYSPHLDTAPPRWVHLAHGILLFLYQTFDAVDGKQARRTNSSSPLGELFDHGCDALACTFESLAFGSTAMCGNATFWFWVISAVPFYFATWEHYFTNTLVLPIVNGPTEGLMLIYVCHIFTFFTGAEWWAQDFRKSLPLLNWVPLVPEISLYGIVLFLMIAFAVIPTIGSNTHNVYKVVEARKGSMVLALAMLFPFGLLMAGTLVWSYLSPSDIMRNQPHLLIIGTGFAFGYLVGRMILAHLCDEPKGLKTGMCMALAYFPFAIANALTARLDDGNPLFDEQLVLLIYCLFTVALYLGRAHPWRTPTANALGTHPRGITRKKA

SEQ ID NO: 127777 - protein, 163 aa, Triticum aestivum
  unsure (1)..(163): unsure at all Xaa locations
  Clone ID: PAT_TA_22195.pep
MGLLELFITACMPVLNMLLVTGVGSFLATDSVGILGKEARKHLNYVVFYVFNPALIATYLAKTITMESMARLWFMPVNVFFTFIFGLIFGWIVIKVTGAPLKLRGLILGCCSAGNLGNIFLIIIPALCKEKGSPFGAPDVCQTYGLAYSSLSLAXCSVYNWRN

SEQ ID NO: 127778 - protein, 70 aa, Triticum aestivum
  unsure (1)..(70): unsure at all Xaa locations
  Clone ID: PAT_TA_22196.pep
IFPLVKMLEEGEGDVLEASLAVLYNLSLDPENHPPIIAAGAVPLLKRIVHXESPHWESVLFKLLKNVAPL

SEQ ID NO: 127779 - protein, 89 aa, Triticum aestivum
  unsure (1)..(89): unsure at all Xaa locations
  Clone ID: PAT_TA_22197.pep
LEPXXFLXSXSXXGIXRVLDXKHXGXGCXXVVCSGXXEXSLSPGSARSFRRSWAFTPGPNSSFSSLPADLTNLVLSXCCCKDHQGGCSY

SEQ ID NO: 127780 - protein, 92 aa, Triticum aestivum
  Clone ID: PAT_TA_22198.pep
ECKITLLRMSILMSSDTAGGGQRQVCVFQMGRCILYLDIKGKTLRKVYEMKDKDWYSVYYIFPFKMVWPPIFPALKPNLQESPSEEQYHPAQ

SEQ ID NO: 127781 - protein, 44 aa, Triticum aestivum
  Clone ID: PAT_TA_22199.pep
QKDALFLFFLPALISKINREYKGRQSLTVIMYHLHYCTCTPQKI

SEQ ID NO: 127782 - protein, 74 aa, Triticum aestivum
  unsure (1)..(74): unsure at all Xaa locations
  Clone ID: PAT_TA_22200.pep
PPFAAVVMYDASGVRFHTGRQAALLNXIVSDLSPDQPTISPFRPXFGXXSLDTGPFQVFAGALVGCTVAYLMGN

SEQ ID NO: 127783 - protein, 174 aa, Triticum aestivum
  Clone ID: PAT_TA_22201.pep
CSGLLHPACPGRVCSVLPRLLAFGSSALGFGGGLPVSTDRLPFLHHQLVLGEPRAASPPACSCRRQSRGADGAVQCPGPQGCCDPTAAADAPRRPGAGSALLLPGPGPSRIWRHRAPCTGSGSSAACPPSLAVVVVWRAVCLGPVSCLCVLPRPLIRLFFCLGGTTFQHIDFCL

SEQ ID NO: 127784 - protein, 154 aa, Triticum aestivum
  Clone ID: PAT_TA_22202.pep
MRELAGRPGTWGGLWLRLGQAALAAASIAVMASANGFAGYTAFCYLIASMGLQALWSLGLACLDGYALKVKRDLNNAVLVSLFVVGDWVTAILSFAASCSAAGVIVLFERDISFCRRYYELPCGRYQLATAFAFLSWALSATSAVIMFWLLASF

SEQ ID NO: 127785 - protein, 98 aa, Triticum aestivum
  Clone ID: PAT_TA_22203.pep
PFLAEGEEVAFSTLDKLELLSFFLIEPSLVTTSIMAATTIYTTQCMLNGCWSWNKCRELHTKYSEDQLWDYSSTIRLPCFGGDVLRLPLCPGPAGPAH

SEQ ID NO: 127786 - protein, 54 aa, Triticum aestivum
  unsure (1)..(54): unsure at all Xaa locations
  Clone ID: PAT_TA_22204.pep
PLCLPSPPSQLPTKSWMQENPTSSRVYDVRPRAESVGMMAMAXTTESQEDRSRG

SEQ ID NO: 127787 - protein, 163 aa, Triticum aestivum
  Clone ID: PAT_TA_22205.pep
MRSSIATYRESLSRLAGEVDDATADEIPAPWPSRRGDNAPTPPSSGRRRRYTRPDPAEPDEISKLKEDIEKIQASEAEIKALSFNYAAMLKEKEECLIAECAANPPSNTGRHKDNLGRAGPHPPCCSFRADGPSRSVEQENRGTAFRLQHPYQLGVHRAIVAS

SEQ ID NO: 127788 - protein, 200 aa, Triticum aestivum
  unsure (1)..(200): unsure at all Xaa locations
  Clone ID: PAT_TA_22206.pep
LAHHLPCPARRALAPAPPRHRPPPAAPPRHPLRLPPPPSRPRRRRPPRPPPSAAPADGRGPPVTIEHGGRLAGVADGRRRRTSWSARWEEGLDVPHDCKLGVCMTCPARLAVRHGGTNSDGMLSDDVVAQXGYALLSAAYPRSDFNIRVIPEHQLLSARLATADDRLPPPPLPAGHLARPRSAVSPCSEALYSVVHQPLQ

SEQ ID NO: 127789 - protein, 202 aa, Triticum aestivum
  unsure (1)..(202): unsure at all Xaa locations
  Clone ID: PAT_TA_22207.pep
APGANHHRPSVFLLRAAATVAAAARLLPSPRRSISPPSPPYPPPPHVPPERRLYAAFVVIRRFKTTTSCHPRITTTTWIRPDICGRESYHGFYCTTPLGHGEYLTVTSIVFNGFGLCAPELQGFIDQLPDLALFEASSNRLEXDMPRLEGLPYKYSLDIQDNIELHSSGLENLFAGRHCNIIMVNKITGKLFCSAEYSLNDL

SEQ ID NO: 127790 - protein, 123 aa, Triticum aestivum
  unsure (1)..(123): unsure at all Xaa locations
  Clone ID: PAT_TA_22208.pep
MASTFSGDETAPFFGFLGAAAALVFSCMGAAYGTAKSGVGVASMGVMRPELVMKSIVPVVMAGVLGIYGLIIAVIISTGINPKAKPYFXFDGYAHLSSGWAGCRPRRAPRIAGAGVGHPGWAN

SEQ ID NO: 127791 - protein, 203 aa, Triticum aestivum
  unsure (1)..(203): unsure at all Xaa locations
  Clone ID: PAT_TA_22209.pep
RPRRPWPSSPSTPASPSSPLASRAAASSLRSAPPRTRLPPLRTSTGHLFRSLRCRRRPCRARAASIPPTASLDLTEDNVRQAIVDAKAELAQLFDTSVGITGQVDLXELDGPSVKLRLKGNFWHTRATVVARIGNYLKXRIPEILEVEIEDEAQLTRQPRGVRSCLRRLPSHYRGLVAALCACEPSLSAPTVFRLASGRIIIL

SEQ ID NO: 127792 - protein, 57 aa, Triticum aestivum
  Clone ID: PAT_TA_22210.pep
SPYRSTTSFDIGRVSVLYVSTFADMSVFHFILSVDVFVVCVLVIHRPGVGHHGFVST

SEQ ID NO: 127793 - protein, 149 aa, Triticum aestivum
  unsure (1)..(149): unsure at all Xaa locations
  Clone ID: PAT_TA_22211.pep
ISPKPSLPLLFSTTSDLHHHLGATLTPHPLLRWPLAATHHRPEPPSTAAATLLDAVLPVVCRRSRRVRLISLSTSICCTARGMAEVGQASAGAGGLSLDRGRGRGEDEGDDLSPLAGCGPXRAPGVSDPEGRPRPADVDMWTRXLRLXF

SEQ ID NO: 127794 - protein, 130 aa, Triticum aestivum
  unsure (1)..(130): unsure at all Xaa locations
  Clone ID: PAT_TA_22212.pep
PILMTKQKQEQAATPSPSPALFSLHPTLFFLFSSLDSNFQFTPAANKRQPATTKAEEDEPSHSQGDDRRLPAMDHVRKRHQEKGFLYDCFFMLCCCFFGXEXASTASSASAAAATGAXDHNRSGIXAHPR

SEQ ID NO: 127795 - protein, 163 aa, Triticum aestivum
  unsure (1)..(163): unsure at all Xaa locations
  Clone ID: PAT_TA_22213.pep
TSRPIPHAPPPNLATNHPTPPAAGHHPAPPSPATDHPAPPTPATTFRIWPXPRPPRRSTLPPPSGIWPATTGRPPXPPRHHTMPPPSPPTNADSPSLPVDATQVLPAAPMLCPDAPLLLPPPLXSPNKPSPHPKPASAVAGFRIGRELPTIVRQHGLCTAKMV

SEQ ID NO: 127796 - protein, 226 aa, Triticum aestivum
  unsure (1)..(226): unsure at all Xaa locations
  Clone ID: PAT_TA_22214.pep
MAARLLPLLVLAVSLAWPASCKPLPVLVPVTKDPATLLYTIPFHYGADLVVDTAGPLVWSTCQRGHLPAEFPCNSPTCRLANAFHIPGCRARGCGHDTRKDRTCTAYPYNPVTGACAPGDLVHTRFVANTTXDGVHPGSQVNLRALAASAPSRLLKSLPRGPRRGPARARPARALLAPRGLRALPPPQGPRCPPRAGAPQSPPWRSSGGAAQPSALPEGLQELVNA

SEQ ID NO: 127797 - protein, 128 aa, Triticum aestivum
  Clone ID: PAT_TA_22215.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQ

SEQ ID NO: 127798 - protein, 94 aa, Triticum aestivum
  Clone ID: PAT_TA_22216.pep
RAAARAGTLASTFVLVFVAEWGDKSFFSTIALAAASSPPGVIAGSLAGHGVATLIAVLGGSLLGTFLSEKIIAYIGGSLFLAFAAVTLVEIATS

SEQ ID NO: 127799 - protein, 121 aa, Triticum aestivum
  unsure (1)..(121): unsure at all Xaa locations
  Clone ID: PAT_TA_22217.pep
XCXGDVFRGSGDSSHIAAVPGRRATFQMFHYTTTDSQRVQRQHGHINIDITTDQPLKISKQELQEQEQRYAKRKELLLRSQALHLLLHFLPGFFCLHQLHFVARDSRHDRKAARNGKDGCG

SEQ ID NO: 127800 - protein, 287 aa, Triticum aestivum
  unsure (1)..(287): unsure at all Xaa locations
  Clone ID: PAT_TA_22218.pep
MRWWESVKSLFGDGGNLGCLSCVGRKAPEDLYSYPMEPAKXKRSRRAAPAAEEEPGAIEVPAVALREVNELTGSFDREKLIGEGSYAKVYKVTLRSARLAVVKKLEKASKHASNDVFRRQLSVASRLRHESFVRLLGYTISGDLRVLVYEFATMGTLHDALHGPREGVGAREEVEERPVLSWAHRVQIALDAARGLEYLHEKASPPVVHKDVRSTNVLLFDGMRAKIADYNMFSQAADMARLNRSTHTLGSFGYQAPEYAMSGQMTDKSDVYSFGIVLLELLTGRKP

SEQ ID NO: 127801 - protein, 254 aa, Triticum aestivum
  Clone ID: PAT_TA_22219.pep
MALAANAHGRVCTLSSRPPTPFGSRSMVTMPGHHVQARFAVRATAERATWLPGLDPPAYLDGTLPGDYGFDPLGLGEQPEDLKWYVQAELVHCRFAMAGVAGILGTDLIRVSGLGNLPVWFEAGATKFDFANTTPLFVVQLLLMGFVETKRYMDFVNPGSQAKEGTFLGIEASLEGLQPGYPGGPLFNPMGLAKDIENANEVKLKEIKNGRLAMVAMLGFIVQASVTHAGPIENLLTHLSDPFNKNIIHALTLS

SEQ ID NO: 127802 - protein, 294 aa, Triticum aestivum
  Clone ID: PAT_TA_22220.pep
MAPTAALSCSCSPSPSPSSTLLLRRTVSAFHRRPAHAGVRRPRLAPLHVVDDSKEVEARSETDRLVDGLNFGELCNDFECISSPYVESTARQIARDILEIRQDNRALSCYAVAVKYKDPLRSFAGREKYKRPLWITEALEKPIVTVQEMSMQSTSSLTIKWTLRGKPKNAFFAAAGGELVVRIDSQFVLNQISGQVLEHVESWDLSASSPLAQAYFWFSRRVYSTVEAGKDTIEAAKGVASRLNKDDNLEVYPDPLGDPTKFFTRPDDLNQDVVQIGLFLAVLYFIVQFLKTTL

SEQ ID NO: 127803 - protein, 219 aa, Triticum aestivum
  unsure (1)..(219): unsure at all Xaa locations
  Clone ID: PAT_TA_22221.pep
MLILLRLAAWPSFLWLQILKNNSKXAGTFYWVINILQVPAAVXVFVWKAVQLCRESRARRMNGNLECVCEANIEWSPXSLIFCAFCGLLGGTVGGLLGSGGGFILGPLLLELGCIPQVASATATFVMMFSSSLSVVEFYFLGAVPIPYALYLIFISILAGFWGQCLVRKIVHVLKRASLIVFILSSVIFASALTMGVVGTEKSISMINKHEYMGFLSLC

SEQ ID NO: 127804 - protein, 118 aa, Triticum aestivum
  unsure (1)..(118): unsure at all Xaa locations
  Clone ID: PAT_TA_22222.pep
MARLNSKAVAAAVVLAAVVLMMAGREASAALSCGQVDSKLAPCGAYVTGXGVLRSARMCCSGXVQGLNGPAPAARPHPLGLRGIVPSESLRPPTSTGPSLPGGTRSPAPRQGASTFPP

SEQ ID NO: 127805 - protein, 341 aa, Triticum aestivum
  Clone ID: PAT_TA_22223.pep
MAVEEEGRKGIPSLLSSGDGEENIASNITQLIGWTPLIEMKNIAKKDGVEARLVGKMEAYQPLCSVKDRSALRMIEDAEEKGLISPGVTTLIEPTSGNQGMGMVFIAIQKGYRFIAVMPAKYSLDKQMLLRFLGAELILTDPANGFKGMIGKVEELMKTIPNSHCLNQVTNPANPDAHFKWTGPEIWKDTAGKVDMFVAAVGSGGTLTGVGKYLKMKNPSIKIVCVEPSESAVISGGSPGSHKIQGTGPGFIPEVLDTSVIDEVVTVSTEEAMVMARRLAREEGLLVGISSGANVAACIKIAAREGNEGKMIVTIFPSAGERYMNSDLFALVREECENMTF

SEQ ID NO: 127806 - protein, 129 aa, Triticum aestivum
  unsure (1)..(129): unsure at all Xaa locations
  Clone ID: PAT_TA_22224.pep
MMELRKYWGVGGRRCGACEGAAPAAVHCRDCAGYLCTGCDARPAHARAGHERVWVCEVCEVSPAAVTCKADAAVLCVRVRLRNHHANPARLVATCRVPXRGPSAPPXAAAVAAEAXMMFCGAXPVRCPR

SEQ ID NO: 127807 - protein, 259 aa, Triticum aestivum
  Clone ID: PAT_TA_22225.pep
MASTSCFLHQSTARLAASARPAPAVGRTQLFVCKAQKNDEAAPDAAVVTSRRAALSLLAGAAAVAVKVSPAAAAYGEAANVFGKAKKNTDFVAYSGEGFKLMIPAKWNPSKEREFPGQVLRYEDNFDATSNLSVIINPTTKKTITDYGSPEEFLSQVGFLLGQQSYGGKTDSEGGFESDAVATANVLESSAPVVDGKQYYSITVLTRTADGDEGGKHQLITATVADGKLYVCKAQAGDKRWFKGAKKFVENAAGSFSVA

SEQ ID NO: 127808 - protein, 253 aa, Triticum aestivum
  unsure (1)..(253): unsure at all Xaa locations
  Clone ID: PAT_TA_22226.pep
TPARQGRWGSGAAPTVLLRRTAAMDGSDADPGTGSGGGGFEWDADSQLYYHASTGFYHDPVAGWYYSSTDGQYYIYENGDYVLWTSDVGKEPNVQSPCDEASQSFLESSSGPEPDIPHQPPSEWFLHKXITLSYLINIFFRHLILLRLILLFFYRLEETLINMYLSGYSNIEVSTENLLRESQISEEGKSDEVENKLSNVASDNASDSLNDATLQQIEDKMEIENFTAVHESVREEEEXWLSQYGQVERVNDE

SEQ ID NO: 127809 - protein, 80 aa, Triticum aestivum
  unsure (1)..(80): unsure at all Xaa locations
  Clone ID: PAT_TA_22227.pep
MHSCMYYSHPPPPRPPPPPKPPPPPPPKPPPPPAPSPAPXPAPKPPPSPPPTPQTASPPPVSRGRVARARASNQTGGRGA

SEQ ID NO: 127810 - protein, 343 aa, Triticum aestivum
  Clone ID: PAT_TA_22228.pep
MGHHSCCNQQKVKGGLWSPEEDEKLVRYITTHGYGCWSEVPEKAGLQRCGKSCRLRWINYLRPDIRRGRFSPEEEKLIISLHAIVGNRWAHIASHLPGRTDNEIKNYWNSWIKKKIRKAPAAPNVTTTSSTTSTSPPNNGLAPCSGSTATSDVHHRRLQHPTFSCAPAGDHLQLDAIIGHHQSTSLALPVAAGAGQDSPPGMSHHCPLFMFDTGVVSTPFASAAAQQHPFIASFTAAMAEADTPSCYHLPPLVDGMGAMGMCMEAMDDHCGAGAGMGNGCFGDEQRQRRRPELEDEEGEQLGQHEQWDEEQLLMWDDQEVLTPSNMEAMQSGEHSLLFMGPNA

SEQ ID NO: 127811 - protein, 113 aa, Triticum aestivum
  Clone ID: PAT_TA_22229.pep
VLTAVKFVDDICYNNAYFARVGGISLMEMNYLEVDFLFGIAFDLNVTPAVFASYCAVLQTEMAYLEHPPPSIDAVSPTSLLQHCLPDQEVDTAAAAAAAAKSGCHRHQQQLTV

SEQ ID NO: 127812 - protein, 72 aa, Triticum aestivum
  Clone ID: PAT_TA_22230.pep
MPLLICNFPSAPPAWRQGRGSGGRRTSCLAREEMVAGSRSRVRSASAIAHLLSHLSGKLPSAADPRVRPRVR

SEQ ID NO: 127813 - protein, 743 aa, Triticum aestivum
  unsure (1)..(743): unsure at all Xaa locations
  Clone ID: PAT_TA_22231.pep
MEVLCIGTADTKLEELLFLATRLRSSLAASAPKVKGSIVDVSTTKTVPTQDSKDIAVIARDTVLSCYPDSSQQDLPDDRGEAIALMSKALQSFLKNRYEAGTLVAAVGLGGSGGTALIAPALRSLPLGVPKLIVSTVASGNTAPYVGTSDLVLFPSVVDICGINSVSRVILSNAASAVAGLVCGILMASSESDETDTKLTVGITMFGVTTQCANAVKDRLNKEGYETLVFHATGVGGKAMXEELVRGGFIQGVLDITTTEVADYIVGGIMACDETRFDAVIDKKIPLVLSVGALDMVNFGAHDTIPAAFSDRKIHIHNEQISLMRTTVEENKKFAQFIADKLNKSLSTVTVCLPQKGISAIDAPGMPFYDPEATSALLDELNXVLSKLXNRQLKLLPYHINDPEFANALVDAFLSMDIKASSAITQKNNMVLPKQDTNEKESSSGQKTSDSSIIWRPPVDFPDARPETLQKTKSILHKLKQQIGEGIPVIGAGAGTGISAKFEEAGGVDLIVLYNSGRFRMAGRGSLAGLLPFADANAIVLEMANEVLPVVKEVPVLAGVCATDPFRRMDYFLKQLEAIGFCGVQNFPTVGLFDGNFRQNLEETGMGYSMEVEMISRAHSMGFLTTPYAFNPEEGAAMAKAGAHIVVAHMGLTTAGSIGAKTAATLDDSVARVQAIADAAVGVNPDIIVLCHGGPISGPREAEFVLKNTNRVHGFYGASSMERLPVEQAITNTMREYKRMSLK

SEQ ID NO: 127814 - protein, 165 aa, Triticum aestivum
  unsure (1)..(165): unsure at all Xaa locations
  Clone ID: PAT_TA_22232.pep
RPSRETQPPPLLAPPIVAAGPTIVARGSSAALPSRKPPLARSLPLASHRSASSLPGAGHWLVGSGYPPLARRPSPSPVSIRHPLLAAALQPLTAARFSEGNWLFVLGIAPDVIGDIQTAFGDSNIFLIQFVPPELAPSTYRSQEPVKXPPHPSSXXQLXRAAVCI

SEQ ID NO: 127815 - protein, 191 aa, Triticum aestivum
  unsure (1)..(191): unsure at all Xaa locations
  Clone ID: PAT_TA_22233.pep
MEEWVYYSLSITLCLTLSLVFSSLRKCKAAGSSFLPPGPTSLTAFGPLLLLAWTSVNIESVVRVARSWYGPVFTLYLLXPSPFVFVPDRAVAHRVLRAPRXPPSANRPAGQPGPPASSLVXKHNITSAAYXPLWRALRXNSPAGRSRSSRGTPPPRAAPPRGSTRTTDAKRSSRGPGRCLKMPALRQGLDN

SEQ ID NO: 127816 - protein, 83 aa, Triticum aestivum
  Clone ID: PAT_TA_22234.pep
GEGVEAYDKLQNDLVTAKERLTNILQSKDRKKTLLDMVERNELNMSILTLLDENIASAKTSNQEEAVAFMEDVRSSMLKYITV

SEQ ID NO: 127817 - protein, 249 aa, Triticum aestivum
  unsure (1)..(249): unsure at all Xaa locations
  Clone ID: PAT_TA_22235.pep
MASTSSSLGAILQRFPLLAPRPASRRAPTTRRAVANKISCIGWDPEGILAPPQPGHISRLEFRRRLDSDADARAAFDLQVKEEQERRRKEREARVIPETDAGLVEFFLDTDAREIEIEIGRLRPRLNKGFFDHIQREIAQIKFAVTTTAANEDRLIELEAMQKVTGEGVEAYDEQQNDLVTAKERLTNILQSKDRKKTLLDMVERNELNMSILTLLDXENIASAKTSNQEEAVAFMEDVRSSMLKYITV

SEQ ID NO: 127818 - protein, 101 aa, Triticum aestivum
  Clone ID: PAT_TA_22236.pep
RLSLLSSFPLVNCDRSDSDEGGGRGQDRPRAHFCLSDRHVARHHHRHHHHYFFAGREYLSHYAYISSFVVTDALLLSTQCMHARMISTLLWPLDHVFVLFL

SEQ ID NO: 127819 - protein, 143 aa, Triticum aestivum
  Clone ID: PAT_TA_22237.pep
MMAAACSLSPLPLAPPGAPRPALFSRCVAAPRRGRNAGGGTGRLRLARRLRPPAAAIEEVEQTEAMMRVAADDDSITATVVSVLLTVSFVGLSLLTIGVIYLAVQDFLQTRESEKFEREEAERQKEEARQKIAKARGKKRNRR

SEQ ID NO: 127820 - protein, 373 aa, Triticum aestivum
  Clone ID: PAT_TA_22238.pep
ARDAATAPVTALGPCDTRRPLSAGRPAPPAKAPLTAAVPGRPGTSGRAASPGCRSASPTTLGGTAPSTTGPQPAFLHAFAVTANYAIFPEIQIVMNPMGMVVGGGSPVGAASGMVPCLGAIPYYTSHESQMRRFQVAGLVSVHSVVGWEAAVGPQIGVMAKYVADNSDTLERKELIYAFVELVRINLRTGNVTRTPLAAANLDFGVIKPGMEVIHASDGLFGVDDPMPNIGGVPKLDFDRAGHGDCTVGAPGLHGSGCFAGEPPFAPRRASRGPETRTTGHWCATCTTRAPATTGSWGEPFFVPDDVEGNGDEDDGYVVCYVHDEGTGDNRFVVMDAQSPDLEIVSEVQLPSRVPYGFHGIIVTQAELRSQHQ

SEQ ID NO: 127821 - protein, 148 aa, Triticum aestivum
  unsure (1)..(148): unsure at all Xaa locations
  Clone ID: PAT_TA_22239.pep
PPRHHTTPLPSETLMSRRRLPSRLPTSASSPYSPISLLSYLTFLPGAASTSLQIHTLSGGGSLQHRWEQWPMPGGTEVGTSQYEAPLPIHSPWGGRAPESNPRVQFHSLQFNFVXAEGXPTSLGXMAMPGGLKWDITYEXVPIHNSWX

SEQ ID NO: 127822 - protein, 243 aa, Triticum aestivum
  Clone ID: PAT_TA_22240.pep
MTANQPAGEALATHISGMSRPEMYDLMSQMKAMLDHDQERVRRMLVENPDVTRALFRAQVVLGMVKTPKAAQSSDMPQPAVAQTTPPASVKATVQDHVNLPQPPVPTNQQNLQPSGQFPSGTSNLTSSLDLPPMPANPPQSAQSKGYPIHQMHSASAPQSSQYPNVTMPPHAPPQYSNVPSHMPTVNSQPQQPLQNPGMFYPQLQPPLPQLPRPPSMQAYTHQMHQQIPSTYGQHMLQQPMFH

SEQ ID NO: 127823 - protein, 316 aa, Triticum aestivum
  Clone ID: PAT_TA_22241.pep
MLLRLKITTVQPVALLLGHDHGATASPRRLAGALPQGGGASTRAKRLRSVAVAMALKEEEPESSRSRFAGGGPSWDPRMEIGVPYEQRPVNEYSALKESTLYSWAELSPGSFFMRLGSLCLVTFTVLAAPISAASFSPGKDPLKFVLAAGIGTLLLVSLVVLRLYLGWSYVGDRLLSAVVPYEETGWYDGQMWVKPAEVLARDRLLGSYKVKPVINLLKQTLVGTGALLVGAVALFAFAAPVEEFVHSFNGAPTAASSKPMMRREDLLKLPAEVRQDDDLAAAAAEAANGRPVYCRDRYYRALAGGQYCTSDDLLN

SEQ ID NO: 127824 - protein, 238 aa, Triticum aestivum
  unsure (1)..(238): unsure at all Xaa locations
  Clone ID: PAT_TA_22242.pep
RPPRPRPPLTPSPSSSPPRTPATSESKSTSPVKRPPRPPPAASPKXAFMDRLQRHIRHAPGPSLCLAPPQAAARAALPPAPSPLRPPPPQXPSPCSPDSHPPTPTAASSAGPSGPTTGLPTSCTPSHSIPPAYRSPXAATPPPPRSPGQPLPLGFAAVGGRVRAPSSHSSCSSSGTPWGKRRPVAPVGFPPPAAPPPDSGRPGESGPRAVRRVLPPGRSPPGWLNKVSPLILFLLRIL

SEQ ID NO: 127825 - protein, 105 aa, Triticum aestivum
  Clone ID: PAT_TA_22243.pep
CLSGEHPPPPGGLGLLTCYSLPRLPVDPPIYPSLFLPIPGGGPTASPGPRCRRNPPRPRHYKELDAQHEVMALKPKTWEEIPRLVRERREAAREARERQQSAMQE

SEQ ID NO: 127826 - protein, 72 aa, Triticum aestivum
  Clone ID: PAT_TA_22244.pep
SWSSIASVLFFFSFLSCLFIYYSSFPFSRTSSLLLISALYCISIEGKREQKCTATSLTINQCAGNSLLPKKK

SEQ ID NO: 127827 - protein, 81 aa, Triticum aestivum
  Clone ID: PAT_TA_22245.pep
AASTLTDTLLDSSLPIVSDSGALPSIANRSQPRPSTLLPAALTGPGTSAVCALHGPDTTVQVQGCMKTRNLNSTACRRRHE

SEQ ID NO: 127828 - protein, 256 aa, Triticum aestivum
  Clone ID: PAT_TA_22246.pep
MRPQRASERAREIRREGARGDLRALVGGRVVGAGAMESGPAGTMGGPLSDVPAMLDGDRYELVRSIGSGNFGVARLMRNRASGELVAVKYIDRGEKIDENVQREIINHRSLRHPNIIRFKEVILTPTHLAIVMEYASGGELFERICTAGRFSVDEARFFFQQLISGVSYCHSMQVCHRDLKLENTLLDGSTTPRLKICDFGYSKSSVLHSQPKSTVGTPAYIAPEVLLKKEYDGKIADVWSCGVTLYVMLVGAYPF

SEQ ID NO: 127829 - protein, 396 aa, Triticum aestivum
  unsure (1)..(396): unsure at all Xaa locations
  Clone ID: PAT_TA_22247.pep
RKGPAAAGRGALLPAREGGRTRGLRRRGRRERPGLRVGPGRDVPIVQGGDRYELVKDIRSGNFGVARHLRKRPDGQLVAVKHLERGEKIDQDVQREINNHRSLRHPNIIRFNEVIPTPTHLAIVMEYASGGGLFARICTAGRFSEDEARFFFQQLLSGVSYCHSIQVCHRDTXLENTLLDGKHGLDASRDATLAFPSTLSVLHLHPKSXMGTPSLHSLGKLLLXKKEYDGKIAGCVVLLEWTLYVMLALVHIPFEDPXEPKNFRKTIQRILSVQYSIPDYVHISSECRDLIAKIFVGNPATRITIPEIRNHPWFLKNLPADLVDDSTMSSQYEEPEQPMQSMDEIMQILAEATIPAAGSRINQFLNDGLDLDDDMDDLDSDADLDVESSGEIVYAM

SEQ ID NO: 127830 - protein, 167 aa, Triticum aestivum
  Clone ID: PAT_TA_22248.pep
IDITHSGSGVSKDVARRGQTSATGKRQLRVLSQRPLITEIQKDNALLRAKQFKSKNPFGLQIMKESYVYVGFFLNLPCEFVRECLPRAHRKLKLWNPQGKSWDVNYVYYSERCVGGLSGGWGKFSLDNNLEKFDVCVFELFSKDNIKVHIYRVVPEITPFLPGPGKK

SEQ ID NO: 127831 - protein, 220 aa, Triticum aestivum
  unsure (1)..(220): unsure at all Xaa locations
  Clone ID: PAT_TA_22249.pep
MNSKLCISSSHQPWHGFHIHESATERVAPPRVHLIKKMSHPKVSIDEFISTLPQRKGWSQPLIQYKNFWFRGPPLEQILLAQHAFEPRADDIILATQPKCGTTWLKALAFTIVNRSRYSFDDQPLLTSQPQXVVPFIEIPGCWRRRRRIIMHTSKTLLPEGSRHTHAMSLLQWTYLRVCTVPDSRCLGRGAFRKVQRRLSCPAAPPCPWRVLSTCFCFSS

SEQ ID NO: 127832 - protein, 279 aa, Triticum aestivum
  Clone ID: PAT_TA_22250.pep
ASVSFNWIGPLAVSCLQHGRTRCWPCEFTYTNQVKYLRPVSSMTPMQGCGCQSVCLPGDANCACGQHNGGDLPYSSSGVLVCRKPIVYECGEACHCTLNCRNRVSQKGIRFHFEVFRTANRGWGLRCWEPIRAGAFICEYTGEVIDELKVNLDDSEDDYIFQTVCPGEKTLKWNFGPELIGEQSTYVSAEEFQPLPIKISAKKMGNVSRFMNHSCSPNVLWQPVQYNHGDDKHPHIMFFALNHIAPMTELTYDYGVVGEETSHRARTCLCGSLTCRGLF

SEQ ID NO: 127833 - protein, 98 aa, Triticum aestivum
  unsure (1)..(98): unsure at all Xaa locations
  Clone ID: PAT_TA_22251.pep
MSKGPVPFPSFGKKAKDLLYKDYNFDQKFSWSTTSESGLGITASGXKFDELFIGDIRVQHKSGRNTVDVTIDCDSKVSTAVTFDEVIPXLKTLSAQRS

SEQ ID NO: 127834 - protein, 77 aa, Triticum aestivum
  unsure (1)..(77): unsure at all Xaa locations
  Clone ID: PAT_TA_22252.pep
XXXVLLFVSKCHVMVLVLHGGFLMGPRICGGYGTPCXGCLXVAPPTDGAQWNRIFCTCWVLLFSRRSALVDGSQRNH

SEQ ID NO: 127835 - protein, 77 aa, Triticum aestivum
  Clone ID: PAT_TA_22253.pep
MSFRSLIQDMKDGRAFRSPPRPRAARPRPAPAGPRPPPVVAGGLAAALAGAGGAPRPPELLREVLVRIDDSQGCWPS

SEQ ID NO: 127836 - protein, 132 aa, Triticum aestivum
  Clone ID: PAT_TA_22254.pep
PAVCFLTCCVHPSIQGWRLSQPRRSPWRMSWRRKQPSQPRRMPRLQKHPSLPRRRPRLGRHPVPGHRRGQHLGIPSSTTSLRGSPHNMERDVVSFPHMINHVLRVDFLECIDYQVIMHGIYLFTIFHPFQHV

SEQ ID NO: 127837 - protein, 110 aa, Triticum aestivum
  Clone ID: PAT_TA_22255.pep
MVPTVMASSDTYGAHFQGLKCTVGLSVRRRYNGASLGSVSNGGRIKCMQVWPMEGVKKLATVSYLPPLNTEDLLKHVDYLIRCKWEPCLELSKVEVIFSEHNAYGWDYDG

SEQ ID NO: 127838 - protein, 98 aa, Triticum aestivum
  Clone ID: PAT_TA_22256.pep
MSPQTETKAGVEFKAGGNDYKWTYYTREYETKDADLLAAFRVSRYPGVPPEETRAAVSAESCTGTWTTVWTDGLTSLDRCKGRCYHIEPVAEEDSQWI

SEQ ID NO: 127839 - protein, 82 aa, Triticum aestivum
  Clone ID: PAT_TA_22257.pep
HSPNEAAHPAKGSPPPQGRTQEATHRRNEQKNTRSRGKLRGQQTAGGGNRRGRREKSSSTGGGSRNRHEQQGIALLPRAPLP

SEQ ID NO: 127840 - protein, 103 aa, Triticum aestivum
  unsure (1)..(103): unsure at all Xaa locations
  Clone ID: PAT_TA_22258.pep
FQDLSRRRARPCPLPRRARPPRSPPSPSGNAPPPPSRHPGRVRPPQSAASRGCSPPTVRPPRPAPPLARSPPPPHAPSGRXSLPPPRPAYPIRTHVLTNNKKN

SEQ ID NO: 127841 - protein, 141 aa, Triticum aestivum
  unsure (1)..(141): unsure at all Xaa locations
  Clone ID: PAT_TA_22259.pep
ETKPNPSYMATVAMDISKPPAAGCGDQSDKGARGGREGLRQCYLQHMHDLELQIRQKTHNLNRLEAQRNDLNYRVRMLREELQLLQEPGYYVGEVAKVMGILKGLGKVHPERKYGVNIGASIGLTXITPXTRVALQNDSYM

SEQ ID NO: 127842 - protein, 201 aa, Triticum aestivum
  unsure (1)..(201): unsure at all Xaa locations
  Clone ID: PAT_TA_22260.pep
MDRAAITTMPRKLVVLYPSPGMGHLVSMIELGKIIAARGLAVTIVVIDLPHNTGASATGPFLAGVSAANPTISFHRLPQVDLPPVKSSHLETLTFEVARVSNPHLRDFLAATSPAVLVADFFCNVARGFASELGIPIYFFFTSGAEVLALYLHLPVLHAQITANFQDMGDELVHVPGIPXFPATDSMXAIMDRDDIAYTKS

SEQ ID NO: 127843 - protein, 61 aa, Triticum aestivum
  Clone ID: PAT_TA_22261.pep
FFCRIIYICISRASNRKAELLMRGAKFSKFHHTEKRCGWMGEVLTCELTKDPGLLGVRVSS

SEQ ID NO: 127844 - protein, 91 aa, Triticum aestivum
  Clone ID: PAT_TA_22262.pep
SRWRPAFHRSAAAVSPRSTGGASAAPAPRPRPPPPLPPGPPRDGPVRPPAPPAAPPSAPVDGPPPNAAPRAPPVSNAQCVAASNSIQIYDI

SEQ ID NO: 127845 - protein, 94 aa, Triticum aestivum
  unsure (1)..(94): unsure at all Xaa locations
  Clone ID: PAT_TA_22263.pep
FKSYREGLMSPQTETKAGAEFKAXVNDYKWTYYTREYETKDADIXAAFRVSPYSGVATEETGAAVSGESSTGTCSTVWTDGLTNMDRYKGRCYH

SEQ ID NO: 127846 - protein, 66 aa, Triticum aestivum
  Clone ID: PAT_TA_22264.pep
CDVAVAGGSGDARSPAPAQGDSGIMVSDAPYRHLDYARFFVLETIAGVTYFGEALNLHHCSSTVGH

SEQ ID NO: 127847 - protein, 139 aa, Triticum aestivum
  Clone ID: PAT_TA_22265.pep
TISELPLAFPMEALCALRMQRLISGTLQHGGLNRNRAAPEDGLRTAWRLGRTFITTPAPGTRALLSGIKSRHDARRPPAWPLADTATPATAGLQARPWRLPARGMRQATRSNGTLRHTAAADTAGPFSRWRSLIPNHPG

SEQ ID NO: 127848 - protein, 484 aa, Triticum aestivum
  Clone ID: PAT_TA_22266.pep
MATNKKQPHAVLVPFPAQGHVTPMMKLAKVLHRKGFHITFVNTEYNQRRLVRSRVPGAVAGLPGFRFATIPDGIPTSDVDADADAPQDPVSLCYYTMTTCLPHLKNLLRDLNGAVGAPRVSCVVGDGVMSFCMDAAADLGVPCALFWTASACGFMGYRNFRFLLHAGLTPLKDEDQVKNGYLDTPVAQAHGMSKHMRLRDFSSFVRTTDRSDVLFNFLLHEVEQSDRATAIVLNTIDELEQTALDAMRAILPLPVYTIGPLNSLTEQLVSQEGDLAGIRSSLWREDQSCLKWLQGREPRSVVYVNYGSVTTMSKQELVEFAWGLANCGYDFLWIVRNDLVKGDAAVLPPEFLEATKGRCLLASWCEQEAVMHHEAVGAFLTHCGWNSMMEGLSAGVPMLCWPFFAEQQTNCRYACMEWGVGVEVGDDVRREAVEARIREVMGGEVGREMRRRAAEWKEVASRSTAQPGGRSLANLESLLKDVLK

SEQ ID NO: 127849 - protein, 146 aa, Triticum aestivum
  unsure (1)..(146): unsure at all Xaa locations
  Clone ID: PAT_TA_22267.pep
RPSGAXVLTSPRRLEAALMGSAPGSSAASSSGTAPASRPRRRRRRPRRASPLPRRSFSTAAPEAPRGGQCRPARGRTTRTRARQRRRRPRAEDQGAARHCHGAHHRGSRAAAETSGTSGGLVSRVVGRIELGARRKGRETVERGER

SEQ ID NO: 127850 - protein, 203 aa, Triticum aestivum
  unsure (1)..(203): unsure at all Xaa locations
  Clone ID: PAT_TA_22268.pep
RVKQSRRQAIEKPIYNHVTGLLDPAELIQPPKIFVIEGLHPMYDERVRELLDFSIYLDISNEVTVAXXKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVLILVYLPFCVQRVMLTAVTWK

SEQ ID NO: 127851 - protein, 404 aa, Triticum aestivum
  Clone ID: PAT_TA_22269.pep
MAFCSPHTTTSLRSPCTTIPNSGFRQNQVILFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 127852 - protein, 104 aa, Triticum aestivum
  Clone ID: PAT_TA_22270.pep
EGVQFARMSSIPSCDYTTFPRNWVPHHELVLHEYIKLQDPKFFCELHKTIKRREISSPQDDVSKMVWHYKVHGVYDNNKVSKKLNEWRSNDEAVNGDTQLLLDK

SEQ ID NO: 127853 - protein, 173 aa, Triticum aestivum
  Clone ID: PAT_TA_22271.pep
MVPQVVGTLGYAAPEYMQTGRLTAKSDIWGYGVLLYELITGRRPIDRNRPKGEQKLLDWVKPYISDVKRFPIIVDPRLEGHYNLKSMTRLAGVANRCLLRLPKTRPKMSEVYEMVQKIVDSVEIGPPEPPLHYHGSVSGPGAKRTKKGSLKRRLQEFKFGCRQIVWRGWKPEI

SEQ ID NO: 127854 - protein, 138 aa, Triticum aestivum
  Clone ID: PAT_TA_22272.pep
SSPGEHRRGRGGGEYRPNANSGERPGGYTGGHNGDERDQFGNGFASDLEEPTWNPRKKNEARNSNGSSEYNSDRNSRFRSGGSGAARRLDSTRPVMNANREDGGGRRSRGDGYSLRPTSEFHSSMDRNGGRQFRGDGY

SEQ ID NO: 127855 - protein, 110 aa, Triticum aestivum
  Clone ID: PAT_TA_22273.pep
RLLPKLPPSQEPTFAPKSPPKLSNPLPPLRDPAPDSISPLPKPTRDPSPSPNPPFPSPESGGRRSGAGAGVRRSSICPSELRRTARRLAAARHWASARFFDNKNGGPGEQ

SEQ ID NO: 127856 - protein, 258 aa, Triticum aestivum
  Clone ID: PAT_TA_22274.pep
PTRPEKEEILAPHTHFCVICGKGFKRDANLRMHMRGHGDEYKTPAALAKPMRDSGSDPTPVTRYSCPYVGCKRNKEHRKFQPLKTILCVKNHYKRSHCDKRYTCSRCNTKKFSVIADLKTHEKHCGRDKWLCSCGTTFSRKDKLFGHVALFQGHTPALPMDDIKASGALEQPQGSEAMDDMVASTGYNFPGSTSDGIPNLDMKVADDTRGYFSPLNFDPCFGALDDFARPGFDISENPFSFLPSGPGSCSFGQLSGDS

SEQ ID NO: 127857 - protein, 128 aa, Triticum aestivum
  Clone ID: PAT_TA_22275.pep
SELHERGFHKVRSAVRGGQRCEGAAATSASRVQRAQAPAKAIAAAFACRRSPPADPWEKAGNCRASDRLGEAPLRRDVAGGRIGAHQDGVHHHYGHLFCSGVRLLPAACGAPANCVGGPQWALPCVSL

SEQ ID NO: 127858 - protein, 164 aa, Triticum aestivum
  Clone ID: PAT_TA_22276.pep
IHPGNLRVILVLSLVLGYQLVRRSLGPFHHYHSQIAGMLTRLFMRDHTQRSLPLLKPIRIVLHQLLSTKVPLHIWWQQVVCLSLGCVNLCFPMVVLRGLQRWLAAPLFSVMSLLLPQDQPKAWWKMKTRLLRPKGPSCRSAALWQEVLLEHRAVVRCALEMMAQ

SEQ ID NO: 127859 - protein, 179 aa, Triticum aestivum
  Clone ID: PAT_TA_22277.pep
RRPLSVDAPSLPLSPASCSAPPPGSPLLTRRPLLLWQRAARRGVDAESCHFCAPATRYWARGRRALALDLSAPAAPLATAGRPPRRRPCSRRRRSSSRGTLFSPCGCGSRVCLGILVRARLPSASGFVILRRCARWCSTGSSTARTGSWRTPGGSQPGLDACTVLSCSGANFVSLLIFS

SEQ ID NO: 127860 - protein, 164 aa, Triticum aestivum
  Clone ID: PAT_TA_22278.pep
MSAAPTGAVAGEEIDETTFRAQAEMSEIMVSLPRCPVYLTRQYRGFWIREFVLEGMAAVQASFEPMPTDVFLASCPKSGTTWLKALAFATLNRATHSPSDSDHPLRHHNPHDCVAFLETGPYPRHGAPFTRCCNHCLPCCQTITDAVGRHVSGSQPSRTQVAGH

SEQ ID NO: 127861 - protein, 199 aa, Triticum aestivum
  Clone ID: PAT_TA_22279.pep
LHLSLPIPFSTLRPPPRPGRRGGAPSIQPPLHHPLHLHHPPLPAPHHHLEPPRHPSPSPAPPATTITTAPPPPPRDSTPSPSLSAAFLPLPPLLPAVSPRLPQPSAAPPIFNLQFFYALRSLLLFLSSSFTCCDLSLSHIFAAAPAEPSTLLLLLLLLPKTAAAPFLPMPLLLPLFSYTFCCCHLSLSLSLSLSLSLSL

SEQ ID NO: 127862 - protein, 116 aa, Triticum aestivum
  Clone ID: PAT_TA_22280.pep
IPRNSFHGTASLVNPTAASALTGQSASRWRSGLGTRATRRRPAKGVARGRQLTTWRRVRGRRGRWWSEGWRAMKEVLALTVSTIIMADAAPGSARLRLAHLPVDQSRRRRSKRRDP

SEQ ID NO: 127863 - protein, 100 aa, Triticum aestivum
  unsure (1)..(100): unsure at all Xaa locations
  Clone ID: PAT_TA_22281.pep
MATAAASQVAFSAPVGGSDRAXRSSGIQXINXLSFXXXSWIGTAVAXDXTXAVHGGMSXGXSSSLAXARALSXLXLXSXXEPPLXTXKPRLHTTLCGLAQ

SEQ ID NO: 127864 - protein, 44 aa, Triticum aestivum
  Clone ID: PAT_TA_22282.pep
NLGIRRGRGRGTHRMISTSMSVMCFLTSRPRNVFSLDILQIFYR

SEQ ID NO: 127865 - protein, 81 aa, Triticum aestivum
  unsure (1)..(81): unsure at all Xaa locations
  Clone ID: PAT_TA_22283.pep
PPPAGRPPAPYPPPSSSPPPAPPPSPPPPSPSPPPPPPXPPPPPPPPPAPPPGPAAPGPPPCPXPPPPGALPAVPPPSPPP

SEQ ID NO: 127866 - protein, 157 aa, Triticum aestivum
  unsure (1)..(157): unsure at all Xaa locations
  Clone ID: PAT_TA_22284.pep
RARGRARGGSPYLWILRSDLAPGXEVGKNGLVVPXCAQEAVLAHPAVGLFVTHCGXNSILETVIGGXPVLGWPMVSEQTTNCRQVSTAWNIGAELPQEARGDEIAALVREMMAGRKGMEAREKTLEWKRLAEDATKEGGSSSANLDRFVEDVLLKGL

SEQ ID NO: 127867 - protein, 136 aa, Triticum aestivum
  unsure (1)..(136): unsure at all Xaa locations
  Clone ID: PAT_TA_22285.pep
PTRPPPYLPHPQFPSSPPCCLISPSPRALAHLQPAPSXSICPEQPHAAXPTPPARPAPAHPRASACRSQRPRGRPSAAMPSALLPIRLPPRQRRVKLHPSGVRPHRPAMRTPAPPVAPSSLSTPELSSPSVPLSAS

SEQ ID NO: 127868 - protein, 62 aa, Triticum aestivum
  Clone ID: PAT_TA_22286.pep
YTASMCNIHNQITIKENQKGFFIGEAIPKLTNKKHHYNYLGSAVCLSLSSLILGSFLCDFFS

SEQ ID NO: 127869 - protein, 370 aa, Triticum aestivum
  Clone ID: PAT_TA_22287.pep
MASSEVVEDEASAAAMLANGAADVRRRRDQAKAMLSKQAVKIATKAEEHERFIFKVTHLMGVLGFGTFCYLLGARPQDVPYVYCLFYVIFVPLRWIYYRYKKWHYYLLDFCYYANTFLLVMILFYPKDEKLFMVCFSFAEGPLAWALIVWRCSLVFSSFDKLVSVLIHLLPGIVLFTIRWWNPQTFAAMHPEGRAARVTWPYVEDKSYLWTWLFVVPLAAYTLWQLMYFLIVNVLRRQRLLRDPEVMTSYRELSKKAQKANNIWWRLSGLLGDKNRPLMYILLQALFTVATLAFTVPIFLSYRLHGIFQVLKVCAATWNGGSFILEVMPRQVVQKEKKRLEMKPIEQANLKEHMDDPSGNHQHASEEPSQ

SEQ ID NO: 127870 - protein, 182 aa, Triticum aestivum
  Clone ID: PAT_TA_22288.pep
QGELGKRVVASRPRYTFMMPEELSLCAGGNTAVGCTSHGGSDRPAYLIATALLLRRPAQLRLRPSRVLLGRHGHERSGRSVGPIRFSTEGNTHQTDSRKKKCMGHSSCLRIQSREKRQRETSCCRPRDVGWLMLEHLRDVDRVAADAVGPRALGVARGLDALPRRAVALEPGAEADHPHAVA

SEQ ID NO: 127871 - protein, 95 aa, Triticum aestivum
  unsure (1)..(95): unsure at all Xaa locations
  Clone ID: PAT_TA_22289.pep
CYRHXVRPHVQGSPLRSMLYLSGRSSGSWFQASMFRPXLCSFILLVAKPGPQELIQVVCVQPPDHSHNLGVAIVLKVXLITMAGSLFSSWQQLPS

SEQ ID NO: 127872 - protein, 95 aa, Triticum aestivum
  unsure (1)..(95): unsure at all Xaa locations
  Clone ID: PAT_TA_22290.pep
QSQELAQFLREPFSDTEEEAXVVAEIVELCSLEHLEKSRGPTRKAPQGVFLKFPYDSYFRKGVVGDWVNHLTPEMAKCLDAIFEEKFKGSGFTLL

SEQ ID NO: 127873 - protein, 145 aa, Triticum aestivum
  unsure (1)..(145): unsure at all Xaa locations
  Clone ID: PAT_TA_22291.pep
EKYKQDKHQKHILLAVADKFLVDRQANKCGASILCFDEIQXRLLSTGTVLVATSNKAPEDLNQDGMQREIFLELLSKLDETCNKILVGTETDYRRLIPTDGSTQIHYYWXTNPDTRNMFEAMWHDITNQTGGNITAVTILYVGSH

SEQ ID NO: 127874 - protein, 358 aa, Triticum aestivum
  Clone ID: PAT_TA_22292.pep
PRVRLGKGFVDELDYNIEADNATKFLDTHSKYSFVMVPKVLKQLTRKRVLTMEWVAGENPRELLSLAKGISGSIAELSEKQKLDAKARLLDLVNKGVEASLVQLLETGLLHADPHPGNLRYTPDGRVGFLDFGLLCEMEKKHSRAMLSSIVHIVNGDWASLVYDLIEMDVVPPRTNLRRVTMDLEDTLGEVTFEGGIPDIKFSRVLGKIWSIALKYHFRMPPYFTLVLRSIASLEGLAIAQDGTFKTFQAAYPVTFEGGMSDIKFSRVLGKIWSIALKYHFRMPPYFTLVLRSIASLEGLAIAQDGTFKTFQAAYPYVVRKLLSDNSLDTRKVLHEVIFNRRKEFQWHKIAVLKLASA

SEQ ID NO: 127875 - protein, 197 aa, Triticum aestivum
  Clone ID: PAT_TA_22293.pep
PPKQSPRNNPSSPLPFRSVPFQSTHPGRTPARPAGWISEQAALLGLKMRDAVLLRCDASMAGRRFHLLRQAARAAGGAFPAQAATAKQRRAPAPAGNGGKSDGGGGYFGPEAAVVLGADDGGAAGCSRFSCPRCRRRRRCSCSCRSPSWPCCSCSCSCPPTPGALPATPSPGSQLAYLPLAARALALSLAGVLPSSS

SEQ ID NO: 127876 - protein, 175 aa, Triticum aestivum
  unsure (1)..(175): unsure at all Xaa locations
  Clone ID: PAT_TA_22294.pep
PIPMTKQKQEQAATPGPALFSLHPTLFFLFSSLDTNFQFTPAATKRQPATRKADEDEPSHSQGDDGRPAAMDHVRKRHQEKGFLYDCSVMLCCSGARLVPCVHRRLRPACCRAMAAGPTIGPVSARAPGEPVVGVCICRAAAFRPFSALVYFIRVCTSGWLPASEPCINTSKETX

SEQ ID NO: 127877 - protein, 92 aa, Triticum aestivum
  Clone ID: PAT_TA_22295.pep
CLRPPAPPTPASSTGGTTRAVSTAVSSLTRLLTPASNAGGAGLPVEDRTLPPSALLNSGEPPRGRPTPRPRLPTPPPGSRPPRAPPPTPRAS

SEQ ID NO: 127878 - protein, 163 aa, Triticum aestivum
  Clone ID: PAT_TA_22296.pep
PRVRPEPKPEPMPKPEPKPEPKPEPMPKPEPKPEPKPYPMPKPEPKPEPKPEPMPKPEPKPEPKPEPIKPEPKPMPKPEPKPEPMPKPEPKPEPKPEPMPKPEPKPEPKPEPMPKPEPKPEPLPKPEPKPEPKPEPMPKPEPKPKPEPKPEPPPKGKPPMTDN

SEQ ID NO: 127879 - protein, 319 aa, Triticum aestivum
  Clone ID: PAT_TA_22297.pep
DAKPEPKPEPKPEPMPKPEPKPEPKPEPMPKPEPKPEPKPEPMPKPEPKPMPKPEPKPEPKPEPMPKPEPKPEPKPEPMPKPEPKPEPKPEPMKPEPKPVPKPEPKPDPKPEPMPKPEPKPEPKPEPMPKPEPKPEPKPEPMKPEPKPVPKPEPKPDPKPEPMPKPEPKPEPKPEPMPKPEPKPEPKPYPMPKPEPKPEPKPEPMPKPEPKPEPKPEPMKPEPKPMPKPEPKPEPKPEPMPKPEPKPMPKPEPKPEPMPKPEPKPEPLPKPEPKPEPMPKPEPKPEPMPKAGPKPEPRNKAGDPFRRASLPIDGKLMGY

SEQ ID NO: 127880 - protein, 225 aa, Triticum aestivum
  Clone ID: PAT_TA_22298.pep
MARHSLLAVLLVGLVAASGFSQAAAAGRGLAEKLPEPEPKPMPYPEPKPEPKPEPMPKPEPMPKPEPKPLPKPEPMPKPEPKPLPKPEPMPKPEPKPEPKPEPMPKPEPKPEPKPDPMPKPEPKPEPKPEPMPKPEPKPEPKPEPMPKPEPKPEPKPEPMKPEPKPMPKPEPKPEPKPEPMPKPEPKPEPKPEPIKPEPKPMPKPEPKPEPKPEPMPKPEPKPEA

SEQ ID NO: 127881 - protein, 407 aa, Triticum aestivum
  Clone ID: PAT_TA_22299.pep
MARHSLLAVLLVGLVAASGFSQAAAAGRGLAEKLPEPEPKPTPYPEPKPQPKPEPMPKPEPMPKPEPKPLPKPEPMPKPEPKPMPKPEPMPKPEPKPEPKPEPMPKPEPKPEPKPYPMPKPEPKPEPKPEPMPKPEPKPEPKPEPMPKPEPKPEPKPEPMKPEPKPMPKPEPKPEPKPEPMPKPEPKPEPMPKPEPKPEPKPEPMKPEPKPMPKPEPKPEPKPEPMPKPEPKPEPKPEPMPKPEPKPEPKPEPMPKPEPKPEPKPYPMPKPEPKPEPKPEPMPKPEPKAEPKPEPIKPEPKPMPKPEPKPEPMPKPEPKPEPMPKPEPKPEPKPEPMPKPEPKPEPKPEPMPKPEPKPEPLPKPEPKPEPMPKPEPKPEPMPKPEPKPKPEPKPEPPPKGKPPMTDN

SEQ ID NO: 127882 - protein, 375 aa, Triticum aestivum
  unsure (1)..(375): unsure at all Xaa locations
  Clone ID: PAT_TA_22300.pep
MARPSLLAGLLVXGLVAASGFSQAAAAGRGLAEKLPEPEPKXPMPNPEPKPEPKPEPMPKPEPMPKPEPKPXLPNPEPIPKPEPKPLPKPKPVPKPEPKPEPTPEHDATAPTKASDPSPDPKPKPEPKPEXPKPGPMPKPEPKPQPKPEPMPXPEPXQPRPQPEQTQPQPXPKPPPTNPSPSPRPSPXKPEPKPKPKARANPEPEAEPMPKPXEPKPDPTPEPMPKPQPKPRTQARSPMPKPEPXRPEPKPYPKPKPEPKPEPKPEPMPKPEPKPEPKPEPXMPKPEPKPEPKPEPKPEPMPKPEPKPEPKPEPMPKPEPKPEPKPEPMPKPEPKPKPLPKPEPKPEPMPKPEPKPEPEPKPEPPPKGKPPMTDN

SEQ ID NO: 127883 - protein, 194 aa, Triticum aestivum
  unsure (1)..(194): unsure at all Xaa locations
  Clone ID: PAT_TA_22301.pep
RLAAAPPSPSLPSPTSQIFPFSLAMRAGEHVLVPCDRPGRPSPRSREVPPPTAPGDGAPSRLKQGQPAAAHVPPLTPAFLSPPLSIFAXGTTLASTPPAIFGHLSXRPRAPPPXIHPPRHRESRRSSGFXSSCLVCRXGEPPHQGRRWHGTQSAXHVLAAGKLYSARLSARSSFRPQRSARGVGGGSGLSRPRR

SEQ ID NO: 127884 - protein, 215 aa, Triticum aestivum
  Clone ID: PAT_TA_22302.pep
MNLFRLAGDMTHLVSVVVLLLKIHTIKSCAGISLKTQELYALVFAARYLDLFVHFVSLYNTVMKLVFLASSFSIVWYMRKHKIVRRTYDKEHDTFRHHFIVLPCLVLALLINERFTFREVMWAFSIYLEAVAILPQLVLPTAHKDIDNLTGQYVFFLGAYRVLYILNWIYRYFTEPHFVHWISWIAGIVQTMLYADFFYYYIISWKNNVKLELPA

SEQ ID NO: 127885 - protein, 207 aa, Triticum aestivum
  unsure (1)..(207): unsure at all Xaa locations
  Clone ID: PAT_TA_22303.pep
MAGVEGQPPPQISSMSNSKLQDGGTKPNLVKEHVPGSELWTDGLICAFELVKGHRKLVHHKSLPKIDLAHMKNQAARNGHRVVSXHPNEGGVVEIPSQAELGIDPFAVKDRPSHAGDVHDHKXWVPIGWSRIAELSQRVQSDASWENEXCPISDSEDDYTVPDVAGPYWLRPGGPTWXXHVTXXHXFVDAWLGXAHWMHPLSKLPER

SEQ ID NO: 127886 - protein, 162 aa, Triticum aestivum
  unsure (1)..(162): unsure at all Xaa locations
  Clone ID: PAT_TA_22304.pep
FXXGXSFPPRQXSFFPDXEVPAPRXDRRAFFXLACACCARLNEPLGSGERAVEGGAEAGIVGXRYTARGRSRRYKVACCGRNEPGEEQVRWLELTATEPADQLLWPEPHQGDDRESGHGGGDNGKEVVHDEPVHGLGVHGGRRRAHAARSVTCGCLWCFVGV

SEQ ID NO: 127887 - protein, 181 aa, Triticum aestivum
  unsure (1)..(181): unsure at all Xaa locations
  Clone ID: PAT_TA_22305.pep
PATTTMATADASKFWTTRNYILVALGGTLAVTAVVIVVSVALHPAHISFSILDASNSIDSAGNDSIPYLNLTIAAANTSRKRAAVRYTTIFRRTARTAHAVRNTIQTQVYXGAAGPAITCGQVTRPAIIKGIVNGKPAVRETVSKSIQGLTVVVVAAGXVPVSGXITRLSEIRLLPHVYSR

SEQ ID NO: 127888 - protein, 62 aa, Triticum aestivum
  unsure (1)..(62): unsure at all Xaa locations
  Clone ID: PAT_TA_22306.pep
QRSXHRSRRPAAAPRVTVTPPPPSHRPPGAHQPQPTTTPIDSETRSPPRHHPXFPPXXFPPS

SEQ ID NO: 127889 - protein, 138 aa, Triticum aestivum
  Clone ID: PAT_TA_22307.pep
LYMVLSFMYYTLYGMMTVALTPNLEIAAGLPPPFFVFWNVFSGFIIGRELIPIWWRWVYWANPAAWTVYGLMFSQLGDRTELIRVPGQPDQTVREFLEGYLGLEGRYFNLVTYLHLVVIALFALLFFIFVKHLKFERR

SEQ ID NO: 127890 - protein, 138 aa, Triticum aestivum
  Clone ID: PAT_TA_22308.pep
INPRSRSRTPLTGTMLRQPHTLASNPESDALSAGHILLGCCMHVLKVSRVTPEPLIKTLDPQEHHGTLASFSATCPADTICKAVPPTSHAVSSGCCSRCLRGDVLPSLVSAPYTNGSRRVRKLSGGRRTRHPRLNDPC

SEQ ID NO: 127891 - protein, 85 aa, Triticum aestivum
  Clone ID: PAT_TA_22309.pep
FFFFIKPTRYSHTYARSSKHKGRYKIRIQQRTIQRVTGSSPRGGLDGATQEGVLNPTWIVSVEGPRSLSRSRSVWMSKCSISHMS

SEQ ID NO: 127892 - protein, 68 aa, Triticum aestivum
  Clone ID: PAT_TA_22310.pep
MHDWAPAIIATALFALLCPGGILQLPGRQRTVDFMNLRTSCLSILVHAVIYPVLLMLFVVILQAHLYV

SEQ ID NO: 127893 - protein, 107 aa, Triticum aestivum
  Clone ID: PAT_TA_22311.pep
MAKAFYAVGFWIRETGQALDRLGCRLQGNYFFHEQISGHRTLMNIFDKAPHVHKEAFVAPSASLIGDVEIGQGSSIWYGCVLRGDANNVQVGSGTNIQDNSVVHVAK

SEQ ID NO: 127894 - protein, 350 aa, Triticum aestivum
  unsure (1)..(350): unsure at all Xaa locations
  Clone ID: PAT_TA_22312.pep
SLPRPPSLRLPPFPRLPSSPCPRQLPTGRGQVPPNARSLPPGRLGRGPVSPRDLPRGKARSQQTQGHRRLCAYAVAVLRSCPPPPGEMAKAFYAVGFWIRETGQALDRLGCRLQGNYFFHEQISRHRTLMNIFDKAPHVHKEAFVAPSASLIGDVEVGQGSSIWYGCVLRGDANNVQVGSGTNIQDNSVVHVAKSNLSGKVFPTIIGDNVTVGHSAVLQGCTVEDEAFVGMGATLLDGVVVEKHGMVAAGALVRQNTRIPCGEVWGGXNPAKFLRKLTDEEIAFIAESAANYSNLAKAHAVENAKPLEKIDFEKVLRKKFAHQDDEHDSMLSVTREVPPELAPPSPTPAQ

SEQ ID NO: 127895 - protein, 138 aa, Triticum aestivum
  Clone ID: PAT_TA_22313.pep
RLPIQGRGSLALVPPMGGCPVVSGGLRRHPRRASPPRPFFVLPFLAGASLPPFQARCSAAHAAAAPSWLYRLVLWWSPFGLTATPLSLALLTVPFAPLSMLHPGKQGGARLPCAARLVGPLLLSFQMKYKGCFFKKKK

SEQ ID NO: 127896 - protein, 123 aa, Triticum aestivum
  Clone ID: PAT_TA_22314.pep
MMDLHMKFLLASLSCVLLIQGAFCGGTGATSWTCVCTAHPLGEANSNSSLSSSCDSSCHCIRDENGGTGSWNCSCRSDKDLQEEEHAVVHSTSCFTSCNCTSGSSEQGRKHFSSKTVIATLLV

SEQ ID NO: 127897 - protein, 217 aa, Triticum aestivum
  Clone ID: PAT_TA_22315.pep
MGSEQEKKAAATVEVEGIPFPREIAAAKTLSLVGHGVTDIEIHFLQIKFNAIGVYLDVDGAMEHLQGWKGKSQLMEDEAFFDALVSAPVEKVLRVVVIKEIKGSQYGVQLESSVRDRLVAADKYEDDEEEALEKVSDFFQSKYFRPGSVVTFHFPATPTAAPEITFVTEGKEEAKVAVENAAVAEMIQRWYLGGESAVSQTTVRSIADSFAAMLSSP

SEQ ID NO: 127898 - protein, 215 aa, Triticum aestivum
  unsure (1)..(215): unsure at all Xaa locations
  Clone ID: PAT_TA_22316.pep
PALCVKLKALEKLSASDDLPLRPGVEKFIXDDALSEGVPVAILATYGRNGEKISRSIVEKLGPERTSKINIVGKDEVERSLYGQLVLGEGVASSLDEQLTKEVQKAASAEKQRIAEEVASLLKLSVDINTASKSSEKIIATLRAGAEYVGCNVQNCILVAGSQPSVIAAERIGMPCIVVRSSLTARAEFHSVKAVMDGFGDTDLTVSKLLSKRWS

SEQ ID NO: 127899 - protein, 85 aa, Triticum aestivum
  Clone ID: PAT_TA_22317.pep
SSSSVRLYLRDLACLLQFRIELILSLMYLQFNPNQYIQKFLSPPPPVLLFYSIPNYTITLDIYSFFLIRISNFIYSDSMFPLVKY

SEQ ID NO: 127900 - protein, 273 aa, Triticum aestivum
  unsure (1)..(273): unsure at all Xaa locations
  Clone ID: PAT_TA_22318.pep
PRVRDNNVGRIVKAVVLDRPSLDESKREHPDSEPVASTSSSDHVMGFLPTRSFPADRFAPLDEDVAYVSPLLAFNLGVHISCLKLLIQKGEEPFKFCSKVYEDGSAVSGIGISLHLELLPCPQVPKHALHLRVSIVRIPDCGVLASLKINSAIGGSDYQDMIDQALNEHFKFDRFLXSGDVFCIHNDWNCGMISCLACNKENDRLHPPSMIYFKVTGMEPSNEPILRVNRDQTALVLGGSASAPIPPCSFFSANDDSVPLHGEVVEQLASIIA

SEQ ID NO: 127901 - protein, 178 aa, Triticum aestivum
  unsure (1)..(178): unsure at all Xaa locations
  Clone ID: PAT_TA_22319.pep
MPLVGSPRHGPPLKLAGRAQRRPPPRTIAPKCDISSPPARLTRRAVSAASLLLTALPFPASSPQLPVASASETEEXSPGEEKGGAPALELERYTDQDQGFNLLKPPQWPKVEKAGATALFQQEGXKGSNNIGGVVXPVRLSSLDGFRTAQFVHGQSSTSKRKKKESAKSAKVSSTEKN

SEQ ID NO: 127902 - protein, 90 aa, Triticum aestivum
  unsure (1)..(90): unsure at all Xaa locations
  Clone ID: PAT_TA_22320.pep
FFFXFVRNFKYTVYITPLSPSXRLVHRKQNSRLRALLRTSSQDEPFFQMPGFDPQQPNQISQALGTQETKFLAXKPCYGRSSQDGPXFKC

SEQ ID NO: 127903 - protein, 173 aa, Triticum aestivum
  Clone ID: PAT_TA_22321.pep
MAMRALALSPSQSSSFGLHQSMPSFKPSSASPARPVRAYAKADEQEEEKKKVPKQSLFGNITEALDFSQVRSEKDAELLYEARDSIKDEGRMTREQYAALRRKIGGTYKDFFKSYVEVDGEYVEEGWVDKTCKVCKKDTRGEPRQVDNLGRYMHVACAENSKPTNFFSKLFSR

SEQ ID NO: 127904 - protein, 229 aa, Triticum aestivum
  Clone ID: PAT_TA_22322.pep
LVSGASAEGAPKRLTFDSFPFKAGKYEMKKFCLEPTSFTVKAEGIQKNEPPAFQKTKLMTRLTYTLDEMEGPLEVGADGTLKFEEKDGIDYAAVTVQLPGGERVPFLFTVKQLVATGKPESFSGPFLVPSYRGSSFLDPKGRGGSTGYDNAVALPAGGRGDEEELAKENVKNASSSTGNITLSVTRGGRETDGVIGVFESVQPSDTDLGAKAPKDVKIQGVWYAQLESN

SEQ ID NO: 127905 - protein, 328 aa, Triticum aestivum
  Clone ID: PAT_TA_22323.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDEMEGPLEVGADGTLKFEEKDGIDYAAVTVQLPGGERVPFLFTVKQLVATGKPESFSGPFLVPSYRGSSFLDPKGRGGSTGYDNAVALPAGGRGDEEELAKENVKNASSSTGNITLSVTKSKPETGEVIGVFESVQPSDTDLGAKAPKDVKIQGVWYAQLESN

SEQ ID NO: 127906 - protein, 79 aa, Triticum aestivum
  unsure (1)..(79): unsure at all Xaa locations
  Clone ID: PAT_TA_22324.pep
QANKTIYHYILQIQGLQLLLNLHSLYKHIQQHQRMCIIPTCKIRTHYARSNNTFSXRESFSQTYTPCILTFSSCMVSIS

SEQ ID NO: 127907 - protein, 195 aa, Triticum aestivum
  Clone ID: PAT_TA_22325.pep
VILRPSIITSILRDPLPPPGQGTRTIDTIIIGYAKQNLSCFLADLDLTMDVIPGDMVANAMMVAMVAHSEEQGAEVMYHATSSLRNPAPYGVLYESGRRHFYENPRLSKGRAGHPHQRRCTSSKTIRQASNLFMLIKLQSLPLRRFLHLGNLPLRAFSQPLADSPRPGDSPCSSSASPPPRLNQRILDDINLERL

SEQ ID NO: 127908 - protein, 177 aa, Triticum aestivum
  unsure (1)..(177): unsure at all Xaa locations
  Clone ID: PAT_TA_22326.pep
MSDTDEHHFESKADSGASKTYPQQAGAIRKGGHIVIKARPCKVVEVSTSKTGXKHGHAKCHFVAIXDIFNGKXSLEDIVPSSHNCDVPHVXRQRYQLXIDITGWMDMSTLPTGEWATPKDDLELPNRMISAWGSXDGFADGKDWILSVIPPWGERTSLPVKETVVASNTSAWPTAIL

SEQ ID NO: 127909 - protein, 160 aa, Triticum aestivum
  unsure (1)..(160): unsure at all Xaa locations
  Clone ID: PAT_TA_22327.pep
MRVQCDVCGLEPAAVLCCADEAALCSPCNRRVHRANKLAGKHRRLTLLQPSPAANDAAAPLCDVCKERRGLVFCVEDRAILCADCDEPIHXSANDLTGKAQPLLLVRANCPPDPWDKRSLPGRTPSNRTRSGSAPRPCIKPATRGGGGGGGGTTRLLTTT

SEQ ID NO: 127910 - protein, 155 aa, Triticum aestivum
  unsure (1)..(155): unsure at all Xaa locations
  Clone ID: PAT_TA_22328.pep
PSSFSLCCPHRNLGSHASRCGSLCLAAERCYYAEPPHLPALRGASPRRSGPHEREQSTETDKHCFKIAFVIFIIGHVLAPTAKHDYISVDFWAALNDVKQDQRLGTGGPLCAEASVPSGQEVQNRCFVAEPNYTHSPDVICSCXCLFSTSWSSVY

SEQ ID NO: 127911 - protein, 189 aa, Triticum aestivum
  unsure (1)..(189): unsure at all Xaa locations
  Clone ID: PAT_TA_22329.pep
MVPNGNNDNNNAAKDYRDPPPAPLINAGELGKWSLWRAVIAEFTATLLFVYVTVATVIGHKRQTDATVGCGGAGILGIAWAFGGMIFVLVYCTAGVSGGHINPAVTFGLLLARXKVSLVRALLYMVGQCLGAMFGAGLVKAVQGAQYARXGGGANELAPGYSKGAGLPAAVSGPSRPSHVRAAGGSSPL

SEQ ID NO: 127912 - protein, 244 aa, Triticum aestivum
  Clone ID: PAT_TA_22330.pep
MGMAPLFRSLALLVLLVTLSSTTLPSSRATSGDGADHDLLMLGRFHRWMSAHGRTYHSAAEKLRRFEVYRRNVDFIDASNRDAERLGYELGENEFTDLTNEEFMARYVGGAYGGAGDGGGLITTLAGDVAEGAASSKNAIEEDRNLTMTASDPPRQFDWREHGVVTPAKQQGACGCCWAFAAAATVESLNKIKGGELVDLSVQELVDCSTGVFSSPCGYGWPKSALAWIKSKGGLLMDRISCNA

SEQ ID NO: 127913 - protein, 53 aa, Triticum aestivum
  unsure (1)..(53): unsure at all Xaa locations
  Clone ID: PAT_TA_22331.pep
AEFGLTLTKLFXRLFSMKVMRILLVTLYASGRTTILYKLXLVKIVPTIPTTLF

SEQ ID NO: 127914 - protein, 158 aa, Triticum aestivum
  unsure (1)..(158): unsure at all Xaa locations
  Clone ID: PAT_TA_22332.pep
MAGLLLRRFIGIQPRAPMTAAGGAALFYASCPSSPRTVAHLEVRGEQAAAEAELSKKSCIPCNSKDLHAMSEDSAKNXLEQVTGWELKNEGDILKLHRAWKVKNFVKGLEFFQLVAAVAEEEVTTRFHLVSWNNVKSMSGHSFRGLTDNDFILAAKFI

SEQ ID NO: 127915 - protein, 117 aa, Triticum aestivum
  unsure (1)..(117): unsure at all Xaa locations
  Clone ID: PAT_TA_22333.pep
MAAAAGSYGKLDKSFKLAARSVLTAFSREDLNNAFPSFTDAEREHLYQMFIYAIKSLHGNIXEEFRNFCDEIEIATALDKVDQFVEEQTLDVLSSDKXTSIEDMKERISKEKKDEIE

SEQ ID NO: 127916 - protein, 113 aa, Triticum aestivum
  unsure (1)..(113): unsure at all Xaa locations
  Clone ID: PAT_TA_22334.pep
XCCLNEPGGGXDAVERLSSTEAKEFGEARVRAGVWQVARVSWSCTPSGGAAAARRGGPWGAGRTAHGGRRPTGGRXEATEEGAAATGTGSTCPTCLLLKMRDVRPSFLHHGWF

SEQ ID NO: 127917 - protein, 97 aa, Triticum aestivum
  Clone ID: PAT_TA_22335.pep
GRQDLCDHLFQHLYIGSWRTNQYERVVSSFLLVYIMPRHAKLWIVCKLPFAFVCPMSVIFATKPIVLRAFYVRTLLGGSLLCAYKQTLLLNDSSLVF

SEQ ID NO: 127918 - protein, 186 aa, Triticum aestivum
  Clone ID: PAT_TA_22336.pep
KDLHSLVDVFFSCCTGVASPLDKPFVSILPLQLSSTDQMMMADKELDVHGSPGSAGSTNSCVRGLAQDTQQVFRIPHRAVLDMLLAHLGLSPAQYEHVVHEDDKIHVTVFFNTSTLGPGGPISMKVSCRHSYWSILCLRHAKLWIVCKLPCAIVSPMPMIFASKPIVQRAFYVRTLLGGFLLCAYK

SEQ ID NO: 127919 - protein, 155 aa, Triticum aestivum
  Clone ID: PAT_TA_22337.pep
KDLHSLVDVFFSCCTGVASPLDKPFVSILPLQLSSTDQMMMADKELDVHGSPGSAGSTNSCVRGLAQDTQQVFRIPHRAVLDMLLAHLGLSPGQYEHVVHEDDKIHVTVFFNTSTLRPGGPILMKVSCLQSYWSILCLRPALSLRSRLLRCAGDC

SEQ ID NO: 127920 - protein, 108 aa, Triticum aestivum
  unsure (1)..(108): unsure at all Xaa locations
  Clone ID: PAT_TA_22338.pep
VHKAVIASGARYSGPTVHFVDERCXTPRTLAQRVVPVLANDTPEQLAARVLHEEHQVYVEAVAALCEDRNCVAETDGVPTYQEVRQTPMRIPNSVISVLRSPGKLMSL

SEQ ID NO: 127921 - protein, 141 aa, Triticum aestivum
  Clone ID: PAT_TA_22339.pep
AGLRQLAWPHAVDELALLSVVLPTAGEAGMRRDSDITAQPPYYSQLARGGVHHGLRWRPGCWPGGKAQQSESVADELQLEALGLEARSSWGGERSQRAGRRSTLAGVETRERGRRGRESLADGDGVLASERREEKGIDGGK

SEQ ID NO: 127922 - protein, 212 aa, Triticum aestivum
  unsure (1)..(212): unsure at all Xaa locations
  Clone ID: PAT_TA_22340.pep
KPPAQPDRWRKPPAHHSSHVAPRLPAPPHRPRRRRVPPPPPATAPAPASKPHPPISPPPPGNRRTSTPPSQRRRRRRRPPKVPRPLRTVGSLLRLNDIRXDNPGATQQKTRKGRGIGSXGKGKTAGRGHKGQKARGTARFGSKGGQXPLRRRLPRRGFKSRFXLTFKPCGLGKXAKLIXNAGKIDPXELXTXKELKDTXPIXKXXRXGFGMG

SEQ ID NO: 127923 - protein, 143 aa, Triticum aestivum
  Clone ID: PAT_TA_22341.pep
IPNHLPFYLIFFTHRWRRTCWCSHSCCPYQLASCSPGPDELPKQEPVHEWVEGPDQYQPPEPHLAPFCLESLTRRWRRICCCSRSCSAYRVPSFCPHPCSGGHMRCPASPARGPLLVLLGPPTDSAPRKAGPACRRQRQWWPL

SEQ ID NO: 127924 - protein, 86 aa, Triticum aestivum
  Clone ID: PAT_TA_22342.pep
MDLRLSDAYDTLTTHAQCCLSSAKQNRATGAWSCLLDLRTARVAAWLRPAPGIRRTQLYVRLAQKKDEAACDASVVTRRRSALWFL

SEQ ID NO: 127925 - protein, 215 aa, Triticum aestivum
  unsure (1)..(215): unsure at all Xaa locations
  Clone ID: PAT_TA_22343.pep
GIDFGTSGARYALIDKQGAIHSEGKRTYPAAGWTNHQLGKLLERSTLPASWRHSVRSPAISLIHLHWMGLHQPLSSLDKKQWRVLGRPFLYNGEFXDALPMIKSDCSPQITQCAPGPSTLCXSVXMGGTSIVXMGGDDPGDTGCTNQDWLXLWVLHGXEYGFGDYNNTLKVGMIQETGSXPNWXKSQAYSHMLPSSSKQPEVPWANKEIAPQYFE

SEQ ID NO: 127926 - protein, 64 aa, Triticum aestivum
  Clone ID: PAT_TA_22344.pep
MEALKSLLKPKPTPQQQLREWQRRLRNEGRNIERQIRDVQKEEKKVENAIRDAAKRGDMGSAKA

SEQ ID NO: 127927 - protein, 130 aa, Triticum aestivum
  unsure (1)..(130): unsure at all Xaa locations
  Clone ID: PAT_TA_22345.pep
RSVGHLFKSPQVIXLVTNLMKAQEIAVTMQEFSKEMTKAGVMEEMVNDAMDSALDDEDMEEEIEEEVDKVLSAIAGETASQLPDAVRKQKEKVTQPSTSEPAQRTAVAESVDEDDDDLEKIRERLAKVRS

SEQ ID NO: 127928 - protein, 233 aa, Triticum aestivum
  unsure (1)..(233): unsure at all Xaa locations
  Clone ID: PAT_TA_22346.pep
MEAVKSLLKPKPTPQQQLREWQRRLRNEGRNIERQIRDVQKEEKKVEKAIRESARRGDMGSAKALAKELVQSRKAVNRLYENKAQLNSISMHLGXEIVATXRTVGHLSKSTEXVMKLVNNLXMKAPEIAVTMQEFSKEMTKAGVMEEMVNDAMDSALDDEGMEEEIEEEVDKVLSAIAGETASQLPDAVRKQKEKVTQPSTSESAQRTAVAESVDDDDDDLEKIRERLAKVRS

SEQ ID NO: 127929 - protein, 131 aa, Triticum aestivum
  Clone ID: PAT_TA_22347.pep
PVLHTSSNMALKNSAVLLIGLLLSCVATSSAARILEETVPSKEEHQPEVPPLPKVELPPFPEVHLPPKPELPKVELPPVPEVHLPPKPKLPKVGVSSGPGKCTCHPNPELPKVELPSVPEVHLPPSRDCPR

SEQ ID NO: 127930 - protein, 118 aa, Triticum aestivum
  Clone ID: PAT_TA_22348.pep
PYRKLVYPTVNKCSSSTIPVNQSTNSVCLCQAIRSKLPNNLGKDVRWESSRPSSEGKHTFHTLLLYQPQRGQKIEGAGIQSKKTTSAYQIEGGGGGGNINNTGESIIIIKLTSQPTEH

SEQ ID NO: 127931 - protein, 252 aa, Triticum aestivum
  Clone ID: PAT_TA_22349.pep
MQGCCIATTQHSAWKLTSFARKYLPAGATIVLSAAVADPRAVAVQDSLPAMGSKGLKGVMVCLLILGLVLEQVQVEGKSCCKSTLGRNCYNLCRARGAQKLCANVCRCKLTSGLSCPKDFPKLVLESNSDEPDTMEYCNLHIPSCVMMRIHGLRFHRARSCLTFAFNKIGSHREYPNQCVTLCYVCVFPFLVRIKVIMLDAMLHCCKKKKKKKKRQTNIKNTKLQTFKRNKSSIHKTNLLGRCLTTKLTGKT

SEQ ID NO: 127932 - protein, 128 aa, Triticum aestivum
  Clone ID: PAT_TA_22350.pep
GQQGQQLGQGQQGQQPGQGQQPAQGQQGQQPGQGQQGQQPGQGQQGQQLAQGQQGQQPAQVQQGQQPAQGQQGQQLGQGQQGQQPGQGQQPAQGQQGQQPGQGQQGQQPGQGQQPGQGQPLSWLLPLS

SEQ ID NO: 127933 - protein, 140 aa, Triticum aestivum
  Clone ID: PAT_TA_22351.pep
LGVVCLSQDVGGVMVCLLILGLVLEQVQVEGKSCCKSTLGRNCYNLCRARGAQKLCANVCRCKLTSGLSCPKDFPKLVLESNSDEPDTMEYCNLGCRSSLCDYMVNAAADDEEMKLYVEQCGDACVNFCNADAGLTSLDA

SEQ ID NO: 127934 - protein, 141 aa, Triticum aestivum
  Clone ID: PAT_TA_22352.pep
TFSILLNAKVRHDLALCLLILGLVLEQVQVEGKSCCKSTLGRNCYNLCRARGAQKLCANVCRCKLTSGLSCPKDFPKLVLESNSDEPDTMEYCNLGCRSSLCDYMVNAAADDEEMKLYVEQCGDACVNFCNADAGLTSLDA

SEQ ID NO: 127935 - protein, 260 aa, Triticum aestivum
  Clone ID: PAT_TA_22353.pep
GQQPGQGQRPGQGQQGYYPTSSQQSRQRQQAGQWQRPGQGQPGYYPTSPQQPGQEQQSGQAQQSGQWQLVYYPTSPQQPGQLQQPAQGQQPAQGQQSAQEQQPGQAQQSGQWQLVYYPTSPQQPGQLQQPAQGQQGYYPTSPQQSGQGQQGYYPTSPQQSGQGQQGYYPTSPQQSGQGQQPGQGQQPRQGQQGYYPISPQQSGQGQQPGQGQQGYYPTSPQQSGQGQQSGRAGRSINQSHYTSLFCKIACQPWEARASRV

SEQ ID NO: 127936 - protein, 136 aa, Triticum aestivum
  Clone ID: PAT_TA_22354.pep
MGSQGLQGVMVCLLMLGLVLEQVQVEGKSCCKSTLGRNCYNLCRARGAQKLCANVCRCKITSGLSCPKDFPKLVLESNSDEPDTMEYCNLGCRSSLCDYMVNAAADDEEMKLYVEQCGDACVNFCNADAGLTSLDA

SEQ ID NO: 127937 - protein, 76 aa, Triticum aestivum
  Clone ID: PAT_TA_22355.pep
PILGAARQLQARRTARDELRAKGKRITTVFLAPTLENLWNMIKLYITLAPLLEREFTPSRNLCTKLRKLGHPIISE

SEQ ID NO: 127938 - protein, 84 aa, Triticum aestivum
  Clone ID: PAT_TA_22356.pep
NVDEAALIRALKAGGIAGAGLDVFEKEPEVPAELLSMENVVLTAHEAVFTVESASDLSDLMIGNLEAFFQGKPLLTPVLPEQML

SEQ ID NO: 127939 - protein, 185 aa, Triticum aestivum
  unsure (1)..(185): unsure at all Xaa locations
  Clone ID: PAT_TA_22357.pep
CSTEQDKALGTKPPNPRRPTPTRIAHHPSNPSPSQPTRPGPEQPWPKEQPEEGEGAPXRRPWSSPAASSSPGSPSSPPSSPSSTASAAPSPAPSTPPATPTRTPPPPPPRRTSRRPPRPSPPLSPPPSPKEXGPDVARSPRRRNPTSXPPPAGAAGPPPPPPAPKGVDGRRTRGQGKGGEALPQH

SEQ ID NO: 127940 - protein, 125 aa, Triticum aestivum
  Clone ID: PAT_TA_22358.pep
MAGDRCEGAIAGCELCGGVAAVHCAADSAFLCVPCDAKVHGANFLASRHLRRRLVHAAADEDAGSAGSGSGSESSSSSSCVSTADSCAAASAATRAAGRRRAGCKHRRARAVLWAKRMGLAAGTA

SEQ ID NO: 127941 - protein, 115 aa, Triticum aestivum
  unsure (1)..(115): unsure at all Xaa locations
  Clone ID: PAT_TA_22359.pep
YKLMVPIFPQFAVTGKSFLFSIEREGIXAMCVLRYNQSKRIKLGPIKNRNEFIKRDWEGISXKGIQRSKTKPNGPNHPLPRGGPGYPMSALMSGLRFGPASQLGPSVLQPAVDRG

SEQ ID NO: 127942 - protein, 165 aa, Triticum aestivum
  unsure (1)..(165): unsure at all Xaa locations
  Clone ID: PAT_TA_22360.pep
ASSTSSSAFLLLHGLASASPSKASAFFASPISPSFPLSTSTSINASSPRRPLPPAPRATGRGGDKDNRVQELRVPDSWAHARRSSAGIRMAEGNATQVAGTTSTAPSRPTWTSSNTAARSVPRVPHGEASDVGEDPDERWVGDCKTVLPRRAPTGPSPPANPXCA

SEQ ID NO: 127943 - protein, 146 aa, Triticum aestivum
  Clone ID: PAT_TA_22361.pep
LRIMPTCRHNFHLSCIDIWLEKQTTCPICRISLDLPGGKASASPARSLPQLFGHPESSASRSPHWILPMHRDRTGGRGNRPASQESLRSGHNMKCTGDKSKTRWVRLCCSLAVHRRTSAICKKSCASLLHHNPPHLGRKSWRQFVW

SEQ ID NO: 127944 - protein, 366 aa, Triticum aestivum
  Clone ID: PAT_TA_22362.pep
MAALAHHHRVLSFTSFATPRTHLPCASSSSPPTHARLRGARVLRHASGGSSSAAPASSSSLEELSRSCTTWSWRGMRVNYLVRGEGPPVLLVHGFGASVAHWRRNIGVLSESNTVYAIDLLGFGASDKPAGFSYTMETWAELILEFLDEVLKRPTVLVGNSVGSLACVIAASDSTRDLVRGPVLLNCSGGMNNKAIVDDWRIKLLLPLLWLIDFLLKQKSIASALFGRVKERENLKNILMSVYGNKDAVDDELVEIIRGPADTEGALDAFVSTVTGPPGPSPIALMPRIKIPVLVLWGDEDPFTPIDGPVGKYFSGLPSELPNVRLYMLEGVGHCPHDDRPDLVHEKLLPWLASLPSAAEPEVAVA

SEQ ID NO: 127945 - protein, 451 aa, Triticum aestivum
  unsure (1)..(451): unsure at all Xaa locations
  Clone ID: PAT_TA_22363.pep
EFGTRETEVAGTQIILAREYLKDVAISTEQLKYLVMEALPRGCQGHRAELYAARVAKCLAAMEGREKVFAEDLKKAVELVILPRSIISDNPQEQQNQPPPPPPPPPPQNQDNAEDQDEKEEDEEKDEEEKEDDDEENEKQDDQIPEEFIFDAEGGLVDGXLLFFAQHAQRKKGKAARANNVIFSEDRGRYIKPMLPKGPVRRLAVDATLRAAAPYQKLRREKSLDKTRKVFVEKTDMRAKRMARKAGALVIFVVDASGSMALNRMQNAKGAALKLLAESYTSRDQVAIIPFRGDYAEVLLPPSRSIAMARKRLEKLPCGGGSPLAHGLSTAVRVGLNAEKSGDVGRIMIVAITDGRANVSLKKSNDPEAAAASDAPRPSTQELKDEILDVSAKIFKAGMSLLVIDTENKFVSTGFAKEIARVAQGKYYYLPNASDAVISAATKTALADLKS

SEQ ID NO: 127946 - protein, 168 aa, Triticum aestivum
  unsure (1)..(168): unsure at all Xaa locations
  Clone ID: PAT_TA_22364.pep
MAMATNYSISNAPFTFKPSAPHKQVPNWRFPTISSGDGGGSIFTISRRNLRTWFHVCAVTGDQSTRDVFSANFPSDYTELIVQAKEATESAFKDGKQLLGIEFPTAGLQSVTKRMAKGGSEMTRKHASHLRVLRSLRTCKESYQGPRISSPEEKGVSXPXXSTFEGGH

SEQ ID NO: 127947 - protein, 99 aa, Triticum aestivum
  Clone ID: PAT_TA_22365.pep
MARRNAGAMQREGSVKDWSEFDPSPSPKMAYSQSYVAMRGVLTSLASLDRVLASTTLLSACAATSARNHAWSGVRPLSGGMGWKKAMINLFVCLMIGIF

SEQ ID NO: 127948 - protein, 122 aa, Triticum aestivum
  Clone ID: PAT_TA_22366.pep
MANDQHLKYLQVELVLSQHPGVAKAVVFGVPDSCPRVRIVACLSIRDDWRWVDATAEHQGEGNEVSAHILQEYCRIKNLSRFKVPRLYHHWSRPFPVTTTGKIKREELKAKVLACMQPRSSL

SEQ ID NO: 127949 - protein, 94 aa, Triticum aestivum
  unsure (1)..(94): unsure at all Xaa locations
  Clone ID: PAT_TA_22367.pep
PDKNFSVKHTHPSVVAMANSGTDSNGXSQFYITXTIKTGWLDGEHVVFGRVIQGMDYVYAIEGGAGTYNGKPRKKVLITDSGEIPREKWGEEAD

SEQ ID NO: 127950 - protein, 216 aa, Triticum aestivum
  Clone ID: PAT_TA_22368.pep
MLRKAAVGFLACLVLYLAFSSYPRSQRAAYVQLPAVTHRVYLDVEIDGQNIGRIVIGLYGEVVPKTVENFRALCTGEKGDGPKGKPLHYKGTPFHRIIPGFMIQGGDIVRGDGKARESIYGGTFPDENFSVKHTHPGVVAMANSGTDSNGSQFYITTIKTGWLDGEHVVFGRVIQGMDYVYAIEGGAGTYNGKPRKKVLITDSGEIPKEKWGEEAD

SEQ ID NO: 127951 - protein, 131 aa, Triticum aestivum
  Clone ID: PAT_TA_22369.pep
MGIVLKPARDPHKDSHQKDSPARSIYGPRKQALACNATQQISEHHGTPKYRGAAHPLCFTDEVLDHEFPAGFKPVNIEAYDGTTDPGVWIEDYILHIHMARGDDLHAIKYLPLKFKGPARHCLLVKFPETP

SEQ ID NO: 127952 - protein, 144 aa, Triticum aestivum
  Clone ID: PAT_TA_22370.pep
KGHGIDSALPVLVCSAGQRFPTSCHSSPFQLLPRSSPSSRCAMESAVYEELFGDYLSRSAHNSSLLTPDNTPAECVGSAARKHVTSYFKRFTGYTPAFGGQVEEESAPSRTRCLGHFSMHTITLSMPSIQMSYRSLGYCYQTTK

SEQ ID NO: 127953 - protein, 122 aa, Triticum aestivum
  unsure (1)..(122): unsure at all Xaa locations
  Clone ID: PAT_TA_22371.pep
MAEEKHHHHLFHHKKEGEDFQPAADGGVDMYGYSTETVVTATGNEGEYERITKEEKHHKHKEHLGEMGAAAAGAFALYEKHEAKKDPEHAHKHKIEEEXAXCGXVGAGGFVFHEHHEKKQDH

SEQ ID NO: 127954 - protein, 264 aa, Triticum aestivum
  Clone ID: PAT_TA_22372.pep
PDKTEALRPLSITAVAALLRAPPVPISTFVGTGREVGGRRGKSVRAGAGWLWGLLGRKGGGGAPTAMTVTPGTVKAGDPVLHEPAQEVSPGDVPSEKIQGVIDQMIAVMRKAPGVGLAAPQIGVPLKIIVLEDTQEYISYASKEDIDAQDRRSFDLLVVINPKLRKTSKRTARFYEGCLSVDGYRAVVERHLDVEVSGFDRNGHPMKVEASGWQARRLRPECDHPGGSSHLDGRLPCSCMGGCSLEAPSCLSSGLRGHSGQLIT

SEQ ID NO: 127955 - protein, 138 aa, Triticum aestivum
  Clone ID: PAT_TA_22373.pep
TSCGAAACSTDASPEQAATNDGELLRCLCVAWTAGHEREAMAEQPPGSNRAAAHGPDPAGTVEELSAGTSSTAQTSAPTRSASPAPRTASTKSLLAVQKRGRLLFLFRCKGVYVNVMSSQLLTIWSHLLESDQMSQIT

SEQ ID NO: 127956 - protein, 205 aa, Triticum aestivum
  Clone ID: PAT_TA_22374.pep
MLKQQLAVAAQLEDYKEAARLRDSLRLFEEEEPVLRLRRSLKKAVEEERFADAAKYRDELMILAPHSLLKCSSDATTLGIRVQVRSVYIESRSQPLKGKFFFAYRIRITNNSQRAVQLLRRHWIVTDANGRTENVWGVGVVGEQPVIFPKTGFEYSSACPLNTPNGRMEGDFEMKHIDKVGSSTFNIAIAPFSLSILGDDNDAPL

SEQ ID NO: 127957 - protein, 151 aa, Triticum aestivum
  unsure (1)..(151): unsure at all Xaa locations
  Clone ID: PAT_TA_22375.pep
CALCXXVLYRRAANWYLDRSCVQCVSRRVVRECFLTALCRQGGVCTXYLGVRVATARTSASTRVTLRQGGSGVTCSSRRPSSLPRRCRLDSRYTKTGWQWCHVLVSASVLATATTSSSTRVTLGQGGSGVTCSSRRPSSLPRRRPPRLALR

SEQ ID NO: 127958 - protein, 134 aa, Triticum aestivum
  Clone ID: PAT_TA_22376.pep
EWQGSSKPTGGRLGDHAPAALSGMKGGCQYNNILDPKEDKDQKVLLFACKNCDHQEVADNNCVYRNVVHHSAGEFTQVLQDVAGDPTLPRTKEVRCAVCGHGEAVFFQATARGEEGMTLFFVCCNPSCGHRWRE

SEQ ID NO: 127959 - protein, 102 aa, Triticum aestivum
  unsure (1)..(102): unsure at all Xaa locations
  Clone ID: PAT_TA_22377.pep
VGEFRRCAASNGRGQQHFVEEXXNSSEKVERESSSFKRRSSSSEIQRRRREQRKWSSSSRGFREEQQRGREQQQGRGKEEQHQGHKTEQQQQEREKEQYPGA

SEQ ID NO: 127960 - protein, 294 aa, Triticum aestivum
  Clone ID: PAT_TA_22378.pep
MTMKSLRGGRKIVPSFRKTENRLILLDYDGTVMPESSIDKAPSSEVISVLNRLCEDPKNRVFIVSGRGKDELSKWFAPCEKLGIAAEHGYFTRWSKESPWETCGLVADFDWKKTAEPVMRLYTEATDGSYIEHKESALVWHHDEADPDFGSCQAKELLDHLESVLANEPVVVKRGQHIVEVNPQGISKGVVVESLLSSMVRGGKAPDFVLCIGDDRSDEDMFESIVCPANGSVKLPATSEVFACTVGKKPSMAKYYLDDTVDVIKMLQGLASAPSQHRPWPVQLRVTFEEGNGV

SEQ ID NO: 127961 - protein, 151 aa, Triticum aestivum
  unsure (1)..(151): unsure at all Xaa locations
  Clone ID: PAT_TA_22379.pep
IAGPXXXLARERPEGXXGPAGTGGTLERLKMFSVPREEALPKAGAKVRSELVRNMNATLDATAAPSPASSVTRRYSARSSGPSSTPAPPPLIPAAPPAAAGGASSSPTTTASGSGGDAVRGARTSSAVSEAKSRRDSTIGDDAVMAINSGH

SEQ ID NO: 127962 - protein, 133 aa, Triticum aestivum
  Clone ID: PAT_TA_22380.pep
MIHPKKLAQLAKKWQRKVAARAGGQQADECCSPVADKGHCVVYTADGARFEVPLAYLGTTVFAELLRIAGEEFGFASNAGEQGHAALQCRGYGTMSCAWLGELPPGGKRFLSPNWAMRGKDIDGEPNNNPLLN

SEQ ID NO: 127963 - protein, 141 aa, Triticum aestivum
  Clone ID: PAT_TA_22381.pep
RLVADQTSRSIHLGVVRSSRRDRSSSMMNVLSSGHPQNLRMIHHHHQHDILLLCPRRSTINAHPPSRTRRPSSGSFRRGAVVPVRAVADDGGESSSGKDDDDEAAPRAADDEGTSSASASRRNQKTLRRLVGAPRRDGFSG

SEQ ID NO: 127964 - protein, 340 aa, Triticum aestivum
  unsure (1)..(340): unsure at all Xaa locations
  Clone ID: PAT_TA_22382.pep
MTTAETEMCLSMLDSLNECRPLSGWLLVENLVRAISDEFQNVFVAEATWKRVRSERAXISRLXDVEQDIVXDLLDPAVSMFEQVGELLRPVLNTLHASSFLFCGELSVELASLSRIRQFFVVESFAGGIHVVHALVAPKAALEYYDTYVPFLLEASNDDNSNIRQAAVYGLGRCAEYGGRSFRPLVGEALSKLNNVIRHPEAQHADNIMAYDNAVSALGKICQFHRDGIDAAQVIPAWLGCLPIKDDKIEAKVVHDQLCSMVERSDSQVLGPHSQYLPKIVSIFAEVLCNGKELATDETTTRMISVLKRFQQTLPPDFLASTFSTLQPQQQLMLQSILST

SEQ ID NO: 127965 - protein, 53 aa, Triticum aestivum
  Clone ID: PAT_TA_22383.pep
CKVACWCIQDNEFDRPTMGEVVRVLEGLQEIDVPPMPRLLAAITAQPGAAYSV

SEQ ID NO: 127966 - protein, 170 aa, Triticum aestivum
  unsure (1)..(170): unsure at all Xaa locations
  Clone ID: PAT_TA_22384.pep
MAKARKPTAFSAAERFLGFHHRPGSATVAPSPYDDLPDLAESDVWYSPSSDAPTTTADQDGVQRTDRAPRGEPPRRVGGLSQAFADGRQVASSAPVEVPAWPSRFADLEPEPEPDEQQQEDADGWVPPHVYLARRQARASVVEGXVGRTLKGRDASRVRDAVWSRTGFPG

SEQ ID NO: 127967 - protein, 132 aa, Triticum aestivum
  Clone ID: PAT_TA_22385.pep
MQQPQLQPRVRARAFLHAAVKLSPRRNPFLLRRPAASAGGAVAGVQLTVSDSELSSRGFAVRRTAEGLDVAALNEVFARVGFPRRQEERLRRALEHSEVAWLASEATGRPVAFARADGDGVFNAVVWDVVVE

SEQ ID NO: 127968 - protein, 116 aa, Triticum aestivum
  unsure (1)..(116): unsure at all Xaa locations
  Clone ID: PAT_TA_22386.pep
MAAPRGAAVVLAMVLAAMVVAPPATVHAAISCSTVYSTLMPCLQYVQQGGSPARGCCTGIQNLLAEAKXNSPDRRTICGCLKEXVPTAPPGGALISTRGGRASPPKCNVRPSPYKD

SEQ ID NO: 127969 - protein, 419 aa, Triticum aestivum
  unsure (1)..(419): unsure at all Xaa locations
  Clone ID: PAT_TA_22387.pep
MGDSSNSNVQKAEELKLRANDAFKANKFSQAVELYDQAIDLNGSNAVYWANRAFAHTKLEEYGSAVQDATKAIEIDPKYSKGYYRRGAAYLAMGKFKEALKDFQQVKRICPNDPDATRKLKECEKAVQKIRFEEAISVGDTERRSIADSLDYHIIEVEPQYTGARIDGDTITLDFVKQMLEDFKTQKCIHKRYALQIVLQARDLLRAVPSLVDVNVPNGCHFTVCGDVHGQYFDLLNIFELNGLPSEDNPYLFNGDFVDRGSFSLEVILTLFAFKCLYPTGMYLARGNHESKSMNKIYGFEGEVKSKLSDTFVELFAEVFCCLPLAHVINKKVFVVHGGLFSVDGVKLSDIKAIDRFCEPPEEGLMCEXLWSDPQPXPGRGPCXRGVGLXLGGDVTKRFLEDNNLDLVAXISYEVKDEG

SEQ ID NO: 127970 - protein, 39 aa, Triticum aestivum
  Clone ID: PAT_TA_22388.pep
SVVGGGDGGGGGYGGGGGYGGGGGYGGGYNGGSRGGGYP

SEQ ID NO: 127971 - protein, 209 aa, Triticum aestivum
  unsure (1)..(209): unsure at all Xaa locations
  Clone ID: PAT_TA_22389.pep
METPTPWRVLEFYSGIGGMRYSLASSGVRAEVVEAFDINDVANDVYEHNFGHRPCQGNIQTLTAGDLDKYKAHAWLLSPPCQPYTRQGLQKHSADARAFSFIKILNLMQNMSFPPQMLFVENVVXGFEVSDTHDQLLAVLSTLNFNTQEFILSPLQFGCPIFXRPRYFCLGKTGIYVFSKSISQWTSCLGQPTCPTLNTTRTQISYDQE

SEQ ID NO: 127972 - protein, 83 aa, Triticum aestivum
  unsure (1)..(83): unsure at all Xaa locations
  Clone ID: PAT_TA_22390.pep
GEDIALVSCCSHARPRTSGQIHVRWMLQARPSPLPSFLLFPSNYHVIFTMSSFLVVLFFHPWGIEMLPQVGNEASDLYPIIFX

SEQ ID NO: 127973 - protein, 117 aa, Triticum aestivum
  Clone ID: PAT_TA_22391.pep
MSGVWVFRNGVVKLVENHPASAAGPPGGGAVRRKALLHTPTGEVVASYASLERKLVALGWERYYAGGGGAAGDCMLRFHKRSSVDLISLPKDFGQFSSVHMYDVVIKNRDAFRVIDV

SEQ ID NO: 127974 - protein, 130 aa, Triticum aestivum
  Clone ID: PAT_TA_22392.pep
LYSWRIASMHLVYRLGPRRSCGLLSKYLLFNCLCHLLSHAIARLIGFDSFSGGLGGLRPSLSSFAIFFNVIWFIYLYQINSSSLISTCRCCILSPRLLSISLLVCPGLLMSTEAIERELVNERSESKSEA

SEQ ID NO: 127975 - protein, 169 aa, Triticum aestivum
  Clone ID: PAT_TA_22393.pep
EFTSDFERPPGQVSSSQAGGVLPLIPCLECRCKVVTFVSRAGEQFYKCVTKDAGLCPFMRTTDTYLPELTRVGIAEPQVLHHSMAMHQSAPVQRRSSREQEFIDGSQGEIQPDHAAARLQMQQANHHPRAPTHCCSFAPPMLLAGKQLYPCRRPVVFNLRPPPVSVSSR

SEQ ID NO: 127976 - protein, 78 aa, Triticum aestivum
  unsure (1)..(78): unsure at all Xaa locations
  Clone ID: PAT_TA_22394.pep
GYIKDLFAKLEGDXLDAFQEDVEPATKVSSLASQRPSVXLLAESMHDDGGVVFAXYYREGAAXPTFLYFAHGLKEVKC

SEQ ID NO: 127977 - protein, 129 aa, Triticum aestivum
  unsure (1)..(129): unsure at all Xaa locations
  Clone ID: PAT_TA_22395.pep
RPSPPPPPRRRSPPRPGAWTPSAPRSPRPAPPRRRXSGLAGRRPPPPRSSGAPSSPPPPPRPPSPPPPCPPRPRXPSPSRTPPRSPWNQALLNDCLALNVRKDIGDEARGSAFLGSTPQISGKLVGGDT

SEQ ID NO: 127978 - protein, 194 aa, Triticum aestivum
  unsure (1)..(194): unsure at all Xaa locations
  Clone ID: PAT_TA_22396.pep
SSALPCHDGLRHHGHLLLLLLLFLSTRTSPPSIHPHQAPLLAVAVAGGGAAERAAPAARNDHNPLLQPPPDPHFPLRLPVQGRQQRQPPPHLLRHGEPDAGGGRSPATWGWSXGGLKFKRRADGEAVRAASRRALRGKRRVPWCXPTGPPGXXEPHGGCSTRXXPAAGASAXTXTAFVXXXREPXANAXLXGRQ

SEQ ID NO: 127979 - protein, 148 aa, Triticum aestivum
  unsure (1)..(148): unsure at all Xaa locations
  Clone ID: PAT_TA_22397.pep
MQIFVKTLTGKTITLEVESSDTIDNVKAKIQDKEGIPPDQQRLIFAGKQLEDGRTLADYNIQKESTLHLXVLRLRGGMQXFVKTSQARXITLEVESXDTIDNSRQVQDKEGSPRTTRLIFAGTLEMATSRLQSEAHPTGAPRGGRSWM

SEQ ID NO: 127980 - protein, 83 aa, Triticum aestivum
  Clone ID: PAT_TA_22398.pep
MSCCGGNCGCGSGCKCGNGCGGCKMYPEMDEGVTTTSQTLIMGVRPLQRAPRPFRGRRPRPEPDNGGCKWRSKLHLATPCTCK

SEQ ID NO: 127981 - protein, 143 aa, Triticum aestivum
  Clone ID: PAT_TA_22399.pep
VEATRIAAAASRRANTRRPLLDAMLGIRDPCLFFFFSGCSGHWPARAEFDIKLTAAVATRFHGDSDLPLSSCLIFPPCSFDPGSRGTSQCHLHHKCIFFIKGGFAFRWSLREELTALTYLLLSSGLILLCSTSDCFCSTSRCL

SEQ ID NO: 127982 - protein, 148 aa, Triticum aestivum
  Clone ID: PAT_TA_22400.pep
NPAWSEPVDTRGSCDLGPAQWRMLTNRGRPRPGRARAAEERQRRQLRHPDVGLGRGLARRPERAPAKEDAATAAMTTARKILELEAMILAARKKMSQMRCSSKNCGGGEGGAEDLGGHDPSCEKENVADAAVLVSGYSCSSKNCGGGE

SEQ ID NO: 127983 - protein, 109 aa, Triticum aestivum
  unsure (1)..(109): unsure at all Xaa locations
  Clone ID: PAT_TA_22401.pep
SLLPHSLPRLPRSDPSAPAAIVVSHHAPPRPPTPPHPSAVPASSVLLPYVACANGLEPGASPXVRDEVRLQPQGVLRRHPNFPATLSLPSSTLLHNYRLRDPPRLPGDP

SEQ ID NO: 127984 - protein, 97 aa, Triticum aestivum
  Clone ID: PAT_TA_22402.pep
AWSRPRYPKWLEDNKSKISKEEYERYSNQLELMLKLNEVYEHEPENMSKVFEIMQNMQECGQPPSDLVQDIVPDLDLSKLGQLSPEMLESTENCCIM

SEQ ID NO: 127985 - protein, 118 aa, Triticum aestivum
  unsure (1)..(118): unsure at all Xaa locations
  Clone ID: PAT_TA_22403.pep
MAKTYSVVSAEYQEAVEKARQXKLRALIAEKNAPRSMLPPPPWHSGPGTFRRSVQRQGGPFRDDERTRRGKAHARQRRALGIAXVRCSXPMKEEIXHISYADFLQLAGXXPLEAXGGP

SEQ ID NO: 127986 - protein, 137 aa, Triticum aestivum
  unsure (1)..(137): unsure at all Xaa locations
  Clone ID: PAT_TA_22404.pep
TFXSFPXLPXKAXAVXEAPFGSLXLDAXVKXEARTSLIAPSGRLFSMLLAFLGHLAARGGSFGAPICHFPHGWVLLLMRPALCSXAGGSFGRGFGSDGGLGRQWRRRRRRGRGWMPLARRDGQHHWVCESEGISLGR

SEQ ID NO: 127987 - protein, 123 aa, Triticum aestivum
  Clone ID: PAT_TA_22405.pep
ERPPGPVGRCDSARGAGRARLGGVQSEAHGPTPLAGQAEGPVCVDYFTRPDGQHLVVGPMEGTARNWDLKVGGCIGELEGHAGRITAVQLHPRASVAHYQVHLDGTIGLWGSTTYQLGGYNWF

SEQ ID NO: 127988 - protein, 78 aa, Triticum aestivum
  unsure (1)..(78): unsure at all Xaa locations
  Clone ID: PAT_TA_22406.pep
SVSLLCLTRSPESGRRQDSGLIDADXRGSVGVVLFNPVKPGGHVAXMIVQVIVTAKVTEVEDLDATVRGXGGCGSTGV

SEQ ID NO: 127989 - protein, 130 aa, Triticum aestivum
  unsure (1)..(130): unsure at all Xaa locations
  Clone ID: PAT_TA_22407.pep
ALGADAARGTSSVHFSLHEKGLEAKTTNKTSIIALSCGLEHRAKIDNNVRLLDFRKRLESACVETVESEKMTEDLPILDHGTEVTREHXLSTKEFTDAVAQQPREKSQISASLQLQSCVYVNSVEGCGVG

SEQ ID NO: 127990 - protein, 149 aa, Triticum aestivum
  Clone ID: PAT_TA_22408.pep
STGRGRVVGNLAFVALVAYLVVSGQFRWLLDAIVSLWLLTVLLPIVGLGALIFFAQRNILQSDCPNCGKSFRILKTSVKNGPQFCPYCTQPFSVQGDKFVREAASFSSGRTPTNAQQAFNELFNRGSNGKAPSGSGTIVDVEAEVTDIE

SEQ ID NO: 127991 - protein, 127 aa, Triticum aestivum
  Clone ID: PAT_TA_22409.pep
PTRPPLSPSPPPHGPRARRAAGKNPPSTALRRSPGTPPPPPLSFPDASVSSLQRPPHLFTAAPEVAPSSIASSSPPPPRRRLLPSVLSLKLHQVVTAACCLFSPAGRRLPIHHLPPLNWVAVAAMGE

SEQ ID NO: 127992 - protein, 106 aa, Triticum aestivum
  Clone ID: PAT_TA_22410.pep
LNVRHRPEGSPGNRSAASRRLLEERHQKSICRKLGNQPATMRRRDEPGMPDQGPKVEQRCRSREEELAGSEVRNRCRAGWGGCGADRGSGRRGGGGAPGRRGDRTG

SEQ ID NO: 127993 - protein, 100 aa, Triticum aestivum
  unsure (1)..(100): unsure at all Xaa locations
  Clone ID: PAT_TA_22411.pep
TSPLISCRLQRLLPSSEQGQHEEVLLPSLPAATXDGELLGVSYLPACGRIXISGTXTXSKIFENWGHWDGVCVSQRTAGXFLPIXVYXSIPGFNXNGRWN

SEQ ID NO: 127994 - protein, 209 aa, Triticum aestivum
  Clone ID: PAT_TA_22412.pep
MPMVAAAAAAPDQPFFSQPRRPPQPPSLFSIRKAALPPRCCSSHSSHCRCHCSWSSSAHARRSSHCRAGATPDHPDEPPPSGRGGRYHPWEDIAEKLQLDDGEPARLTDAESARTIVEVNNNATVMISTLIDDGVHERIIFPEFPYLTDENGDIYFEVDNDDAVMENIMGDDKIAHVIIGLDNTDVFADLDLAAASSTAFAQEEDDDDS

SEQ ID NO: 127995 - protein, 123 aa, Triticum aestivum
  Clone ID: PAT_TA_22413.pep
RPAPLPEHHLPRRLPPTFPRPPQILPPRLPSSSTRHRRGSPPPPRVAAADPHSLHPPAQSTDAGLPPQPSEPPPPLPDPRAPLTPAAGHRQDLAPPPTTTKEAPHLRVDSVLPEVPQDGGTQG

SEQ ID NO: 127996 - protein, 167 aa, Triticum aestivum
  unsure (1)..(167): unsure at all Xaa locations
  Clone ID: PAT_TA_22414.pep
MAASLRASSSPLRSRLLSSPAAWSPWRLLLSSSVHSDAAHQTETLAFHEIQLSPEKPPTATAFVLHGLLGSGRNWRTFSRTLASQLRDRSPADEWKMVLVDLRNHGSSAXIKGLSPPXDMSSAGKDLADLVKAXGWTWXXVVVVTSXGGXVAXSRILPLRIRSLQGG

SEQ ID NO: 127997 - protein, 241 aa, Triticum aestivum
  unsure (1)..(241): unsure at all Xaa locations
  Clone ID: PAT_TA_22415.pep
MGRPCVGALLACAAIAASCCCCFQLQFQGADAAATPSFGDNFDITGAEDHVKTPPDGQTWYLSLDNKTGVGFQTKQKYLFGWFSMKLKLVGNDSAGVVTAYYMCSDLDAAPERDELDFEFLGNRTGQPSLRLASGYRSAGAAPAMRLSPRFXPTAAVRASAFLWNPKLIVXVDKVPIREYGNSDSPTXFPIMKPCTSXPSXWNAXXWASAGXREKAGQGGELKAWPRRPGGWGKTDDTKKQ

SEQ ID NO: 127998 - protein, 136 aa, Triticum aestivum
  unsure (1)..(136): unsure at all Xaa locations
  Clone ID: PAT_TA_22416.pep
LHRISPSWQDINHVXKFLLRIHWIVPFLNTGNTASINRPPAGGGSGAHLGLGPLGTSHRENQMVQMGCMPFNVFLRGHHHIKCXQVPDLTSAAQVKXAPILETXTQLSVXMFKLPLMDXYSNILRRPXTXQLFMTE

SEQ ID NO: 127999 - protein, 151 aa, Triticum aestivum
  Clone ID: PAT_TA_22417.pep
MFYGAMVWDPWLIVAQIVCLQCLYYLGLGLFMALLVGTRVPRLTLLYLFDFATLTPRTTTGWCAIASFLLAAIAGAGFMFYVIERAKKCLDFAATLYIIHLFICIIYGGWPASGTWWVVNIVGLAIMSLLGEYLCIRRELKDIPVRLRASV

SEQ ID NO: 128000 - protein, 152 aa, Triticum aestivum
  Clone ID: PAT_TA_22418.pep
MALTLVFSSLLVFCLNGVSSDSSYFTSLFTLGDSYFDTGNFLIMADPAIPEYNGNPPYGMTFFGRPTGGLCDGRVTVDFIAEQFGLPLLQASMLNSSDVSKGVNFAVGGATAIDIDFYERSKLVPYKLLNNSLNVQLGWFEELLPEICTAGR

SEQ ID NO: 128001 - protein, 130 aa, Triticum aestivum
  Clone ID: PAT_TA_22419.pep
ENKIQKGKYRIVAFVQAFTAQITHKNLPGPGGRWSLAWRRELGRRKTWWVPAGMESHGAGRRRGACRRAATSLRRCRDLGRQRTRPCPREWRTSSRGVGSSVEEHTGGDVASSRSGSRRRPELGALEELG

SEQ ID NO: 128002 - protein, 84 aa, Triticum aestivum
  Clone ID: PAT_TA_22420.pep
CEGAVNSAVDVMHTMASSMCNLLSKVEGTSSVVYELAKLATQEQMLLDQSRDLLSTVAAIHVKQCSLKTHLLQRKQRQSLQTRW

SEQ ID NO: 128003 - protein, 47 aa, Triticum aestivum
  Clone ID: PAT_TA_22421.pep
YGLAGTSWFNGAFSKVAEAGHVAGSRTTEKFQIVVSNISAKGPAVVA

SEQ ID NO: 128004 - protein, 276 aa, Triticum aestivum
  unsure (1)..(276): unsure at all Xaa locations
  Clone ID: PAT_TA_22422.pep
MEEGRRGTRTVRVXRNISDLAGEREVREFFSFSGEIDHVDITPDGAAAGRTAYVTFKDAKALEIALLLSGATIVDRVVNITSAEDYIYIPVNEQQLVMNEVTSTAPTADLEQPTEANSSPTSVYASKAHDVMTTVIARGSXAIRQDAVNKAKSCDERHQLXRANASARISSFDRRVGLSXEKLNTGISVVNEKVKTVDQRLHVSDKTMAALLAAERKLNDTGSAVKTNRYVSAGTSWLNGAFSKVAKAGHVAGSRTREKFQIAVSNISAKGPAVVA

SEQ ID NO: 128005 - protein, 85 aa, Triticum aestivum
  Clone ID: PAT_TA_22423.pep
SVPRQQHSTSLPPNAYKTHVPIHQQQSTNLASVCALGYDRDSGAREELYVESLHFEQEEEEERVHVRPTINLQARRPDGGQRLSI

SEQ ID NO: 128006 - protein, 203 aa, Triticum aestivum
  Clone ID: PAT_TA_22424.pep
MGLMAGMLPGVEFARRRRLRPAPEAPCAGARRPALMGVFGHDHAHLGSAGFAKQRSGVCEEAWATQLDSIAREAKERLDHKLRSQRESVVKRRHSTGSLRLPVPSSTTSDHPAKDTAGAASTLQREVFTKRGGGRRFSWGRRKEQQQQAECAVCLEEFRAGDVLAHLPCAHRFHWACAVPWVQAASRCPFCRAAVRLADHQLL

SEQ ID NO: 128007 - protein, 164 aa, Triticum aestivum
  Clone ID: PAT_TA_22425.pep
MAAQAAPPPPPEQKMMVAIDESECSHYALEWALRNLAPRRLILFTVQPFSPLSYLPAGSPRAVGPSVASPELIRSVTEHQRQLAQALVDKAKAICAEHGVDAETTIEVGDPKETICEAAEKLNVDLLILGSHSRGPIQRFFLGSVSNYCSHHAKCPVLVVKKKE

SEQ ID NO: 128008 - protein, 166 aa, Triticum aestivum
  unsure (1)..(166): unsure at all Xaa locations
  Clone ID: PAT_TA_22426.pep
MAAQAPPPPPPEQKMMVAIDESEXCHYALEWALRNLAPRRLIPFTVPPFAPLXGYLPVGSPRAIGPSVASPELIRSVTEHQRQLAQALXDKAKAICAEHGVDAETVTRGGXDPTETICEAAEKLNVDLLILGSHSRGPVQRFFLGSVSNYCSHHAKCPVLVVKKKE

SEQ ID NO: 128009 - protein, 111 aa, Triticum aestivum
  Clone ID: PAT_TA_22427.pep
ATHPRHRGVSNDGDDRLLCRGVGTGQLEAAVAPAPTATHSRRGRPCRLVTTSSPCPVLVRHGSCFSVPLSGLCSLCLLICSQQHTNLVSYFPLLLAQIVYKFICLLIQRGG

SEQ ID NO: 128010 - protein, 190 aa, Triticum aestivum
  Clone ID: PAT_TA_22428.pep
MSKYGTIPTSSSAAAGAPHLGGASPLDFISRAKARGATALATRRPWRELADVHAVGLPPSLGDAYLRVRANLAHFAMNYAIVVLVVVFLSLLWQPISLIVFLVCMVGWLVLYFLRDEPIVLFGRVVGDGVVLAVLAAVTLILLLLTGATTNILTSLLIGFVLVVVHAALHKAEDNVDEEVGRWYAPVPAQ

SEQ ID NO: 128011 - protein, 114 aa, Triticum aestivum
  Clone ID: PAT_TA_22429.pep
FDGWSEGVISFPPTYKYRFNSKKYTSDEPKSGRRTPSWCDRILSYGKAMRLLSYETVDTRLSDHRPVKAVYTVDTEVFSPKKLQRALTFTDAEVEDRLSSEDERIAGIYSLGLS

SEQ ID NO: 128012 - protein, 178 aa, Triticum aestivum
  Clone ID: PAT_TA_22430.pep
CHRSQSILMTSGSQRMHTTSNRTSSLVITWSNESLTNQSTGRLVIKVTSKLEHHKIRHHNTASERVSTTSGIDYFHLINCFLLINQSCGREYLLNSLRSHALAGWFLRRKPAGRDSSVTTLAPPTTGRHRGGPRHQPRPDTFFWSARHNNPLLLGIQVKVKARTSESITDDQGMITHY

SEQ ID NO: 128013 - protein, 291 aa, Triticum aestivum
  unsure (1)..(291): unsure at all Xaa locations
  Clone ID: PAT_TA_22431.pep
MWCCRVVAATAWRRSRRRRRTELRRGPWTVDEDLTLINYIADHGEGRWNALARAAGLRRTGKSCRLRWLNYLRPDVKRGNFTADEQLLILDLHCRWGXNRWSKIAQHLPGRTDNEIKNYWRTRVQKHAKQLNCDVGSATFKDAMRYLWMPRLVERIHAAAGDPTIGDTSCASGVRSMATTAATATTYPDNNSAASAVTTSRSASSGSFTSEXSAARRKNLHVHGSGEKTTSGGDWMQEADQEFWAMHMQIQPEDGGLFHVDHELSGWVQGFSDVGVSADNLWSLEDIWKMQ

SEQ ID NO: 128014 - protein, 206 aa, Triticum aestivum
  Clone ID: PAT_TA_22432.pep
MDAMEEDTPPPPPPPHTTGAKQPPYKDPDDGRQRFLLELEFIQCLANPIYINYLAQNRYFEDEAFIGYLKYLKYWQRPEYIKYIMYPHCLFFLELLQNANFRNAMAHPANKEVAHRQQYFFWKNYRNNRLKHILPRLPPEPTPAPAPAPAPVPTPPPVPAPPSSLPTMSAVGASAMPPMQFIGTPGTNNPKNEMRNVMGGRKRKMG

SEQ ID NO: 128015 - protein, 347 aa, Triticum aestivum
  unsure (1)..(347): unsure at all Xaa locations
  Clone ID: PAT_TA_22433.pep
ATRGHPPHPPASPRAPPPLKQASSGSQAERISSRGTRRTCPPALPGARAPRGAPRPLPLPGGPAPPQQGTGVVRVDKASPASSFRQLDDAFLQKQTKIWLGEVLHVRFDEDILVADLLGDGELLFQVSKVIWKRLLRKNKEQLKQSKVYIYERPSFGKSNGKYTPYPKVDSFLKVCQTLGLAGIDLFTPSDVVEKRNVRKVCMCIRSLSKKAGMMQLNVPDFDVVTHTIAMPNYIVGGIRRSLEQPQCSSSCSSGHSPRAISKSIFEGQSDEQSDRHYDSDEAESSLFVLGPQDSLDDDKLSEXLQXGDAPQEEREGYGDSGHEMPKEKSLAESAGSLDAVXMGADT

SEQ ID NO: 128016 - protein, 118 aa, Triticum aestivum
  Clone ID: PAT_TA_22434.pep
NTRIWPFSNQVAQTRPPAASRPPPAPAPPSCPPPTPPPKPPPTPPPAPIPPPSPPPAPRQSLPRRMAPTPPRPLRLPAGRSQPLYSPPGPPAPRPSVPLPWYPKPPTLGVLPWLALQS

SEQ ID NO: 128017 - protein, 136 aa, Triticum aestivum
  Clone ID: PAT_TA_22435.pep
QERGVQDKERYQSQLAAYKEELRTGQPMSNPMPIIGNAPIQQTFPQTEVTIDEVDSKVSKGDMLLSNQRYNNSDEGVDSGGKLVEDEEFNTDTSPEPSIDTTDSPGLLDPSADGDRFELRRRENPNKNEKQSTAPK

SEQ ID NO: 128018 - protein, 73 aa, Triticum aestivum
  Clone ID: PAT_TA_22436.pep
RPGRIGRIGPARRRRPSRAWRPPAPARRRPWRPLPTGPRTACATARRRRSTRSTSCRLGERRRGTGDRGGGRS

SEQ ID NO: 128019 - protein, 131 aa, Triticum aestivum
  unsure (1)..(131): unsure at all Xaa locations
  Clone ID: PAT_TA_22437.pep
GPDELFEVVQHCFWVEVERAGRDCLEALALKVSDYNCICWLTAGGIPTLRPSSPPAFDLHVTPFSLPIARILQASPPVMALLLVANXPSVLFIPIIAVADSPMFPAGQAPKQQGCRYSTASGSLHYTSXRL

SEQ ID NO: 128020 - protein, 219 aa, Triticum aestivum
  Clone ID: PAT_TA_22438.pep
SELRSLFEQFGDIRTLYTATKHRGFVMISYFDIRAARGAMRSLQNKPLRRRKLDIHFSIPKENPSDKDLNQGTLVIFNLDPSVSNEEVRQIFGTYGEVKEIRETPNKKHHKFIEFYDVRAAEAALRSLNKSEIAGKRIKLEPSRPGGTRRSLVQHLGHELEQDEPRGYRHSHVGSPMANSPPGAWAQYGSPTDNNLLHAFSNSPTGNGMSSIGMSPTMM

SEQ ID NO: 128021 - protein, 173 aa, Triticum aestivum
  Clone ID: PAT_TA_22439.pep
AKLVIMDRRAVCISWLVILALVLLAGPGLAASSLAGGTASIDVARQLMPSSLMRLEDGVAPELAVDLGLHRRVLAGIAPGGGTTERQQASLQAQVRGARTAQHRPGLPQNLWLPKEEAERHSTKDVDSTSGTYTAMGACTRVPMFYFRFHSAIQHRVVLLYYGAGAVFVPPAR

SEQ ID NO: 128022 - protein, 200 aa, Triticum aestivum
  Clone ID: PAT_TA_22440.pep
PTSTASIAGWQPSLAPALLCCLRRPVSHRWKPRSSSPSPPPPPPPRPSPSTMTATARPTTSPLPAPRHPAGASPRATSPWPSSPPSRCSRSTRRPRASASTSSGAVARPVPPAGASTSSSSPTAAPSACSTRQPPRQGDALPRPSFRAAGSPRNVRRWPAETHADERRRAARTGVVFLTKLCPSRRSKTRARLPRVPPLC

SEQ ID NO: 128023 - protein, 113 aa, Triticum aestivum
  unsure (1)..(113): unsure at all Xaa locations
  Clone ID: PAT_TA_22441.pep
XDXXAPPAVGXYPEGAFWRFXPPXSGXSPLPTNGXXNXXEANXGSTTTPRDRGFAGIGGRTVLLFFWWGRRVGVECEGRKGRQRHDLVEWRCQVRRGTYGTGARACLFFFVKF

SEQ ID NO: 128024 - protein, 137 aa, Triticum aestivum
  Clone ID: PAT_TA_22442.pep
TSAQPWLTQPAPTPSNSGDIDASRELHITWSCSAQDSHPGFGTLSVPPTSFVADDPRGGPLGPLGPPADLVAPHARRSPIFPRSPSLQCPQSFRSPLNPYAKSRAGGPRVGWYSPSPGQRPRAGGRCAPPPLPPACC

SEQ ID NO: 128025 - protein, 411 aa, Triticum aestivum
  unsure (1)..(411): unsure at all Xaa locations
  Clone ID: PAT_TA_22443.pep
MNGGGGVGAGTQISLRLQYYVLLAGVGAVLLVGCLKSMPAAAGLAAGCGPWGSGLPVATRAAAPDAGPATTRSPVLRFRFAAPNPHTGGMAAASGLDIARPGGRAHLRRPPGRLSDGRLVIDFICESLGTPHLRPXDRALGSHLSNGANFAIGGSTATPGGSPFSLDVQLHQFLYFRTRSFELLNKGEKTPVEREGFRNAIYAIDIGHNDLSAYLHLPYDQVLAKIPAIVGHIKFGMETLYAHGARKFWIHGTGALGCLPQKLSIPRDDDSDLDANGCLNKYNNVAKAFNEKLAETCNQLRQRMADAAIVFTDLYPIKYDLVANHSKYGVERPLMACCGNGGPPHNYNHFKMCMSGEMQLCDMDAKFISWDGIHLTEFANAIVASKLLTGDYSKPRVRIASLVNSTAPHDG

SEQ ID NO: 128026 - protein, 150 aa, Triticum aestivum
  unsure (1)..(150): unsure at all Xaa locations
  Clone ID: PAT_TA_22444.pep
APRVRRRHGETSLILSTARQPIPNHLSPPSFPPHLPTSSGCEAAGYAWRHTAWRARGVNCVWRPRLEMLDRLGKLQPAEFFCCWTWPLRDDGGEPEKRMPRCCNHGGRYAETCMCSNCMCYNDHAMLEDGSTTPKEENHRHGFFLFLXGP

SEQ ID NO: 128027 - protein, 169 aa, Triticum aestivum
  unsure (1)..(169): unsure at all Xaa locations
  Clone ID: PAT_TA_22445.pep
LSAYKVLLPPDSLQVFMYQSCNLRIIVVRDLSSLTRGFPYSYLCIVHLQDIIMYIVGQVISRIATTGHHPRIISDDVASNTLSGGHDCFACSPSWGNCFPSSSFFSPVTSGRPLPPRRPAIWPFCLPRIGALQRTLSRLLRGRPSARRPPRPDHHNXXHXVSPXPXKSX

SEQ ID NO: 128028 - protein, 204 aa, Triticum aestivum
  unsure (1)..(204): unsure at all Xaa locations
  Clone ID: PAT_TA_22446.pep
PVHARSLPPTSLPRSPFVDIIISFPTTLFNRPQIQRRRRHMDMDSPPVPVPMPPSKPADLSLTLAPAAQSVAEADGGAGAGRVRACVDGKDVRLFPCLFCNKNSSSRXRSAAPKRAQEGAQHRLGPYSKCAXPQRTPPKPHAQSPXPRLRGYPVWRWRAXXAYAXVPSGLPTSSNRSKVIRSVDGSVXRXEGXXVSRGGNXKKD

SEQ ID NO: 128029 - protein, 184 aa, Triticum aestivum
  Clone ID: PAT_TA_22447.pep
MAMAMAASFAARHHHGHLAAGLPSTPQSGGRTSRSAATISMKAQKKQSSEPGSGKGGGDGRVSGGRRVWRRRKLTKEDDMLRYKLDRIPFLEEKVRKVRENGKLVCLDINQLMLSQENRFAFTMEVAEEANAYLEKHRHEYGLKKPILHVLSDRMNEAGFSRPEGYLYPYPIKPGPYFIKEEGN

SEQ ID NO: 128030 - protein, 177 aa, Triticum aestivum
  Clone ID: PAT_TA_22448.pep
PLLCSSTHATPPPPPTPPPQHLHLPPRRRTTSLPVPPDPIPPRSAAPPPTRTIAPPPAPRHRSSSSCRPPLLPSTTGRECFDRLPSARWGVGGASASDSTPAGHVHADWARRRQPVHHPPRRQALHRRCPTDLGGIRVRLPHSLLLTQRLSPPARGLIRASLLGLNTILVIRTNIEL

SEQ ID NO: 128031 - protein, 198 aa, Triticum aestivum
  Clone ID: PAT_TA_22449.pep
KFGFPPSSPAAAPPSRAPATGAAPNLKRRRREGEGDAGADADMREEAVERLRGVVRDSVGKHLYTSAIFLADKVAAATGDPADVYMLAQALFLGRHFRRALHVLNNSRLLRDLRFRFLAAKCLEELKEWHQCLMMLGDAKVDEHGNVLDQDDGSDIYFDKDAEDHEINIKSAICFLRGKAYEALDNRDLARQWYKAAV

SEQ ID NO: 128032 - protein, 361 aa, Triticum aestivum
  unsure (1)..(361): unsure at all Xaa locations
  Clone ID: PAT_TA_22450.pep
MKIQCNACGAAEARVLCCADEAALCAACDEEVHAANRLAGKHQRVPLLPDAAAPPKCDICQGGXSDTFFCLEDRAXLCRDXCDVAIHXVNSFXSGHKRFVLRGVHVDIHPVSPVPGTCITLCTTAPCSSLKHPPCRPKKTPSAQLPGESGASIPSQNVISGDYSRQISAPNTKTGMTNWTMDNSALRLAEPPPKYLSDGNSKLLLSNQTTTALSNQMNRDSGRAYNLPLAFGNGSDSLPDWPVDEFFSNXEYGPNFGFTEHGSSKGDNAKLGSAGGSPQCRLAEGLFAEDLLGQVPGLDAEDPWVVPEVPSPPTASGLCWQGNLHYPVYDGAMFVPEAPSLQSSQDHFTASAGFKRRRREF

SEQ ID NO: 128033 - protein, 150 aa, Triticum aestivum
  Clone ID: PAT_TA_22451.pep
MEFQGQHDNPANRVDEYGNPFPLAGGVGGAHAAPGTGGQFQAHRGEHKTGGILHRSGSSSSSSSSEDDGMGGRRKKGMKEKIKEKLPGGHKDNQQHMATGTGTGGAYGPGTGTGGAYGQQGHTGMAGAGTGTGEKKGIMDKIKEKLPGQH

SEQ ID NO: 128034 - protein, 114 aa, Triticum aestivum
  Clone ID: PAT_TA_22452.pep
FHYCLAWSRPRCRGDASAPCQDKAEEQHGCGRSDRGDGIASFLPPFHNFDDPDKAVCPGLEADGKIQTCFYHWWLRISGFACPSMTSLPSKADSSFQDRAARPYKALQDSMMDV

SEQ ID NO: 128035 - protein, 365 aa, Triticum aestivum
  Clone ID: PAT_TA_22453.pep
MVAIATSFSAAAAVAVARRSSPAHLQLVARRRLPFCTAASSSTVPPAAAAGFGWADALRVASEFGVGDESDLSGYFQKVDICNRGMGNKGEFVEFMVEDQVVGYIHKGFTEHLRDFHDVFTIVSGSNGKNSVEHVTLHSSLRTPEDRTIAIGDVIKGLGELIPGIRNELYPVTSSYGMPVYFSLERAAAPYFGIKAYGVHMNGYIEKHGEKSLWIGKRSDVKQTYPGMLDHLVAGGLPYGISCKENIIKECEEEAGIPRSMSTNATSVGAISYMDINGFRYKRDVLFCYDLRLPVDFVPNNEDGEVDSFRLIPVPHAANIIRRTDFFKPNCNLVIIDFLFRHGYINPDCNGYLKLLTSLRSGDCS

SEQ ID NO: 128036 - protein, 298 aa, Triticum aestivum
  Clone ID: PAT_TA_22454.pep
MAAPLPRAPVSSPASRAALCPARSNPCTAAAPSSGALGWRRRQPCPVLSIAPGSARSTPAALAVDPKVEALLDSVKWDVKGLAVAIAQNVDTGAILMQGFANKEALAATISTRKATFYSRSRSSLWTKGETSMNFINVHDIFLDCDRDSIIYLGTPDGPTCHTGAETCYYSSVYDALQGSKSNQERQVATTLYSLEDTISRRKEEIVTEGSGKPSWTKKLLLDNQLLCSKIREEAGELIETLLENEDKSRTASEMADLLYHAMVLLSVRDVKMEEVLEVLRRRFSQSGVEEKASRKKS

SEQ ID NO: 128037 - protein, 78 aa, Triticum aestivum
  Clone ID: PAT_TA_22455.pep
MVINGDAPARGSAAAAASLRRRRTTSGAAGGGGGASTMLQFYTDEAAGRKMSPNAVLIMSIGFVAVVAVLHVFGKLYR

SEQ ID NO: 128038 - protein, 86 aa, Triticum aestivum
  unsure (1)..(86): unsure at all Xaa locations
  Clone ID: PAT_TA_22456.pep
MVDKGDAPCKEGVQLQLASLRRRRTTGGGCXSAGGGGVGASTMLXFYTDEAAGRKMSPNAVLIMSIGFIAVVAVLHVFGKLYRTPN

SEQ ID NO: 128039 - protein, 150 aa, Triticum aestivum
  unsure (1)..(150): unsure at all Xaa locations
  Clone ID: PAT_TA_22457.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLKFYKVDDATGKVTRLRKECPXADCGAGTSWQHFDALRNAAHYATTEG

SEQ ID NO: 128040 - protein, 89 aa, Triticum aestivum
  unsure (1)..(89): unsure at all Xaa locations
  Clone ID: PAT_TA_22458.pep
CTFGPLLRVYKSXRIERPLVLPPVAPGPDPSTGVQVQGRXTSGAXLRPAPTVPPSPPGAALARLPAPLSVVYVQXXXGXXGFEFQLSFL

SEQ ID NO: 128041 - protein, 269 aa, Triticum aestivum
  unsure (1)..(269): unsure at all Xaa locations
  Clone ID: PAT_TA_22459.pep
PPSPVTPPPTPVTPSPTPKTPPSPVTPPPTPVTPSPTPKTPPSPVTPPPTPVTPSPTPKTPPSPSPPATPPTPITPSPTPPSPITPPPTPVTPPSPPMGKCPVDTLKLLGCVDALXNGLVHTVIGSSASDTCCPLLSGVAGLDAALCLCTTIELKALNINLVLPIAIQVLVNQCGKTVPXSDFQCPATPPSPTPVMPPSPPVXPPTPVTPVTPASPTTIXTTISRRSAPAVPRAPLRTSPAPRPLLRPGPSPPRDCRRHLNRGPWPIGG

SEQ ID NO: 128042 - protein, 178 aa, Triticum aestivum
  unsure (1)..(178): unsure at all Xaa locations
  Clone ID: PAT_TA_22460.pep
PPPPPLLPSPVSAPPPVNPHPVPIPSPPLPGGIFAPSHLYKPLSATPLSQIYILPPPRLAGRPAAPQSCVGRGAYPARRVFDTTEAPPTLFLSISAIDLTHAKHPRLLPTRPRAMDFLAGARPQWXLAGASAAARQRRPPLGPPPPPPGPGGPAPPXIPGAPWAGFLGPVRAIRALTS

SEQ ID NO: 128043 - protein, 306 aa, Triticum aestivum
  Clone ID: PAT_TA_22461.pep
MSISFSQELLISTLAIILLPLMLYLRSSRSKNPSVLPINWPIVGVFPYLIANFHNLHDYLAVVLAGSGHNFRAHGPPGTGLRFFITCEPANVRHIFTTNHANFPKGAEFAAIFDIAGGSFFTTEGEPWRRQRARAQRVLSNPRLLACMTACCRDKVENGLLPVLMHMASTGTTFDLQDLTIRLVLDMTATPLLGVHPRPRSSDPPPMDAAGAIDTATRGALFRHIVPTSGWKVMRRLNIGPERKLAAAHTVLRGFIEEMMERRKRKEHAGNEGAPSVDILSSYIDDPDYQQNDGLLHATLINYMIA

SEQ ID NO: 128044 - protein, 262 aa, Triticum aestivum
  Clone ID: PAT_TA_22462.pep
MDDSSHPVHYNHGNGNVEAAQRQQRLKDPKEVINNGFSISTDGAGDNNMGNRHDVSHARSNINHVNGLLSKHPETSSKGSDHHLELMGCYLHPMPVLSIMLNTKDSSSLNIYVLCGSSESCKRFLYVYDITPNDHHEKPPNFVGYTTLLLPSLEQASTRNSTFGRSGIQFTPDGQFLVLLSGIRIPCCRMQSIDCSCSLCKVDQCGDNSLKIVSVNFGYISLLTKLMPSGTVSCFSISEPNYVVAAEDSRNLHVWMMVAGWS

SEQ ID NO: 128045 - protein, 336 aa, Triticum aestivum
  unsure (1)..(336): unsure at all Xaa locations
  Clone ID: PAT_TA_22463.pep
MEALVVRKLGDPTLPPGGEDSPFAAVSGDRPIPELSSPTSVRVRVAATSLNLATFLQVQGKYQERPXLPYVPGSDYAGVVAVGPGVXRFRPGGPRLLPRSSVGSFAEFVVADEKALYAVPDGCDLVAAGALPVAFGTSHLALAHRAQLKAGQVLLVLGAAGGVGVSAVQIGKVCGAIVIAVARGVEKLQYLKSIGADHVIDSSKENVIESAKSFLKASGLKGVDVLYDPVGGKLTQDSLKLLNWGAHILLIGFASGDIPVIRANIALIKNWTIHGLYWGSYXSHLTHGPAVLIDALLACLSWRLMAVIPAHPSRPAEARRAPAALLLNLRVRKGGR

SEQ ID NO: 128046 - protein, 209 aa, Triticum aestivum
  Clone ID: PAT_TA_22464.pep
MACWVDLLRGVAFSWCNTLFPKDCRKEPTLNFGFFSLPRELPGADHCRGNTRVAQPEAYRTIGVVQGFSRLVSFPRSRPRFDLKDRTLTVWKRTLNRVWQLEYKLSLETLWGLQGFGDLPKNLTPMYPLLSTENTDIVYFALGEYLENRRRWKFIPICAHYLLAVNMQSNTVQASISLADCFGSPDIPDLVSSSFKPGMSMSWGMIYTL

SEQ ID NO: 128047 - protein, 67 aa, Triticum aestivum
  Clone ID: PAT_TA_22465.pep
LRQTFKQVYLDAQLTTAYPAVLYKLTSTWPHLSPDEHLYFAFSINFHAVCNTGISSPQLVQRCPLSS

SEQ ID NO: 128048 - protein, 207 aa, Triticum aestivum
  unsure (1)..(207): unsure at all Xaa locations
  Clone ID: PAT_TA_22466.pep
MLPPPPPRNTRTCPSPAADRTTLPMPPPAPSPDPYRDWANLPELPLAEVLRGLLPCIRSLYAFAGTCSPGRHLLRASAADLVPPPRPAAPPPSAPTFRLGAFSPRSFAPQSLSYPSPPRREGATLLSRLTPAPDSPPPGVPXITYTXSTPSTAPTPRVHVPSXTSLYYAPKPPSLSSIIQPLGPPPEAKKKRHGKAPGAHKNWARYP

SEQ ID NO: 128049 - protein, 389 aa, Triticum aestivum
  unsure (1)..(389): unsure at all Xaa locations
  Clone ID: PAT_TA_22467.pep
NGDVEHRELHNAYGYYXHMATSDGLLKRGEGKDRPFVLSRAFFAGSQRYGAVWTVDNTADWDHLKSYIPMVLTLGLTGMTFSGADVGGFFGNPEPDLLVRWYQVGAFYPFFRGHAHHDTKRREPWLFGERRTALMREAIHMRYSLLPYYYSLFQEASVTGVPVMRPLWLEFPDDKETYNNGEAFMVGPSILAQGIYEEGQKSVSVYLPGTELWYDLRNGSPYKGSVSHKLQVSEDSIPSFQRSGTIVPRKDRFRRSSTQMVNDPYTLVIALNSSGSAEGELYVDDGKTYDYQQGAFIHRRFVFADNKLTSINIAPDSLGKKVYSTECVIERIIVLGLSSGAKKAIIEPGNQEVEIDLGPISLRSGSKSVAPTVRRPNVRVVDDWTIRIA

SEQ ID NO: 128050 - protein, 89 aa, Triticum aestivum
  unsure (1)..(89): unsure at all Xaa locations
  Clone ID: PAT_TA_22468.pep
LCTGRHLHPCDAVIKACSPAHAGSXDGGGGRSGGRRPGPTARREIGTSSRLAAGAACRDRRGRAARAECGGGRAGPRVYGRWGFACRGI

SEQ ID NO: 128051 - protein, 88 aa, Triticum aestivum
  Clone ID: PAT_TA_22469.pep
VFLYFLRDVPLALFGHTIGDGVVLAVLSALTLILLLLTGATGNILTSLLVGLVLVLLHALLHRPADSIDEEAGRWVHTRHTAAAVLVF

SEQ ID NO: 128052 - protein, 81 aa, Triticum aestivum
  Clone ID: PAT_TA_22470.pep
KNKYSICYRNTLHMTSILLLCQFCGKYTFESCLIATRVVLQRPATYMMKHGQRQQSSKPEPNGSYSAMHACWLVTFVPNQT

SEQ ID NO: 128053 - protein, 202 aa, Triticum aestivum
  unsure (1)..(202): unsure at all Xaa locations
  Clone ID: PAT_TA_22471.pep
VLRTSVGYAGGSKANPEYRNLADHAECVKIEYDPRLIQYKQLLDVFWASHDPREVFGQGPDVGNQYRSVIFTNGTLEARLAALTKEREQAKDRSSVITTKIQPLGAFYPAEPXHQKFELKRKPFLVQLIGNLPEEELLSSTLXAAKLNAYAAELCPPKTQKKISSKIDEIAKKGWPILRDIWAAHSGSRFSSNCNPSSCNPA

SEQ ID NO: 128054 - protein, 206 aa, Triticum aestivum
  unsure (1)..(206): unsure at all Xaa locations
  Clone ID: PAT_TA_22472.pep
MNPQQSMALGDTGNPRMRYCRKCNQLKPPRCHHCSVCGRCILKMDHHCVWVVNCVGALNYKYFLLFLFYTFLETSLVTLSLLPHFIAFFSDVEIPGTPSALATTFLTFVLNLAFSLSVLGFMIMHISLVXGNTTTIEAYEKKTSPRWMYDLGPGKKNFAQVXGNDKKYGFIPAYPERTXRSRSGSTSVTAGWACNDTIPPDKNLDV

SEQ ID NO: 128055 - protein, 318 aa, Triticum aestivum
  Clone ID: PAT_TA_22473.pep
MTMRKRPSASSLLVAPLLLMLLPVFALAAGRHNLITRNPQYGPRANPNPEPLPGKQPDPNPQPLPGPQPDPKPQPLPEPKPHTNPQPLPDPQPDPNAQPLPGPHPDPNPQLLPGQNLQQLMNPRPNTKPWPLPDPRAKPNPRPLPGPQPDRNPQPLPDPNPKPLPDPQPNPNPKPLPGPQPDPNPQPLPEPNPKPLPDPQPNPNPQPLPGPQPDPNPEPLPDPNPIPLPNPQPNPNPQPLPGPQPNPNPQPLPDPNPKPLPDPQPNPNPQPLPGPQPDPNPQPLPDPNPQPLPDPNAQPKPPLGTQAEKGNGEANVQE

SEQ ID NO: 128056 - protein, 106 aa, Triticum aestivum
  unsure (1)..(106): unsure at all Xaa locations
  Clone ID: PAT_TA_22474.pep
PPPPPPPPPPPPYAPPYPLPDPEPXPEHPPDPPPPPPPPPPPPPPPPPPXPPHAPRPCGARRCGGRQGRRAPDAWGWPPSGCAPPAGSVRVPSRHKPFGGGPRAAT

SEQ ID NO: 128057 - protein, 371 aa, Triticum aestivum
  unsure (1)..(371): unsure at all Xaa locations
  Clone ID: PAT_TA_22475.pep
MAMLVDPPNGMGNQGKHYYSMWQTLFEIDTKYVPIKPIGRGAYGIVCSSINRETNEKVTIKKIHNVFDNRVDALRTLRELKLLRHLXHENVISLKDIMMPVQRRSFKDVYLGYDLMVSELRQHSQSRLIGLHYKHLCRDISFQLLQGQKNRIWISSCYGPLLGVCILLCASCGLKKNCXSHSSTNSSKGQFMTEYVVTRWYRAPELLLCCDNYGTSIDVWSVGCIFAELLGRKPIFPGTECLNQLKLIVNVLGTMSESDLEFIDNPKARRYIKTLPYTPGVPLASMYPHAHPLAIDLLQKMLIFDPTKRISVTQALEHPYMSPLYDPSANPPAQVPIDLDIDENISSEMIREMMWQEMLHYHPEAATAVNM

SEQ ID NO: 128058 - protein, 317 aa, Triticum aestivum
  Clone ID: PAT_TA_22476.pep
CISVHTGSHCYFLRGNREISYSQKLDPDDDKAYTGGKVAVKAVHDGVNVFFMLQVDGDYAYTKGESKKCPSVALMFQVGEKATYYNMGGCKDLPGSCTRKSCRDHEVDIMHFSVGNAIPGRLYGGNHIDNAAGNGGDRFGHLVDVYAWNPHCRYLDGIGPKENNSNAQNDWHGAWWHSSLTFHSGFVDDDSPYGKKDDKGTYYFEFSRPLRTMDQFQQDAQFTIGEPSNMAVAFWYPTDGKPWSNSQHYSASCDWVTLDIQPSLEAARYRPAPNRSWDAATAFALLLSVVAVCVSIFVGYSASKNKSGVQFTQLAQI

SEQ ID NO: 128059 - protein, 85 aa, Triticum aestivum
  Clone ID: PAT_TA_22477.pep
PSRSALSPSRSPSHRGSPPATHHGHAPPARSSSHGREPISSFPSSASLRVGDCSSSLPCVLYRQIHGHGGKMQRARLPHRHQALW

SEQ ID NO: 128060 - protein, 147 aa, Triticum aestivum
  Clone ID: PAT_TA_22478.pep
LPSAQPCARVLGRRVRNGDLLRPGLDLLRPGLGLPLLLTYIGAGEVKRRRDGGPRRRGEGGRLAAAAAARRRAKSTNCGHGGAVHMLDDELRCRRVPSISLQYIPPTSQIFLMCAAAKQEPRRQAHLGAARMLKPPPPPELHCSRPF

SEQ ID NO: 128061 - protein, 146 aa, Triticum aestivum
  Clone ID: PAT_TA_22479.pep
MARIAPLLLVALLSLAVQLPPSAACPSCPKPKPPPPPPRKLTPPPSVPCPPPPHSPKPTPPHTPTPKPTPPHTPTPMPTPPHTPTPTPTPPHTPIPPHPPTPAPTPPRAPTPPTPPPPPQLRRLASPRAHTRPAPPPVPSPAPALQ

SEQ ID NO: 128062 - protein, 148 aa, Triticum aestivum
  Clone ID: PAT_TA_22480.pep
SSSSACKLVVGTSSVVGVIVDDGVCLLGFQHLVSLARRDRQLRSRNGGSSSVGLVVYSEPVDEQGGLGEGSTLPESMTKFVGVEEEDDVTGLDAGVPGSNRSMWMTKQPTVELTDAVARFGVLCGYACGMAAMTAAASTAGEDATAHG

SEQ ID NO: 128063 - protein, 216 aa, Triticum aestivum
  Clone ID: PAT_TA_22481.pep
PTRPTGSLLQPQALSAFSTPAMGCNLFILDSNGNPLPQDSAGIGELALDPTLFGSSTTLLNADHHEVYFSGMPEWNAKVLRRHGDEFERTTEGYYRAHGRADDTMNLGGIKVSSIEIERICNRRNDAILETAAIGVPPVGGGPEQLTIAVVFKDQSPQAEDLNQLKLMFNSALKKLNPLFKVSSVVVVPSLPRTASNKVMRRVLRKEFTQAKHSKI

SEQ ID NO: 128064 - protein, 141 aa, Triticum aestivum
  unsure (1)..(141): unsure at all Xaa locations
  Clone ID: PAT_TA_22482.pep
GLHADYQSPPPPSRSRGGTPACTEAIGRPGLARVLPQKLSQPAGSLQLSSPPRPTNPWRSAGRSWLPGWPTISHACACDDERLEMISAGDHGNDRRKFEPXGGRQQGPASGGGGSRHWVGVNRVPDRARAPVFGGKDRHTR

SEQ ID NO: 128065 - protein, 443 aa, Triticum aestivum
  unsure (1)..(443): unsure at all Xaa locations
  Clone ID: PAT_TA_22483.pep
MIRAASPRPPSAVRVRSRGASSCCSACPFRARGSGSRVAATSGRRRRNVISCCSSDDREGARGAAPPAPSDGSIQLYSQIEKVITEAAKQSNQGWSSTGDWIEIEGAWVLRPKSSAPSFVVHFIGGIFVGAAPQVTYRYFLERLADKGALVIATPYASGFDHFFIADQVQFKFDRCLRNLVEPVNDLPTFGVGHSLGSVIHLLIGSRYAVQRSGNILMSFNNKEASLAIPLFSPVIVPMAQSFGPILSQLTSSPTIRFGAEAAIKQIENLGPPVVKQLLPLIQQLPPLYMDLVKGREDFIPKPEETRRLIKSYYGISRNLLVKFEDDQIDETSIIAQVLSSESAISSLLDMSIRSLPGDHGLPLQQVLPDVPPGMADAVSRGGELLANLTTGTPWEAVAKEVGTTFGTDSGVLRTQVXEDVNALVDVIVSWIASNSGPKLLRS

SEQ ID NO: 128066 - protein, 143 aa, Triticum aestivum
  Clone ID: PAT_TA_22484.pep
MVRAPRLPEMTRRRRGGGAIGRKRLMCSAKEVDECCTSVAVKGHCAMYTADGRRFEVPLAYLSTTIIGELLRMSQDEFGFTSDGRITLPCDAAVMDYVMCLLRRNASEEVERAFLSSVVRPCHYGNGLEPSMGVSQQVAVSGF

SEQ ID NO: 128067 - protein, 231 aa, Triticum aestivum
  Clone ID: PAT_TA_22485.pep
MEYQGQQQRGRVDEYGNPVAGHGVGTGMETHGGVGTGAAAGGHFQPMRDEHQTGRGILHRSGSSSSSSSEDDGMGGRRKKGIKEKIKEKLPGGHGDQQHTGGTYRQQGTGMVGTGGTYGQKGHTGMTGTGGTYGQQGHTGMTGTGGTYGQQGHTGMTGTGGTYGQQGHTGMAGTGAHGTTATGGTYGQPGHTGMTGTGAHGTGGTYGQHGTDTGEKKGIMDKIKEKLPGQH

SEQ ID NO: 128068 - protein, 211 aa, Triticum aestivum
  Clone ID: PAT_TA_22486.pep
YIPRLSQSEFIGPYWKFTKSFSQPFSVGSRFKMRYESEDAAERRYTGIITGTGDADPMWRGSKWKCLLVRWDDDGELGRPNRVSPWEIELTSSASGSHLAAPTSKRMKPYLPHANPEFTVPHGGGRPDFAESAQVRKVLQGQELLGYRTHDGTAVATSQPCEARNLQYIDERGCSNNGSNNVLRGVPSHGVKTPLGIPYHCSGFGESQRFQ

SEQ ID NO: 128069 - protein, 73 aa, Triticum aestivum
  Clone ID: PAT_TA_22487.pep
HRDAYSWHGRELPSRRSPSPEQSRGLGTRGKTRSSLSRRLIPEGAAQVRRTPGESLAGSRQPAAGRHQPPCCK

SEQ ID NO: 128070 - protein, 347 aa, Triticum aestivum
  unsure (1)..(347): unsure at all Xaa locations
  Clone ID: PAT_TA_22488.pep
MRLPGGARLALLLARRSLSTAAASSARSSSLHASRAHRARWGDAARAPPSWRPPFSSPSRFFHGTRPVAVRDYYDVLGVRKDAGQGEIKKAYYALAKKLHPDTNKGDADAEKKFQEVQKAYETLKDEEKKAVYDQVGPDQYERAAAGGGGAGGFEGGFGNPFEDIFNAGRTGGMNDFLRNIFKDRESGGQDXRLSLSCHLWKQLKDAKRQSXFQTLVTCETCNGAGVPAGTKPETCLACRGSGYMVLQTGPFRMQSTCTQCGGSGKTVKDFCKSCRGKKVVPGIKTVSIDIAPGTDDEDVMKVLRSGQADPDGLRAGDLYVAIKVREDPVFRREKGDIHVDAVLNVT

SEQ ID NO: 128071 - protein, 377 aa, Triticum aestivum
  unsure (1)..(377): unsure at all Xaa locations
  Clone ID: PAT_TA_22489.pep
CCYQLDNDRHWSNCVTGVDEEGRSRQRILTFAAKRYNNTIERHSEHPDAFGTCALVLRERAENVDPNSDSSKDSLLEEACKRYAEATRNCPTRYDAYCNWASASAXLRGRPGGAEELWQQAIRNYDKAVQLSWNSWNSPKNWGLGLQELKEIGAIDPAKDKQTIIKTAISKFRSAIQLQFDFHRAIYNLGTVLYGLAEDTSRSGGADTSPNDLYSQSAIYVAAAHALKPNYSVYRSALRLVRSMLPLPYLKVGYLTAPPADDPIAPHKHWERSQFILNHMELQQVNDSESAPVKANALVEKAKRFIKVDVADIVSVSTCSDLTLPPGAGLCINTTHGPVFLVADTWESLDGWLDAIRLVYTIFARGKTDVLAGIITG

SEQ ID NO: 128072 - protein, 456 aa, Triticum aestivum
  Clone ID: PAT_TA_22490.pep
MKERGGSRAAVDERYAQWKSLIPVLSDWFANHNLVWPSLSCRWGPQFEQATYKIPKRLYLSEQTDGSVPNTLVIANCEVVKPRVAAAEHISQFNEEARSPFVKKYKTIIHPGEVNRIRELPQNSRIIATHTDSPDVLIWDVESQPNRHAVLGATDSRPDLILTGHQENAEFALAMCPPAPCPPAPDVLSAGVDWSVLGRSSALGDSSLGDSSPGASGSKQSGKTATEKESPKVDPRGVFHGHDSTVEDVQFCPSSAQEFCSVGDDACLILWDARTGTSPAVKVEKAHGGDVHCVDWNLHDVNYILTGSADNSVRMWDRRNLGPGGAGSPIHKFEGHKAAVLCVQWSPDKASVFGSSAEDGFLNVWDHEKVGKKKNPNSPGGLFFQHAGHRDKIVDFHWNSSDPWTIVSVSDDGESTGGGGTLQIWRMSDLIYRPEDEVVSELETFKSHLASCTPRA

SEQ ID NO: 128073 - protein, 152 aa, Triticum aestivum
  unsure (1)..(152): unsure at all Xaa locations
  Clone ID: PAT_TA_22491.pep
NSTNAYILYFSSKYKTCSWVKEEQFEAFGGQVHESSEAEREEEESEEEPAAVVEGNGSLGGRKERIRDSLERGLSPVELKIEDISYQHSGHAGVAGSDGETHSNVRVVXSKEFEGKXHASRXRRAVDDLLQDELKSGLXTRLSIDAKTPCEV

SEQ ID NO: 128074 - protein, 122 aa, Triticum aestivum
  unsure (1)..(122): unsure at all Xaa locations
  Clone ID: PAT_TA_22492.pep
MGFELDGESYLSGDQLNDEACSTISSXXTRGFQYQGSERGLPTCFPDTDLTTAKNLMEARGIKQLPVVKRGVGHRTERRRKLVALLYYDSIGHCLREEIENWKAIYQRKEDFHILATGHTLQ

SEQ ID NO: 128075 - protein, 141 aa, Triticum aestivum
  unsure (1)..(141): unsure at all Xaa locations
  Clone ID: PAT_TA_22493.pep
GSVHHRQRRTDAAAPSKKLHRYVCLVWLTPLLRECFWSPLDLPXGHGGVWTVILLLELPGSVNLPVGMVVFGLLYSRWSCLGPLSLEVCVILVSPDPAPRRLRCPCRWGSSVPDPPTLXFLSVSYVGLSVNLXSYLNGRVC

SEQ ID NO: 128076 - protein, 189 aa, Triticum aestivum
  unsure (1)..(189): unsure at all Xaa locations
  Clone ID: PAT_TA_22494.pep
SIWIGGAYARFRRCLTRPGSVPIALTPSPWTSPPRPQPPIAGPHRLPLFPELDALLPENLAGGHDARATPPACILSVRRLRPRPPPPRPTANPLYARPQRLLLGTPVIRLHRRRXLLLPERTRCWSPGARXHGRRRLLHGRCYYNFKLLTPQEVFKGNQEGGCPSISAPCAARSYGLLSGRXRCSPASS

SEQ ID NO: 128077 - protein, 307 aa, Triticum aestivum
  unsure (1)..(307): unsure at all Xaa locations
  Clone ID: PAT_TA_22495.pep
MGKRAIRYAXVVDAFAAEPFKGNPAAVCLLEEEGASAAMDDRWMQSVAAEFNLSETAFLARDSSGGAGAAPRFHLRWFTPVTEVDLCGHATLASAHFLFTTVLPEHGKLEFMTRSGILTAKKVPAPGSTGVPGEEQGKLFIELDFPMIGFLECNEMLSIPETLNGAPIVSVHKSATDGDLIVGLSSGKEVVDILPSIDEIKNLACRGLIVTGPAPAGSGYDFFTRFFCPKFGIDEDPVTGSIHCVLXAPYWGRKLGKQKLTXFQASPRGGTLYLQLDDQIREANPGEVFRVGGPLPPPRSLVVRHIA

SEQ ID NO: 128078 - protein, 179 aa, Triticum aestivum
  unsure (1)..(179): unsure at all Xaa locations
  Clone ID: PAT_TA_22496.pep
ETYRERFSDKHFDLETVLHAKIRPLTVAPNKSFVGFFQPESAEDGSGFDFLDGAMSFDNIWEEISQAAEASSTEKPTLYVVSWNDHFFVLKVEADAYYIIDTLGERLYEGCNQAYILKFDDSTTIHKEPAEKKEGSPDSSAHHKDSAESSSTEQDSGTDDTEESVLVXXRGKEACKEYI

SEQ ID NO: 128079 - protein, 152 aa, Triticum aestivum
  Clone ID: PAT_TA_22497.pep
MSTPARKRLMRDFKRLMQDPPAGISGAPQDNNIMLWNAVIFGPDDTPWDGGTFKLTLQFTEDYPNKPPTVRFVSRMFHPNIYADGSICLDILQNQWSPIYDVAAILTSIQSLLCDPNPNSPANSEAARLFSENKREYNRKVREVVEQSWTAD

SEQ ID NO: 128080 - protein, 86 aa, Triticum aestivum
  Clone ID: PAT_TA_22498.pep
EQANGADSEAQDPLRGCRRLRHGQHGLRGRWTSSGPGLRRLSGRPGCRHGVLDRTRPRLLLLRTLDDVGRAHNHFRTFFGSSRVHT

SEQ ID NO: 128081 - protein, 127 aa, Triticum aestivum
  unsure (1)..(127): unsure at all Xaa locations
  Clone ID: PAT_TA_22499.pep
SGGVFLSSTWPATYLERXAYGALRRALVSSIESQGVTPVDAEDLHQLCYRRWSCRDGPEPGLTLVFDGVNATMEVKPENYFFKDGLKVCLTVLPSKGGSVLGSLLQTGTNMIFDIAGGLLTFETPTP

SEQ ID NO: 128082 - protein, 212 aa, Triticum aestivum
  unsure (1)..(212): unsure at all Xaa locations
  Clone ID: PAT_TA_22500.pep
MAMGAAATAAACFSSASSGVSRCRVRAQATSWAGGAEELVRSGAVKAVRPRDAAEVMGSEGFQLLDVRPAWEHDRAVVRGSVHVPLFVADDYMGPXTLLKKWVHLXGYIGLWTGHSFTKMNDRFPRRRRRRRRRGKDAKLLVACGEGLRSLIAVRMLHDDGYKNVAWLAGGFSKSVDDDFAELEGESKLRYATIGGVSYIFLQILLLLRVVQ

SEQ ID NO: 128083 - protein, 251 aa, Triticum aestivum
  Clone ID: PAT_TA_22501.pep
TTEVGTKIKKRKWQAVLGLSTAFSPPRRSWIAVRLRNGATGRSGGGLSLRRSAAAAVAVRAEVSFVDGDEAKRLVAEEGYTVLDVRDRRQYERAHVRASAHVPLYIENEDNDIGTIIKRQAHNNFAGLFYGLSFTKLHRDFTKTVRSKFSPESKLLVVCQEGLRSTAAADALERACFQILACITSGLQTLKPGTLETFGKAELQNAGKAGLVTIQGKISIVLGTVLITLLLLITVFPDQAEQIFESAGIKL

SEQ ID NO: 128084 - protein, 228 aa, Triticum aestivum
  Clone ID: PAT_TA_22502.pep
QPHHPAALGTLSSPSHYHTTIIIANELAACRWPWRSADRCRTSTPRRRTMGAAAGTTARTIPWSRPRYPHHHHHPQQGAGPAPVAMEKGGAVPRDHATAPYYRGGGGHASRFHGPGRRGAQAVKLQRPSAVEDPAAKRRRRDCRRATMFARREARLISSVRVIPMAQVQAIGTPLRWPLKLFPQPATNSSMKLNLFYIHCVHAALKEVIYVCGCLVASAAFYTCKHGP

SEQ ID NO: 128085 - protein, 159 aa, Triticum aestivum
  Clone ID: PAT_TA_22503.pep
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKEGKAPKSPKKTAKSPKKAATPKKA

SEQ ID NO: 128086 - protein, 224 aa, Triticum aestivum
  unsure (1)..(224): unsure at all Xaa locations
  Clone ID: PAT_TA_22504.pep
PGRFGRLVLADINECQDERYPCSVPDTCVNTIGGYSCVCPEKTSGNAYNGTCEQDKSQIGWEIAIGSGIGVIVLIATASCAYMIYAKRRLAKIKREYFEQHGGLTLFDEMRSRQGLSFKLFTQEELEEATGRFDERNVIGKGANGTVYKGTTKDGDLVAIKKCRLASERQQKEFGKEMLIVSQINHRYIVKLYGCCLEVEVPMLVYKYIXNGTLYRLIHGRRER

SEQ ID NO: 128087 - protein, 147 aa, Triticum aestivum
  unsure (1)..(147): unsure at all Xaa locations
  Clone ID: PAT_TA_22505.pep
GEMGLAFGKLFSRLFAKKEMRILMVGLDAAGKTTILYKLKLGEIVTTIPTIGFNVETVEYKNIXFTVWDLGVRTSLDSLEXYFKNTKXSNFVXDNNDXDRFCXTKXXSXXIXNXGXFAHPXXLVXPXKQIFQIQXXAEIXENLDKSL

SEQ ID NO: 128088 - protein, 186 aa, Triticum aestivum
  Clone ID: PAT_TA_22506.pep
MAAMATALSASLPHLPPRRLPSSPAASVSLAPRGLRRREAPPRLAAVASASEVLDSTNGAVPAPASPAPSGQQQYGREYFPLAAVVGQDAIKTSLLLGAIDREVGGIAISGKRGTAKTVMARGLHAMLPPIEVVVGSIANADPNIPEEWEDHLADQVQYDADGNVKSEIVKAPFVQIPLGVTEDRL

SEQ ID NO: 128089 - protein, 301 aa, Triticum aestivum
  Clone ID: PAT_TA_22507.pep
AESVKEKIGREEREREKEREKDKLAVERATREAQAVERAIREAHERSFNEAREKAEKMALERIAAARQRASAEAKLKEERANAEARIKAERAAVERATAEARERAIKKAKAEKAAAEARERREQIRSSSKDVRQDNQFQRATSSGFVRNTDSSSKVVDSESALRHKARIERHQRTTERVSKALAEKNMRDLMAQREQAEKNRLADFLDPEVKRWSNGKEGNLRALLSTLQYILGADSGWQPVPLTDLITAAAVKKAYRKATLCVHPDKVQQRGATIRQKYICEKVFDLLKDAWNKFTSEER

SEQ ID NO: 128090 - protein, 113 aa, Triticum aestivum
  Clone ID: PAT_TA_22508.pep
KKNDHHQQHTQRGSILSKRGFLFIPFLRVSFVRRCCVDIMSVNLVLRRVFPDEDGDGPCSCAGPSSCSSHHRHVTMVVLVKKRMEGRMKKVCTYINLLVMQLYHVIELHKLIQ

SEQ ID NO: 128091 - protein, 62 aa, Triticum aestivum
  Clone ID: PAT_TA_22509.pep
LGHRRRAHHHHIPTTYSNSNSHSFAPSYTHAAPAVRIQGFDVAAARGSHDTNGGVQQHSDRA

SEQ ID NO: 128092 - protein, 144 aa, Triticum aestivum
  Clone ID: PAT_TA_22510.pep
HESTPSVAALLRQLGELERTVRSLQGAGAEGVGDGRRHRRTASEGGGRRVEESVAVVKESADPLADFRRSMLQMIVEKEIVGGADLRELLHRFLSLNAPHHHHLILRAFAEIWEEVFSGYERTPDFLVSHSHGRKRLPAANSLR

SEQ ID NO: 128093 - protein, 221 aa, Triticum aestivum
  Clone ID: PAT_TA_22511.pep
MPTAHMASAYLSSFQQAAPTATSGGAGASPRPRPRAVACHASEPSGTGRRSACLRLGIGLATSVVPVLHTAPARATADADEDPEPANNGWWLTEFPLPVPKIRNKEINNGESGTRSFVKNGIYMADIGPSFAAHAYRIRSSAFDLLALEDPARPRRSSNSVTKSIPPKASFTYYHFDKPTTAAHADVRPTLPRASRPPLRQLQGSCTPGHHHHGLARKLAR

SEQ ID NO: 128094 - protein, 622 aa, Triticum aestivum
  unsure (1)..(622): unsure at all Xaa locations
  Clone ID: PAT_TA_22512.pep
MEWDSDSDGSGEEDEEEEEGEGGTGPWGADGCRGGGGFSLAIEGVLXAPCGLVVSDALEPDFPIIYVNRGFEDATGYHAEEVLGRNCRFLQCRGPFAQRRHPLVDAIVVTEIQRCLEEGTGFQGDLLNFRKRVVPQFMXSLQLKAHIWENDETITHYMGIQFFNDCNVDLGPLPGSMAKEVVRSIWITPDNTLRPSPTGKGNFCSEYSHLFQLSDEVLCQKILSRLSPRDIASVNSVCKRLYHMTKNDHLWRMVCQNAWGNDATRALENVAGTKSLAWGRLARELTTLEAVTWKKLTIGGSVEPSRCNFSACAVGNRVVLFGGEGVNAQPMNDTFVLDLSASKPEWRHVNVGLAPPGRWGHTLSCLNGSLLVLFGGCGGQGLLNDVFILDLDAKHPTWREIFGLTPPVPRSWHSSCTLDGSKLVVSGGCADSGVLLSDTHLLDVTMERPVWREIPAPWTPPSRLGHSLSVYDGRKILMFGGLAKSGPLRLRSGDVFTMDLSDAAPSWRCITGSGMPGACNPAGVGPPPRLDHVAVSLPGGRIMIFGGSVAGLHSASQLYLLDPTEEKPTWRILNVPGRPPRFAWGHSTCVMEGSKAIVLGGQTGEEWTLTEIHELSLASSLV

SEQ ID NO: 128095 - protein, 63 aa, Triticum aestivum
  Clone ID: PAT_TA_22513.pep
RVGHLGCTCGSARRASCRCSMHSPRGPACCRHYSRIRLRTPAIRRRAVLVDSAHRTPSRGGAR

SEQ ID NO: 128096 - protein, 58 aa, Triticum aestivum
  unsure (1)..(58): unsure at all Xaa locations
  Clone ID: PAT_TA_22514.pep
ANIXQFDPNTTRSINPDEVYCVAPSVYKFHIFSRILGPDLTYKILHPISVVALQIIKT

SEQ ID NO: 128097 - protein, 180 aa, Triticum aestivum
  Clone ID: PAT_TA_22515.pep
TVNEPHNFAIGRVGFGIQAPGRCSIISHLFCKEGTSSTEPYIVAHNILLAHAGVFHAYKQHFKKEQGGLIGIALDSKWYEPLSDVDEDREAAARAMDFELGWFLDPLIFGRYPASMQKLVGDRLPQFSNQESQLVSGSLDFVGINHYTTLYARNDRMRVRKLVMNDASTDAAVISTAYRH

SEQ ID NO: 128098 - protein, 132 aa, Triticum aestivum
  Clone ID: PAT_TA_22516.pep
WRGGGGLPRPTEAPRPYELVFAEAELRSMDCNLSTLCDNVQAEGFGSSGFSNAVVKAMGVTYRLHRLLISRNTYFRWASFSNIDAATEYLGFHILSMHQYVYWAAPCGCFSMSHPLPSASSTLYMRRLTPKS

SEQ ID NO: 128099 - protein, 100 aa, Triticum aestivum
  Clone ID: PAT_TA_22517.pep
CPILLTLPLNHGDEFSTVSTPPSIPQQHEFFPPLSERALRATKPPQDARAMSIELKHIANVKHNITGLIYIAHVRHVSHKAQKIIIKGMQHEDFPGGHPS

SEQ ID NO: 128100 - protein, 107 aa, Triticum aestivum
  Clone ID: PAT_TA_22518.pep
MAEAAQGGGLRGRGVLLGGVQDAPAGRENDLATIKLARFAVAEHNTKANALLEFERLVKVRQQVVAGCMHYFTIEVKEGGAKKLYEAKVWEKAWENFKQLQEFKPAA

SEQ ID NO: 128101 - protein, 107 aa, Triticum aestivum
  Clone ID: PAT_TA_22519.pep
MAEAAQGGGLRGRGVLLGGVQDAPAGRENDLATIELARFAVAEHNTKANALLEFERLVKVRQQVVAGCMHYFTIEVKEGGAKKLYEAKVWEKAWENFKQLQDFKPAA

SEQ ID NO: 128102 - protein, 137 aa, Triticum aestivum
  Clone ID: PAT_TA_22520.pep
SEPAPGRGSKRRLGPGPGPPEGRIGSWFCRIPAGKRLAINRGKTRTNTVPYGLPSQLTMFRSSSRWPKERKQRKRSSSGRQIINVGKRKAKPRANGAARGRVDSSPCAQARVVAMVACARTNLAVTSSRSGDEQLAS

SEQ ID NO: 128103 - protein, 386 aa, Triticum aestivum
  Clone ID: PAT_TA_22521.pep
ASPLRVDSDSLQRQIDELASFSDSPAPSVTRVLYSDRDVQARRYIKGIMKQLGLSVREDAVGNIFGRWVGSEAELGAVATGSHVDAIPFSGKYDGVVGVLGALEAISVLQRSGFQPKRSLEVIMFTSEEPTRFGISCLGSRLMAGSEELVQSLKRTVDNHNVSFVDAADSAGYKIHPDDLHNVFLNQDAYFAFIELHIEQGPILEKEGIPIGIVTAIAAPASIKVEFEGNGGHAGAVLMPARNDAGLAAAELALAVEKYVLESGSIDTVGTVGILQLHPGAINSIPSKSHLEIDVRDIDEKRRNYVIEKVHKSAIDISKIRGVELSEFKIINQDPPALSDKSVINAMEFAAKQLGLEYKLMISRAYHDSLFMARVSPMGRSFPPLG

SEQ ID NO: 128104 - protein, 116 aa, Triticum aestivum
  Clone ID: PAT_TA_22522.pep
SQRSGAARKLLDRKQQGMLGATDARGHGLAAEPQGPGALALPPAGRQEQLAREVLRRLTGDAVFFVMRETELELVGIRRSRGEPAALRLVTAAVQASVLSLPPARLTGAEGVFSAG

SEQ ID NO: 128105 - protein, 98 aa, Triticum aestivum
  Clone ID: PAT_TA_22523.pep
GRASYSRRLRRSWPASSSSCSSSPRSSPAPSTSATSRIGRRARASAGRRGSPTPEAARTRTGARTEPTAARWYTNTSQVVLFLPNKLRAQVIKSRLFM

SEQ ID NO: 128106 - protein, 107 aa, Triticum aestivum
  unsure (1)..(107): unsure at all Xaa locations
  Clone ID: PAT_TA_22524.pep
MAAPSPAVAAVSSAPSSGLLPARRAAPCSAVQVQLPSIRRAAPGGRMATVARAVGDVGAEGNTYLIAGAGFVRXSGSTLRANAARKDQAQIVCANCNGLGKLGQIDK

SEQ ID NO: 128107 - protein, 212 aa, Triticum aestivum
  unsure (1)..(212): unsure at all Xaa locations
  Clone ID: PAT_TA_22525.pep
NNARRSLPRPGRPISHRSRNHTRRSFPRRSQPPTPASKQWPAPSPAVAAVSSSAPSSGLLPPRRAAPCSAVPLPSMRSTAPGVRMATVARAVGDVAAEGNTFLIAGAVAVALVGTAFPIFFSRXDTCPECDGAGFVRKSGSTLRANAARKDQAQIVCANCNGLGKLGQIDNVEASCCAYMYIDPPSRRSIVSSVFLLLLLPCSCSLVGTRES

SEQ ID NO: 128108 - protein, 174 aa, Triticum aestivum
  Clone ID: PAT_TA_22526.pep
MKRAAPSEEPVELSSGDDLSSDSDDEAGNGKGENSFRLPMSSKSTAPAKGALIRRAEMYQEYMKHIPIPDHCSSLIPSTSWLGLGRSVKQLYEQPLHYLTNILLRQWDQQRVGSDNEHQPLDAIIHPMKAQALIWATEEVHRLTTSSDHLEKVWAKDPMYHANIDPVFPSLKLH

SEQ ID NO: 128109 - protein, 180 aa, Triticum aestivum
  unsure (1)..(180): unsure at all Xaa locations
  Clone ID: PAT_TA_22527.pep
LTGAIPPSLADLISLSSINLRRNRLSGAIPSLLLSKSPNGAYLQLSHNNLSGAIPTEFAAVNFSYVDLSRNALSGXAACLFGADKALQHLDVSRNALNFDLSAIEFPEQLTYVDLSHNTIRGAIPTQVATLTGSSIQREFNRLCGPCPPAATCPVRPLQYSITSASAPRRSRLPPAVGTH

SEQ ID NO: 128110 - protein, 276 aa, Triticum aestivum
  unsure (1)..(276): unsure at all Xaa locations
  Clone ID: PAT_TA_22528.pep
GIEQAERLTLSSRAFYNDKFPVFAEYLTSMFGYDMMLPMNTGAEGVETAIKLARKWGYEKKNIPKNEALIVSCCGCFHGRTLGVISMSCDNDATRGFGPLVPGHLKVDFGDIDGLEKIFKEHGDRICGFLFEPIQGEAGVIIPPDGYLKAVRDLCSRHNILMIDDEIQTGIARTGKMLACDWEDVRPDMVILGKALGAGVVPVSAVLRXDRRSVLCIKPGEHGSTFGWKPIGKCCGIPSLKGAKDEGLVERPPVGRQAFTFQSQQIPQITRNTGKL

SEQ ID NO: 128111 - protein, 248 aa, Triticum aestivum
  unsure (1)..(248): unsure at all Xaa locations
  Clone ID: PAT_TA_22529.pep
MPTPQAKNPIPPSHPPPSTPAANSSNPRRPTPTLAGACACDASAPASATGGAVMVGFFRSGNLASRVFDRQFLSPRPGATVNTVRQFYENLVPSYTIYDIDCPDYSFRKFTDDGKYLVAFSRNHQDLIVYRPIWLTFSCHEECDSHDLPANAERFDSFFKQLYSISLASSNEYICEDFFLYMECHQYGLFATSTAQSNDSSXTEGAIHGVPSIEKITFYLVRLXDGAILDEKAFCNDFINLAHSNWCI

SEQ ID NO: 128112 - protein, 141 aa, Triticum aestivum
  unsure (1)..(141): unsure at all Xaa locations
  Clone ID: PAT_TA_22530.pep
XRKASLATPDKVLFLKYEEIKEDSVGVVRKLAVFLGVPFSQEEESSRVPEEVARVCSFETLRSLQVNQVSVVNEHGNHRFPANSAFFRKGQVGDWANHMSREMGEKMDQITKENSRDLDSHSHLHFWFLSAQLCSYSDISD

SEQ ID NO: 128113 - protein, 108 aa, Triticum aestivum
  unsure (1)..(108): unsure at all Xaa locations
  Clone ID: PAT_TA_22531.pep
EDWLVVFSFLRIVFCFCLAVGRKWAILFFPNHRYGKGTISFSAGFFLVLIGXPFFGMLLEAYGFFLLFSGFWPTLAVFLQRIRILRWIFRQPFVTSFLDRYRGKRVPV

SEQ ID NO: 128114 - protein, 250 aa, Triticum aestivum
  unsure (1)..(250): unsure at all Xaa locations
  Clone ID: PAT_TA_22532.pep
EVLKSAGVSSNPQESTANAEPEISAAEKQELQNKMAKLLAMLDEVDRSVRHYFHQMQIVVSSFDMIAGSGAAKPYTAVALQTISRHFRCLKDAINDQVNVIRKKLGEEDSSSGREGKLTRLRYIDQQLRQQRAFQQXGMLQQNAWRPQRGLPXNSVSILRLXLXFEHFLHPYPKDSEKLMXARQTGLTRSQISNWFINARVRLWKPMIEDMYKEEXXEAELDSNSXSDNLPRSKDKRPSCEDREDLKWLM

SEQ ID NO: 128115 - protein, 61 aa, Triticum aestivum
  unsure (1)..(61): unsure at all Xaa locations
  Clone ID: PAT_TA_22533.pep
SSFSMFSNMITGNARVHSPERQARVPYIGRRHLHRAPSTRAGTCPRWLTLRPLPPNGPPXW

SEQ ID NO: 128116 - protein, 96 aa, Triticum aestivum
  Clone ID: PAT_TA_22534.pep
PPPAPPPWSCPPPPTRGAPAGSRWPAGRPAAATAPPASAAPPAAAPAAAATEPAPRRPAGRGEHEDEEEKQAPSPVHHHPAYQFDHQPLHAPARAR

SEQ ID NO: 128117 - protein, 212 aa, Triticum aestivum
  unsure (1)..(212): unsure at all Xaa locations
  Clone ID: PAT_TA_22535.pep
SFTVPGDPMHEEALSILKKLQIIENDASSGDFCTRREFARWFVKLCSKLERKRMHRIIPNLITSGSVESAFDDVDFDDPDFLYIQSLGESGIVPSKLSSFFGTSANGSQSANTNSNFLPESYLSRFDLVNWKLLVEYPFASELDQKMLSKNVHTLDLSAWPDVTASVFVDLFGGDHSXRXANXLETPRRLQHHKPVQKHNRCALSAEDGRIY

SEQ ID NO: 128118 - protein, 86 aa, Triticum aestivum
  Clone ID: PAT_TA_22536.pep
TQLCHDNLLTRRPRSALTHRTNLLPRLIMHHPLVRTVCIVNSFAACKSLLVVHRTFPILRKLQNFFMRFSRTSKCHMMNLWDFMLL

SEQ ID NO: 128119 - protein, 102 aa, Triticum aestivum
  unsure (1)..(102): unsure at all Xaa locations
  Clone ID: PAT_TA_22537.pep
RQKASGGICKLCKLPVNNVHEPLSSDGPVSPGPLGCTTSATQASRPGATLVLGXSPEVXSHHPIDHFPVIHQGXLTSSWXPILGPDPPPXQHSSTTAETSLG

SEQ ID NO: 128120 - protein, 244 aa, Triticum aestivum
  Clone ID: PAT_TA_22538.pep
MTEYWVSQGNKWCDLCKIFISNNPFSIRTHELGKRHKDNVTQRLSTMQKDGAAKEKEQQQAAKALQLIEAKANKSYQKDLENNQRNTDGDSSAAPGEGWVFDSTSGYYYDKSTGLYYDSNSGFYYSDGLGKWVTQEEAYKWAETSKTNVAQSSTSQPKPAGGSGPVAGIKGGPAPGVVVTKPLNPMRAVKGAPSALAANKRKREDTKKPKVVTKEEEAALRAREAARKRVEDREKPLMGLYKTY

SEQ ID NO: 128121 - protein, 255 aa, Triticum aestivum
  unsure (1)..(255): unsure at all Xaa locations
  Clone ID: PAT_TA_22539.pep
LVVSIPPLPVTCSTNPQVHGGPIIXCQWRXGLKLGCETRREITLDGVKXLRVALGATVHDVLYYMSPIYCQHIIDSVSGQLNXLYMKFLKRNPGYSGKVSLYGHSLGSVLTYDILCHQESLSAPFPTDYFKMEVSSDEGQVGKGPNTIDHDSGVKEHDTSSTSGHSCVDNVNRVDEESTRTDHSLTDKTVLPCVLENVPNNDDALESPIPVDGVQTEVENQVENHQMTYTELPSVAQMLMRHSRSQGPMPDTNPH

SEQ ID NO: 128122 - protein, 142 aa, Triticum aestivum
  unsure (1)..(142): unsure at all Xaa locations
  Clone ID: PAT_TA_22540.pep
LTRLLSEQKFDEAFTMALQRSDVSMVSWLCSQVDLQGLCRLNPVPLNQGVLLALFQQLACDIANDTPLKLQWMTAVAMAIQPTHQMIAAHVRPIFEQVYGVLARQQSVPRNHPTXEANNIRLMMHVINSVMMTTSDMIGRIL

SEQ ID NO: 128123 - protein, 103 aa, Triticum aestivum
  Clone ID: PAT_TA_22541.pep
KILLVATIDRGKSLPPGRSRESTAGGSEKEAGAGLGRSSALSAGAEQSNPGAGGAEKEASAGLGSSSALSVVCISAGNSSNEAPVPLLSRNPLIRKDLPGGYE

SEQ ID NO: 128124 - protein, 97 aa, Triticum aestivum
  Clone ID: PAT_TA_22542.pep
TVVNGLFAHMSMKEQLQAILEASVIIGAHGAGLTHLVSATPDTKVLEIISSFYRRPHFGLISRWKSLEYHAINLPGSYASIPDVTSELGNILKGLGC

SEQ ID NO: 128125 - protein, 171 aa, Triticum aestivum
  unsure (1)..(171): unsure at all Xaa locations
  Clone ID: PAT_TA_22543.pep
MAAPNTYAVHLSSETHKIEAWCESDEALAKQLQEEEDSLATREFAGSVSLEPSSPAVEYRPANNAAQVATEDNVDPDNMSYEQLQAIGEEVGTQSRGLSDDLISYLEPFRNKCNFFSCKKNTDECXICKSNYKSLQKLIRLPCSHCYHAGCITRWLKINKACPLCXYRVFG

SEQ ID NO: 128126 - protein, 139 aa, Triticum aestivum
  unsure (1)..(139): unsure at all Xaa locations
  Clone ID: PAT_TA_22544.pep
MILRNLFSCLCSGSLVPARAPPRGQAPVLDASYIGLIKPNSLVRFRGMVQDMLGXGFYADSLKDXATWRTXKFTDFSPFSMMYPCDSHLWVRHLCHCVPVHKQNLGYWISPWTCLXQMANWLTPEKRDKRRRMGMVMSM

SEQ ID NO: 128127 - protein, 75 aa, Triticum aestivum
  Clone ID: PAT_TA_22545.pep
FITEASTTCMVVGASCGTYSEALQCSMVSHASSYAHLPLQPMHAPQTTCWCFHLDTIGRGRAIRRQQQPGTNDLL

SEQ ID NO: 128128 - protein, 71 aa, Triticum aestivum
  Clone ID: PAT_TA_22546.pep
FFLMFFLLFLTNHQSQRPRAATTWIHLLHQQITVWTTVTIQAKMSITRRFPGAKANSFIISDDDATLLSTR

SEQ ID NO: 128129 - protein, 174 aa, Triticum aestivum
  Clone ID: PAT_TA_22547.pep
EKELHEIGSRAARACKLSLTPRGAERRARPERGHRTPKRTKQREARGNKEGLHKSTHGRPTRTAMDEKRNRTRREAGVAARANRAWGRTAPAAEAVHRERGAPHNEEIRGRPGRAARRPTRAPTDAARAQGGAHGTGDEGDGARRRGEANCARGTTRRRERRRARGGGEARCGG

SEQ ID NO: 128130 - protein, 198 aa, Triticum aestivum
  Clone ID: PAT_TA_22548.pep
VTVDPRALAIFEHASKLVGIDEPKAELIKLLTDKDGVASTQQQVKMVSIVGSGGMGKTTLANQVYQELKEKFKCKAFISVSRNPDMTNILRTLLSEVGCQDYADTEAGSIQQLIRKITDYLAEKRYIIVIDDIWDVKTWNVIKCAFPMTRCSGVIITTTRLSDVACSCHSSTGGHIYNIRPLNVEHSRQLFPRAEFGT

SEQ ID NO: 128131 - protein, 180 aa, Triticum aestivum
  unsure (1)..(180): unsure at all Xaa locations
  Clone ID: PAT_TA_22549.pep
KAQAAGATPHAAPDPHRPASLKQVQRPIADEQPPVLHPCRSHLPHPQQKKRQKHLPMEPKKRTSPNHRSTGPKPRTPWVRILDPPRRLATPKSPAVXPMTTTTNSQDRKHSDPRDQKDPSSSLVPRTTPGERRRRHGHFIPHTXRLLRHDAGAKDTKPRKSRTIYTARHQIRDLPPLRQP

SEQ ID NO: 128132 - protein, 250 aa, Triticum aestivum
  unsure (1)..(250): unsure at all Xaa locations
  Clone ID: PAT_TA_22550.pep
CYPAWAGSAEEEAAAASFVFVGDAKGLSGRLCSSTPLSWNPLALAAAAPGGPGSLFSSSPELTPWLAXPVALVPHALRGNGGTNSSRSRRHHHGTAHLVILDCSILHMNVRAVAETIGQRERQRRRYCRTIRQAHRLLLVGAAYYEGGVLFILLLSYTGRLNLVWLELKQPSLSFPFFCCCCCWVVSLRLSLDHFSYMLEPFTLRALASVGVLRGPLLKGKGDPCFLLNIHRPMAPWAGEELGAWKKQDL

SEQ ID NO: 128133 - protein, 69 aa, Triticum aestivum
  Clone ID: PAT_TA_22551.pep
SVVAAEVQENATDRPTMGDVVSMLGSETMILDEPKQPAYINVRVGNEHASTAPDSDSIRDMALSVTTPR

SEQ ID NO: 128134 - protein, 158 aa, Triticum aestivum
  Clone ID: PAT_TA_22552.pep
ARGTRGPPGPPDVEVYGSLALGQLAPQLLPHVLSKVELVEGDGGVGTVLLVTFLLLGASEPRSHKEKFNVVDHEKYIKEAETVEGGFLDLGFRKYLVRFKVVGKEDGASVIRSTVEYEVDAEHAKNVSFVSTEAMASIAEAITKYIKEQKKSHEQAAE

SEQ ID NO: 128135 - protein, 310 aa, Triticum aestivum
  Clone ID: PAT_TA_22553.pep
MWLTSPSLLSSPLPSRGALVFKKPSASSLAVSTAKRGVRVVAEAAAVSSPASSVSAQRTQPSAAEVARTVVELAPSGTLSVVGADGWPLGVGARFVADAAGAPALCLATAGVTVPDARASFHVEFRQSGARTPQCTFLGALTKPSDKYMLKKLSTRWETKFGEEIDEDRLYLISVERILHMEDFNEGRVWVVPSEYSDAEPDPLRNFAESVVEEMNSEHAEDVHRIYNIYAESDFQALDVKMIWVDRLGFDLHVHSEEGIFAVRIPFSRQVSDQKAVKSSFNMMAHHAWEVDKSYATPEFEKVQFLKKVT

SEQ ID NO: 128136 - protein, 71 aa, Triticum aestivum
  Clone ID: PAT_TA_22554.pep
INPLDFQQKVIHNVDHVINRIKSISPHYLADEEESTTEPPQSVQRGVTELVESALSSRNLCMMDPTWHPWF

SEQ ID NO: 128137 - protein, 231 aa, Triticum aestivum
  unsure (1)..(231): unsure at all Xaa locations
  Clone ID: PAT_TA_22555.pep
AEAVLQICHRDGAEYLVRDLGLLVENATVDQLGTARKITIHQTTTTLIADAASKDEIQARVAQLKKELSETDSIYDSEKXAERIAKLSGGVAVIKVGATTETELEDRQLRIEDAKNATFAAIEEGIVPGGGAAYVHLSTYVPAIKETIEDHDERLGADIIQKALQAPASLIANNAGVEGEVVIEKIKESEWEMGYNAMTDKYENLIESGVIDPAKVTRCALQNAXSVSGMV

SEQ ID NO: 128138 - protein, 223 aa, Triticum aestivum
  Clone ID: PAT_TA_22556.pep
MASANAISTASLLRSFSSQGRLRRSKNGRSSRLVVRADAKEIGFDQKSRAALQAGVEKLASAVGVTLGPRGRNVVLDEYGNPKVVNDGVTIARAIELANPMENAGAALIREVASKTNDSAGDGTTTACVLAREIIKLGILSVTSGANPVSLKKGIDKTVQGLIEELERKARPVKGSGDIKAVASISAGNDELYRAMIADAIDKVGPDGVLSIESSSSFETTVD

SEQ ID NO: 128139 - protein, 133 aa, Triticum aestivum
  Clone ID: PAT_TA_22557.pep
MGTAFSSSSSSSSSTPESRAMALAKAKEIVASAPVVVFSKSYCPFCVQVKKLFTQLGASFKAIELDTESDGTEIQSALAEWTGQRTVPNVFINGKHIGGCDDTIALNKGGKLVALLTEAGAISGSSSKTTVTA

SEQ ID NO: 128140 - protein, 147 aa, Triticum aestivum
  Clone ID: PAT_TA_22558.pep
MKKKKKKKKKKKKKKKKKKNPAFSSSSSTPESRAMALAKAKEIVASASVVVFSKSYCPFWVQVKKLLTQLGTSFKAVEMDTESDGTEIQSALAEWTGQRTVPNVFINGKHIARCDDTIALNKGGKLVALLTKAGAISGSSSKTTVTA

SEQ ID NO: 128141 - protein, 349 aa, Triticum aestivum
  unsure (1)..(349): unsure at all Xaa locations
  Clone ID: PAT_TA_22559.pep
MTDVLGNLIESGVIGRRQGDEMRARERCLGVPEWSSPRKAIVVEKPKPKPKVADASGGAALRLIELYVKISSGLLRVFRCFSSDRPSSRILVEINKKKKKKGKILIGCLKMQKETNLWLERTTVYQLETARHIRIHQTTTTLIADAASKDEIQARVAQLKKELSETDSIYDSEKLXAERIAKLSGGVAVMRQSSKTVSFRERGREECHFPKHAEEGIVPGGGAAYVHLSTYVPAIKETIEDHDERLGADIIQKALQAPASLIANNAGVEGEVVIEKIKESEWEMGYNAMTDKYENLIESGVIDPAKVTRCALQNAASVSGMVLTTQAIVVEKPKPKPKVAEPAEGQLSV

SEQ ID NO: 128142 - protein, 121 aa, Triticum aestivum
  unsure (1)..(121): unsure at all Xaa locations
  Clone ID: PAT_TA_22560.pep
MKGKADTSKKGEGRLKAAGGASKRKKDAAAAGKPKRPPSAFFVFMSEFRQQYNAENPNNKSXVANVSKAAGEKWRAMSDEDKAPYVEKAEQXRRRDYEKTKATFDXRESASSKKKAKTQND

SEQ ID NO: 128143 - protein, 96 aa, Triticum aestivum
  Clone ID: PAT_TA_22561.pep
KLDAIVHDRLANCVSFCQSYFSGFSRDGDLLLHVLQTLFKTLAITFSRMMIFNGITSLYGSILQYARPSSLVRVWVIVSFFTWFIGVVMLGVSPSL

SEQ ID NO: 128144 - protein, 207 aa, Triticum aestivum
  Clone ID: PAT_TA_22562.pep
MAMATARLIHPSMVVSKSSRAPPAPLLLHTHKPLTTALTSSFHFTLHSVDVSKDDKPLDTALETKQEDATAAAAAGDLATPLPGELDAEEDRPKLDPRRFEEQFAVLNTGVHECRSCGYLYDQAKGDPSYPVPSGLPFNKLPDDWRCPTCGAAQSFFDSKSVEIAGFAQNQQFGLGGNSLTSGQKTLLIYGSLLVGFAFFLSGYFLQ

SEQ ID NO: 128145 - protein, 171 aa, Triticum aestivum
  unsure (1)..(171): unsure at all Xaa locations
  Clone ID: PAT_TA_22563.pep
LSYIVQQPGESXRKIWTRFLTKKNQIVNCPDAEALAAFKHSIRDEWLARHLGQEKPKSMAAVTTLMTRFCVGEDSWQARSXNNVSEPGPSEARNSNGKPRRNRHKRRSNGDNTDDTAVNAGFSGSKSGQWKKPFKRSNPGSSSLDRIPDQPCQIHGTPDKPTNHTNRSVRL

SEQ ID NO: 128146 - protein, 284 aa, Triticum aestivum
  Clone ID: PAT_TA_22564.pep
MARFCCFGAGCSELTGHASTTSGKGKGCQGQVKVSYGFSLVRGKTNHPMEDFHVAELAEVKGNELGLFAIYDGHLGDTVPAYLQKNLFPNILNEEEFWTHPDRAITKAYEKTDKAILSHTPDLGQGGSTAVTAILINGSKLWVANVGDSRAVLLKGGEAIQMSIDHDPNAERGAIENKGGFVSNMPGDVPRVCGQLAVSRAFGDRNLKSLLKSEPDVKVEDIDHTAELVVLASDGVWKVMNNQEAVDVVKRYKDPQTAAKQLVAEAVKRDSKDDISCVVVRFKM

SEQ ID NO: 128147 - protein, 84 aa, Triticum aestivum
  Clone ID: PAT_TA_22565.pep
VTSGSKGAGVVFTNMFHSKSAAAAGGGHRAMSEPTTPGMSAVGSPSTAEMTTCAANPAISQQRFTLPFLIPQYDPPLLAWLLFA

SEQ ID NO: 128148 - protein, 97 aa, Triticum aestivum
  Clone ID: PAT_TA_22566.pep
LLMLDTCAKSSSWRKEFDMRTAVAYGVAVSVSELLEEAAVCCFSCLDCKGHVVYAWVVDCFRHLRSQSSHILTYFEAKFFPKKKKKKKKKKKKKKNS

SEQ ID NO: 128149 - protein, 159 aa, Triticum aestivum
  Clone ID: PAT_TA_22567.pep
MAAAAGGDEVKLLGVWDSPFVNRVQIVLNLKGISYEYVEEDLHSKGELLLASNPVHKKVPVLIHNGKPIPESQVIVQYIDEAWRGTGPSVLPADPHQRATARFWAAYVDDKVGSPWFTILFARKTEEKMEAAVRAISAMETLEGAFGESSGGKPFFGGD

SEQ ID NO: 128150 - protein, 103 aa, Triticum aestivum
  unsure (1)..(103): unsure at all Xaa locations
  Clone ID: PAT_TA_22568.pep
RAEDALLCLKHRFPGLAQTTLDASXIQHNKDVGQAVLESYSRVLESLAYTIVTCIDDVLFADESGEEDLMMMIICSSCLDLDLGPRKPKCRSIHPSNNMCIMP

SEQ ID NO: 128151 - protein, 122 aa, Triticum aestivum
  unsure (1)..(122): unsure at all Xaa locations
  Clone ID: PAT_TA_22569.pep
PTRPPTRPRRSPSLALSSPPSSPWPSPPXPPRSPSSSSTAPPQARTPPRSPSPPPSARPRCAPAPPPPRQPRPSPTTCPPTRLRLVRGREFRCRRRLGRMGRELGHPSRRSESSWRSLLGAT

SEQ ID NO: 128152 - protein, 70 aa, Triticum aestivum
  Clone ID: PAT_TA_22570.pep
VTTASSDQQGKKVCAASRGDSFSVSKIWQWGRSGRRLPVLPAGSSSPTDQDLPWASPASARSYEAEQTDT

SEQ ID NO: 128153 - protein, 183 aa, Triticum aestivum
  Clone ID: PAT_TA_22571.pep
MEVIRGPILPRCAAPALTSGSRIGGQLLRRVRMRRRACGGVSPGDYHRVSPRFFGAPAQQHSTSFWPVCCSYGSSSDGNGAPPANFDASGEEFVDSSVMEAVELRCVSDGFVIRMRDGRNLICVQNNPRVLRLRDSTPDHAYNVVKLPPMMGYPGSLVRITENGALCSILDCIVQRWKMEAIY

SEQ ID NO: 128154 - protein, 194 aa, Triticum aestivum
  unsure (1)..(194): unsure at all Xaa locations
  Clone ID: PAT_TA_22572.pep
DCFVIRMRDGRNLRCVQNNPRVLRLRDYTFHHAPPFRINGIPSPTIYNVVKEMTDXMEYTVRLVRITEMVHDAYYSRLYLAKIGNEEETISFDLKPSDAINIAFRCKVPIQVNKRIAYNNGLKVIQPKPTGSYVNSDQIQYTRLDKPGDQPCFEAQEFDLVRGMLIAAVEERYKDAAQYRDRLLMFRANKKNTI

SEQ ID NO: 128155 - protein, 180 aa, Triticum aestivum
  Clone ID: PAT_TA_22573.pep
TRLHSAVLNVKHLLWLIERMVDMRVADNAVKLWSEQVALAADLQKLLNDADMWRNMAPGLPMLVTRCTLRLAHSVMIGETLVPRQVRMKLVKSWLPVLNVCRDIAQPMHSGYKLSNCQELEETFLKIISTLSVPDAQELLQQCLGFSTRNVDDCQHLVTAFKTWFRRASRDPQGPQGGED

SEQ ID NO: 128156 - protein, 149 aa, Triticum aestivum
  Clone ID: PAT_TA_22574.pep
GSRRGASCVPATLQRVARGGAVSGLVGPACYPGSKAKASTTRFLPVSGQYSSIDCKGTVLVGGACSGSASACLEGGCWSNWLRCSCSSRGRGVSMAGGRKRARTGWACRGDCRRTWGAWCWRCWPSGFRRACLSLMRSPAACGTGRIAP

SEQ ID NO: 128157 - protein, 186 aa, Triticum aestivum
  Clone ID: PAT_TA_22575.pep
HQIRFSTRRTSEPTFNIVFLQGSAHGHHLPPIVASAPISSVDGRRLPLCRGRTQGGAGWCRVDGKADGPASRGGQGRSHPHSEAGSLLAARDEIHAHITHTDAQGNDTVQIDDLASSLAQMLLGPCYTSVAVYRPRRQAAVHSHPCGLWTTSSAAGMPTAEEEQAQGNKSRGQTIGTARPMAAILE

SEQ ID NO: 128158 - protein, 121 aa, Triticum aestivum
  Clone ID: PAT_TA_22576.pep
DYKIVRDELRMYNPKYLERPYVVVLNKIDLPKAQDRLSSLALEISSVGCEECHDNNTSKEKLNENFNRHHMSEDDDKELGDYPRPQAVIGASVLRHIGIDEMLKEIRTALGKCSDHMSPGP

SEQ ID NO: 128159 - protein, 130 aa, Triticum aestivum
  Clone ID: PAT_TA_22577.pep
STPAAAEDGFAAAAGVGLPPAGAGAVARRLVRLQPSVADVLGAVSKHPPLWVRRLLLTLREAHLVVLDGAHRHRRMGAGAGEDAAAHDQRRGDVGQEEEELRLRLHCPCFKWRLHCGLCFRFKWCRRRGA

SEQ ID NO: 128160 - protein, 55 aa, Triticum aestivum
  Clone ID: PAT_TA_22578.pep
DINAIRLCWLTPMANPLKKKKTTMANSTMDTPQRPKTDDKLLFFISFARTHLDEI

SEQ ID NO: 128161 - protein, 197 aa, Triticum aestivum
  unsure (1)..(197): unsure at all Xaa locations
  Clone ID: PAT_TA_22579.pep
MFLVDWFYGVLASLGLWQKEAKILFLGLDNAGKTTLPSTCSKDERLVQHQXPTQYPTSEELSIGKIKFKAFDLGGHQXIARRVWKDYYAKVDAVVYLXWNAYDKERFAESKKELDALLSDDSLATVPFLILGNKIDIPYAASEEELRYHLGLSNFTTGKGKVSLSESNVRPLEVFMCSIVRKMGYGEGFKWMSQYIK

SEQ ID NO: 128162 - protein, 185 aa, Triticum aestivum
  Clone ID: PAT_TA_22580.pep
QQQYEMEMEEEFGELQGTPMRFTFQQLKAATEQFADKLGEGGFGSVFKGQFGDERIAVKRLDRAGQGKKEFSAEVQTIGSIHHINLVRLIGFCAEKSHRLLVYEYMPKGSLDRWIYHQHDNDSPPLNWSTRCKIITHIAKGLTYLHEECMKKIAHLDVKPQNMLLDDNLNAKLSDFGLCKLIDRD

SEQ ID NO: 128163 - protein, 201 aa, Triticum aestivum
  Clone ID: PAT_TA_22581.pep
AGPEIYIEDSSQLTEVYFSSLYPSGILSYGRAKLPSIASNVERLTLVFCGENVNTPMLPEKLHHLKTLEFELHGSGACSPVYDIFSLVSFLDASPALESLILRVGRNAIGDHGDAGDDVYLKGKSACQLDRLKRVTITGFWAAKSLIKLVISILESAPSLERLTLDTTPRGCGRKLGDTSICTAAKYRSKCCWISKRSSKI

SEQ ID NO: 128164 - protein, 144 aa, Triticum aestivum
  Clone ID: PAT_TA_22582.pep
DAWARASSTTKRARHVLDVFPLRPRGHGARLPPTRARSPPSAAPPQSPAARVRHQHRLLFPLPTVLPLALPAEGQLRGSRRWRRLVRSAGRQFARRRPPQESLRGRGRGPSAGHCCGVAGRRGRLRLESVSRLVRLQCDISGGA

SEQ ID NO: 128165 - protein, 251 aa, Triticum aestivum
  Clone ID: PAT_TA_22583.pep
MVLKFLAQSSGPLPPGVGLGLHPLDVFRRSMLTGKCHQIRSPQDNEEDNTIIRSAVELYEAGIQFKPSKTPSLHDIRFRRGTLSMPTVSVDDSTEYMFLNMMAFERLHAGAGNDVTGYVFFMDNIIDSAKDVALLSSKGIIQNAIGSDQAVAKLFNTISRDVVLEPNSALDAVQRQVNGYFRQPWNIWRANLIHTYFRSPWAFLSLAAAVFLLGMTVMQTVYTVLQFTGTTATATITFSYVSQPGAKTSNH

SEQ ID NO: 128166 - protein, 80 aa, Triticum aestivum
  Clone ID: PAT_TA_22584.pep
RLGGQYPKRQAQDMAALALRCLQNDPKSRPSMADDVLPSLELLLQPSAAKSSSSSSTTTSSRSPAASAAPVHRGHRRNKA

SEQ ID NO: 128167 - protein, 101 aa, Triticum aestivum
  Clone ID: PAT_TA_22585.pep
WPGVSLIVLEQYRGRCKLTGSCCTAILAATILWIARWGELLLRCDHGAAILHNVLVDSGTAVQQAHLVTPFANFLASNSYRRQSCAWFKLFTIMYRPIYLL

SEQ ID NO: 128168 - protein, 63 aa, Triticum aestivum
  Clone ID: PAT_TA_22586.pep
WRATSCHPVESRRNGPFNPRQAMEMLKIPLSWVEERSSRPAMDDIFKALIACDDEDEHPAYLS

SEQ ID NO: 128169 - protein, 191 aa, Triticum aestivum
  unsure (1)..(191): unsure at all Xaa locations
  Clone ID: PAT_TA_22587.pep
MTGLLMVFLARSNFVMHSMCRLTPRAPSPPPRARIQGTFGYLDPLYFYTGQLTEKSDVYSFGVLLMELLTRKKPCSYRSSQGGNPCXYFTSSLAAGKLVHVLDPQVVEEGGKEVEEVAVLAVACVRIEGDHRPTMRQVELTLESLGASHYSFVMHDMDVPKYPVIEGTNMEETSRQYSLEAEYLLSSRYPR

SEQ ID NO: 128170 - protein, 99 aa, Triticum aestivum
  Clone ID: PAT_TA_22588.pep
MASFSKQAALFLLAALLLCLLCTRGQAARPTPGSSLQKSQGAGSATSHEKSAAGTGMEMEQVDQEAMRGGEGGEGAEECLMRRTLVAHTDYIYTQGKHN

SEQ ID NO: 128171 - protein, 67 aa, Triticum aestivum
  unsure (1)..(67): unsure at all Xaa locations
  Clone ID: PAT_TA_22589.pep
XXHITXDXYAIXSSTSVGMVHTHDHYRLLLRQQEPEDVNDGESITTSRFKGRCSSDDIPDIKWYTSG

SEQ ID NO: 128172 - protein, 118 aa, Triticum aestivum
  unsure (1)..(118): unsure at all Xaa locations
  Clone ID: PAT_TA_22590.pep
PYKXSVLIYISPSDQEELKCPSPGRAHHSYRSVSSVINSERVEHSTFTSKPRTETREPARQHYFSRHSNHLPIKQIASSPSHLTSVVIPSGKYYTAESFLLYRICCVSPGNYSGGKKQ

SEQ ID NO: 128173 - protein, 502 aa, Triticum aestivum
  unsure (1)..(502): unsure at all Xaa locations
  Clone ID: PAT_TA_22591.pep
VNTILCLMFPLKYRXLMIFLSVIRSKKGGFDFKTAIVDXIIILMRNIRNTTESGLFHLCEFIEDNEFTYLSTQILHFLGNEGPKTSDPSKYIRYIYNRVILENATVRASAVSTLAKFGALVDALKPRIFVLLRRCLFDGDDEVRDRATLYIKLLDGEATVGETEKDVTDFLFGSLDVPLANLEASLRNYEPSEVPFDISSVPKETKSQPLAEKKATGKKSTGXASALFGPVPTIDASYEKLLSSIPEFAGFGKLFKSSTPFELTEAETEYSVNVVKHIYDGHVVLQYNCTNTIPEQLLEEVVVFVDASEAEEFSEVASKPLRSLPYDSPGQTFVAFEKPEGVLATGKFSNILKFIVKEVDSSTGEAEDDGVEDEYQLEDFEIISADYMLKVGISNFRNAWESMDPESERVDEYGLGVRESLAEAVSAVISILGMQPCEGTDVVQNNSRSHTCLLSGVFIGNVKVLVRLSFGISGPKEVAMKLAVRSDDPEVSDRIHEIVANG

SEQ ID NO: 128174 - protein, 58 aa, Triticum aestivum
  Clone ID: PAT_TA_22592.pep
WMLFEAGSMPKLEKLEIGVRFYNSSDSNTTSGSGDAFDLGMGNLPSLIKSQICNIWLV

SEQ ID NO: 128175 - protein, 142 aa, Triticum aestivum
  Clone ID: PAT_TA_22593.pep
MAELAPLSMLFLALLVVVPVLHFIRSSRRHEGSSRPRPPPSPWALPVIGHLHHVAGALPHRAMLGLSRRHGPLMLLRLCELRVVVASSADAAREIMKTQDLAFASRPMTPTGKALLGDSPGIVFLRDRGGTRKIAPQLSLRR

SEQ ID NO: 128176 - protein, 145 aa, Triticum aestivum
  Clone ID: PAT_TA_22594.pep
MAATCRFAAPLGLAPLPRSCAGAKSVAFSIGTTKVATRTRSVAVRAGDGSAETPEILKAAQDAWAKVEDKYAVATIGVAGLVALWTAVGALKSIDKLPILPGVLELVGIGYTGWFTYRNLIFQPDRETLISNIKSTYNEITGSSS

SEQ ID NO: 128177 - protein, 103 aa, Triticum aestivum
  unsure (1)..(103): unsure at all Xaa locations
  Clone ID: PAT_TA_22595.pep
SRAFLCRLYEMCPSSSCIVPFRLFFVQCSAVHECNQYLFTSVPGILVCPAXNKNAGLIPIYRTTKQASNYGTTFVSFAHGGDMPFIFSKFFQKKKKKTETSSL

SEQ ID NO: 128178 - protein, 129 aa, Triticum aestivum
  Clone ID: PAT_TA_22596.pep
CIFLVSIPTKFNEHKSSMEYTNYKKCNLYILSIANSVVFSYTEKQKYTGVACSKRLLIHHYHRMYSGVTTHDSRDQLPQARITTDVNDQNDGRGLTADEPSTAWLLPVADAELFFFLMKSAPTSGISGF

SEQ ID NO: 128179 - protein, 156 aa, Triticum aestivum
  unsure (1)..(156): unsure at all Xaa locations
  Clone ID: PAT_TA_22597.pep
QLQLLRLRHGGQHKVFSLFLLPQWLFHFYHSLLLHFPQRGRIDFDKLFSRRXLPQSFSPPTSRRIEGGTRGGNKTKLLAVTVDLNKSAAVIDHELDTLVGPRAATFPIELSHLNMKSRRPGFKPYKRCSVEAKENRVPAADEVGTKRIRLDSEPST

SEQ ID NO: 128180 - protein, 137 aa, Triticum aestivum
  Clone ID: PAT_TA_22598.pep
RAPMPGAATPRNSRARSRRTPPSARRVGARTSHRSTPQWRPSVHGIARGYLPVAVLLLIRRDPAGFGHERPVQTFPPRLGRRPHRRRHTAHGIQLNRWLATSPPTRDAPTSAPLQRATAANASRRVSLVVSFSSKSF

SEQ ID NO: 128181 - protein, 220 aa, Triticum aestivum
  unsure (1)..(220): unsure at all Xaa locations
  Clone ID: PAT_TA_22599.pep
MTATRAVINLPGSPLSPPSGRCPSSSGLPCGVLPMRPSRSPRPTVAAVAKNRQLEVGENAASLQNQLLVLINGMDRKKVRETRRKQQLQEPEPAPSSHDTAGVATAAPLPLPASPPIQCFPTSSTNIHHQLSMLDVLEKIGISRHFAGEIKSVLDXTYSRWLQRDEEIMLDTGTCAMAFRILRMXGYDVXSDSLSHLTEASVHLNDTRSLLELYKVSQVS

SEQ ID NO: 128182 - protein, 116 aa, Triticum aestivum
  unsure (1)..(116): unsure at all Xaa locations
  Clone ID: PAT_TA_22600.pep
GPTXEXXAAATEAAVAALQKMEGAFGECSKGKAFFGGDGPGYVDIALGGFAAWMRAFHAVASVNLLDAARTPLLAAWAERFAALDAAKEVIPDVDRIAEFAKHDLLPLLQKLHPKN

SEQ ID NO: 128183 - protein, 241 aa, Triticum aestivum
  Clone ID: PAT_TA_22601.pep
MAAGAAGGGSDELKLLGAWVSPFVHRVRVALHLKGLTGYEYAEEDLTNKSDLLLASNPVHTKVPVLLHAGKPVCESMLIVQYLDEAFPCSGPALLPADPHDRAVARFWAAYADDQFFASWIKAFVGTTDEERAAATEAAVAALQKMEGAFAECSKGKAFFGGDGPGYVDIALGGFVAWIRAFHAVASVNLLDAARTPLLAAWAERFAALDAAKEVIPDVDRIAEFAKHDLLPLLQKLHPKN

SEQ ID NO: 128184 - protein, 167 aa, Triticum aestivum
  Clone ID: PAT_TA_22602.pep
MASLALRPIMPAAAAAASTTTTLNRARRGSSTLLRRRQPVTCMAESSGGGNSTVELAAGAAGLASCATVAWSLYTLKATGCGLPPGPGGSLGAAEGVSYLVVAGLVGWSLTTKVRTGSGLPAGPYGLLGAAEGVAYLTVVAIAAVFGLQFFQQGSLPGPLPSEQCFG

SEQ ID NO: 128185 - protein, 45 aa, Triticum aestivum
  Clone ID: PAT_TA_22603.pep
PTCSSTASARSGPPAAFLLTSLSFRAALAHIHIHWLICTGVYRVL

SEQ ID NO: 128186 - protein, 169 aa, Triticum aestivum
  Clone ID: PAT_TA_22604.pep
ILASKQHISTISTNIIGKQFLKLQHYTDTSTTTGDKISTLEAERREKNDSGENQCQSGGHQSRQRHSAAVLGAVRPRVRRTATGTGVSPGTARSTAGAAASRVPKLPAAHDLQEPLALDFMGLESCTGHGPSRSCFTPCAMGCEGEEEEEESEGIYLHREIDSVPNHAS

SEQ ID NO: 128187 - protein, 144 aa, Triticum aestivum
  Clone ID: PAT_TA_22605.pep
AIGQTSQDALVCTVNLMEGDMIVSGSDGFFDNIFDQEILSVINESPGTDEAAKALAELARKHSVDVTFDSPYSMEARSRGFDVPWWKKLLGAKLVGGKMDDITVIVAQVKTVVIPDDEGSGVELEKVGGEQLAAAGVASTEQNE

SEQ ID NO: 128188 - protein, 109 aa, Triticum aestivum
  Clone ID: PAT_TA_22606.pep
RDQTHSYWYTPSAPRVNYFLLIMESAGMMKMATSDGPPLRQGAGTGSRLVICGYRGLRRRNSQSRLFFGGLGIYRRGWHREQVRRPHRKSTRHRGAPSTLVGAHGPPLR

SEQ ID NO: 128189 - protein, 103 aa, Triticum aestivum
  unsure (1)..(103): unsure at all Xaa locations
  Clone ID: PAT_TA_22607.pep
GSGGDDAGAWSWRSRLRLVVMMDEQRVRVFPTTAKTASTKAATDLNSEHQVYCLSWVVIVAVVFVLDNLQPPLFTSNSPASHXVYLLSRWIAGQPLSSTRALQ

SEQ ID NO: 128190 - protein, 129 aa, Triticum aestivum
  Clone ID: PAT_TA_22608.pep
MADEPNRAAFVELQSRMIETTGKIKQLQTQMRSKESEKKRAYLTLEELIQLPDDTNTYKAIGKVFILEPRSLMVNEQEKKLNDSETAISSMQTSKEYLEKQLGEVENNVRELLQQDPGLARQILSMTVQ

SEQ ID NO: 128191 - protein, 57 aa, Triticum aestivum
  Clone ID: PAT_TA_22609.pep
IGNWVGGLKFLVGVGCGVYVAQNYNVPNVKKLFNTYVFLAKHIEETYRKPKKDDKDE

SEQ ID NO: 128192 - protein, 105 aa, Triticum aestivum
  Clone ID: PAT_TA_22610.pep
SALSSWNSLVLWVSRLWKTQNGRLSLTSSSRSAAVLQLRLCCQHDGALELHLLSLGLLFFKDQCQGACSKERRPLSPWAHLSARLNISRAEHRHHVWRLLTIWTP

SEQ ID NO: 128193 - protein, 113 aa, Triticum aestivum
  Clone ID: PAT_TA_22611.pep
PRAPRAAERGTGGGSVLNNSGNALSGSACGSSSNRIATPTEQCNASDGATENPSMEGSHQLSQREIALNKFRLKRKERCFEKKVRYQSRKLLAEQRPRVKGQFVRQEQNIQAS

SEQ ID NO: 128194 - protein, 166 aa, Triticum aestivum
  unsure (1)..(166): unsure at all Xaa locations
  Clone ID: PAT_TA_22612.pep
PAPLLPRRAREDCEIMGYKIPEGTNVQVNIFAICRDCRYWDAPEAFKPERFKESNIDHKGTHFEFTPFGAGRRQCPGMLFGTSTVEIALANLLHHFDWVFPDGPNPGSLDMSEXFGINVRRKSDLELRATHMCSPKLRNQGPAGDAGKIGPHTSSSLASLSLTTFR

SEQ ID NO: 128195 - protein, 149 aa, Triticum aestivum
  Clone ID: PAT_TA_22613.pep
MSGGGAGDTLDKLVVFLAKRDGIDKLVKTYQYVSKLAHWAAETSHPGLAGRAKSWETAAGLSRKVFRSGRSLTGFNALRRSPGEFGALAVLANAGEMVYFFFDHFTWLSRVGVLEPWLARRASFVSAFGECVGYVFFIVMDFIMIRRGI

SEQ ID NO: 128196 - protein, 51 aa, Triticum aestivum
  Clone ID: PAT_TA_22614.pep
KHHYHSNQKDELDLHDYEAEYAFYRDLAERPQVVPFLKDTGLAVPPVVFYH

SEQ ID NO: 128197 - protein, 224 aa, Triticum aestivum
  unsure (1)..(224): unsure at all Xaa locations
  Clone ID: PAT_TA_22615.pep
LAGAAAKVVTNTASLLCYTTAMAXXPQQSREFEFHMSAPVDHWEPIASPADELFYKGKLLPLHLPPRIQMVERLLEIAADKGLLSASTAPATPYQSCHVSPANSCYASGELNAEQYFSECASASIAAAEVEAACEKKPWSKKLKFIKNLNLGLKLKASKAYLKTIFAAKAGDPDDKGGAPRANEFSTAQVKXWRKNHLAVRSTVHNSPSQQCTLGGKLKEVSTA

SEQ ID NO: 128198 - protein, 142 aa, Triticum aestivum
  unsure (1)..(142): unsure at all Xaa locations
  Clone ID: PAT_TA_22616.pep
KPTYRPFGGRGVSRRKILFIFFYLPSGCSSPEGCSAYVVRWXLSQHLDIMSLGILGCACRPGGVTPVTALPGGCAMELRAVCRPMEVCGAAAVMAEAKATHGESAMSSADVEASAARWRHAASTVATDVGAAGRVRGSGDRR

SEQ ID NO: 128199 - protein, 136 aa, Triticum aestivum
  unsure (1)..(136): unsure at all Xaa locations
  Clone ID: PAT_TA_22617.pep
EKRLNAGDTVSFCRGATEATRDRLFIDWKCRALVHDSLPKVDRPSRAVKKRVRLFGVNLGTQQPQGGELTHDANAGAAGVESSAAASSPSSSXDRSTFLLGSRSVNACPRKVQQHNSFSLSPLXSSPPFVVXSVIH

SEQ ID NO: 128200 - protein, 142 aa, Triticum aestivum
  unsure (1)..(142): unsure at all Xaa locations
  Clone ID: PAT_TA_22618.pep
LPSPLNPMANPVASPLLHPSCARRPPPSGGARPPPPSIAAPPSLEPLDPRSPSPSHPLPPSDLDPPPPSPXEIDLLPPSRSPLALSTPSQPTTPDPSSPTQPSSSPPPPQVPGELASPCCYLKPPAEARWREHECLRRAPER

SEQ ID NO: 128201 - protein, 236 aa, Triticum aestivum
  Clone ID: PAT_TA_22619.pep
LGTMFWGIGKKRHNQQDLFNAMGSMYSSVLFMGVQNSASVQPVVAVERTVFYRERAAHMYSPLPYAPGQVAIELPYIFVQSLIYGVLVYAMIGFEWTAVKFFWYLFFMYFTLAYFTFYGMMSVGLTPNYNVASVASTAFYALWNLFSGFITPRTGSPLWARWVFSPCPSASTPNGLVSSPFRVVSELFANGVRVSGFVLSYFRFRHDSRPPVAVVVVSFALLFAFLFGLSIKLFNF

SEQ ID NO: 128202 - protein, 121 aa, Triticum aestivum
  Clone ID: PAT_TA_22620.pep
MDTIRRPVTAASSLGQSAANHLQPLVTLAQRNGVNRRCLLTLLASAAAIPEASESRKALLQDYVKRSKENKEKNDKERLDDFYKRNYKDYFGFMEGSVREKPAEELTESEKGILAWLDKNK

SEQ ID NO: 128203 - protein, 83 aa, Triticum aestivum
  Clone ID: PAT_TA_22621.pep
CFHIISSYNLALVAFFMCCSGGWQQRKEAPSVDSSPQLRSAEDASPLNDEGLKLLRPACRLCPSVYLEAEPWDEMSLLSSVLS

SEQ ID NO: 128204 - protein, 93 aa, Triticum aestivum
  Clone ID: PAT_TA_22622.pep
MGVTKEDVEAAVAAALSPTHLVVTDTSGGCGASYEIEVVSDKFEGKRLLERHRMVNTALAPLMAEIHAVSIKALTPAQAQPKSEPAAADKAQA

SEQ ID NO: 128205 - protein, 247 aa, Triticum aestivum
  Clone ID: PAT_TA_22623.pep
MAQHSENAAENMMSGIMDAIADKLPKQKSVRFDDEGSISGQAKKLFGGHKSVHHVLGGGKSADVLLWRNKKISSSVLAVATAAWVFFEWLDYHFLTIVSFVLVLGMVVQFGWSSFAGMLNGSPSNVPRVELPEELFANMGAAVGAQVNKFLGSLQDVSCGRDLKQFLMVISGFIVAAFIGSWFSLITVIYIGFVCAHTLPVFYERYHDQVDEVLYNMLGLIGSQYQKLDKGVLSKMPKGNLKLRKSQ

SEQ ID NO: 128206 - protein, 106 aa, Triticum aestivum
  Clone ID: PAT_TA_22624.pep
NNTLLVLLFAIFLPPIVLPLCDASARRPIAGRYAMACPEEAIRYFGGLKPSTLWIIRPLCVLSSGLPRDASSCGAPVQFFVYVKKFLPSPHLFGKLGELCNLVLYP

SEQ ID NO: 128207 - protein, 137 aa, Triticum aestivum
  Clone ID: PAT_TA_22625.pep
FYMLHPTGELICNSLILLLDIWMDSSWMTADDEDQWLLPREARMVHALVLLKPLQFFMAARRKGWLQTAPARSAQDSGGCALLMAASSGLLEPGGEEGTTLGPRIAWATYRERGERRRRHEALGRLAAAEACGVLVP

SEQ ID NO: 128208 - protein, 230 aa, Triticum aestivum
  Clone ID: PAT_TA_22626.pep
PNPSRSWPPLSAARSAALFCSCSSPSSDAVVAPAPTQAAVEEKKPAPAVGEEEKGEVPVGELAGLLDIRVGRVVKAWLHPEADTLYVEEVDVGEEQPRTICSGLVKYLPLDQLQDSNVIVLANLKPRNMRGIKSSGMLMCASDASHETVELLTPPEGSVPGERVWFGSEDEKSIQSEPATGNQVQKKKIWESVQPHLKTTDNCVAVLGEQPMRTSAGMVFCKSLQGASVS

SEQ ID NO: 128209 - protein, 104 aa, Triticum aestivum
  Clone ID: PAT_TA_22627.pep
EFFFFFFFANEKLNFIPFEKTSHNIWSVPPTCAASPTVTCIHICLQNKTIFFAIYQDKSTNLMDRSILGFRSHVYDAILENLHARRPRHQLMMLRVWATGALPL

SEQ ID NO: 128210 - protein, 68 aa, Triticum aestivum
  Clone ID: PAT_TA_22628.pep
PRVRPLVQRMSHRGLPGNDPTDCAMVFLYFLCSMSIRTNLQKLLGFTPPRAAAGAGGGLFAMPDPKTN

SEQ ID NO: 128211 - protein, 164 aa, Triticum aestivum
  Clone ID: PAT_TA_22629.pep
FLRRGSGINRSPEETTSQNTDVQGSTSRVNPMKTRLADYQERPRYLHGSYKYASSNVMSGSPSKFPKNFPLRKFGEEKRRQTLLEGADVAESSRRKSDAGCLEGSKKTIVENQSSDAPQTGTEGLTAKDHELIAPDPEVSHPAGSSGMHAHTAESLGKECFTKF

SEQ ID NO: 128212 - protein, 53 aa, Triticum aestivum
  Clone ID: PAT_TA_22630.pep
CCSRVKTNSQPRVTTLLTYLIVKSTPTNTWNTPHTKTFFPSSIEHFGYTLLAR

SEQ ID NO: 128213 - protein, 293 aa, Triticum aestivum
  Clone ID: PAT_TA_22631.pep
MPICPPPPETSGSGGRAWIFHGLALGAAAAAAAAAYVYRRPRGFRSLAVGIIPARYASSRFEGKPLALILGKPMIQRTWERVMLASSLDHVVVATDDEKIAECCRGFGADVIMTSVSCQNGSERCCEALQKLRKHYDIVVNIQGDEPLIEPDIIDGVVMALQRAPDAVFSTAATALKPEDAFDTNRVKCVVDNQGYAIYFSRGLIPFNKSGKVNPHFPYLLHLGISGFDSKFLKIYPQLAPTPLQLEEDLEQLKVLENGYKMKVIKVDHDAHGVDAPEDVEKIEALMRARNIQ

SEQ ID NO: 128214 - protein, 282 aa, Triticum aestivum
  Clone ID: PAT_TA_22632.pep
AVCYRPDGKGVVVGTITGNCRYYDASENRLELESQVSLNGRKKSPLKRIVGFQYCPSDPKKLMVTSGDSQVRILDGVHVISNYKGLQSSSQVAASFTPDGDHIISASDDSRIYMWNHVNQLAPVTSRVKTVWSYERFFSNDASIAIPWNASQSRNSISLACNIPSLRQEVSGDLCDIQDSSTSRCQTEDCLEDDNMFQLPSGNFTLSRAFLAESAPRGTATWPEEHLASNSATASTLRKSQYKFLKASCQNAATHAWGQVIVTASWDGHIRSFQNYGLPVQV

SEQ ID NO: 128215 - protein, 103 aa, Triticum aestivum
  Clone ID: PAT_TA_22633.pep
FFFLKMVVCWSRLRGPSGLGVQRPVILPPLEAGSCRCSVKPASRGACHIMDREAQLSHRPHQAVHYSTWNGRANSSTPRPGPQRYNSVHTTLMPPLGLAGGLS

SEQ ID NO: 128216 - protein, 92 aa, Triticum aestivum
  Clone ID: PAT_TA_22634.pep
MGLKEEFEEHAEKAKTLPDTTTNESKLCLYGLYKQATVGPVNTARPGGLFDMAGKAKWDAWKAVEAKSKEEAMADYITKVKQLLEEAAAASA

SEQ ID NO: 128217 - protein, 480 aa, Triticum aestivum
  Clone ID: PAT_TA_22635.pep
MRKGAELLVLLVASSLCLSAAIAAQETCPADIDAKCGDAASDDWEGEFFPGITKIRYEGPTSKKPLSYKWYNAEEVILGKKMKDWLRFSVAFWHTFRGTGGDPFGAATKNWPWEDGTNSLAMAKRRMKAHFEFMEKLGVERWCFHDRDIAPDGKTLAETNANLDEIVELAKQLQSETNIKPLWGTAQLFMHPRYMHGAATSPEVKVYAYAAAQVKKALEVTHYLGGENYVFWGGREGYQTLLNTDMKRELEHLANFLQAAVNHKKKIGFNGTLLIEPKPQEPTKHQYDWDVATTFSFLQKFGLTGEFKINVECNHATLSGHSCHHELETARINDILGNIDANTGDPQVGWDTDEFLTDISEATLIMSSVVKNDGLAPGGFNFDAKLRRESTDVEDLFIAHISGMDTMARGLRNVAKLIEDGSLDELVRKRYQSFDTEIGAMIEAGKGDFETLEKKVLEWGEPTVPSGKQELAEMLFQSAL

SEQ ID NO: 128218 - protein, 99 aa, Triticum aestivum
  unsure (1)..(99): unsure at all Xaa locations
  Clone ID: PAT_TA_22636.pep
MGLKEEFEEHAEKAKTXLPDTTTNXDMLCLYGLYKQATARAPALSVCQDARPRKFTSRARXKWDAWKSVEAKSKEEAMADYITKVKQLLEEAAAASASS

SEQ ID NO: 128219 - protein, 249 aa, Triticum aestivum
  unsure (1)..(249): unsure at all Xaa locations
  Clone ID: PAT_TA_22637.pep
MDGNAAPDAYARYEAIASSLPTSACQGLGAAAYKNHRGFWYPAHQMAPTLAARDTFVARPTDILVATLPKSGTTWLKALVFAVAYRRTHTPALEDGAGQRRHPLLGSSPHDLVPFLHYVYEKHQSAAAPLLEAMPAPRVLAVHAPLSALPASVAGSGCRAVYMCRDPKDALVSLWHYLRKANRPGATAASLEELLAAFCDGVSPFGPAWEHVAEYWRESLARPEQVMFLRYEHVKEDTXGSAKRLAEFL

SEQ ID NO: 128220 - protein, 197 aa, Triticum aestivum
  unsure (1)..(197): unsure at all Xaa locations
  Clone ID: PAT_TA_22638.pep
LTSVXSGPTGGGASRLPNLRAVVLHSPILSGLRVLYPVKNILWFDIYAEVDTISLVNLSSSGIHGTSDDVVDWSHGKXQLWELCKVKHSPLWLSGGGHCNLELYPDYIRHLKKFVSSLGKKSTKPDLKELPATEDTSRKDAESVSSDKPQEAAKCRQISRKSLDSRVGKSKTVDAPEKPRMSSDDVDKFRRRRCLVW

SEQ ID NO: 128221 - protein, 112 aa, Triticum aestivum
  Clone ID: PAT_TA_22639.pep
AVWVLLSAAGALADGGNGTVCLCTGPQCVPPCPVPGTPPTTSPTQFPFCPQRPPAVGPFPWEQQPPASPRSGSGFPQDAGFLAAAAASPTSPAAAWLAVAALCSAFLLLLPQ

SEQ ID NO: 128222 - protein, 167 aa, Triticum aestivum
  Clone ID: PAT_TA_22640.pep
LSSIASLLALFSTRTTQFINGFISEGGRHRRCLRHARPQHGSPGGSHRMRRLSGRLCCNAHPLPSCGGLCPLLTPASRAPDVAACGHCGPSCYGRWPLFPFPPGRPGPAPRRELCFGLPCVRGCLYVPWHLAVPILWWGAWRAKVLAVCRPPLFQSSINSPSGPNSS

SEQ ID NO: 128223 - protein, 357 aa, Triticum aestivum
  Clone ID: PAT_TA_22641.pep
RAAVKGGHVYDADHFQGKLGDENGVDSSIEKKISPKLLEFTFQELKSATVNFRPDSILGEGGFGYVFKGWIEPNSTAPAKPGTGLTVAVKSLKENALQGHREWVAEVDFLGQLHHKHLVKLIGYCIEDDQRLLVYEFMARGSLENHLFRRTLPLPWPCRMKVVLGAAKGLAFLHVGPKPVIYRDFKTSNILIDAEYNSKLSDFGLAKAGPQGDKTHVSTRVLGTYGYAAPEYVMTGHLTTKSDVYSFGVVLLEVLTGRRSVADAWAPGEQNLVAWARPYLSDRRRLYQLVDPRLGLNYSVRGVQKVAQICHHCLNRDSKSRPMMDEVVKHLTPLQDLNDMAAASYRPRSSPRGKARR

SEQ ID NO: 128224 - protein, 54 aa, Triticum aestivum
  Clone ID: PAT_TA_22642.pep
GNEIHSIASMDADGKGIVEFDDLAFSITQLLLGPCYVFTGRDPSIIPATRCVWR

SEQ ID NO: 128225 - protein, 451 aa, Triticum aestivum
  Clone ID: PAT_TA_22643.pep
GIGEPSRIGREERTGTPPITREETHRAAAAAASVWVQRSVLPIDTCLVTMRGSILYSSFRRISQGHPPKSSGFHRSSPLAAQRFGRSKRWIATSDGLPGEKMMLVNDLVCPVKYFTEEVPLLEPLDNNILLKTVGGPRGKTLVAWKAGKTIRSLPELIAAYQLRGCTLGNRLRLENLKISRSSGRFVLIDTSEIGPTEKKGSFIQDWNLGGDVLDTIARRVLGVGTPYPKDLEKYINNMRSAEPKLWRLLYNSLFLSPEARYWLRVYVNQMSREDFKSLSRGMKHKMQKFFGELPYQGGEEDEGSLKWLSKNEEFIRATLAESRKDAQNRVTGPNYLSTEEARKRDLGRWLVCVNRDGLTHGTRTKAEHLKDIKRNMLTAQNISQLLHVEFDELDQEYIDLCGEDNGLRELLSIEGIFFETPETWRTAIEALEKDIQAVRELKEKNLVLLT

SEQ ID NO: 128226 - protein, 104 aa, Triticum aestivum
  Clone ID: PAT_TA_22644.pep
GTWAGHDAVAMRRTAEGAAVAGSSGDGDARATGRSQRTEHGRRQQQQVINVSVMAEQSSRISHSDTSPYNASNLEKDSHDGQQLPDQQQKETTEAEKNTENAKK

SEQ ID NO: 128227 - protein, 197 aa, Triticum aestivum
  unsure (1)..(197): unsure at all Xaa locations
  Clone ID: PAT_TA_22645.pep
RCLVALIVAFVPYTKIDWDAYMSQVDAFREGERDYTKIEGDTGPLVYPAGFLYVYSAIKFLTAGQVFPAQILFGVLYLVNLSLVLLLYVKTEVLPWWALGLLCLSKRVHSIFVLRLFNDCVAMTLLHAAMVLIVYHKWYLGLIIFSGAVSVKMNVLLFAPSLFLLMLKAMSIKGFXXALLGAAGIXVLLGIHCCQSC

SEQ ID NO: 128228 - protein, 174 aa, Triticum aestivum
  Clone ID: PAT_TA_22646.pep
SDTSNKFTVIGCQALAYIIGDGGDHGDDGDYSGKYMSGCVAMCRGDDVRSTLSNGSCSGIGCCQTAIPRGLQYYHVGVRPCLQTRRRFHNGQPLQLRRCSWTPPTSPSSTNLCDLAGVQETTTAARRRSSLIPIGNHTCDVPQEAGPPPVRPNSSAQLAHGQLISTAQRLMVSY

SEQ ID NO: 128229 - protein, 187 aa, Triticum aestivum
  Clone ID: PAT_TA_22647.pep
GRLHGPGDSDPAKDNDNFRIRRYIAKYTINPAIVSGFSDFVGSVEAGKLADLVLWKPAFFGAKPELIIKGGAIAWANMGDPNASIPTPEPVMMRPMFGAYGKAGSSHSIAFVSKAAKEAGVASEYKLAKRVEAVVGVRHLSKLDMKLNDALPKIKVDPETYTVTADGEVLTCQPAATVPLSRNYFLF

SEQ ID NO: 128230 - protein, 92 aa, Triticum aestivum
  Clone ID: PAT_TA_22648.pep
PRAHAFAHHWWEWRCRAWKTPGGFFDADEKIVHFVSRHPQVPSRNVQTAFALVCKSKTFFDMLDGNICGKADVGKKKNQFIPVPDSGQPYSI

SEQ ID NO: 128231 - protein, 209 aa, Triticum aestivum
  unsure (1)..(209): unsure at all Xaa locations
  Clone ID: PAT_TA_22649.pep
KTLSISKVKQSVSRWADEMGMETPDDLSINCTNLGNTSDIFSKILEKFQTRKKASGKLSPLQQLQRMFSHKESAPRRMLLIVVDEMDYLITRDRAVLHDLFMLTTLQFSRCILIGIANAIDLADRFLPKLEPLNCKATRYNFXRAYSKDQISNIITQWWSGLGVVVFEPVGGRISRLGEVAPAAXDXEKALXVCRSAVGNIWIQGLQDS

SEQ ID NO: 128232 - protein, 46 aa, Triticum aestivum
  Clone ID: PAT_TA_22650.pep
RVRPFFFFLKEKSNLPSRDSIIILGCSILASVSSALSSSPTSQLIR

SEQ ID NO: 128233 - protein, 322 aa, Triticum aestivum
  Clone ID: PAT_TA_22651.pep
PGRAPPAAAPGPGSPSPPPPSRPGPARRHPWPAPHSHAHHNARAPSTSAPPHGVPSLGAPLAPDSAAPPVPVAIPGPASTPPSKPAPRPRKYRPHWQHRLPPHPSAASPPPRRATCAAAPRPAPPMGPKPPAWGGGMRALATQHPPTAPPARRRAPQQHSARPLRVSAAPSTAPPRSTTGQRHSRARALMPAWAPPPPPPSDPAFWHHPYMRGPAAYMPTHGTPCMAMPMTPKFPAAPVPVAMPCPVYASPSPAPALASKSQQDSQLQLQAQPSNESIDAAIGDVLSKPWLPLPLGLKPPSLGSVMGELERQGVANVPQACG

SEQ ID NO: 128234 - protein, 215 aa, Triticum aestivum
  unsure (1)..(215): unsure at all Xaa locations
  Clone ID: PAT_TA_22652.pep
QVDVVICAVPTKHALEQKPLIRAIKEAGCVKRFIPAEFGVDHTKVQICDMDHGFYEKKAEIRRLIESEDIPHTYIYCNFLMPYLPPSLVQPGLDAPPRDEVTIFGGGDTKGIFVEEGDVAKFTVCTIEDPRTLNMTLYLRPPGNIYSLNELXVSLWETXITKCLKKIHIXEEQLVKNIXNAPFPPKNXLXFXYSAFVXGDHTYFXIXSSEGTNCF

SEQ ID NO: 128235 - protein, 191 aa, Triticum aestivum
  Clone ID: PAT_TA_22653.pep
RHELVSCGDISLISSYEKVENCVYTSTLLRKCGRWGSEVANPKNNCSRWKLTHAERFAADFYITDAKSGKRALVKAGYHTKVVPLIDENVLVTTSRSTDLSSTLKCWLQERNLYSEEAQLIRLEEGYITEGMKLSVIGILSKKNGDFLIFPPREPISTGCVLLSFLLPAYFDGIVLRLVDKSYFMPHSGIS

SEQ ID NO: 128236 - protein, 233 aa, Triticum aestivum
  unsure (1)..(233): unsure at all Xaa locations
  Clone ID: PAT_TA_22654.pep
VDFEDPDDILDQGVXQQNDDLIKMRQATAKVLASQKRLENKYTAAKQADADWYRRAQLALQKGDEELAREALKRRKSYADNASSLKTQLDQQRSVVENLVSNTKLLESKIAEARQKKDTLKARAQSAKTATKVSEMLGNVNTSSALSAFEKMEEKVMTMESQAEALGQLGADDLEGKFAMLETTSVDDDLAQMRKELSGSSLKGELPQGRSATPRDRDIEXELNELREKANDY

SEQ ID NO: 128237 - protein, 171 aa, Triticum aestivum
  Clone ID: PAT_TA_22655.pep
MASAALFVLLALATMQPQTASSEKETHLKVYWHDVVSGPDPTSVPVARAATTNTSKSAFGVVMVMDNSLTEGPSLNSSRLMGRAQGTYIAAGKDQLALLMLMNFVFTAGKYNGSSVAIMGRNAVFTEVREMAVVGGTGVFRWARGYAQARTHTLDLKTGDATVEYNIFIMH

SEQ ID NO: 128238 - protein, 61 aa, Triticum aestivum
  unsure (1)..(61): unsure at all Xaa locations
  Clone ID: PAT_TA_22656.pep
HGNERDLXMNRXPVPFFLLFSSTGGGPGRYKLRSIYPSGIKTQVELFQLLFPLPFSTFAST

SEQ ID NO: 128239 - protein, 106 aa, Triticum aestivum
  Clone ID: PAT_TA_22657.pep
PEYRPAASPTFVPSKHSNSHRKVVELRRQKDTPQRPPRHHSPRPPPLQRPLPPAPHPPPRPQPRLGPGPGVSRCRAPLLFDGPRLGGGADEFLIRNRIGPDHRQLI

SEQ ID NO: 128240 - protein, 296 aa, Triticum aestivum
  Clone ID: PAT_TA_22658.pep
MALPGLAFSNSQVVMLAACTGPPVTAGRPSRARFMYSLTSVNRKLIVSSSSINNPYTAAGGMQQVAAGEDEHELKLLGTWRGPFAMRVRLALNFKGLSYEYQEEDLANKSDLLLASNPVNKKVPVLIHNGMPICESLAILEYIDEVYHGIGPSLLPADPYQRARARFWAIYIDDKLVAPWWKMFVGKTDKEKDEGTMQTLAAVDMLEGALRECSKGKPFFGGDNVGYVDVVLGGMVAWMQGTEALCGVELLHTTKTPLLLAWMERFGEMEPAKVVLPKVDRLVEFAKMKRAQRALI

SEQ ID NO: 128241 - protein, 165 aa, Triticum aestivum
  unsure (1)..(165): unsure at all Xaa locations
  Clone ID: PAT_TA_22659.pep
KAAWTFAQDCGISLVTVCPAVTVGEAPAKIVGSSGRLDPGPLPGEGERGRDPADTAEESSAIPMVHVHDLCRANIFVAEEEAASGRYICSCLDTTLTELATFLAAKYPQYNVNVNRFGGSPGEAESLXFPSAKLVGEGFEFRYKALDEIYDDVINYGRPWGILPY

SEQ ID NO: 128242 - protein, 84 aa, Triticum aestivum
  Clone ID: PAT_TA_22660.pep
GPTLLNSPSIIRSSWETTDEFSAYKHLPRRLRSVTSASRSLFCRGHPSRRCDGAIVIIHWLVIERRFVRCSRALVVASCKAAVP

SEQ ID NO: 128243 - protein, 193 aa, Triticum aestivum
  unsure (1)..(193): unsure at all Xaa locations
  Clone ID: PAT_TA_22661.pep
RKIDVFEPCILSTTYIDHLSPLDTAQVIKASLAQCANVVSTXFIQNYTIQYEIPAAALVEVDNVSQAQAAVDLMNNFPFMFGGMPRPVRAVFAKPEMFPDRPRKPGLKVEFSWVKQGDPAYDGMNKLKGLIRRQEAENMALIKNQLEEEKELAAQQQETLEASTTKYVTLLALLYNGEITKLAQHYKVKLGED

SEQ ID NO: 128244 - protein, 173 aa, Triticum aestivum
  Clone ID: PAT_TA_22662.pep
LACLGPVHFVACSPTFRGLLPHDWGFHLCRLVLPCLPSRGVGSCCARRRCRLRASRWGGIWGSSLRFGWLFGAPSLLDVVSIPDLPFVCLSASASRFRDLRSHAVSVLPPGVWLLLSCGPGPLGSASGGVAAARGSGSGTAALIERPPAFMWGTCRHSLLAVLQRAWRLSLCT

SEQ ID NO: 128245 - protein, 81 aa, Triticum aestivum
  Clone ID: PAT_TA_22663.pep
RTWSPAASSPNLATPSPSALRSAASPRTIRARPLWGWLISPMITCSSWTSSGFLPPPPDGAPACPSIDCVVVTAYIIEVGE

SEQ ID NO: 128246 - protein, 109 aa, Triticum aestivum
  Clone ID: PAT_TA_22664.pep
RICGQCGKNFNLACIDVKAENGLPPIYMSPLLPPNNCMSKLLTRDDDTEEVVRNRLRIYNEMSQPVEDFYQKQGKVLEFDLPGGIPESWPKLLDVLNLEDQQEMKLAAA

SEQ ID NO: 128247 - protein, 269 aa, Triticum aestivum
  unsure (1)..(269): unsure at all Xaa locations
  Clone ID: PAT_TA_22665.pep
MAAVQRLLRSSAVAAAGRRRMATSLAPGQAPAAAPAFPFAGAERRRRPAHERNVQWVFLGCPGVGKGTYASRLSRLLGVPHIATGDLVRDELASTGPDAVQLKEIVNQGKLVSDEIIINLLSKRLKKGEEKGESGFILDGFPRTVNQAEILDGVTDIDMVVNLKLREDIIVQKCLGRRICGQCGKNFNLACIDVKAENGLPPIYMSPLLPPNNCMSKLLTQXDDTEEVVKXRLRIYNKMVSPGGTLTLRRSWREVLSLEDQQEMKLAAA

SEQ ID NO: 128248 - protein, 323 aa, Triticum aestivum
  unsure (1)..(323): unsure at all Xaa locations
  Clone ID: PAT_TA_22666.pep
PPNSILCNTLLSMCADVGLVAEAEQLFEEMKNPDLTDVPQPDKWSYTAMINIYGSIKDADRALQLFVEMLQSGIEANIMSYTIVIQCLGKANRIRDAVEVLEAGLERGLKPDDRLCGCLLSVVALSTGEETELVLGCLEKFNGNLVKLIRMLGDDQVGTDELKDQLKAVLNAAETEVRRPYCNCLIDICQNHGLPARRPRELFRLAQGYGLYSKLHIRXTTKWLLDLRSLSVGAAKTAFDDWMAALSERVMQGQPLPQSFNVFTGSSTHKFAQGLASAFAAHLEEAAVPFRRSESQVGSFVSSRVELVPWLQTSSSSSRVVAG

SEQ ID NO: 128249 - protein, 264 aa, Triticum aestivum
  unsure (1)..(264): unsure at all Xaa locations
  Clone ID: PAT_TA_22667.pep
MASATEMQPLAPSGYRRAPEMKEKVEASSIDLEAGNGETLYPGISRGENALRWGFIRKVYGILCAQLVLTTVVSAITVFHPTLNATLSNSPVLALVLAVLPFILMIPLYIYQHRHPHNLAILGLFTLCLSFSIGVACANTEGTIVLQALVLTSAVVVSLTAYTFWAAKKGKEFSYLGPFLFSALTILXVISFTQIFFPFGPASNAVYSAGLELFLFSGYXSLYDTENLIKRHTYDEYIWASVELYLXILNLFLTILQMLRQNDN

SEQ ID NO: 128250 - protein, 325 aa, Triticum aestivum
  Clone ID: PAT_TA_22668.pep
MWRLGLAGGEEAAGEGLPERPGEANCVYYLRTGACGYGETCRYNHPRDRAAAFDGGTRTARTVEYPERPGQPPCEYYMKNGTCKFGSNCKYNHPREGGSVQPVVLNSCGYPLRLGEKECSYYIKTGHCKFGSTCKFHHPEGPEHGVVSETPNMYPPVQQLPVSSPLPYPPLASWQLGRPSVLPRSFFPGSYPPMMHPSAVMPMQGWNPYMPPINQVASAGGQQTVQAGSLYGLSHQGPPSAVAYGSNYASLSSSAWPSIDKQEVVFPERPGQPECHHYMKTGTCKFGSTCKYNHPQYLSTPRSNYMLSPLGLPIRPGAQPCLYYS

SEQ ID NO: 128251 - protein, 82 aa, Triticum aestivum
  Clone ID: PAT_TA_22669.pep
PNHQIKKLWERSSGRERQCRSAASTPPRPSRWPSPTPCPPPPSSPPPPPRRSPPCSQRSRRRPWLRPRRRPSCRRRPRTQRP

SEQ ID NO: 128252 - protein, 90 aa, Triticum aestivum
  unsure (1)..(90): unsure at all Xaa locations
  Clone ID: PAT_TA_22670.pep
VLAIVYIILADTLYLARALALARIHNFTYSTSYVSGRAALVTGCETTNRAPMISITCRWSAAPPAQRPVLNLPARASAAIALARLXAQAT

SEQ ID NO: 128253 - protein, 372 aa, Triticum aestivum
  Clone ID: PAT_TA_22671.pep
PVGARVCDVDGWCVFSAWACGGDFAGLPVPNCVVGWVGWGGSFRPLKALEAAGTTIRLAPQNQRLPPASSRAAYNRPRFTTRSTQGLHPRPTQKKLATSLKDLGVNNGNLIRGAHMSTMGTGTSGNSFANISNGAPLAPTNRAVQSLESNNRQHLGRINSSSTDSFSSFASDSPHFPDLGRSSNTWQTAVPSNIQQLGQNGSMSQASLHGNGPRMEPVSSYTPPSNQITSLGNDMQNQVAPLASNTLPMVFNQGAAPFTFGNSTNSREALNSNLAFSNSGINTSLPNLRIDNSVVPRQTLDGGNTGGVPSLQDGKIDQQAVGNQLNYNNNDLVGTSGLQRELSGGLDDIVVDMFRPDNDNGGIFIDTDWGLV

SEQ ID NO: 128254 - protein, 112 aa, Triticum aestivum
  Clone ID: PAT_TA_22672.pep
ETDASSISVRGADAPGKDVAACNSVAKASSLQSADRCTVNDAVSANVSGASESNGSTQVIEGKYGSADSQKLTQNPNGEDGTRATLVVQKSRTGSLIDGLTQKWGSFFKNND

SEQ ID NO: 128255 - protein, 54 aa, Triticum aestivum
  unsure (1)..(54): unsure at all Xaa locations
  Clone ID: PAT_TA_22673.pep
LGRIVTMLAPCSXGRENKLFDLKNVLEDWKTYKKRVAAGNTDYFSWRVPGRCIH

SEQ ID NO: 128256 - protein, 291 aa, Triticum aestivum
  unsure (1)..(291): unsure at all Xaa locations
  Clone ID: PAT_TA_22674.pep
LATERLGFAANFKISFYPGKFSKERRSIIPAGDTSEFIPSREADIAILEEPEHLNWYHHGKRWTDKFNHVIGVVHTNYLEYIKREKNGALQAFLVKHINNWVTRAYCHKVLRLSAATQDLPRSIICNVHGVNPKFLNIGEKVIADRERGHNSFSKGAYFLGKMVWAKGYKELIDLLYKHKNDLEGFKLDVYGNGEDSQAVQAAARKLDLGINFYKGKDHADDSLHGYKVFINPSVSDVLCTATAEALAMGKFVICPDHPSNEFFKSFPNCLMYKTPXXFVARVXXXMSSEP

SEQ ID NO: 128257 - protein, 182 aa, Triticum aestivum
  Clone ID: PAT_TA_22675.pep
MRLWSSRPRRRPTGSLQAAFCNALEEAINTLVDPPVLRPSVDPRHVLSANFAPVDELPPTPCPVVRGVIPRCLAGGAYIRNGPNPQHLPRGPHHLFDGDGMLHSLLLPTAPDSDPVLCSRYVQTYKYIVERNAGEPVLPNVFSGFHGLAGMARGAVTAARVLTGQMNPMEGVGLANTSLAVF

SEQ ID NO: 128258 - protein, 79 aa, Triticum aestivum
  Clone ID: PAT_TA_22676.pep
FSSVRFDNGYFRNLLSRFGLLHSDQELFNGGPVDSIAQQYAGNGGAFSADFVTAMIKMGNISPLTGSNGEIRNNCRKPN

SEQ ID NO: 128259 - protein, 76 aa, Triticum aestivum
  unsure (1)..(76): unsure at all Xaa locations
  Clone ID: PAT_TA_22677.pep
FKGRDFQFLPFGAGRRICPGINFGMASVEIMLANLGFXLXLAWSRPRWQEDLDMTGVFGITMRRKEKLFLVPRTRC

SEQ ID NO: 128260 - protein, 246 aa, Triticum aestivum
  Clone ID: PAT_TA_22678.pep
RRLERRRARADELAVARRRAAEGVERRKEQMQAQIERVLPLSRALAAAHRQVQEAKELKSAEKARLGDLQRLLRTRQQSMVAQVAALYPVRVFRDLPAAENHHSRTNGECRTPSEENGALPQEMNGNGTHLLSVIKSPHVGPLTFFGWQIGKPRTKQPTYSHKELQRSAAVLGYAAHPCLLPRVLPFPAASPSPSQGHQLIPFSWNSKMIQQRHPTPFTCSKGYGAALELHRSRDSGRMHRNLREL

SEQ ID NO: 128261 - protein, 179 aa, Triticum aestivum
  Clone ID: PAT_TA_22679.pep
QIKREISIMKLVRHPNVVRLHEVLASRKKIFIILEFITGGELFDKIIRHGRLSEADARKYFQQLIDGVDFCHSKGVYHRDLKPENLLLDSQGNLKISDFGLSAWPAQGAALLRTTCGTPNYVAPEVLSHKGYDGALADTWSCGVILYVLLAGYLPFDEVDLTTLYGKIESAEYSFPAVF

SEQ ID NO: 128262 - protein, 108 aa, Triticum aestivum
  Clone ID: PAT_TA_22680.pep
GAHLSPSDAASIIEAAQSKDAIHIRPGESLPNQLKPLAPRPLSSLAPAIAPSSAQHLQQPGQSSFGDSTAAKEAIFGSTDGSDGDEYEDEDTDDDDDEGLTGDEGEQE

SEQ ID NO: 128263 - protein, 95 aa, Triticum aestivum
  Clone ID: PAT_TA_22681.pep
CGDAMPRSMRTCVQCLCGEDVRRALHPHSRVGPDVRESVVHPLPGRLQELVRAPSSLDSLTRPPADIAGNMHGCYFGAYLPPCNPLFNVLLFLSQ

SEQ ID NO: 128264 - protein, 95 aa, Triticum aestivum
  Clone ID: PAT_TA_22682.pep
SFAFNTYYQSQGKAGGSCYFQGAGMVTTTDPSHDSCIFVGSKLYSNVTKSDGANTTTTQTSDAEGCAVWRLRTGREKGFLSAPRLLLSPNGGGYQ

SEQ ID NO: 128265 - protein, 179 aa, Triticum aestivum
  unsure (1)..(179): unsure at all Xaa locations
  Clone ID: PAT_TA_22683.pep
PECEDHVNGIIAKICTLLEEYTLESDDDHGQPSSSFSSLEAPTLMSLFNARGAQKRTTSFRMKSELDRYLEDELVPLSNDKFSVLDWWKVSGTRYPTLRLLARDVFATPVSTVASESTFSTSGRVLSDNRSRLTPEILGALLPSPASARSXCLDADNEDGQRFWSCLQDIQEGMRDLAL

SEQ ID NO: 128266 - protein, 96 aa, Triticum aestivum
  Clone ID: PAT_TA_22684.pep
KSHMLSISHSTGKTADPDSSISEPLLKEAVEITQPEENGLKIDCIHESYFAANPEHDLSAVSVDTSEERVVLVNNDDDVGVESAAGSAVSASQGDV

SEQ ID NO: 128267 - protein, 91 aa, Triticum aestivum
  unsure (1)..(91): unsure at all Xaa locations
  Clone ID: PAT_TA_22685.pep
RPCRETGLAGTSGAERRAWREPPGRERRPGXSGDLAGAGRAGTSLVAADWRDRAGAAYGRETTRRRRGGGERGSEHELRVRKKKPKALIPC

SEQ ID NO: 128268 - protein, 129 aa, Triticum aestivum
  Clone ID: PAT_TA_22686.pep
ARARPILHLNEGAKLLAEPRAREPTGAQESGGSTRLRERRISGTALRERRGGPVGRHLGQGAGPGAKEVNDLGVSVALSMLKFYKREISPLLPSSCRYVPTCSEYSMQAYKRHGVAKGTILTAWRLCLL

SEQ ID NO: 128269 - protein, 112 aa, Triticum aestivum
  Clone ID: PAT_TA_22687.pep
MATATRLLPTLLRTLTGTRHAGAARGLATEKAVGAAAVVGSHTAKWMQDTSKKSPMELINEVPPIKVEGRIAACEGDKNPALGHPIEYICLDLDAPAVCKYCGLRYVQDHHH

SEQ ID NO: 128270 - protein, 272 aa, Triticum aestivum
  Clone ID: PAT_TA_22688.pep
DASRFDLVDAMYKEMAERSVTPNTVTQNIVLSGYCRAGRLDDMEKLLSAMLESANCKPDVWTMNIILSLFGNSGQVELMEKWYEKFRGYGIEPETRTFNILIGAYGKKRMYDKMSAVMEYMRRLAFPWTTATYNNVIEAFAVAGDAKNMEDTFNQMRSEGMKPDTKTFCCLINGFSNAALFHKVVGMVKLAERLDVPANTSFHNSVLAACAKAEDLMEMERVFRHMKHMQCEADAITYSILLEAYRKEGMTDKMYALQQENPSLVSTELVMV

SEQ ID NO: 128271 - protein, 311 aa, Triticum aestivum
  unsure (1)..(311): unsure at all Xaa locations
  Clone ID: PAT_TA_22689.pep
IPFYGDNWRNPAASGPASSLLPAVVAFPDRHRMAAFSAARSAADLKETFAAWMTEQHWEDMKQLFESWVRSLDAATGKPNRPDVDLFNHYLRANLMSGALPHEMLDLADQMREFDLAPNTASYNLVLKTMVKAREVEGAEKIVERMLQTGIVPDDESYNLVVDLLLRHNRADSAFKYLELMLKSGYAVSSLVFAEYVRVCVKSGSLDTLASIIEKCKATEKNKLLCPQWAWCIDIAEAAFEANNSKLAMFGLXFLARWIAHGEGSKPPIHRSVXXLVLSAFSAAGRTAAVTEPLAIYQSCAERHARDYLQD

SEQ ID NO: 128272 - protein, 468 aa, Triticum aestivum
  Clone ID: PAT_TA_22690.pep
MTRRAALWGAAFARPSPCLCAPVVAARAGGGPRPPPAPSRPAPPLRPMAGALADARGVGHGRPAHSRAFERAVEAVAASPVRAGAQRWVPPGRWLAGPCCLSCRVARSLPGGAASRGITDGHVWPLMPALPSYGYGRERKGPRFCSLIHGQNLKDVVITGHNGSINGQGEVWWLKHRRRMLKNTRPPLVQLMWSKDIVITNITLRNSPFWHFHPYDCTNVTVSDVTILAPISGAPNTDGIDPDSCEDVLIENCYISVGDDAIAIKSGWDQYGIAYGRPSSNILIRNVTVRSLVSAGISIGSEMSGGVANVTVKNVRIWDSRRGVRIKTAIGRGGYIRNISYSNITFDNVRAAIVIKVDYNEHADDGYDRNAFPDITGISFKKIHGWGVRVPVRAHGSNYIPIKDITFQDMSVGISYKKKHIFQCSYIEGRVIGSVFPKPCENLDVYDEQGQLVKRGAVLNSTEVDYDI

SEQ ID NO: 128273 - protein, 101 aa, Triticum aestivum
  Clone ID: PAT_TA_22691.pep
MAAAAAGATRRAASSLASRCLLSRPAASPAAVPSALRRADGARGLLPGLLQRFGTAAAAEEPISPSVQVGETQLLINGKFVDAASGKTFPTLDPRTGEVIA

SEQ ID NO: 128274 - protein, 73 aa, Triticum aestivum
  Clone ID: PAT_TA_22692.pep
AGVFTNNLDTANTLTRALRAGTVWVNCFDIFDAAIPFGGYKMSGIGREKGIDSLKNYLQVKAVVTALKNPAWL

SEQ ID NO: 128275 - protein, 552 aa, Triticum aestivum
  unsure (1)..(552): unsure at all Xaa locations
  Clone ID: PAT_TA_22693.pep
MAAAATRRAASSLASRCLLSRPAASPAAVPSALRRADGARGLLPGLLQRFGTAAAAEEPISPSVQVGETQLLINGKFVDAASGKTFPTVDPRTGEVIARVAEGDAEDVDRAVVAARXKAFDEGPWPRMTAYERSRILLRFADLIEKHNDDIAALETWDNGKPYEQAAHIXEVPMLARLMRYYAGWTEKIGLIIALADSVPPEGPHHVQVLREPIGDVGQITPFDFPLLRXACKVRRALACGNACVLNTAVXTPLSALDVSKLLHEAGTXEGVLYSASGFXGPTAGAALATRMGMLTRLVLTELILXLAARSNDKLVTQELEGNDPFIVVDDADIDQAVELAHFALFFNQVXCCCAGSRTFVHERVYDEFVEKSKARALKRVVGDPFRKGVEQGPQIDDEQFKKILRYIKSGVDSGATLVTGGDKLGDKGYYIQPTIFSDVQDGMKIAQEEIFGPVQSIFKFNDLNEVIKRANASQYGLAAGVFTNNLDTANTLTRALRAGTVWVNCFDIFDAAIPFGGYKMSGIGREKGIDSLKNYLQVKAVVTALKNPAWL

SEQ ID NO: 128276 - protein, 176 aa, Triticum aestivum
  Clone ID: PAT_TA_22694.pep
VEGISQGLSGTQVSRPEASRYTIIGDWYRPPFFISGALRGTRGGLQPRVPPEEAQDGGREPPRDPGPERHNHAPGAGARIPGEVAELAFTRCVWEAGVLVHVTLWLLCTRLGTLALCGRLCVSGEFPYVRRFADMPVGRREEALRRWARARWLIPRQDRLRHGQEPLLQRLLHQGA

SEQ ID NO: 128277 - protein, 87 aa, Triticum aestivum
  Clone ID: PAT_TA_22695.pep
HPNSQGTYLPTRSLFHWFMYANLLLVTKGILIKCKTEKPLHYQAFSKVPHNGHRVVIDRTIVQKNMYILALRASSIHKILNRYYGTT

SEQ ID NO: 128278 - protein, 77 aa, Triticum aestivum
  Clone ID: PAT_TA_22696.pep
LIPSREEGRAAVIHMTSRVKRRNEKEKRLLAVLTPNQNVSEPERASVLEYGHELAGDVNGHEPVRARRGASRPRKRP

SEQ ID NO: 128279 - protein, 93 aa, Triticum aestivum
  unsure (1)..(93): unsure at all Xaa locations
  Clone ID: PAT_TA_22697.pep
MGTEDSKDMLKNADWKTVSGAVTESSQPVVRKRLPKKIRQVPECYFLPRRSLPSALAIYGAVCAAGVGAGMLLEVWXNKKIKEDGGVVWEMGK

SEQ ID NO: 128280 - protein, 283 aa, Triticum aestivum
  unsure (1)..(283): unsure at all Xaa locations
  Clone ID: PAT_TA_22698.pep
MATSAMTLAMAAATDASLFHPTFLAQHKLAPASASLPLIFSRAPLLRSTRPRVPLTPLVASSDAAEAGLDWADAEEAEETVTEEEPAVAASGGDAGYAAEPPEEAKVYVGNLPYDVDSERLAQLFDQAGVVEVAEVIYNRESGQSRGFGFVTMSTIEEADKAIETFNRYDISGRLLNVNRAXQRGSRVERPPRQFASSFRAYVGNLPWQAEDSRLVQLFSEHGEVVNATVVYDRETGRSRGFGFVTMASKEDLDSAISALDGQEMDGRPLRVNVAAERPQRGF

SEQ ID NO: 128281 - protein, 83 aa, Triticum aestivum
  Clone ID: PAT_TA_22699.pep
SFFFFFFNKNKKMGDIDQHCKWQRWMMDGCMGLTKNLQGVIDRPRIISGTYGRSWFGYKAVGRLNTPKASPEAKNYLYFTYYR

SEQ ID NO: 128282 - protein, 130 aa, Triticum aestivum
  unsure (1)..(130): unsure at all Xaa locations
  Clone ID: PAT_TA_22700.pep
MLATSRPLVAAASALPNSGLPRRTYTVQAIKPLGGGGGGYVACHSRAYPYAVYECHMMEGSSEEAYVVSIRGGSGLPTVDMAAVCHFDTSNWIPAHPAFKILGTHPGGSPVXHFLPYADLMFGVKMADNA

SEQ ID NO: 128283 - protein, 120 aa, Triticum aestivum
  unsure (1)..(120): unsure at all Xaa locations
  Clone ID: PAT_TA_22701.pep
FFFFILRNSISSLTRKXNEVYMKPMDTLSPMNTLRSVVVLRVGSPRTEPLGGPIDDQIGDLLLWPHSSRGARHRRCLQAATAVDVLELPTVVQRAAPGQEIRRGGADEEDDDQADAEARE

SEQ ID NO: 128284 - protein, 108 aa, Triticum aestivum
  Clone ID: PAT_TA_22702.pep
MEHGSVADSSASTFSIMEEDHTLANSVRFVLNQDPRVAFCGYSIPHPADNKVNIRVQTTGDPAKDVMKDALQDLMVMGQHVRGTFDKAVADFKSKMPAEQMDVDLNQQ

SEQ ID NO: 128285 - protein, 193 aa, Triticum aestivum
  unsure (1)..(193): unsure at all Xaa locations
  Clone ID: PAT_TA_22703.pep
AWSRPRYVQDSPLSLAASGAACQRAQSSPSSPPPPPPPLNPIPPAPPRSMAAKWAQKTVVIPAQRRGCHLITPKILREIRXDLSGFKCGLAHLFLQHTSASLTINENYDSDVQADTETFLNKIVPKGRSAPWKHTMEGPDDMPAHIKSSMFGCALTIPITDGHLNLGTWQGIWLCEHRDHASARKIVVTLNGI

SEQ ID NO: 128286 - protein, 239 aa, Triticum aestivum
  unsure (1)..(239): unsure at all Xaa locations
  Clone ID: PAT_TA_22704.pep
KPQSSFEHHHHHPHPVSPPSPPQDSLAAQAMRASAAHRDASSLSSAYSSAASAAAAARRSHEPSVSTPSPDSSSYGYTSMKSLNEAKYGFWGTLARKAKSLIDEDGSPEQYDSPTRQQPPRDGTSPSXHRQHLQQPAPETWKSETPPSQKRSEALASSLNYGGGSIASALAEGRTIVETKTADIIQETRKLNIRRKGLVKIHKEKLSQFAHRISSPLDYETIEGSPHLQMPFSKTNCYT

SEQ ID NO: 128287 - protein, 138 aa, Triticum aestivum
  Clone ID: PAT_TA_22705.pep
KYLALLYLATIQGIARGPRRGVEHCNAHGHKIDTLLACGGLAKNSLYVQEHADIIGCPIILPRENESVLLGASVLGAVAAKKFSGIHDAMKSMNAAGKVVHPSSDPRVKKYHDAKYQIFRSLYEQQLSHRSAMAQALQ

SEQ ID NO: 128288 - protein, 120 aa, Triticum aestivum
  unsure (1)..(120): unsure at all Xaa locations
  Clone ID: PAT_TA_22706.pep
IGKRLGXLTLVYPVDTFVLLSQNLSWRVVQAKPVPWTFVXNIGEWQEVWCNGIYPXTLHRVFNSSPRYRAXVAFFXESNFDAVVEPCGAMPRRKRAALPSTDKVVYGEHLVKKVLNNFVL

SEQ ID NO: 128289 - protein, 169 aa, Triticum aestivum
  Clone ID: PAT_TA_22707.pep
MDGHVGQFFQSVSSIFRGSDTLPVCDRDIIAGCETEVAEAANEEQKNDSLMRLSWALVHSRQPEDVNRGIGMLEASFGKSNSPLQTREKLYLLAVGHYRNGDYTRSRELLERCLEVQPDWRQALTLERLLEEKTKRDGMIGMAIVTGAFGLVGLVAGGIIAAASSSRKK

SEQ ID NO: 128290 - protein, 111 aa, Triticum aestivum
  Clone ID: PAT_TA_22708.pep
MAAQGLLSGRQLLGRPLQSSISRSSSSRKSPFVVRASSSPPAKQNDNRQLRFASKQSLTYLDGTLPGDFGFDPLGLSDPDGTGGFIEPMWLAYGEIFNGRTAMIGGVGMIA

SEQ ID NO: 128291 - protein, 84 aa, Triticum aestivum
  Clone ID: PAT_TA_22709.pep
PTTGRCSTWSRPSRRRGDDKRARAAAGGPEIVAAHALCFVPVVRYLDGARNLCMCRLSCYKCYNMSLLCQCMAAGDGCFRGWGR

SEQ ID NO: 128292 - protein, 289 aa, Triticum aestivum
  Clone ID: PAT_TA_22710.pep
AALLLENQEYTEALTLLTGLIGEVRGLDDKLLLVDIDLLESKLHFSLRNLPKAKASLTAARTAANAIYVPPAQQGTIDLQSGILHAEEKDYKTAYSYFFEAFEAFNALDDPRAIFSLKYMLLCKIMVNQADDVAGIISSKASLKYVGPDVDAMKAVADAYSKRSLKYFETALRDFKAQLEEDPIVHRHLSSLYDTLLEQNLCRLIEPYSRVEIAHVAQMIELPIEHVEKKLSQMILDKKFAGTLDQGAGCLIIFEDAKTEAIFPATLETISNVGKVVESLYMRSAKIMA

SEQ ID NO: 128293 - protein, 236 aa, Triticum aestivum
  unsure (1)..(236): unsure at all Xaa locations
  Clone ID: PAT_TA_22711.pep
MSAMQSSYLPATTESIAMAQEAKDASESILILYRVLEDPSSSSDAVRTKEVAITNLTNYLTKENRAEELRNLLTQLRPFFALIPKAKTAKIVRGIIDAVSKIPGTSDLQISLCKEMVEWTRAEKRTFLRQRVEARLAALLLESQEYTEALTLLSGLIMEVRRLDDKLLLVDIDLLESTLHFSLRYQRNANAXLTAERTAANAIYVPPVQHGTIDQLNIHLHAEEPNSNSSYSYFVR

SEQ ID NO: 128294 - protein, 77 aa, Triticum aestivum
  Clone ID: PAT_TA_22712.pep
IVQTIHYVKWKTQTFRFNNSLSWSLLVSDKSKQFTKHICTIASMHWTAEQFTLLPGTLPFLDNYGYYAIDSSKSCSP

SEQ ID NO: 128295 - protein, 87 aa, Triticum aestivum
  Clone ID: PAT_TA_22713.pep
GWIGPLARPSRTARPGSVPTVMGVARACLQRDPPKRPSMVDVPYTLSQGGRVLRGLLRRERVRGWQRRDRRAVSRLFVVLLCFVVNQ

SEQ ID NO: 128296 - protein, 656 aa, Triticum aestivum
  Clone ID: PAT_TA_22714.pep
VFFCVVGKRWIIILVPLAMKRQREAALDDAVETVKIGKATWMADGTHWPGTWIQPSAEHTRGDHAGIIQVMLKPPSDDPLYGGDGEEGRPLDFTDIDIRLPMLVYVSREKRPGYDHNKKAGAMNALVRSSAVMSNGPFILNLDCDHYVYNSQAFREGMCFMMDRGGDRIAYVQFPQRFEGIDPSDRYANHNTVFFDVNMRALDGLMGPVYVGTGCLFRRVALYGFDPPRSTEHGGCCSCCFPKKRKIKSTVSSGTSEETRALRMADFDDEEMNMSTFPKRFGNSNFLINSIPIAEFQGRPLADHPGVKNGRPPGALTVPRDLLDASTVAEAISVISCWYEDKTEWGQRVGWIYGSVTEDVVTGYRMHNRGWKSVYCVTKRDAFRGTAPINLTDRLHQVLRWATGSVEIFFSRNNALLASRRMKCLQRIAYLNVGIYPFTSIFLIVYCFPPPPSLFSGQFIVKELDVTFLTYLLVITLTLCMLAVLEIKWSGINLEEWWRNEQFWLIGGTSAHLAAVLQGLLKVIAGIEISFTLTSKSGADDENDEYADLYIVKWTSLMIPPIVIMMVNLIAIAVGFSRTIYSEIPQWSKLLGGVFFSFWVLAHLYPFAKGLMGRRGRTPTIVFVWSGLLAITISLLWVAINPPSQNSQIGGSFQFP

SEQ ID NO: 128297 - protein, 303 aa, Triticum aestivum
  unsure (1)..(303): unsure at all Xaa locations
  Clone ID: PAT_TA_22715.pep
MVHVELDLADEWSESDVSEDVSDSEVGDGLDWLDTVESHDGSARLSAAFSTVGGAAAARRPNAHGGVLSRPFQPLSNRTQKLASHIRATPLEEWEGRMNVGMSNSVTTAIRDSIRDTSIGKXRNHEKADRATVEQAIDPRTRMVLFKMLNSGVFNNINGXCISTGKEANVYHATKIDGQELAIKIYKTSVLVFKDRDRYVQGDYRFRYGYCKHNPRKMVKTWAEKEMRNLKRVAAAKIRCPAPLLLKLHVLVMEFMGKGGGAAPRLNDAALSVDTLREAYFEIVTIMRTLYQKCKLVHGDLSV

SEQ ID NO: 128298 - protein, 171 aa, Triticum aestivum
  unsure (1)..(171): unsure at all Xaa locations
  Clone ID: PAT_TA_22716.pep
TRVTLTISVPEWWGGRFLQGYVVLSDRAILLSFRQAEFFIFSCHSLAWTQVITQHINTYIPIRGHGVYIKEDNTVDMLYNNXIYXYELRXPGHEGLQPPVKVDSVCPFSGYGFLTQLDRRLLCXVXIXSXXDKCSCNCPHXLIXTFPSSQRHRFCINLPVKHAAKQFFGTK

SEQ ID NO: 128299 - protein, 151 aa, Triticum aestivum
  Clone ID: PAT_TA_22717.pep
PGLSSSSSSSSSTPSLCASSSKEVRSMEPEENPNRPPSRLDCIKYFNALWSCYSPFHQMQNYYRYGVFDNCSSKWRDLVDCLTLKTKSKAEVEEMLMAREKARPHFWTYRTVDEASANWWKMYKHRVMMSSPPKTAGFPAPPPKSAAPKKR

SEQ ID NO: 128300 - protein, 273 aa, Triticum aestivum
  unsure (1)..(273): unsure at all Xaa locations
  Clone ID: PAT_TA_22718.pep
EVGAPRRSLQGGERRPRTPPPSASTGTGQVVNPGAPTSPSQPRSANHPQPCRPSDRGCPPAPEPRGQPTTNTAGQPPPPRATPEPRTHEDGEGGRGRNGPRPRPATTWAGDGQLRNGAPVLPTSSPPRNXPVSPHPAIGPAPRETMAAARGRSRGSRALAATSMDDHRRDLPCRTTPTSRKGPTGQRRTHPPAAAPPPRPRAMAGEADRDPGHPRPAAPEADLGAPPDAAAATTDLQPAPPPRCPSHRRHAPSPAHAGAPSSCCAQRQAPHPG

SEQ ID NO: 128301 - protein, 75 aa, Triticum aestivum
  Clone ID: PAT_TA_22719.pep
IFGVSKLFKPCSCLQWLLPIMLVLLKFFCQINSYDAKSLVTSFNILELRSKLLGFNILGYEPWSYCPSVLDNSPV

SEQ ID NO: 128302 - protein, 82 aa, Triticum aestivum
  Clone ID: PAT_TA_22720.pep
DGYPTSNLQTLPRKQTHRRKVSETYPAVAPAKDGHGVPSCSGGQTAINIRALVDTMVGCNAVASASTLFHRIWPPAINSMSA

SEQ ID NO: 128303 - protein, 91 aa, Triticum aestivum
  Clone ID: PAT_TA_22721.pep
HLRCPTLPPWCDSETLRTPYSTAARPRPVFPLSAPRFHGCWLPYWQRLLGCAPAVAVAFRPSCVSLSSSFCSVIFPPQHKVPGLNCELAHE

SEQ ID NO: 128304 - protein, 261 aa, Triticum aestivum
  unsure (1)..(261): unsure at all Xaa locations
  Clone ID: PAT_TA_22722.pep
MRPCFVGNPTCLRKLELNEGSLEYLQVDSCTALEELEVENCHLLVAIEGIQSLGTLRSLVLLVNSSMESLQLHSCTALERLEIQYCSSLVSLEGLRSLVNLKHLKILYSPALGSLTPLESYEPIEGISSHSXSLXVHDLSPLNASFCKGLTCLRSLMLIELDATRLTDEQERALLLLRSLQELCFVECEDLVHLPAGLHGLHSLXSLKIISCSSISGLPKEGLPPSXEKLGDLRLQRRVIRRMQSLATSKLEVEIDGCYVN

SEQ ID NO: 128305 - protein, 145 aa, Triticum aestivum
  Clone ID: PAT_TA_22723.pep
LDQDTFIANPAMKAARLLLWVLAACSAHVVICNTFISYGNEMDRLSLLAFKDAISLDPQQTFMSWNHSTHFCNWGRCPMQGQGSTSCHFSKPGQVEVWVGHISPSLGKPNIHAVFGPSTGNTLRRGRSPPCLGTWHPPPKTKKKK

SEQ ID NO: 128306 - protein, 86 aa, Triticum aestivum
  Clone ID: PAT_TA_22724.pep
MRRTTALLLRHGGGGIPQALADVLVCPLSKKPLRYCEASGSLVSDAVGMSFPIVDGIPCLLPKDGKLLEDHQRESGHETSSRDSSD

SEQ ID NO: 128307 - protein, 154 aa, Triticum aestivum
  unsure (1)..(154): unsure at all Xaa locations
  Clone ID: PAT_TA_22725.pep
DLHLVTHAFLQCISKNIGRQFFSLSSTKKLTAVPPIHAWNETSYARLPQIINHVPRLSVVLPPVPHHAWGCPFSSTQLPAVCALCFMPCEHGRVLARGVLSALCVPCVFVLCVLVCVLGYPSIGKSCAIASAAIVGCFSLGQRHNVISFPXKKK

SEQ ID NO: 128308 - protein, 386 aa, Triticum aestivum
  Clone ID: PAT_TA_22726.pep
MRFTAGGSSTRSWQPKPTADTTDLRFWLTWRVAVCALWVLCCVAAAAYLIWRHEGPRAHRRPGAAKQDTARRRPDGLLYDDEAWRASAPDINPRRLLACGLRSFCAPFRLLVVLVISRRANVFYYYTESSRPLVTDIFPPSTTASIFVSCYVLFSHAVAAMSDAEQGPYAVHGAAPKPIVDGEDDGTREVAGFWGYLLQIIYQTNAGAVMLTDCVFWFIIFPFLTVKDYSMNFLLIGMHSVNAVFLLGEASLNSLRFPWFRIAYFFLYTALYKVYRRIFHVIGMHSGPAVFLVGEASLNSLRFPWFRIAYFFLYTALYVVFQWIVHASTPTWWPYPFLDLSSNLAPLWYFAVAFMQLPCYLIFRLVMNLKPPLFSKHFPDSMVLGY

SEQ ID NO: 128309 - protein, 167 aa, Triticum aestivum
  unsure (1)..(167): unsure at all Xaa locations
  Clone ID: PAT_TA_22727.pep
FWVRSNQGLRGFFPQTCIYYAHLLCAPPLGTSDHLPSIAISVAGTGHVASSYPTGAALQTMKFGFPKPPLAXCPLRIPPRPAXSPPHILRKNPSPPNNGGSPXYAPTPSRLARAGRCSAGFVGRRSVHAPSRGNPRHYHXDKNXIXXGFHXNPKRXLLXDDHHXTKN

SEQ ID NO: 128310 - protein, 114 aa, Triticum aestivum
  Clone ID: PAT_TA_22728.pep
EHSKLIQDMCFPLDELLYILQQENRVSPARNVDAGEQDVKTSYMLLLIGYNYNMMVSVYFSEFETYISHHESEICKFHLESVNTFPLLYNFFVLMMVPCLLIIRGTNKLFLCLS

SEQ ID NO: 128311 - protein, 113 aa, Triticum aestivum
  unsure (1)..(113): unsure at all Xaa locations
  Clone ID: PAT_TA_22729.pep
KAPNMLNKTKEFLQRRSEFXISDLGLEPXYIAHRPVMLSYSLEGRLRPRCYVVKFLKENGLLHRDRDYYSAVAVTPKVFMEKFICPHKEAAPHLAEDYAAACRGEVPARFRFT

SEQ ID NO: 128312 - protein, 380 aa, Triticum aestivum
  unsure (1)..(380): unsure at all Xaa locations
  Clone ID: PAT_TA_22730.pep
HLLGFVYLLLLAHGYFLFLVRRWYEKTTWMYISVPLVLYVGERMLRALRSNAHPVKILKVLLLPGRVLTIQMSKPYGFRYRSGQYIFLQCPMISPFEWHPFSITSAPGDDYLAVHIRTNGDWTQELKRIFVENYFSPHMNRRTSFSELGAAEPRPTPAPKLLVDGPYGAPAQDFRNYDVLLLVGLGIGATPFISILKDLLNNIKLADELMDLAMETTQTSRSEDSANSFSVSTASSNRKRSYRTSRAHFYWVTREAXSFEWFKGVMNEVAEMDKKGVIPLLGGRSCPRATRPARTTLLSMVQALNHAKHGVDIVSGTRVRTHFARPNWREVFTKIAAKQPNSTVGVFYCGAPTLAKELKNLSHEMSHKTSTRFHFHKEYF

SEQ ID NO: 128313 - protein, 83 aa, Triticum aestivum
  unsure (1)..(83): unsure at all Xaa locations
  Clone ID: PAT_TA_22731.pep
RPVRVLVVYYLLTPFVRKYLSSKWIKKVYLNDKYFRTNRVRVIIYRHLTINLHLQCYHANNKNVCNIYCIIYTXFTKTVQINK

SEQ ID NO: 128314 - protein, 307 aa, Triticum aestivum
  unsure (1)..(307): unsure at all Xaa locations
  Clone ID: PAT_TA_22732.pep
MTVVRVDGASEDKVVLEEPNEDNSKTSEIEGKTNDGDAEEKKAVDEAGGEDKVSRDDDEKNDEAESGTKDGSSEQKDADNKGQSSSPTPLFSFTNLSSGQNAFTGLAGTGFSGSSFSFGSGSKDSSNAPLFGLKSDGSSFPSLLLGAGVXPITRQLQQTHQKKFAMSEGPVETGEENEKAVFTADSAIYEYLDGGWKERGRGELKLNIPVSGGERSRLVMRAKGNYRLILNASLYDDMTLKDMDKKGVTFACINSIGESPSGLTTFALKFKDTGIREDFKAAVETHKAKKASDTPKTPEGSPKASDV

SEQ ID NO: 128315 - protein, 136 aa, Triticum aestivum
  Clone ID: PAT_TA_22733.pep
MSILWEKSRAWRWLVGRTRDSKPFFFTFAALCGVVPGVVGYGVMQLTSSRNDKLEAHLRSNARPETTMMGQVNRERLAEFLGEIQRKENTNDRYVAALKGETLTRKRYERIQPVPQQAAQENAKDQQATKESAKAK

SEQ ID NO: 128316 - protein, 117 aa, Triticum aestivum
  unsure (1)..(117): unsure at all Xaa locations
  Clone ID: PAT_TA_22734.pep
IYSYGIVLLEMLTRKRPTNEEFNDGLTPPKFGGASLSRTPDLLHPGLASERNTFALKXCVLSGSLDLGLLCSAESPKDRPAMHDVYGEVTEVKEAYFSMGQPKATTLHIEGKDPPRR

SEQ ID NO: 128317 - protein, 156 aa, Triticum aestivum
  unsure (1)..(156): unsure at all Xaa locations
  Clone ID: PAT_TA_22735.pep
PRVRPRVRRSPPRPRPPRSRPATMCTLERRGRVFVLTLTGEDQHRLGHPLIAAIRSALAEVLAAAQAQPQGPGAALVTVAEGRFFSNGLDIGWAGTSRARLGELVDALRPVAADLLALPMPTVAAVTGHASTDGXLLALCHDCRVVRAXRGVLYMS

SEQ ID NO: 128318 - protein, 95 aa, Triticum aestivum
  Clone ID: PAT_TA_22736.pep
SLKALENPLKVVREDNGSSSARLRATSSRGSWNAAFFGSWRHSSSEIGPSRDDNMFKRSETIKSSGGSNGDHSSSRRRQSKEIFPEPSGSRDTED

SEQ ID NO: 128319 - protein, 48 aa, Triticum aestivum
  unsure (1)..(48): unsure at all Xaa locations
  Clone ID: PAT_TA_22737.pep
FFFWRQSPVFPRRIYSDNSSLVRPNKFRVGTTLTCISKSAILLVLLCX

SEQ ID NO: 128320 - protein, 121 aa, Triticum aestivum
  Clone ID: PAT_TA_22738.pep
GEKITQLHSSEFDNSAELRPIQVERALVAAKRPSSETTYAKPLAGYILCAEADDATLVLIRDPCSGCPPPTPPPPSSGPPPWRGASPPTPAGQPREPCCRAPCPPARPLSGSSSACPPRTS

SEQ ID NO: 128321 - protein, 257 aa, Triticum aestivum
  unsure (1)..(257): unsure at all Xaa locations
  Clone ID: PAT_TA_22739.pep
GGRAVHSQSAAYPCRANLPPPRPHLHGVPPPYYHQYPPWRPGAAAPPPVPFPTHVERHRAVAVSAGVNVKGHTLRLDRDDDGGHLLAFSFDADAPGSITVYFFAQEGDDCVLKGTKENLLKPRRLVTFKXEGHGPEFRQPSGTGIKLSMFEESELTKVGEDRVFPLAFKVEVGVPSKQELEXAHDAEDSKASGKFAVFVKKEPXNTGFLPCRHMCLCRECAQTLRFQTNKCPMCRQPVESLLEIKVDSTPRHQGGDQ

SEQ ID NO: 128322 - protein, 60 aa, Triticum aestivum
  Clone ID: PAT_TA_22740.pep
LGDGGEATVANELRLWDLMLHEVKLNISPGSSCHCSEPGWFRVCFANMSLGHAGRCTGRG

SEQ ID NO: 128323 - protein, 276 aa, Triticum aestivum
  unsure (1)..(276): unsure at all Xaa locations
  Clone ID: PAT_TA_22741.pep
PPGSAPLPLPPPPAPHTAPTRPLRPSAVPAPNTLPGGASALAAPPPAPRPGSLAKQAARPSSREQLEDDDMAGEDEITGXGAPTDQXRLRRRGQADREAASRSRSRNAAHLNPLQVQVSQLRVQHSSLVRRLADVNQKYNGAAVDNRVLKADVETLRAKVKMAEDSVKRVTGMSALFPAGSDMSSLSMPFTGSPSEATSDAAVPDDLSAYFSTSEAGGNNGYMPEMASSAQEDDNFLNEAMDTGKMGRPDSLHRVASLEHLQKRMCGGPASSGSTS

SEQ ID NO: 128324 - protein, 176 aa, Triticum aestivum
  Clone ID: PAT_TA_22742.pep
MASSLLKPHSHCSALPSGRSSGLNGGSCPATVHLVQGPAGRRGDALKARAFPLDVVPLMVTMVEHVDNQRDWVVTKSIWHLSDTAIKSFYTFYAMFTVWGVCFFATMKDPFYDSEYYRGQGGDGTVHWYYDRQEDIEATARGDLLREELLEEIEQRVGGLRELEDAGMEGELEEAK

SEQ ID NO: 128325 - protein, 175 aa, Triticum aestivum
  unsure (1)..(175): unsure at all Xaa locations
  Clone ID: PAT_TA_22743.pep
ARAPYPPAPRRPCSHAPTAPLGRPPATAPAAGGPRAHGRSRSGRSKRSGSAKVSALPSLEVVPLMVTMVEHVDMSRDYVVTKSIWHLSDAALKSVYTFYAMFTVWGVCFFASMKDPFYDSDTYRSAGGDGAVHWYXDRQEDLEASAWERGQRGERLEEIEXGGGGLREPKEGVAK

SEQ ID NO: 128326 - protein, 87 aa, Triticum aestivum
  Clone ID: PAT_TA_22744.pep
VKCPLPEPSILHDGRIWQERMSTAGGRPRTDLPVVKEGSQLEPDSSTTRSRSAVRRRAILPSVSAPEHNILALLDECDVPESQRPAE

SEQ ID NO: 128327 - protein, 157 aa, Triticum aestivum
  Clone ID: PAT_TA_22745.pep
MVGIFSRFSSGAGHRRAKSAVEVVETLAPNMETGESDPAADPGDSPHGIEVGIEFKPVEHPVEPVNLDQPVKCPLPEPSILHDGRIWQERMSTAGGRPRTDLPVVKEGLQLEPDSSTTRSRSAVRRRAILPSVSAPEHNILALLDECDVPESQRPAE

SEQ ID NO: 128328 - protein, 106 aa, Triticum aestivum
  Clone ID: PAT_TA_22746.pep
PHRRGRLMPIPHPRRVGEGRHLLDQMGHVRDWAPPGWYWEALPSGGRSLVRSQPVVDPILVWWRSRGPVTVPRLPDTADVVRHRVSEEDELVRRYMVALEGRFENT

SEQ ID NO: 128329 - protein, 183 aa, Triticum aestivum
  Clone ID: PAT_TA_22747.pep
VHQLRKSCFAASIVSVEDDKPKEKKTPCQEACEKAWKDKYEKACKERCEKACKEPCCDDCGDKGTPYGGHGYRCTPGCYSSPCGLPSCHYYSSGYGYGYGVRAPPLGYTWVRVEVARNRRMMRHAPPLEHCHGRVCTWTRCDFTVCGCACVFNTVSPYASCRQWWLVALGFCPAPCLAPLLKK

SEQ ID NO: 128330 - protein, 233 aa, Triticum aestivum
  Clone ID: PAT_TA_22748.pep
MAAAAVDPMVLGLGTSGGASGSGVVGGGVGRAGGGGAVMEGAQPVDLARHPSGIVPVLQNIVSTVNLDCRLDLKQIALQARNAEYNPKRFAAVIMRIRDPKTTALIFASGKMVCTGAKSEEHSKLAARKYARIVQKLGFPATFKDFKIQNIVASCDVKFPIRLEGLAYSHGAFSSYEPELFPGLIYRMKQPKIVLLVFVSGKIVLTGAKVRDEIYAAFENIYPVLTEYRKSQQ

SEQ ID NO: 128331 - protein, 381 aa, Triticum aestivum
  Clone ID: PAT_TA_22749.pep
MTTLNQFDLLGDVDNDDPSQLLAAAAAAAAKKAQANKTEAAPAGKAAQTAAAAKLPTKSAPPAQAGRDARSGGPPSRGGFGRGEPGRGRGGGRYGQNRDFGSENTNGYQGGYGGVGSGDGAVAGGGDGERGPRPYRGGGGRRGGYRNGEFGDDSERPPRRNYERHSGTGRGQGMKRDGAGRGNWGSSTDEGLAQETDEALKIEDNAPIAEKQGEQDDAPPTTVENKDHKDGAAKEEEENEEDKEMTLEEFEKIREEQRKALLALKTEERKVEVDKDLQSLQPLSTKKANDEVFIKLGSDKEKKKESTERDERAKKSLSINEFLKPAEGERYYGGRGRGRGRGEGRGDRGGFRGGFGGGYQRGQAAAPSIEDQSQFPTLGGK

SEQ ID NO: 128332 - protein, 108 aa, Triticum aestivum
  Clone ID: PAT_TA_22750.pep
SGRTRLTAQRVGPPEPPCCGNQGDGEVHSMDDDHDDDASSTETVQESCSQASATSSGPSSPCHSAKRGCSPSATKQGWDQHGIDEHAIMRGADDSRGPLRSITRPELR

SEQ ID NO: 128333 - protein, 190 aa, Triticum aestivum
  Clone ID: PAT_TA_22751.pep
LARPGASRVFHADSCERELETIRRPRRLRGAAHAGRSQREQEAPQGHGRWGRGLSMVESRSINAGRQGRDSIRPWDSHASLHVALHCNKHATKRRVVHAAVTTAGGLHATVRRPATQRSRRQRRRPGPRQLPALFLGPLLLNRGTGDSGGHALGDSIVEGKSRSIQRLDGVRAAGESQIRDRLFACSWNG

SEQ ID NO: 128334 - protein, 177 aa, Triticum aestivum
  unsure (1)..(177): unsure at all Xaa locations
  Clone ID: PAT_TA_22752.pep
MAMASPSWSSCCASTSTRPLPSPPASSKSRNPWRASSGRRSASGGKRRQQLSIRAVAAPSSAVDYSDTAAGAGDVPSLKIKLLSAVAGLNRGLAASQXTEPGTRADAAARQLQAAAPAPVDLAKDLDELQEGGMQVDSSAFSWSRLGGSRPRPPPARLLPIAPGLVXDSSGPCPSEM

SEQ ID NO: 128335 - protein, 124 aa, Triticum aestivum
  Clone ID: PAT_TA_22753.pep
CYTLETPESTDESNRRALADLHNLLGRSDPNKMQPETPAEIPSSVTFIPRKKSVDAMVVDEGPRFSSANPSLISAAAAVASDGTDQCQMDEDDPKASPPPPPPLMQTNSKMNSRRYRSSRADDE

SEQ ID NO: 128336 - protein, 40 aa, Triticum aestivum
  Clone ID: PAT_TA_22754.pep
SIGDDLNSVSSSIGGGAKWMVNKIKGKLQKALPDLLIDKF

SEQ ID NO: 128337 - protein, 170 aa, Triticum aestivum
  Clone ID: PAT_TA_22755.pep
MDQVLNKVGSYWFSKRASKEIDSIGDDLNSVSSSIGGGAKWMVNKIKGKLQKALPDLLKEYDMPAGLFPRDTTNYEFNEETKKLTVYIPSACDVGYKDSSVVRFFTCVTGYLEKGKLSDIEGMKTKVLVWTKVTSIKTEGSKVHFTAGMKKTRSRDAYEVVRDGIIIDKF

SEQ ID NO: 128338 - protein, 170 aa, Triticum aestivum
  unsure (1)..(170): unsure at all Xaa locations
  Clone ID: PAT_TA_22756.pep
MGSEKFPAPVADLCDANASLILTGELRILDPVFQPYGQCRSFSGRVVTMRVLEHNAGLRALLEAPGEGRVLVLDGGGSKRCALIGGTLAEVARRSGWAGAVVNGCVRDVDDVNGCAIGVRALXRNPRKPGKRGATEMHVDVDVGGAVVRDGECRYPDSDGIIVCDREIYG

SEQ ID NO: 128339 - protein, 97 aa, Triticum aestivum
  Clone ID: PAT_TA_22757.pep
SGEHPALEAFSVDCVRPVIERLQKLEGRVDELGSKPPEIPLEKERSLLDSWDRIKCIESDLERTKKVLQATVMKQLEIADSVEEVILSKLHRRRFCA

SEQ ID NO: 128340 - protein, 90 aa, Triticum aestivum
  Clone ID: PAT_TA_22758.pep
ASRRRRPRRRWWTRRNGGRRSRRCSPPTAPGWTGRTSPSPPPSPTTTPESGGASASRAPRPARTAHPPSASRACSTAASTRPGRPRAASR

SEQ ID NO: 128341 - protein, 173 aa, Triticum aestivum
  unsure (1)..(173): unsure at all Xaa locations
  Clone ID: PAT_TA_22759.pep
MAMEQEGTTAHQRHGGGTITDALSLFASRLSHHRFGDEELRVLEAALSAGGDVAALLSTRSAARKLLRESVAGACAAAAVEGDGARLSVADFFARAFALSGDVEXSCLAMRYEALVLREAKYSDDLDLHVFHEEWLTFAQDSLDNGFYTNASRLLQMLLCTFNPSHLDSTNSL

SEQ ID NO: 128342 - protein, 117 aa, Triticum aestivum
  unsure (1)..(117): unsure at all Xaa locations
  Clone ID: PAT_TA_22760.pep
ITFLATVMSPAKKVGAIITWQKTCKPHTAPKASSLQIVHAKQNSIKIWLQWIPKYTWHTELTEKGKSLRKQITASTNSGTTLALPLGGGIELEADLDVHLTXTXRIICYNHARPLXF

SEQ ID NO: 128343 - protein, 72 aa, Triticum aestivum
  Clone ID: PAT_TA_22761.pep
GKDAICGHHATLCAQTNKASLIHRVSKTQEQEKRRNILACHLEYCKIVRVFDCSQVKSRILSYVLELMEIFL

SEQ ID NO: 128344 - protein, 77 aa, Triticum aestivum
  Clone ID: PAT_TA_22762.pep
GQLAKDPNRPKEQTNIIDWAKSLADRRKLSHFMDPRLKGQYNSKQALQVLHVALSCLAGELRSRPSMKVVLKALEQI

SEQ ID NO: 128345 - protein, 157 aa, Triticum aestivum
  unsure (1)..(157): unsure at all Xaa locations
  Clone ID: PAT_TA_22763.pep
TGHPFLCRIRHEEXAIGWLXDTILANLPAGGKLDWWIXQAGLGNETMKLKAEVEAVEMVVSAVQGRAAGNKPLTRSLARLKELLYDADDVVDELDGYRLKQELEPGPRPQTDGHAGAQQVERSRENDDDVQSSGNSRLQSKEWNHFEITEFEQKKKK

SEQ ID NO: 128346 - protein, 152 aa, Triticum aestivum
  unsure (1)..(152): unsure at all Xaa locations
  Clone ID: PAT_TA_22764.pep
INGRRRWEQQRRPRTRGPDPHLQSRTRHRWRPRCSSSVAPTARCSSLRRGTIARPPPKPSRWRCGCPRAPSRGCSSTGPSTAWPRPPVXVPGVPRPLGRRLPAPSRGRRPRQGGRRSRPRTPPPRRRPWRASPSPRRHGRIWCRCSSHRHPC

SEQ ID NO: 128347 - protein, 114 aa, Triticum aestivum
  Clone ID: PAT_TA_22765.pep
LNFRAQFASQSSSRRIPHSSLDPMANFAAQLKERFLGLVDRVTGCGRGAAAKEEATKPAMKEHVEIRSRAPNVSGGSRGGSQLSTHTACMLIRAEDVFVLADSCACSFQCTPCY

SEQ ID NO: 128348 - protein, 122 aa, Triticum aestivum
  Clone ID: PAT_TA_22766.pep
VEDRPRVREHGIIFVMLLAMAATVGARSGATAQPSCVPTADGAPRMHAGAVPPSLAANSSPALHRLHRPARGLPTRPAPADHAPRSLARPLPRLPRPARGLPTTPTPVDHEPWSPPPPAMQG

SEQ ID NO: 128349 - protein, 407 aa, Triticum aestivum
  unsure (1)..(407): unsure at all Xaa locations
  Clone ID: PAT_TA_22767.pep
NSQTTFEKLNSQVQSHTSDLEKCFGVIALGADNLLNELQCSLSKHXERLAHFANKQREGHLRAVEASRSISNITVGFFHSLDVHASKLTSILEETQGVQDQQLIDLEKKFEECAANEEKQLIEKVAEMLAISNRPRTRGVQTAVGGLRESAVNRTGQLQKEISTAQDFTSSVREKWGFYMEETENNYIEDTTAVDSGRSCLAEVLVECKTKTGMGAQQWKNAEDSLFSLGKGNVESVDSIVRTGREANQLLRSKLSAAVSTTLEDIDVANKALLSSIDSSLKVDHEACANIVSVLTLCHGEMTELKGAHYHKVVEITGNAGKCLEEEYLVDEPSCSTPRRRQIDLPSAESIEELRTPDYDELLRSFRESRAGWKQANGDTKHLPEAQEAASPPSSVREARVPLIARN

SEQ ID NO: 128350 - protein, 126 aa, Triticum aestivum
  Clone ID: PAT_TA_22768.pep
EHTGSVIGDLNYMDPVYLQEGLLTEKSDVYSFGVVILEVISSRRALHSENNSLVKSFVEAHMKHRKATELFDKEIAITKDLELLDSLACMAMECLSLDVDQRPTMMEVAERLHILSPSRKAQDVCQ

SEQ ID NO: 128351 - protein, 239 aa, Triticum aestivum
  unsure (1)..(239): unsure at all Xaa locations
  Clone ID: PAT_TA_22769.pep
MALPYLEAVLCFMTLNYIFETYLNIRQHRALKLPTLPKSLAKVISHEKFEQARAYSLDKSNFNFVREAITIVMXDIVILYYXVLPWFWKKSGVLVTNVGLKXQENEIXHTLAFLAXCHGFGSTRSTGLCQFSXIPPTCVIEXRHGFNKQTFLGSSFGDMIKGNFXLSVVLRTTKLWAAIIRHSTRMGGXYLTIYLWGFMFALTLLMMTIYPXMILXVQQITPXPEXSLXEEIEKFEDSS

SEQ ID NO: 128352 - protein, 245 aa, Triticum aestivum
  unsure (1)..(245): unsure at all Xaa locations
  Clone ID: PAT_TA_22770.pep
VGLPKRAAGASRSGPGHQADGKGRAKPLNTDSAAAPSKASVPQNLGEELQEPPQRAGGWHGDGGRRQLRLHLPAGGLRARASAATQAVRGRLCIPXEIVDDVHTDICGQLFEKVVKEAILSGVDDNVDKREAVRKASQGLNLKKEAAMTIFNKEVRKLFLNYIQKAKAAGNCIEQAKELKKLISSLQRPREQIADAEALLDITTTLVKSVRSQSSEGITPSDFVTALLKKFGQQATLDSEPGSLR

SEQ ID NO: 128353 - protein, 132 aa, Triticum aestivum
  Clone ID: PAT_TA_22771.pep
GTSAVVIMSSENIPSRINICLAEGANEFFLKPVRLSDMSKLKPHIMKSRCKEHCHQDEDLLSNSETNPTNNSSSSSDTITISSSNPMDNSSGDTISSSNPTDNSSGDSSNIRKRKAADDEILTKTSRPNHNC

SEQ ID NO: 128354 - protein, 258 aa, Triticum aestivum
  Clone ID: PAT_TA_22772.pep
LLPFLYLIAIASTSSSSGKNTFALSSPMAVAIAEAPFHVLAVDDSVLDRKLIERLLKTSSFQVTTVDSGTKALEFLGLHDEDASISSVHADQLDVEVNVNLIITDYCMPGMTGYDLLKKIKESSSFRDIPVVIMSSENIPSRINRCLEEGANEFFLKPVRLSDMSKLKPHIMKSRCKEHCHQDEDLLSNSETNPTNNSSSSSDTITISSSNPMDNSSGDTISSSNPTDNSSGDSSNIRKRKAADDEILTKTSRPNHNC

SEQ ID NO: 128355 - protein, 243 aa, Triticum aestivum
  Clone ID: PAT_TA_22773.pep
AHTSSLSLSLSLSCQAHTPPALTLPSLLSPHSILLHHTKHTLSLSSPMAVAIAEAPFHVLAVDDSVLDRKLIERLLKTSSFQVTTVDSGTKALEFLGLHGEDASISSVHADQLDVEVNVNLIITDYCMPGMTGYDLLKKIKESSSFRDIPVVIMSSENIPSRINRCLEEGANEFFLKPVRLSDMSKLKPHIMKSRCKEHCHQDEDLLSNSETNLTNNSSSSDTVTISGSNPTNNSSSDTISSR

SEQ ID NO: 128356 - protein, 120 aa, Triticum aestivum
  unsure (1)..(120): unsure at all Xaa locations
  Clone ID: PAT_TA_22774.pep
FDWFFDPLMVIKDQIKAENFXKEEEAYLQKRVLLISDPKRLKATLPHLPSLNERKQAEIDAFARRLQGITKSISRYPTSKRRFDDLVKALSEELERAMGGSRSVSGSQFQEAQKRSCSNA

SEQ ID NO: 128357 - protein, 123 aa, Triticum aestivum
  Clone ID: PAT_TA_22775.pep
MPPMATTTATATATDSAARRFASACGVLSQYVKASGVQEPGYQADGAQQLTIFYGGRGVVLDRCTPARAAELIRFAAAAAAASQGAPVVQPPAPAFVDMPIARKASMQRFLSKRKDRSAPAPA

SEQ ID NO: 128358 - protein, 127 aa, Triticum aestivum
  unsure (1)..(127): unsure at all Xaa locations
  Clone ID: PAT_TA_22776.pep
MGYLTSXHADELCDACLAGKQRRLPFLEKARYRAQKXWELVHGDLCGPITPATPGGRRYILLLVDDYSRFMWVLLLASKDEAXQAIVKQQAAAEVEGGQKLRVLRTDRGGEFTPATFYKHCDEKGVL

SEQ ID NO: 128359 - protein, 80 aa, Triticum aestivum
  Clone ID: PAT_TA_22777.pep
NFLTPHINSELSDSFCIGKLESVPFLRKNISENWHKLFKRKVGEKVVDISCLAVVSHHYLHCRCDLHLYLAVKSYLGILQ

SEQ ID NO: 128360 - protein, 343 aa, Triticum aestivum
  unsure (1)..(343): unsure at all Xaa locations
  Clone ID: PAT_TA_22778.pep
MLVPWGGVGCCLSAAALYLLGRSSGRDAEVLRSVARTGSLKDLAAILDTASKVLPLVVAVSXGRVSSDTPLICQQSGMRGVIVEETAEQHFLKHNDAGSWXIQDSAVMLSVSKEVPWYLDDGTGRVYVVGARSAAGLILTVASEVFEESGRTLVRGTLDYLQGLKMLGVKRTERVLPTGTSLTVVGEAIKDDVGTIRIQRPHKGPFYASPKSIDQLILNLGKWAKLYQLASMGFAAFGVFLLAKRALDHFLQRKRQREFHKKARAAAAQRQARDAEGGNGTSDGEPKKDQLVLEICVICLEQEYNAVFVPCGHMCCCMNCSSHVTNCPLCRRRIDQAVRTFRH

SEQ ID NO: 128361 - protein, 87 aa, Triticum aestivum
  unsure (1)..(87): unsure at all Xaa locations
  Clone ID: PAT_TA_22779.pep
DYFELVVVTNVGGSGVVSQMWIKGSNTNWLAMSRNWGANWQSNAFLNGQRLSFXVRLDDGREATASDVAPSNWXWFGATYTSWVNFY

SEQ ID NO: 128362 - protein, 83 aa, Triticum aestivum
  Clone ID: PAT_TA_22780.pep
QVQQAHLASLLKDVPYHKGGNYRVLSAFPLLCKSLAEFGYAMVISPSVLINHASGETTPVNNLHIFTWKVGQLFFIYLPAKCS

SEQ ID NO: 128363 - protein, 328 aa, Triticum aestivum
  Clone ID: PAT_TA_22781.pep
RPELCSKWLALLTMEKACFSAVALEETSDMVTRVGGDFKETLRALGGLDNIFDVMVDCHSSLEGIVKDTSTLSLETSLQSAALLLKCLKILENATFLSDQNKTHLLSMSRKLSPRGSTVSLVGVIININELLSVLSRLSSLEGIVIDTSTKSLDMKEGTSSQSAALLLKCLKILENATFFPKRHKSPSPSLGASLSPRASTGALARALITLVGSLSAPSLRPSSASVAGRPGNGPALALILGATTVRGHANPMSASSGWLSLTPHCPDGSSSELAAPRRRSASASGVGRSRRARDRSQSTSSNRASSGSLGARHSNGLGLGLKLNIRK

SEQ ID NO: 128364 - protein, 317 aa, Triticum aestivum
  unsure (1)..(317): unsure at all Xaa locations
  Clone ID: PAT_TA_22782.pep
FQEAYKAAMHYLHHDPWYIEVNMNSGAXVWPLFNSLQAFWPGLQIXVLAGDVDPAIRTHAAFFSVWKKYGFTPEGFNLATSTVQNGQRSYPLRPELIESTYWLFKATRDYRYLDVGRDILASLQYAAKCPCGYCHISDVETHKQDDHMESFFLAETVKYLWLLFDLAVGPDNIVENGPYKYIFSTEGHLLPATPEITLVDEHCLYFGDRGYGSGDGSSIQQSANCAQFDERRTVSSQNSLSNVLFTTRGYIKGVCPGLSHAQKLGISYHAEEDNTQNSRSHEHPDESYVDQSSVQIQSSSVILISHPATSPPDEPSK

SEQ ID NO: 128365 - protein, 141 aa, Triticum aestivum
  unsure (1)..(141): unsure at all Xaa locations
  Clone ID: PAT_TA_22783.pep
GALPPACCLAARTRAISPPQAATPDLPPVRAGDXSESSVAAMGEDALFAQLTXVKGIGEWTVHMFMIFSLHRPDVLPSGDLGVRKGVQELYKLKALPKPEEMAALCERWRPYRSVGAWYMWRLLESKGAAVKKAKKGNASS

SEQ ID NO: 128366 - protein, 55 aa, Triticum aestivum
  unsure (1)..(55): unsure at all Xaa locations
  Clone ID: PAT_TA_22784.pep
XXLVPGPXXSFFFFFLSVIXTIIKVYFTVELQCKYRFLRYDCSRFTVQLHHKYYS

SEQ ID NO: 128367 - protein, 199 aa, Triticum aestivum
  unsure (1)..(199): unsure at all Xaa locations
  Clone ID: PAT_TA_22785.pep
LIKIDLLLEEGRNREEQLQEEEMKIIKAQTEIFILKESLRDMSEANSDYSAKLQKKEEACKVHEEKLGCLSQDNQKLTEGXGSLRKVLHWEKMYESLDQMKLDIILQLILHEVNCLRSTISDAQDARQKELVEKSLVVSLLEHFGGGVADLRSERNTLKQEGGAKTEELLQLQAERQELAEISDEFWEEMESRDQIVDD

SEQ ID NO: 128368 - protein, 227 aa, Triticum aestivum
  unsure (1)..(227): unsure at all Xaa locations
  Clone ID: PAT_TA_22786.pep
AMKIKLRLSTAYQTQSDGQTKRVNQCLESYLRCMVFQEPKKWHSWLPLAEWWYNTTYHTATKFTPFQALYSYPPPLISEIAIPXPVDTDARDFXAEKQHMLSTLKENLAQAQGRMKKYADRKRLQRQFEVGDMVYLXMQPYRMAAFRIRQAMKLTTKFYGPYRILGKDGPCSLQTPTSNECGHPSCIPREPVEKAPGPSCPSQSKSPSLWAQDGRDQRTLCPGKPDR

SEQ ID NO: 128369 - protein, 377 aa, Triticum aestivum
  Clone ID: PAT_TA_22787.pep
GAFIPFADDFDISTVTTIVREVGEIGDVKIIDLQCPIKSLIGRQVCKVGRSSGHTTGTVMAYALEYNDEKGICFFTDLLVVGENRQTFDLEGDSGSLIILTSQDGEKPRPIGIIWGGTANRGRIKLTSEYGPENWTTGVDLGRLLDRLELDLIINDESLKDAVQEQRKAFVAAITFAIGEASAVTVTAPEATPAEKAEEIFEPLGIQIQQLPRHDLTNATTEGEGATNTPSDMEERQFISNFVGMSPVRHDHDARRSIANLNNPSEEELAMSLHLGDREPKRLRLDPESSLDLEKQPHPDPEPSLDLEERPRPDPEMMSLDLEKQPRLDPEPGLDLEKQPCSDPGTGPRTWRSAFQPTRSRAWTWRNEALIPMTFMG

SEQ ID NO: 128370 - protein, 178 aa, Triticum aestivum
  unsure (1)..(178): unsure at all Xaa locations
  Clone ID: PAT_TA_22788.pep
MGNFCVCMGGSAKCASASTPFQSKVNPRSSTSNSNSKASRRSSSGPEKPPQPAEAPTAAGEAQAVPPASLKSFSMADLRAATKNFGSTSYLGEGGFGCVYKGWIDETTLAPARPGATNAMMVAIKKLKKESFQGHREWLTEVTYLGDXHHENLVKPGGGCSDQPQXKKNFLVFQIYAS

SEQ ID NO: 128371 - protein, 142 aa, Triticum aestivum
  unsure (1)..(142): unsure at all Xaa locations
  Clone ID: PAT_TA_22789.pep
LLDIYEQRLEEAEYLAGDKFTIADLSHLPNADRLAADPRSRRMFQRRKNVXSRWWDKVSQREAWAYVKSLQRPPTSNGAGAGAAAAQNQQQPRSGEARDGSSHPQLPARPVRPTRATAAATTSAASTEHSDYQQSRTGDARY

SEQ ID NO: 128372 - protein, 242 aa, Triticum aestivum
  Clone ID: PAT_TA_22790.pep
MNSSRSLLSSPLFPTSSPNFRSSPSPSRTSGTSSTHTYYSTHLVWAVPMIHDSTGGRASTACHYSPSLVAEEQQAHSSVSLKGEKALLESLPPLALEQHTEGKSLTGQDGAEGEFESYLRGLQRQVIYQQAFGEKNNFTCAITSTSTPSAKSVSSLDLNATSATLMKEVAFLAHGSGTSATQLNVPPPVTTSVETNHLHEKLLSNGQVFIRSTRLLERRSKKRNVPRASTSSTDVVQCGVAD

SEQ ID NO: 128373 - protein, 66 aa, Triticum aestivum
  Clone ID: PAT_TA_22791.pep
RSSEEARRPDSGLDTRLPRLPTKARRILHPSSTPENRCGLRRPLRPALAEPCHAPTLAPASLRPKK

SEQ ID NO: 128374 - protein, 147 aa, Triticum aestivum
  unsure (1)..(147): unsure at all Xaa locations
  Clone ID: PAT_TA_22792.pep
ARGPSPPPPPPPPAPLHGRLPPPLPARPPSPAVLGPGPHHLPXNGYFSSVAPQANAYFSSAQKDGAFPGAGDRRIEIYTTAPPPLPPPPRLALPPPPGRREGGVGSGGSGGGGGGGGSANMWCFSDPEMKRRRRVASYKAYSVGRGK

SEQ ID NO: 128375 - protein, 246 aa, Triticum aestivum
  unsure (1)..(246): unsure at all Xaa locations
  Clone ID: PAT_TA_22793.pep
MMGISALRSHHPLPLSTARPATALPRATSPTSHQPSSLALLRCRCRCRRSLPHSCCSSSPRASLSPGAPDSAAFMALAPNNAALRHRLIAPNSTAGSGDAAATGGLPSVVGIAHLAVSLGIVLATDKYLKQAFVAASIKFPSALFGMFCIFSVLLVLDTVAPALAKAFMDFFEPATLFIQRWLPLFYVPSLVVLPLAVRDVPAASGLKICLITFGGWFASLAVAXYTALTVRKIVKTELIAAEPMG

SEQ ID NO: 128376 - protein, 586 aa, Triticum aestivum
  unsure (1)..(586): unsure at all Xaa locations
  Clone ID: PAT_TA_22794.pep
FDSVVDDGFNNAFKLTRSSLGWMENAMSDVTKRLSVLVSSTALRLFNRLKLPFPGYVLGHGPRGSGKTALTRAAAKYFEDHQEILAHIIYMDCSKLAIGKAKETRQAIEESISEALLYSPSIIIFDDLDNVISVSSDPQVSQSSSSSDSLVRYLTDILDEYKDKSRNACGYGPIALMASVQSLQSLPQELTSSGRFDFHVELRALAIPEREALLKHQVEEHKLQCSEEVISEIASKCDGYDAYDLGILVDRAVHAAASRFVLPSACLNSVNPTLVKEDFLKALHDFLPVAMRDLRKYAPDGNNGGWEDVGGLNEAVTIIKETLELPSKYPNVFTKAPVRMRSNILLYGPPGCGKTHIVRVAAAACSLRFISVKGPGRPGRYIGSSEQSVRDFFAKAAAAAPCLLFFDEFDSIAPQRGTHSAGVSDRVVNQFLTELDGVETLTGVFVFAATSKPQLIDAALLRPGRFDRLVFCDFPRWDERVEILKVHSRTVSLASDASLEDVASLTEGFTGADLAAILTDAGLAAVHEVLDSRQDGIPEREPCISKELLMSVAMKARPSTPADDKXGVPEXPGEFVSSRKSLSTKG

SEQ ID NO: 128377 - protein, 59 aa, Triticum aestivum
  Clone ID: PAT_TA_22795.pep
FFFLVNDSCTLFGTKIDFSVRLDLMMQEILTASVPLVFNSIVNNIFLTEKYLNYIEDIS

SEQ ID NO: 128378 - protein, 216 aa, Triticum aestivum
  unsure (1)..(216): unsure at all Xaa locations
  Clone ID: PAT_TA_22796.pep
LVPNSARPPLRRPASQPWQMLPSSPSSPSTTILSSAAPPTTAPLPRSSSSPPPPPATAFHSSSSPAAPPRXPQPPTRRPRLRRRQPRRPPPRWSSWASSWRRGTTGRPTRQPGPPHRPRRRGRAPPRVRLLLGGPIHLRGGPARRWTRSGWSTTAEVRVHVHAGLGESLPSPLLIGSVEKNGHEVDNHYRLPTIGSHEKPGALPTKPREGNHRRRS

SEQ ID NO: 128379 - protein, 125 aa, Triticum aestivum
  Clone ID: PAT_TA_22797.pep
WGLLPAHQEQARAFCDPHSLLHVLVLMESLCIALAPPVHPMILIPQLMAGCVLRPTPVTGVACGPAVVMSCAVDYVSCMVLAFNPSLYEQATDSDTRTGMILVFGTRLYEAAVDPDSSRAWRLEP

SEQ ID NO: 128380 - protein, 59 aa, Triticum aestivum
  Clone ID: PAT_TA_22798.pep
FLRRRGHVLESTSPGAVCQLIVQDLLAPVSGGGGGGENVFRGMLTAVSDPRKDGSPAGL

SEQ ID NO: 128381 - protein, 77 aa, Triticum aestivum
  Clone ID: PAT_TA_22799.pep
FALPCSCWTVGWIMWPAVEPRETTDPDRQAGRRQVNAGGAPLPSPVYFSRSICRGKRRRKKKKVKLDGATQGDAACP

SEQ ID NO: 128382 - protein, 68 aa, Triticum aestivum
  Clone ID: PAT_TA_22800.pep
MASLGNRGASRFMALLKMALLVVVTTFIINSSVCLGAAGHHNTAGPPTVNHRGCLGKYYCRPPAGGQP

SEQ ID NO: 128383 - protein, 112 aa, Triticum aestivum
  unsure (1)..(112): unsure at all Xaa locations
  Clone ID: PAT_TA_22801.pep
PAGSGCWRPGTGTSRRSPSRRCPRPRASRASPPLRWPTPLGVAALGAADPGDGKAVEEAEFKKLLTEVLGAVMLRLSGXNPIFFSTSTVVHEPLSSSSALLPSPAVASPPSE

SEQ ID NO: 128384 - protein, 172 aa, Triticum aestivum
  unsure (1)..(172): unsure at all Xaa locations
  Clone ID: PAT_TA_22802.pep
NGGEEIGSPRKVATLQGWKGKRLRVGHPGPQGSPLAPKPGRSGGPPGSRKPAVFVNAWAIRGTPGRAGSRAASNPERFAXSGERRDSGEVDFTGSELGYXPFGSGRRXCAGIAMXERMTAYSVAMLLQAFDWELPEGAALDLTEKFGIVMKKATPLVAVPTPRLSRPELYSA

SEQ ID NO: 128385 - protein, 103 aa, Triticum aestivum
  Clone ID: PAT_TA_22803.pep
EHPFVFWANGPLFWPAASTLSTESYHVCFPELIFFSSLCLQVLSDCAVSLDPRRARRAPPSAPTRRLVDPFWFLTESTRDPSEHKANYQALWVSVLDPFSWSW

SEQ ID NO: 128386 - protein, 290 aa, Triticum aestivum
  Clone ID: PAT_TA_22804.pep
MSADLNRDYEIGEEIGRGRFGVVHRCTSRSTGEAFAVKSVDRSNLADDLDRELAEIEPKLAQLAGAGNPGVVQVHAVYEDDSWTHMVMDLCSGPDLLDWVRLRRGAPVPEPVAADIVAQLAQALALCHRRGVAHRDVKPDNVVLDVDDDGENSSPRARLADFGSAAWIGADGGRAEGLVGTPHYVAPEVVSGGDYGEKADVWSAGVVMYVLLSGGALPFGGETAKDVLSAVMRGSVRFPPRLFSGVSPAAKDLMRRMMCRDEWRRFSAEQVLRHPWIVSGGGARAMEQPT

SEQ ID NO: 128387 - protein, 121 aa, Triticum aestivum
  unsure (1)..(121): unsure at all Xaa locations
  Clone ID: PAT_TA_22805.pep
GRGRCRSRRLAVSRAGYWGAVPGGPDPSRTPVFRFCSRPRFSWEACSAEVFGRRGPAGSPPPAAPGCRANVCSTLAVSHXRYKGVVPLVQELNKNQDFLFCFCPTINKDKNNARXTSIYPX

SEQ ID NO: 128388 - protein, 171 aa, Triticum aestivum
  Clone ID: PAT_TA_22806.pep
LPLPPWFLSVTSPSPSPPQSLLVSVFSSSCPKLGFVEFLARSAPSANTSSFAFCFCWICSLCEYYFFCFLFLLDLLIFTLFVLTKVLLYGSLWCLQDLPIGGVSLMTDCRCSISSFSGMVCPVCRCPGAPCVPFLRADEVPEVFDVVVDEDCFTRDGPCPLPRFLCANSYF

SEQ ID NO: 128389 - protein, 811 aa, Triticum aestivum
  unsure (1)..(811): unsure at all Xaa locations
  Clone ID: PAT_TA_22807.pep
MEEGAAGGGGGGGGGVAVAGDRSSFVIGLIENRAKEVGVAAFDLRSASLHLSQYIETSCSYQNTKTLLHFYDPNTVIVPPNKTAADGMVGVSELVDKNYQASKKVTMARGCFDDTKGAVMVKNLSARDPSALGLDTYCKQYYLCLAAASATIKWIESEKGVIITNHSLSVTFNGSFDHMNIDSTRYCFETTDPQILSMFXTLEIIDPLHTELWGTSNKKKSLFQMLKTTKTTGGSRLLRANLLQPLKDIQTINARLDCLDELVSNEELFFGLTQGLRKFPKESDKVLCHFCFKPKKVTDEVLKPANGRKSQLLISDIIVLKTALDAIPFLSKVLKGANSFLLQNIYQTICENPKYGSMRKRIGEVIDEDVIHSRAPFVACTQQCFAIKPGIDGLLDVARRSFCDTSXREEFTLPNLKIPYNNRLGFYFIIPQRDITEKLPNKFIQVVRHGKNVHCSSFELASLNVRNKSAAAECFLRTELCLEGLISEIREDIRILTMLAEVLCLLDMIVNSFAYTISTKPVDRYTRPEFTGDGPMAINAGRHPILESLHTDFVPNNIFLSEASNMVLVMGPNMSGKSTYLQQICLIVILAQVGCYVPAQFASLRVVDRIFTRIGTGDNVENNSSTFMTEMKETAFIMQNVSSRSLVVVDELGRATSSSDGLAIAWSCCEHLLSLKGYTVFATHMEGLSELATMYPNVKVLHFEVDLRNGRLDFKFRLKDGVRRVPHYGLLLARVAGLPTSVIDTATSITSRITEQEMVRMDANCVQYQPLRMAYQAAQRLICLKYSNQGDDYIREALQDLKESYAAGNLI

SEQ ID NO: 128390 - protein, 129 aa, Triticum aestivum
  Clone ID: PAT_TA_22808.pep
MQIFVKSLTGGTMTLEVESCTAVDSVKAKIHDKEGIQPDQQRLIFAGKQLDDGRTLADYSIHKESTLHLALRLVGGGKGGYYPTRMEPNLRMLVCRKCYARLPLRSANCRKKKCGHSNDIRPKEKLRPH

SEQ ID NO: 128391 - protein, 142 aa, Triticum aestivum
  Clone ID: PAT_TA_22809.pep
MQIFVKTPSGKTITLEVEGGHDIAGVKARIHDKEDVPPDQQRLIFAGKQLEEGHTLADYNIQKESTLHLVLRLHGGRGGTGKGGTYPKIEPNLLQLALKYRQLKLVCRKCYARLPVRSANCRKKKCGHCNETRTKKKLKPRE

SEQ ID NO: 128392 - protein, 138 aa, Triticum aestivum
  Clone ID: PAT_TA_22810.pep
MQIFVKTPTGKTITVEVESGGAVDSLKAKIHEKEGIQPDQQRLIFAGKQLGDGRTLADYNVKKESTLHLVLGLAGGDKGSCYPPKMEPNLLALALKYRQHRLVCRKCYARLPLRSANCRKKKCGHSNEIRPKEKLRYH

SEQ ID NO: 128393 - protein, 163 aa, Triticum aestivum
  unsure (1)..(163): unsure at all Xaa locations
  Clone ID: PAT_TA_22811.pep
VRGRAGGGVPHTTATATHAALRRPAKMQIFVKTPSGKTITLEVEGGHDIADVKARIHDKEDVPPDQQRLIFAGKQLEEGHTLADYNIQKESTLHLVLHLHGGRGGTGKGGTYPKIEPNLLQLALKYRQXCYARLPLRSANCRKKKCGHCNETRTKKKLKPRDP

SEQ ID NO: 128394 - protein, 132 aa, Triticum aestivum
  Clone ID: PAT_TA_22812.pep
MMQIFVKTPTGETVTLEVESCAAVDSVKAKIHDKEGIQPDQQRLIFAGKQLDDGRTLTDYSIHKESTIHLALRLVGGGKGGPNLRMLALKYRQHRLVCRKCYARLPLRSANCRKKKCGHSNDIRPKEKLRPH

SEQ ID NO: 128395 - protein, 429 aa, Triticum aestivum
  unsure (1)..(429): unsure at all Xaa locations
  Clone ID: PAT_TA_22813.pep
KSAAQYAAPYPPSDAPVPPSARARANPVHAGAREARRRRTETGRRARAGGRAPMNHRFARRAHRVRRCGRQASGDDLNDERNGSIRWVFSLRELQSATNRFNYDNKIGEGSLGSFYWGQVWDGSQIAVKKLKNARNGTEMEFAAEVESLGRVRHKNXLLSLRGYCADGPERILVYDYMPNSSLFAHLHGTHSSECLLDWRRRRFIAIGSARAIAYLHHHETPSIIHGSIKSTNVLLDSDFQAHVGDFGLMKLISDEIDHDKIIGENQRGYHAPEYVMFGXKPTTGCDVYSLGIILLELTSGRKPVEKSGSQKMLGVRNWVLPLAKEGRYDEIADSKLNDKYSESELKRVVLIGLACTHREPDKRPTMLEVVSLLKGESKEMLLRLEKEELFRPDSMASSVGTTPEGSTDCILKNDERAGWGLMGWYPGP

SEQ ID NO: 128396 - protein, 116 aa, Triticum aestivum
  Clone ID: PAT_TA_22814.pep
AFARVFRAPRRGGGEAPCRHRLTLRGTGKAVGDRHPKIGDGVLIGAGATILGNVLIGAGANIGAGSVVLLDVPPRSTAAGDPARRLGGKKGDDMPGESMDHPSFIQQWSDYTILRH

SEQ ID NO: 128397 - protein, 204 aa, Triticum aestivum
  Clone ID: PAT_TA_22815.pep
RSGDCRSRIAGGRDGAENEAIHRRSGALLLLLAAVFAAAAGASASAIGDKCAACKAVASELEIGISSEKPRNHLDLRNRLNSKGQREGKVIDYRVSELRIVELLDDLCDKMQDYTLQKLESGEKEWVKVPSWSSFQTDKKAAARAHSKNLSSYCGRLLEETEDELAEWIKTSSAESADVSQALCQDISKHCQSTSATAPVDDEL

SEQ ID NO: 128398 - protein, 103 aa, Triticum aestivum
  unsure (1)..(103): unsure at all Xaa locations
  Clone ID: PAT_TA_22816.pep
PASGYDMSNYPLNAFIVNIRLNVLFINGRSYTASAYXFPLSIFTXVXLXLHRYTLERGXASGSXXPXIXMXVEXXXRRPXXIHYXTXXHFXPKWKPAXLGLIR

SEQ ID NO: 128399 - protein, 157 aa, Triticum aestivum
  Clone ID: PAT_TA_22817.pep
MGGGSCDVCKEAPSKYKCPTCRTPYCSVICFKKHKVEFCQKIVPQEETNKPSLQEEVTTSSVLLEKGTDYPNIKDQLPSLSKNPDEDQLPSLAADTTCPAQSPNTGVKDALRDSELQKMILQIDGSSEPEKELEKLMEGQAFQQFANKILDIISAQQ

SEQ ID NO: 128400 - protein, 167 aa, Triticum aestivum
  unsure (1)..(167): unsure at all Xaa locations
  Clone ID: PAT_TA_22818.pep
MPGLVSGGWGSERGARGPGVPGWVHRPTWPLSLGVAALPPVVVALSFHQSSRGXGLGGCIAQAXFGLATVGYMCIMFSVTTPLGILLGMAVFHMTGYDDSXPNALIIEGLLGSLSAGILVYMALVDLISLDFFHNKMMSSSLKLKKASYIALXVLGSASMSILALWA

SEQ ID NO: 128401 - protein, 134 aa, Triticum aestivum
  Clone ID: PAT_TA_22819.pep
GTKMESIAYNSEAIRFNSMLQTGGTYDFNRVGFSPTEMPDGHFWYLNMDFVTTLSSTTEVWMSAQQITSTICPLCFPQFEEIFELRDKTITGASSLHLLLYIMLYNSESHSDFKLADVVAILAYVGQIEYKLDS

SEQ ID NO: 128402 - protein, 150 aa, Triticum aestivum
  Clone ID: PAT_TA_22820.pep
MKRSFDAMEAKPVFLSKEERQRLALERRQAAVADQRRSALDILQSLPRPPPPPPPSGAPRDSFFSHRDPSDRDRGDRDRDRDRDRDRDRRRDDDSRRDRDRDRDRDRDEPSRRDRDRDRDRDRDRDRDRDRDRDRDREHRDRERGERDKD

SEQ ID NO: 128403 - protein, 151 aa, Triticum aestivum
  Clone ID: PAT_TA_22821.pep
MASASASTDVASSREASRQAGKKALEEFRKKKKKAAKKATAAVVDQAAPVVPSVVENPLPNSNNGNPGQGLVSDLDSSTPSTSSAPSASYENDPTTSSRVTGFLSNGPVVADASANVTTVAPLQDSVDDGGSKFYGNLSFSDLVNGHHDDW

SEQ ID NO: 128404 - protein, 168 aa, Triticum aestivum
  Clone ID: PAT_TA_22822.pep
PTWPVRSGRSGQRPPARGARVPQHHPATTTRTSAPPLGIPAAVTVPNPIDAQPRARAPGVGRARGQAPPPRSHGREMHGSGRANHRSQAPVSAGRSPWTRCDAAPLDAPDWPGIAPRHRLPRGRPGLRRRAPSGGGETGGGGGEDYGGARVSTPVSPKLGGTGVGTRE

SEQ ID NO: 128405 - protein, 347 aa, Triticum aestivum
  unsure (1)..(347): unsure at all Xaa locations
  Clone ID: PAT_TA_22823.pep
MAVWAEQLQRELAGRGLAVASVPGKGRGLVAARSFFPGEVIICQEPYASTPNRISVGSSCDHCFASGNLRKCSVCRVAWYCGSVCQKEEWKLHQLECQAISALTEERKKMLTPTIRLMVKLILRRKLQSEKAIPSSATDNYDLVDALEHXSKVDDNQLVLYAQMANLVQLILPSIELDLKEIAHTFSKFACNAHTICDPELRPLGTGLFPAISIINHSCVPNAVLLFEGRTAYVRALQPLSSNTEVSISYIETAATTLKRHNDLKQYFFTCTCPRCIKDSEEDALLEGYRCKDQKCDGFLLPDSGKKAYTCQKCSISRDEEEVKKVSSEILLLSDKASSFLSSGNNS

SEQ ID NO: 128406 - protein, 193 aa, Triticum aestivum
  unsure (1)..(193): unsure at all Xaa locations
  Clone ID: PAT_TA_22824.pep
MARQNAASALAAALVVGVFAPILTVVQSIGVCNGMLGDNLPSRADVVQFYQSQGIGAMRIYAPDLETLRSLDGTGIDLIMDVGNGDLAALASDPAAAAGWVRDNVLAYPGVRVKYVAAGNEVDGDDTQNILPAMKNLNDALAAAGRGDVKVSTAVXMSVLASSSPPSDGAFXXVYMTDVAQLLKXTGAPLLAN

SEQ ID NO: 128407 - protein, 100 aa, Triticum aestivum
  Clone ID: PAT_TA_22825.pep
LCVCMLVRGRVLVIKVSENSHNWLREGGRVISGACLRERHLGRECVSMCERPPMEGETTHKILMYALRKDINCIQTLGWDHDICNSRKERSLIHQTSRFY

SEQ ID NO: 128408 - protein, 80 aa, Triticum aestivum
  Clone ID: PAT_TA_22826.pep
KVGMYKEKYKICTLKNKSIYTGDRRLCIALLGELHLCFHSSKSPQPIPNTHSQLVWFASFYSLIPISLVILAAKAQASTA

SEQ ID NO: 128409 - protein, 233 aa, Triticum aestivum
  Clone ID: PAT_TA_22827.pep
GIGARGPLPAPPPPPHELPPPLAPRPAAPRPALLRPRARPRATAPPQHAAAAPQPANRGAAVPAGKQKDAAAARGRPGAGGNRRVLGDIGNVVHAHGRDGRVLRPAGINRPITRSFGAQLLPKAQADPSKNGVAVPPAERAGLKPVAKNVPVKLKPAAPRPQPAAKIVTGPGENRKPSEVAAGCSAPRKKVVHTLTTVLSHRSKEASIDDIDKLDGDNELAVVDYIDDIYRYY

SEQ ID NO: 128410 - protein, 127 aa, Triticum aestivum
  Clone ID: PAT_TA_22828.pep
YLLYLKLVEADLGSFTIDNGDFPSLRRLCLVVKMPILPAVKEGALPYLVSLQLLCKDLFDLSGMRIEFHDCLEEVALDSMVSARTAEMWEAAAKKHPKRPKVVFLKRIDPKRTRVRCEIRRGGWADT

SEQ ID NO: 128411 - protein, 354 aa, Triticum aestivum
  unsure (1)..(354): unsure at all Xaa locations
  Clone ID: PAT_TA_22829.pep
MTFFLFLYIQALIKFFLPDSVLGEGGFGRVYKGWVDEKTMNPTKSGTGMVVAVKKLNSESMQGYEEWQSEINFLGRLSHPNLVKLLGYCWEDKELLLVYEFMAKGSLENHLFRKGCAPLSWELRLKIAIGAARGLAFLHASEKQVIYRDFKASNILLDASYNAKLSDFGLAKLGPTGSNSHITTRVMGTYGYAAPEYVATXGHLYVKSRRLRFPGVLMXEMLSRARARDPNRPNGQQSLVDWAKPYLADRRKLARLMDPQFEGQYNSKQSHQAAQLTLNCLAGEPRSRPSMKEVLEPLEQIEALKSRTREARGGSGTSSRDRGPRTLCCSAPTVVATWRQRCAPWFEGHQRPRH

SEQ ID NO: 128412 - protein, 88 aa, Triticum aestivum
  unsure (1)..(88): unsure at all Xaa locations
  Clone ID: PAT_TA_22830.pep
GFNLPLLWPSPAVATRSCITLESSSHLRHERPHPPNVITECVARGDRHCGPRSGAACQGSSTKPPPLGSPQRKRPISESPGWGAQXXN

SEQ ID NO: 128413 - protein, 122 aa, Triticum aestivum
  unsure (1)..(122): unsure at all Xaa locations
  Clone ID: PAT_TA_22831.pep
MAWDARFKIIKGICDGLLFLHSIPIIHMDLKPQNILLDDNMTPKIADFGLSRLFGQEQTRANTXMLWGSYGYIXPEYLYRGEISSXSPDIYSLGLLTIRDYQPGGEGTPPPRTFHPATKGMG

SEQ ID NO: 128414 - protein, 78 aa, Triticum aestivum
  Clone ID: PAT_TA_22832.pep
QGAQDTRSRGFKCTGGIMAEEAVALFRNFYEQGNPNAPKPHRPVRVDHRSPVGLAAARGRSQIYILQVRQFKKILSTN

SEQ ID NO: 128415 - protein, 78 aa, Triticum aestivum
  Clone ID: PAT_TA_22833.pep
NLKLVVSSMWDPSDFADCESIGRMTQLGRCVPPHLCARANFRTCYFKSMYTLPTLTCMAFHETFRLSEGCHRHPQPSS

SEQ ID NO: 128416 - protein, 129 aa, Triticum aestivum
  Clone ID: PAT_TA_22834.pep
ELQCKSNKNYTLKSWNYKNQPWMEDEEGYTGFADPHEEDEEWREVKRSREDSAAGSPWHRFRLSLCARLRTRKQGTGGGRGEEERMLNHRLALERSATGDLLTKNRHEPTRPPTRPEMGNEDGHATRQD

SEQ ID NO: 128417 - protein, 100 aa, Triticum aestivum
  Clone ID: PAT_TA_22835.pep
PLEGAIVCLLVLGLVLEQVQVEGVDCGANPFKVACFNSCLLGPSTVFQCADFCACRLPAGLASLRSSADNTEEMKLYVKRCGDACDSFCKGDTLLASLDD

SEQ ID NO: 128418 - protein, 264 aa, Triticum aestivum
  Clone ID: PAT_TA_22836.pep
ERASPMAVHLQVQQQKHLNLPAGFRFHPTDLEIITFYLVRKVLKKPFDVIVIEEVDLNKCEPWDLPNNVNMGEKDQYFFSKKDLKYPTGVRTNRATNAGYWKATGKDKEILHPPTMSLIGMKKTLVFYKGRAPRGEKTNWIMHEYRLEMGKQHTPDLPTDIVRAASINGSSKEEYVVCRIFHKSTGLKKVVTPSYSIPAAPFILVPSAREPGNHSHGRRPKGSGECDRVPTGAGAGPGAGASRGRGLRRKPLQSGLLQLLPSRS

SEQ ID NO: 128419 - protein, 184 aa, Triticum aestivum
  Clone ID: PAT_TA_22837.pep
MGAWMSRVWFLMFPAKEYKIVVVGLDNAGKTTSLYKLHLGEAVTAAPTIGSNVEEVVFKNIRFEVWDLGGQESLRTSWATYYRGTHAVIVVIDSTDRARINIIKDELFRLIQHADLDNTVVLVFANKQDLKDAMSAAEITDALSLHSIKNHDWHIQASCAITGEGLYDGMGWIAQKVAGKATAS

SEQ ID NO: 128420 - protein, 191 aa, Triticum aestivum
  Clone ID: PAT_TA_22838.pep
MGVTGMVWPLMSRGLFLRVRGEEYKIVDQWGLTTAGKTTSLYKLHLGEAVTAAPTIGSNVEEVVFKNIRFEVWDLGGQESLRTSWATYYSGTHAVIVVIDSTDRARINIIKDELFRLIQHADLENTVVLVFANKQDLKDAMSAAEITDALSLHSIKNHDWHIQASCAITGEGLYDGMGWIAQKVAGKATAS

SEQ ID NO: 128421 - protein, 118 aa, Triticum aestivum
  unsure (1)..(118): unsure at all Xaa locations
  Clone ID: PAT_TA_22839.pep
XSXNXPQTQFWXXXNXVLGXIXRXLNTLAQGXGTITARPKYGLKRTRGCRILFLIFSYFQDSILRTTCSAIRLPHKRCKIQGGRQAMPHYGTPRWVSVTSSIPVLNTIPRPAPGSRTC

SEQ ID NO: 128422 - protein, 92 aa, Triticum aestivum
  Clone ID: PAT_TA_22840.pep
ALPNILGFAFGVIQMGLYALYRNAMPTPVPKQVDDVDAIKVPEHVVNIAKPSPTAAIELNTHNPIEPGMPPPTKDNSLACTRVVTKGESSQG

SEQ ID NO: 128423 - protein, 133 aa, Triticum aestivum
  Clone ID: PAT_TA_22841.pep
RVATVDELSLETLATTPQAASPGSAPLPATPSPAPPPRRHRSPEATTMRSLRRGGGAGRGFSSPPGWPVRAPPRGGQLSAPYVRRCVSLWQIRGGCAPMAKPVTPARRLAPPLPSKEARCGASSIYIIRIHPP

SEQ ID NO: 128424 - protein, 217 aa, Triticum aestivum
  unsure (1)..(217): unsure at all Xaa locations
  Clone ID: PAT_TA_22842.pep
AWSRPRYFKLHSGFCPIRAALRLGKIKECVGESPPGCLMFSFTSQMNDARKLPLMQYVVCLAMTEAIKDLCCAKGLPELDVRIKWPNDLYLKGLKVGGILCTSSYEPKVYNICTGIGLNVDNEKPTTCLNAALQELKANSXRLKREDILASFFNKFEVLFGYFLKSRISPEGANTTTHGPSRWALDVVARGRPGHGPLWGNPMAPRVGGPSPPGRGP

SEQ ID NO: 128425 - protein, 171 aa, Triticum aestivum
  unsure (1)..(171): unsure at all Xaa locations
  Clone ID: PAT_TA_22843.pep
MTKGEVVRTLSTRARIEPGLHYFKYGTKLEEENSXEFFRAYYIRLKLKRQIVLFNHLLQHQYNLMKYPAPPNVPLAPMQNGMHPLPVNNLPMGYPVLQQPLMPAPGQPHIDPMVCGLSSGHVVNGIPAQGGYHPMRMNSGNDMVVDNGAPEVAHAGALSSGRPLSPSSAAS

SEQ ID NO: 128426 - protein, 105 aa, Triticum aestivum
  unsure (1)..(105): unsure at all Xaa locations
  Clone ID: PAT_TA_22844.pep
GNGRILGGTPVKCSWGNKPTPPGTTXAPLPPPAAPSHPAATDLVAYHRAIEMSKMASTQALMQAQHLRQAAMGMGVGASQAMYDGTFQNVGTSQQQQQQQQLMYY

SEQ ID NO: 128427 - protein, 421 aa, Triticum aestivum
  unsure (1)..(421): unsure at all Xaa locations
  Clone ID: PAT_TA_22845.pep
MLPQQSQAAAMMQQAAAMQSMYAMPPPPHHHHLLGAAPPQXSGQLPPGFDTSTCRSVYVGNILSAIFVALLRELFSGRFSMNXCKLIRKQASSNGIIPHKELGSAALATLTLNRKQFFGLTRKVNWAXAIGLREDTTGHFHIFVGDLSPEVTDSALFAFFSAYSPNCSDARVMWDQKTGRSRGYGFVSFRNQQDAQSAINDLNGQWLGNRQIRCNWATKGANSGEDQLTSDSKSIADVNNNFTENAKQKSNEDAPENNPLYRTVYVGNLAHEVTQDVLHRFFHALGAGAIEEVRVQHGKGFGFVKYSNHAETALAIQTGNGRILGGKPVKCSWGNKPTPPGTTSAPLPPPAAPGHPAAADLMAYQRAIAMSKMASTQALMQAQHLRQAAMGMGVGASQAMYDGTFQNVGASQQQQQQLMYY

SEQ ID NO: 128428 - protein, 390 aa, Triticum aestivum
  Clone ID: PAT_TA_22846.pep
GIVAVSHGCRGVAARACGLVNLQPTKIVEILKDRPSWFRDCRSLEFFTMLPAGNGGTIELVYMQMYAPTTLVPARDFWTLRYTTTMEDGSLVVCERSLSGSGGGPSTASAQQFVRAEMLPSGYLVRPCDGGGSIVHIVDHLDLEAWSVPEVLRPLYESSRVVAQKMTTAARRHIRQRAQETSGEVVYALGRQPAVLRTFSQRLSRGFNDAISGFNDDGWSVMAGDGIEDVIIACNSKKIRSNNTAPNAFIVPGGVICAKASMLLQSVPPAVLVRFLREHRSEWADYNFDAYSASALKSSSCSLPGLRPMRFSGSQIIMPLAHTVENEEILEVVRLEGQALDEGLLSRDIHLLQFCTGIDEKSMGSCFQLVFAPIDELFPDDAPLISSGFR

SEQ ID NO: 128429 - protein, 209 aa, Triticum aestivum
  unsure (1)..(209): unsure at all Xaa locations
  Clone ID: PAT_TA_22847.pep
MATRLLGAFRNCMCLRRFPPPLINAYTVLFRVGTVHSVSQAIEATPLDSSESSFDTYRSPPRPLPYDDPRFSPPLRDWVXHQGMILQSHSPRGTRTTQDXNYDXEIGTMXNPTSQXKTNYDTKMEKKHSXXGDNXPXKESGNYSTYFLXPXEDEDSXPHSKINFGPKCNAKSQLGWYQGWKNSCFWMGLRKRGLNPMGPKKPTRKTEKP

SEQ ID NO: 128430 - protein, 246 aa, Triticum aestivum
  unsure (1)..(246): unsure at all Xaa locations
  Clone ID: PAT_TA_22848.pep
MATSMVCLVALCLVSPLLLAGAVLGNPGYGGLFPQFYDHSCPKAKEIVHSIVAQAVARETRMAASLVRLHFHDCFVKGCDASVLLDNSTNIIEREGVIKDALETACPGTVSCADILALAARDSTVLVGGPYWDVPLGRRDSLGAEXSRGSNNDIPAPNNTLPTIITKFNRLGLNIVDVVALSGGHTIGLSRCTSLLQRLYNXAGNGPADSTLXDVPHAAALAQPCRRLDGPTTMPPRRDVARSDRG

SEQ ID NO: 128431 - protein, 128 aa, Triticum aestivum
  Clone ID: PAT_TA_22849.pep
MGTAVLPVAHKLSLASPFLPRHRRAKSKSQAPVIPMEARAEKALEAIYVCCFGQDMVEPEDERLLCTMLNAVFPSVGRPAVERMVSTMAEQVASGERRGPGAKVVPKEVAQRQLKDLEFLKQNKLDSI

SEQ ID NO: 128432 - protein, 108 aa, Triticum aestivum
  Clone ID: PAT_TA_22850.pep
AAAALAAGRGGPGARAAGAALVGPHRAPPGARRPHHPPTRPDGAQGRGWGQPCCPPPTSSRSPPPSSRATAGPAAPPPSSTAGAGAMGRWWPTWSRTRTGRPLTWGAS

SEQ ID NO: 128433 - protein, 120 aa, Triticum aestivum
  Clone ID: PAT_TA_22851.pep
GYLASSGETEASDNLPKNVCGGALWEKLLEYTAKSTEKIAGDSSAGRGQLYVWGKLKNWGDECMYPKPVRDLSGWNIRCMASGDMHHIIGAEDSCISWGLSEYGELGYGPTQKFCLRGVP

SEQ ID NO: 128434 - protein, 53 aa, Triticum aestivum
  Clone ID: PAT_TA_22852.pep
LMDTGTVHLVTSRIKGAVIEAASCLDDQFDCSALLLSCVLCYFSCSLCLITLG

SEQ ID NO: 128435 - protein, 61 aa, Triticum aestivum
  Clone ID: PAT_TA_22853.pep
CKFVIYDNLPGKTYLRYHMRIESQFVAYERLTFYFSHKIIYFFPFILLFFTINLMISLLML

SEQ ID NO: 128436 - protein, 269 aa, Triticum aestivum
  unsure (1)..(269): unsure at all Xaa locations
  Clone ID: PAT_TA_22854.pep
FAERVSTVELGAARLNKESGEVKELKEQVSRLKTALQMKDSGSEQNITRHSEALNTKMPSPVFSNRRQGSCDLLPGQANFRQPMEDVGNIEVRPNPKLRQKKPSFDLQDLLASNDSPSWPDSNSRVNFQMGEERETVCGDWVDKVVVNNNHSLGDWEGDNTALPDFFYQRYHSGLRDEQQRPRFCSTNTDDSDDIDVATSDPPEXDALWAXNVPKHKXSIYSKVGQKIKKPQPENKRGSKIQGHQXSPNTIKRPRKLQWTNNSGKXFXW

SEQ ID NO: 128437 - protein, 184 aa, Triticum aestivum
  Clone ID: PAT_TA_22855.pep
MPRRRLRPQPLRRGAIRAGPAALQPAGLRSTAGALLPAACSPSARAQAPTRHQPPAEGLDGGDRGRSADARSPSVPRPQPPNARCGGGRTPGSTAAVSTPDTLARSPSATPPLCIRHGCSPHWNPRGHLVARGTRSHWSRRGSPPPRGRPSTPLLLCGRAAPPLMEPAVGTGEEQGQELVIWRG

SEQ ID NO: 128438 - protein, 122 aa, Triticum aestivum
  unsure (1)..(122): unsure at all Xaa locations
  Clone ID: PAT_TA_22856.pep
ASAISVDDNRVGLLYKHVFPPILAPHISFIGLPFRTIPFLVFQLQSKWVAGVLSGRLELPSQEAMMRDVDAFYSXWKLRGCPKRRTHDLGTXYPLEYEDWXAERCGLGRMEGWRRDMFLATC

SEQ ID NO: 128439 - protein, 135 aa, Triticum aestivum
  Clone ID: PAT_TA_22857.pep
GPFGGEHETTANGGDPKEGGLSESQRPPRRRLLPPTSPDARPPGSDDGILRRGALHGDGFSRRPRRMRGRPETTTPSCATAPSTASSSPSTATIPCPWATDICSSSSPAARTPSVEDILPKQVQLYATSLAHMVI

SEQ ID NO: 128440 - protein, 218 aa, Triticum aestivum
  unsure (1)..(218): unsure at all Xaa locations
  Clone ID: PAT_TA_22858.pep
RRGARGSCGTAACAPRALLLPGVLPRARARPGLLPLAGPRPLLVAPGVPRSCFGAQWPLVFAIISEVFGLKYYSTLYNFGGMASPVGSYILNVLVAGRLYDAEADKQPGGGFTAGGGRDKGCLAGGGRDRACLGVACFKRSFPLISXSSGFGALVSLVLVWRTXGFYKGDIYATVPRRRRRETRRPPARRPRSEAGGGGVNPGQCHSTKVRTQKALQA

SEQ ID NO: 128441 - protein, 85 aa, Triticum aestivum
  unsure (1)..(85): unsure at all Xaa locations
  Clone ID: PAT_TA_22859.pep
NECVCFCNQPQFCYHHLQILLGTSPIFCYNGFVFAGIITCVATTISVVLGYPQFCYQRGGAPVPQIALIVEVVLTRGSLGRSVLX

SEQ ID NO: 128442 - protein, 296 aa, Triticum aestivum
  Clone ID: PAT_TA_22860.pep
MLSLRCWAPAFGIAFERAVVLRPRKFNSLVVCGARGPRPRYPRVWKTDKRIGTVSKSQKLVKCIKGLSNVKGELCGPLESCGAGELEFPLSAGWSALVTRGPGEACKRFFLLFSWMVDLGQRKTLGSCHSLVKVVLAAVRIEEAEELFQKIFSRYMEGLPRVFFMKIISLYYRLGSYEKMFEVFADMEELGVRPDTSIVRMLGDVFMKLEMLDKYEKLNRKYPPPKFEYRYIKGKRIRIRVYPDDSTEEVTKRDSDRDELEDAGSMNLDNELKEAPRTVLDMNVLGNAASGDHKFV

SEQ ID NO: 128443 - protein, 171 aa, Triticum aestivum
  unsure (1)..(171): unsure at all Xaa locations
  Clone ID: PAT_TA_22861.pep
MGFWMGLAMGVAAASALIVAFARCENSRGARRRKLAATVATFSKMTVEDSRKLLPGTLYPSWVVFSTQQKLKWLNEELNKIWPFVNEAASELIKASVEPVLEQYRPVVFAALKFSKLTLGTVAPQFTGISIIESNEEGIVMELEMNWDANPSIILDVKTXXXXALPIQVXD

SEQ ID NO: 128444 - protein, 325 aa, Triticum aestivum
  Clone ID: PAT_TA_22862.pep
MKDFPGVFPRIFGHEAFGVVESTGEHVEGFAAGDAVVPTFLAQCSECADCRSSRSNVCSKYRFAVRPGMPRDGTTRFRDGDGNPIHHLSSADAWGEYTVVDVTQVVKVDPAVPPATACLLSCGATTGVGAAWKLAKVEPGSSVAIFGLGAVGLAVAEGARICGASKIIGVDLNPDKEELGKKFGVTHFINPKELGEKTVSQVIIEMTDGGADYCFECIGLAALMNDAFQSSRAGWGKTIILGVGSHGAPLTISSLEILHGKCVMGSLFGGVKPKQDIPILADKYLNKELELDKFITHEVGLKDINTAFDLLLQGKSLRCTIWMDK

SEQ ID NO: 128445 - protein, 111 aa, Triticum aestivum
  Clone ID: PAT_TA_22863.pep
TPLRYHTCPHSFSSSVSSRGPGRSNWKGGLGWVPNTFVSAYRNVQYTPSWSPSDPPGPAVISIIGNSPNLYLLARHAVDLSTSIDLVNMCRGMNRTGCQNYDAKRHVVEAK

SEQ ID NO: 128446 - protein, 132 aa, Triticum aestivum
  unsure (1)..(132): unsure at all Xaa locations
  Clone ID: PAT_TA_22864.pep
VGQTIGFGSQPLVDNSPYDSGAQKHGWSLLGIGVALGVKLCHCHGPRYLICVHALVQRRDGFGRFPRIPYYFLGANKPGMCCCWTPGPAVAPFLGRWACWVGLHLYLGDHESVFFRLFKVRPLSVYQXKKKK

SEQ ID NO: 128447 - protein, 59 aa, Triticum aestivum
  Clone ID: PAT_TA_22865.pep
MQKLGLSGLRGLDGFRSLAGATSTAGKATNPKPSSDAGGITYGSFANLKITAGTDLRSL

SEQ ID NO: 128448 - protein, 76 aa, Triticum aestivum
  Clone ID: PAT_TA_22866.pep
DRQSISHSRQESSPACIVLMQRPGVILLFQKKKESSPAVHLCTTQVIAYGHCSVLRLACNCYSHRCGVSVYAEAHV

SEQ ID NO: 128449 - protein, 725 aa, Triticum aestivum
  unsure (1)..(725): unsure at all Xaa locations
  Clone ID: PAT_TA_22867.pep
MAAGTKTVDYAAERALAKDFLTNFAGPHGEPKYXNILQDIANRKIRAVQIELDDLFHYKDVDEEFLQRVTENTKRYIGIFAEAVDELMPEPTETFAVDEDRDILMTQRVVEVADRGADGTDPLQWMPPEIKRFFEVYLKAFSKMTSLTLRQVKAYHIGQLANISVIITLSSDVNPLMHWASYPFSENCXSRVMLDEALRLYADVKGTRSTLDDRQXDLAWMLISEHILHPREMKQQXTNIMDVKYGHALNLFSTTEYSEELTRKGLQEDASLNAGHIHPMTYFGFFIVRXMMEVNXHQKQMTMMYDKEIYCQCELNXDEQDLIDRLAGDGDIYSKLSKSLTPXIFGHEXDVKKALLVLLVGAPHRKLGDGMKIRGDLHICLMGDPGVAKSQLLKHIINVAPRGVYTTGRGSSGVGLTAAVQKDPVTNEFVLEGGALVLADMGICAIDEFDKMEESDRTAIHEVMEQQTVSIAKAGITTSLNARTAVLAAANPAWGRYDMRRTPAENINLPPALLSRFDLLWLILDRADMENDLEMARHVVHVHQNLESPALGFTALEPSVLRAYISAARRVTPSVPRDLEEYIATAYSSIRQEEAKSNAPHSYTTIRTLLSIVRISIALARLRFSETVAQSDVDEALRLMQMSKYSLYSDDRQRSGLDAISDIYSILRDEAARTSSMDVKYGHALNLISRKGYSEAQLKECLEEYASLNVWQIHPSTFDIHFIDA

SEQ ID NO: 128450 - protein, 126 aa, Triticum aestivum
  Clone ID: PAT_TA_22868.pep
MDGQSRKHRILMVSDFFFPNFGGVESHIYYLSQCLLKLGHKVVVMTHAYGKRSGVRYVTGGLKVYYVPWRPFLMQNTLPTLFMTFPIIRTILIRERISVVHGHQAFSTLCHEALMHARTMGYKVVF

SEQ ID NO: 128451 - protein, 201 aa, Triticum aestivum
  unsure (1)..(201): unsure at all Xaa locations
  Clone ID: PAT_TA_22869.pep
AGXGGQSLARGGGKSRDSRDRGCVSGPRTRPEGANTVTKGEVVRAPAGEGSKPPHPGEEAGGRAHHGREKGGCEAEVPACTPPPVQTKYPRPGGNTRDLRDVFGKQSRTCKIGSTDHGGAPQRGMTTVTPDILKSKSGRAEYSRQDSYELRRDIARHRGAAHPLCFTDEVMDHEFPEGFKPVNIESYDGTIDPAVWIEDLL

SEQ ID NO: 128452 - protein, 170 aa, Triticum aestivum
  Clone ID: PAT_TA_22870.pep
VRPRAAHASADAWAFLSAGSELLLEIMRPRVGGGVGLPILGALPDALLVLVSGLSGTKETAQSQVLIGMGLLAGSTVFLLTLLWGTCVVVGKCDVTENGVAIDSTDTKGFSLTGSGITTDVQTSYAARIMAISGIPFVIAQFPKMLKTHHGERLAILLALIASFSLVLAY

SEQ ID NO: 128453 - protein, 351 aa, Triticum aestivum
  Clone ID: PAT_TA_22871.pep
MLKTHHGERLAILLALIASFSLVLAYCLYQVFQPWVQKRKLAYAKHKHVISGILQHAQKQALGRLLNDDGSPNENVIRKLFHKIDNDDSRNLSRAELHALIIGINFDEIDFDKNDAVDKIMDDFDTSGNDTVEEDEFVAGMKTWLNEAKQKVAASGAYSNKFVNDYHARTREDHDQLVDRSDEAVESVENPGWCIAKAVGYLLLGATICAAFADPLVDAVHNFSNATHIPSFFVSFIGLPLATNSSEAVSAIIFASRKKQRTCSLTFSEVYGGVTMNNTLCLGVFLALIYFRELTWDFSSEVLVILLVCVIMGLFTSFRTSFPLWTCLVAYLLYPLTLAVVYVLDFVFGWS

SEQ ID NO: 128454 - protein, 92 aa, Triticum aestivum
  Clone ID: PAT_TA_22872.pep
MSHLSIVLSFTSRHFKVGYDQSAGDCNSMLTSQTVFLALCRSRIARTHGSCSTGPGERPSPVRGGPGRARGPPHCQEAEALSSELAVTSAGP

SEQ ID NO: 128455 - protein, 97 aa, Triticum aestivum
  Clone ID: PAT_TA_22873.pep
GGGTSVWRGCANSRRSTGATRSPARQGKAWHSRVPTRAGISLHLRAIASHLPFISHLMLGSLSISLSSFCKFHDSGFAVPFAQFHTSMKEGNITAFR

SEQ ID NO: 128456 - protein, 212 aa, Triticum aestivum
  unsure (1)..(212): unsure at all Xaa locations
  Clone ID: PAT_TA_22874.pep
ADSKRIVTMVRDTFEKEDLAIVVACGRDTIPYASSVRCLAPDNVFVIQIQHPRYRLDRFDLVVTPRHDYYALTAKGQQEVPRLFRRWITPREPPGLNVVLTSGALHQADSAALRVAATNWHDELAPLPKPLVVVNIGGPTRNCNYGVDLAKQLVSSLHNVXETCGSVRIYFQENATKVSDLILRESAHXKVHIWGGEELTTPDLGHASTQLI

SEQ ID NO: 128457 - protein, 94 aa, Triticum aestivum
  Clone ID: PAT_TA_22875.pep
GGGSCCWIREGRRRELEIGRLASRLAVQPISQILNLLAVLPIFFFGSVFQCMIKSLTNQLKQHELPWCCCREADRCAGQNRAFLCLWIHTVLSS

SEQ ID NO: 128458 - protein, 169 aa, Triticum aestivum
  Clone ID: PAT_TA_22876.pep
MAASSFLPLHLPASPRPATVAARAASGVASTVPAATTQTSQLEETFGRKGLRFGTDATGAPTAELSVRNGSSLQLRLNDGLVTSYRPKVSWEGGDGCRELLHTVAGAGAVKGGVGLVLNEASSSSSLLGASDLSVTDVGSASCGAVQVELGCAGRAAGPTCLLTITDKG

SEQ ID NO: 128459 - protein, 158 aa, Triticum aestivum
  unsure (1)..(158): unsure at all Xaa locations
  Clone ID: PAT_TA_22877.pep
MSAAVEEQMVVKAIREECPWESLPKRLQXSTLHTKDEWHRRIVXNCIRKRLQWNTCFARRVYREGEYYEEMMRYLRRNLALYPYHLADYICRVLRISPFSSCCPFLFETMKNEQPYDSIPNFTAADALRLTGIGRNEFIDIMNKCRSKKLMWKLNKSI

SEQ ID NO: 128460 - protein, 280 aa, Triticum aestivum
  Clone ID: PAT_TA_22878.pep
ITHGRCFPGDHRPPPPASRARLPLPDHAKAPRHPPGRLEYGRGIGERSGRQEPPSSGNGKRVVAKLLERGFGVVAGTTDVGRARGSLPQDPNLQLVRADVTEGADKLAEAVRGVDAVVCATGFRRSFDPFAPWKVDNLGTVNLVEACRKAGVTRFVLVSSILVNGAPMGQLLNPAYIVLNLFGLVLVAKLQAEKYIRGSGINYTIVRPGGLTEQPPTGNIVMEPEDTLYEGSISRDQVAEVAVEALLCPEESSYKVVEIVTRADAPSRPLKDMFASIKQK

SEQ ID NO: 128461 - protein, 126 aa, Triticum aestivum
  Clone ID: PAT_TA_22879.pep
PVLFHFPLRLRVAVEAVQLFKRRELNSLVRAMRSSAPLCLVITLVAFYFLVPSNAIPLSRVQRLVPLQHAGEQVPWVKENTPKPKMDMARVILEDDAVNVSTRMALETQDYAPSGPNNHHKPPGWN

SEQ ID NO: 128462 - protein, 62 aa, Triticum aestivum
  Clone ID: PAT_TA_22880.pep
MGYLTEADVDLRPLTMEDLRQAKNQVAASFAAEGAVMNELKQWNDLYGEGGSRKKEQLTYFL

SEQ ID NO: 128463 - protein, 64 aa, Triticum aestivum
  Clone ID: PAT_TA_22881.pep
FFFYGFTGLIITVFRSYQFTSSTPVHATPTHSSVITMDHGRVHHIIYGFSLDSAVRFPLFPWLI

SEQ ID NO: 128464 - protein, 207 aa, Triticum aestivum
  unsure (1)..(207): unsure at all Xaa locations
  Clone ID: PAT_TA_22882.pep
MIGPLPLVRLSMMLDGLDDERDTVLSLPXRDSKDRGFGRIEPWFPGCGLYGATMEHLKNESWGRDSIAXNKEGGQDGLWRSPMPKPQXEKTDGRPYSAGKGSGQLLYHEGITDGASKDLCNTSKDPAVRAYGQXGTELHXEAHMLGETAGECYNDXSNNGYKRNPSQEXTCFQGDPYLXNXGPLINEXGTNFGKDNXSPGSPVKPLI

SEQ ID NO: 128465 - protein, 162 aa, Triticum aestivum
  Clone ID: PAT_TA_22883.pep
HASAHASADAWVEDALNATKAAVEEGIVVGGGCTLLRLAAKVDAIKDTLDNDEQKVGAEIVRRALCYPLKLIAKNAGVNGSVVTEKVLSNDNFKFGYNAATGQYEDLMAAGIIDPTKVVRCCLEHAASVAKTFLTSDVVVVEIKEPEAAPLANPMDNSGFGY

SEQ ID NO: 128466 - protein, 410 aa, Triticum aestivum
  Clone ID: PAT_TA_22884.pep
MASPFGGASTCGLKAAAPSGFAARKQLSLVSPPLVSLPQRVRPGRRCGVRVNAAKELYFNKDGSATKKLQVGVNKLADLVGVTLGPKGRNVVLESKYGSPRIVNDGVTVAKEVELEDPVENIGAKLVRQAAAKTNDLAGDGTTTSVILAQGMIAEGVKVIAAGANPVQITRGIEKTAKALVLELKKMSKEVEDSELADVAAVSAGNNYEIGNMIAEAMSKVGRKGVVTLEEGRSSENNLYVVEGMQFERGYISPYFVTDSEKMTTEYENCKLLLVDKKITNARDLINVLEEAIRGQYPILIIAEDIEQEALATLVVNKLRGSLKICAIKAPGFGERKTQYLDDIAILTGGTVIRDEVGLTLDKADSTVLGTAAKVVLTKESTTIVGDGSTQEEVTKRVAQIKNLIEAAEQ

SEQ ID NO: 128467 - protein, 404 aa, Triticum aestivum
  unsure (1)..(404): unsure at all Xaa locations
  Clone ID: PAT_TA_22885.pep
MSDGPTTGAHFARGLSVXGVKVTASSSNPVXINRGIEKTAKALVLELKKMTEEVEMFLLSVVAAITNSXHDGSGYEQAGAESKVGPKGVVTLEEERSSXNNLYVVEGMQFDRGYISPYFNTDSEKVTTEDVGCKENXLYKGINHSRDLSHELEEPNPGQYPGQIIAEDIEQEALETQVVLXLIALSKTPAFWESGSPKRWTQYLDDTGINHPEETVITHEVGLTLDKSDNTLLGTAAKSVLQKESTTIVGDGSTQEEVTKRVAQIKNLIEAAEQDYEKEKLNXERIAKLAGGVAVIQVGAQTETELKEKKLRVEDALNATKAXVEEGIVVGGGXCTLLRLAAKVDAIKDTLDSDERXCGAGIVRRALCYPLKLIAKXNAGVNGSVVTDKVLSNDNFKFGYNACD

SEQ ID NO: 128468 - protein, 166 aa, Triticum aestivum
  Clone ID: PAT_TA_22886.pep
LTQNYCQSVSPTERKPQNILFLSSALSLAQRENRPEPAKLKIQLSYSSLGLLPCLLFFVARHPHNCHHGKRKKAQISPCLLMFLNNLSRRFLLAATFSFNPPNQQQQIYILLEQYSSRTTSKTSGTSSAGTNRKHGAPGQQQTGQTIPILKKGIDVAELIRLPRIP

SEQ ID NO: 128469 - protein, 210 aa, Triticum aestivum
  Clone ID: PAT_TA_22887.pep
PCRRVHDRPATKASKSKSMALPSPAGIAKPRLHLLFNHRRASSSSVTCCSNNGRSSSSEPEDWAAPSGDAVDWRSFRAQLVLKEQYAKSVNPALRASWAPAAKIADKWAHPLVEPEKGCLLIATGKLDGSHIFERTVILLLSAGVLGPVGVILNRPSLMSIKEAQSLFAEEADIAGTFSGRPLFFGGPLEECFFLLGPRKAASAADDVVG

SEQ ID NO: 128470 - protein, 190 aa, Triticum aestivum
  unsure (1)..(190): unsure at all Xaa locations
  Clone ID: PAT_TA_22888.pep
GLWPGWLGCGRRRNSEPTHHPLCSHCRRSNRHARLRLRRHRRYGRRCRRRTGTSAHRALEGHLRHMTYTWWIPQRFGDGERNSGGSSLKGNSPSAGVRRRRSNPPHSQNGDFXAQGNNNPQESAKDNPLQASLPAGACRPHLGGRRQTFGSGSYPPPPPAAQPSSPLPSPLPRPHPTXXXQTLRKHTXNC

SEQ ID NO: 128471 - protein, 166 aa, Triticum aestivum
  unsure (1)..(166): unsure at all Xaa locations
  Clone ID: PAT_TA_22889.pep
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAXLRHVMTNLGEXLTDEEVDXMFREADVDGDGXINYDDLSKAMMANDTNLLPKTGGNFPLHIV

SEQ ID NO: 128472 - protein, 176 aa, Triticum aestivum
  Clone ID: PAT_TA_22890.pep
MAPPFEPTIWGDFFINYTPEPLQSEERLRERVDQLKKVTSELFEFCSDSVVGTMKLVDTLEHLSIDHHFEGHIATALSNIHGAELDSSSLHDVALRFRLLRQHGLWVSPDEFDKFKEADGTFNDEIMSDPRGLLSLYNASYLLIPGEVELESAMLFSRHRLQAMVNDLASPLAEQV

SEQ ID NO: 128473 - protein, 86 aa, Triticum aestivum
  unsure (1)..(86): unsure at all Xaa locations
  Clone ID: PAT_TA_22891.pep
MGFHSTAQPARSPCNSRNVQLKLAAAAQGLHAALAGLVAAEATAQCKQACIXAAFLLMALLNMIIVGHVLRTRRVVHLDVYLYTSI

SEQ ID NO: 128474 - protein, 209 aa, Triticum aestivum
  unsure (1)..(209): unsure at all Xaa locations
  Clone ID: PAT_TA_22892.pep
VLNAWFGIPEVPITATTVRDEQGVLEAVEHVHEMLDKEVAAGTSPTNIFVCGLSQGGALAIASVLLYPKTLGGCAVFXSGSVPLSKSFADRVTPEAXKTPVLWFHGXADGGVLSEAGHPGCAFLXQELGMACQFKTYPPLGPSLGGDPLLRRRRRTLGPPGGPRATHAARPPSSSSSYIGHSDSNMTKFINLSKGGRSIPGIPPRRLRE

SEQ ID NO: 128475 - protein, 219 aa, Triticum aestivum
  Clone ID: PAT_TA_22893.pep
LLNYHLISVQASGFATRFLSNFNAVQSYFCLTESDNSFKKSRANRTQFAGSKDEMFFESQPWLDSDCEDDFYSINGDFTPSRGSTPVHQPRAQTVMSNVFLPDNAARSPNSSEASPTGRRKLADLLQEATRNDTGETAAAAAGEADGSKSGQQAVAPAAGKTVSEPSSGCSTEPTPVREARTRKERAWYSGRCCLPTFVHSLALDDEGRQKTGPGPCAV

SEQ ID NO: 128476 - protein, 280 aa, Triticum aestivum
  unsure (1)..(280): unsure at all Xaa locations
  Clone ID: PAT_TA_22894.pep
PPPVSPWTTPPTPPPAPAPAAAPARARGLFFPDPPVRLQSAHACGWAWVLARRLSRTPSGCPRSSSCSASSPPPKDGKAVDGAPVGDVLRRPQAQDRGLRPQQDPCTPGSKDEMFFXSQPWLDSXDCEDDFYSINGDFTPSRGSTPVHQPRAQTVMSSVFLPDNAVQSPNSSEASPTGRRKLADLLQXATRNDTGESADAATGESDGSKSGQQAVAPAAGKSVSXERSSGCSTEPTPXREARSRKERAWYAGRCCLPTFVHQPGPRLQRAAENGPGPCAV

SEQ ID NO: 128477 - protein, 70 aa, Triticum aestivum
  Clone ID: PAT_TA_22895.pep
NKFNSCVFHPNYPSLLVIGCYESLELWDIREKNTVTISNAHDGLIAALAASNASGLVASVSHDKLVKLWK

SEQ ID NO: 128478 - protein, 79 aa, Triticum aestivum
  Clone ID: PAT_TA_22896.pep
TTPRMPEQGTCERCGYISSQKLCKACVLLDGLNRGLPKLGIGRTAKVGAGADGSGEQQGKRAERRNRSSLQGKHGNLDF

SEQ ID NO: 128479 - protein, 82 aa, Triticum aestivum
  Clone ID: PAT_TA_22897.pep
MCQSVAMDPKCIYLVECTLNTLSIYFSLTFRSHATKPHKLHGCPPHHIIHTTLIEKKINHPKQDLPVFCSYDVVPCTYLLVV

SEQ ID NO: 128480 - protein, 113 aa, Triticum aestivum
  unsure (1)..(113): unsure at all Xaa locations
  Clone ID: PAT_TA_22898.pep
ARVYDHIGLVRAPLDSESDAEPRRSGEEGETEAELRRLRVQAEQWRKAAXETAMALLHCGQGXGTGKILDRGESLGXGGKYAGLYXDELGRTTRRQPRKNGNVLRRISGMWKK

SEQ ID NO: 128481 - protein, 109 aa, Triticum aestivum
  unsure (1)..(109): unsure at all Xaa locations
  Clone ID: PAT_TA_22899.pep
KSSESAPPPALVPRHCTPAQPARGGSPRAAVPSALPFRCGAPSLPRGPTDDPKVGESVACKASQIWVLFVEEWAFFSKALGHXLVLVWMASMGTLMCFVGXLDAKFTIG

SEQ ID NO: 128482 - protein, 88 aa, Triticum aestivum
  Clone ID: PAT_TA_22900.pep
MEKDTAATAARVCRRCKAKYSPSGNTPQSCRFHPSYFVCRRHDDQKRYYELKEGDPPYAAKFYDCCGAEDPAAAGCATGFHLSYDDPE

SEQ ID NO: 128483 - protein, 90 aa, Triticum aestivum
  Clone ID: PAT_TA_22901.pep
LVTQVSRQTKGRQSAGDQADIGGEGAGAPRPEGGVIQRGKVGVLNKVRRTVTGMRWKSKLLDHEDGPLVPEKLLIAVKTYWVGREEGSSS

SEQ ID NO: 128484 - protein, 448 aa, Triticum aestivum
  Clone ID: PAT_TA_22902.pep
MPWIHLGCRSAQGYRWMLQWSPMRRGWVSILEALKLYGRSWRQIQEHIGTKTAVQIRSHAQKFFSKVVREPGAKIEIEIPPPRPKRKPLHPYPRKRANSCNGANAANGQSKLAHMSSSSGSDQENGSPVSVISAMQSDAFGSSMSNPSSRSTSPESSDEENSVLPMVNGGEGQQTGIDQPHKEADQENKDTGTSEEDSSDEVQVTSVKLFGKTVVIPDPRKRCSPDTGSGHENGEQTSQSSNKGTSQAPLAVEIPTHTKGEQISQSSYKATSPAPLAVEVPTYTNGEQISEFSYKATSHPPSAVEIQAYAAPPSAWVLPYNSFPLHFGESAEARIARLHMWWPYYGFPMVHPSGPSAVAHNGKATDESEAAKSPPVESSSDFVDNTQATASKQWKVLESLGTAQAPPSVSNFQLKPSTNSAFVRVKPIISSGDEPVRGFAPYKRCRVE

SEQ ID NO: 128485 - protein, 202 aa, Triticum aestivum
  unsure (1)..(202): unsure at all Xaa locations
  Clone ID: PAT_TA_22903.pep
MEPSAKVDTQPKPRLIVRLGIFLASHHILFSALCCSAGIIALLFLPSLAKNTYLSENALIPGSANPLFSSEDVTEANKFIKGIEAAAGESRGGMEMSKFIVQQMKDLGAEVCYHEFLPHSKHFHPPEFFTSXMTNDLAVRPNGTYSNXGTNTMGIIRAPGGDGKEAIVLVTPYNPQKVQANEVLSLALGFSVFSLLXRAAWL

SEQ ID NO: 128486 - protein, 258 aa, Triticum aestivum
  unsure (1)..(258): unsure at all Xaa locations
  Clone ID: PAT_TA_22904.pep
MAANFWASSHSKQLLDPEDVDLVPAADRERGITTEEFRLVKIHMSSHIWRLAQQVKVRQRVIATAITYFRRVYTRKSMSEYDPRLVAPACLYLASKVEESTVQARLLVFYIKKMCGGSDDKYRFEIKDILEMEMKLLEALDYYLVVYHPYRPLLHLLQDAGVTDLTQFAWGLIXETYIKDFFLVHTPYMIALYCIYISSFLKANDTTSWLEELHVDMNIVKNISMEILDFYETYKVDPQRGLSDEKISPIMNKLPAKA

SEQ ID NO: 128487 - protein, 105 aa, Triticum aestivum
  Clone ID: PAT_TA_22905.pep
MLPDAAPGDSPAAGSPPAAAAVAKVRVKVLFFARARDLTGVAESSVEVPSGSTAGECLGRVLASFPKLDEIRRSMVLALNEEYAPESAPVADGDELAIIPPISSG

SEQ ID NO: 128488 - protein, 251 aa, Triticum aestivum
  Clone ID: PAT_TA_22906.pep
HEVKILNTVRHRNIVRMAGYCIRRNVGMILYEYMPEGTLFELLHERTPQVALDWTARHLIALGAAEGLSYLHHDCLPMIVHRDVKSSNILMDAELVPKITDFGMGKIVGDEDADATVSVVVGTLGYIAPEQGYSTRLTEKSDVYSYGVVLLELLTRKMPVDPAFGDGVDIVTWMRSNLTSTQADHGSVMSCLEEEITYWPEHEQAKALDLLDLAVSCTQTACQSRPSMREVVNILMRIDESIISRASQVRQ

SEQ ID NO: 128489 - protein, 105 aa, Triticum aestivum
  Clone ID: PAT_TA_22907.pep
LLSPLPVHAATHLFISLMRCVALLQLDLGGAGSCWLELGCNRVDGSMPHEHLCSAFFLLCVLICFLLILSLRDAKRIKKMLCLELILLLPMMYVIVSPPNVLVMC

SEQ ID NO: 128490 - protein, 84 aa, Triticum aestivum
  Clone ID: PAT_TA_22908.pep
MNCVESAAIDRPSMTEVVSRLKVLLPTTPSRKQYASPSSTKSMNDEMRKQFQLLISGEGNDESSSSFQSGYTSRMTQLPPLSGR

SEQ ID NO: 128491 - protein, 168 aa, Triticum aestivum
  Clone ID: PAT_TA_22909.pep
MAGRHRNPLPSSFSRGAGAGNHPHPPPPHHPHLPPYHLDEFREPPRLPPHHLDDFRDPARLPPGHPDSLREHPPPPRHHLAGHGGGTLPPASHMAAALEERIGAEIEEAHALLGQNQRLSATHVALLQEVSAVRHELGHTARAIGAAQQEGDLRIREVYERLMKMEAE

SEQ ID NO: 128492 - protein, 337 aa, Triticum aestivum
  unsure (1)..(337): unsure at all Xaa locations
  Clone ID: PAT_TA_22910.pep
MAGRHRNPLPSSFSRGAGAGNHPHPPPPHHPHLPPYHLDEFREPPRLPPHHLDDFRDPARLPPGHPDSLREHPPPPRHHFAGHGGGALPPASHMAAALEERIGAEIEEAHALLGQNQRLSATHVALVQEVSAVPHELGHTARAIGAAQQEGDLRIREVYERLMKMEAELRAVEEMRAELAHVRMDIQQAGCSKXTQDLARSAVELQQVAAVKAETQELRHETQHLRSSIELEKKGYAESYEQGQEMQKKLVSVASEVEKLRAEVANAEKRSRAAVSAGNQGYAGSYGNPNANYAANPYNAGYSMTQANATDSGSQYGAGAAHSSWGAYDMQRAPGRR

SEQ ID NO: 128493 - protein, 173 aa, Triticum aestivum
  unsure (1)..(173): unsure at all Xaa locations
  Clone ID: PAT_TA_22911.pep
SCRIRHEAALSFPGRGSSFAGRSPPSRACLTSSNPKLRTPAPSLRVSYRRRRLYVCACSGDVDPDASAASPAEASFDIKLPRRSLLVQFTCNKCDARTKRLXINRVGYERRNXVFLQCRKGAKVFHXVXLDKSLGLICPSXDLTXKENGGCTCFGLTDFCVYLENMLISLLNH

SEQ ID NO: 128494 - protein, 88 aa, Triticum aestivum
  unsure (1)..(88): unsure at all Xaa locations
  Clone ID: PAT_TA_22912.pep
QKHKCFLQKKKKKKKKKKKKKKKKKKKKKKKKKKKKKKKKKKKKKKKKKKKKXXXGGAVLREQSLKPRASKEKVFLWGTQNKITWAGV

SEQ ID NO: 128495 - protein, 282 aa, Triticum aestivum
  unsure (1)..(282): unsure at all Xaa locations
  Clone ID: PAT_TA_22913.pep
MTGWEANQSDVLKPNAVTGLGKTAVNNWGIYDGPXPRPNWLAKTHGMHTCAGKSSNRFTLXFVVERFEASTLQVMGANDEDEADNEWAIVGGTGEFTMARGIIQRRVYSVTDSTITHTLTLALIIQIYYHVTEVVPSPTKRGTVGGNRGTLPREMEGKSQRLENVTIYHVGAVEGFQFSYVDEDGKIRTTDTWGRVHPDPLRKTEIKFGPSEFVKKINGAQRGGEGWLSKFEIVTTHKTYGPFGADNGTPNFSYTVPEDETVVGFFANTDNIFVTSIGVYTI

SEQ ID NO: 128496 - protein, 148 aa, Triticum aestivum
  Clone ID: PAT_TA_22914.pep
LPCSPRRVRHEILPSYCYPPPPSRPIHVTPPSSEPRPPPLGAGACPVCCRRGLRGVPHALLPAKLAPVRAQHRYCTALNPRASAYRRCNWCEMEPAEADAQAHNQAPEGASKNPEKRKRSPCREQETGDAEAWRQHRRRCATDTGERR

SEQ ID NO: 128497 - protein, 221 aa, Triticum aestivum
  Clone ID: PAT_TA_22915.pep
STLGSARQRNLVPLLGYCIAKKERLLVYKYMPKGSLYDQLHHGGSDREALAWPLRLKIAIGAGKGLAWLHHSCNPRILHRNISSKCILLDDDYEPKISDFGLARLMNPIDTHLSTFVNGEFGDLGYVASEYTHTLVATPKGDVYSFGVVLLELVTGEVPTRVSKAPENFKGSLVDWITYLSNNSILQDAVDKSMIGKDNDPSCSILKAPVLRASLKGKTTS

SEQ ID NO: 128498 - protein, 106 aa, Triticum aestivum
  Clone ID: PAT_TA_22916.pep
ERLPRAHLKEATRTLGGKPGYEDWSEQLHILETAEFPEVVIDARLRHAQEILEELLKPVDETQDIYKRQQLRELAMLNSTLREDSPHPGSVSPFSNGGMKRAKTGQ

SEQ ID NO: 128499 - protein, 196 aa, Triticum aestivum
  unsure (1)..(196): unsure at all Xaa locations
  Clone ID: PAT_TA_22917.pep
LRLQFLRQIFWDVNEKLKVLATLTFPDLAAFVPFGHMQLHIEGLCHGNLSGDEAINISKIFQNTLSGQTLSVEARHGERVLCIPHGANFIRSVRVKNDLEENSVVEVYXQVEQDIGKDSTRLRAITDLFSNIIEEPCFDQLRTKXQLGYTVDSIKDDYRLLLYLSQSPITRYCNMLNLRWPALPMDREFSPKGGLE

SEQ ID NO: 128500 - protein, 82 aa, Triticum aestivum
  unsure (1)..(82): unsure at all Xaa locations
  Clone ID: PAT_TA_22918.pep
EFVLYIFYVMPGLVSLIAKLSLGMLWHAASRAVHRASLENNASILVSMFDPNAPLFAXLRRLSSFYWFPGLKEXNWYYVSIP

SEQ ID NO: 128501 - protein, 81 aa, Triticum aestivum
  Clone ID: PAT_TA_22919.pep
AHTKADISNEIWNCISTFEYTATQAPFHHHYLVMRSTYTYNANNIHTDNVNQFSSLGCLFRGPQPISLLTMMIHKLLGPEN

SEQ ID NO: 128502 - protein, 179 aa, Triticum aestivum
  unsure (1)..(179): unsure at all Xaa locations
  Clone ID: PAT_TA_22920.pep
SCLHRPAYLPRPRAHPLPHSLRPAAARPCLHRPTHATTDAMYLTPSQQREIKRERSNINSAWCQLRLDRGRFNFTEEMSALDQSMVETCKQHQAGLPKVWSKLERVHERAQGLDARARGLDVTEEELKQRETRVETPCGTRQAGKGSWRSGQMSLGLGGSLXREEXWWLGKXYQDRQLR

SEQ ID NO: 128503 - protein, 108 aa, Triticum aestivum
  unsure (1)..(108): unsure at all Xaa locations
  Clone ID: PAT_TA_22921.pep
MDRRAFRSNSCNSKNPAPPSSPSAAASAAVYRTSAPVGGSQDNVXERKALLPRRPEGGTARKAYKGPKRRVQWKDTHGKKLAEVLEFQPSDSSDSDDDYLDTCICSVM

SEQ ID NO: 128504 - protein, 570 aa, Triticum aestivum
  Clone ID: PAT_TA_22922.pep
MPAAHSLLHLAAPKSVAPTSTLSLAGAAHLRLLPSRRPQRLVASCSSAHPDLAAFPNPNGLLVAEPAAAAPIDIDVATEAELRENGSRSTRRTKLVCTVGPATCGPSELEALAVGGMNVARLNMCHGDREWHQKVISSVRMLNEEKGYAVAVMMDTEGSEIHMGDLGGAPAAKAEDGEIWTFSVRSFEAPLPELTVHVNYEGFAEDVRVGDDLLVDGGMARFEVVEKLGPDVKCRCTDPGLLLPRANLTFWRDGSVVRAKNAMLPTITSKDWLDIDFGIAEGVDFIAVSFVKSAEVINHLKSYIAARSRGNDIAVIAKIESIDSLTNLEEIIRASDGAMVARGDLGAQIPLEQVPSIQQKIVKLCRQLNKPVVVASQLLESMIEYPIPTRAEVADVSEAVHQRADALMLSGESAMGRYPDKALIVLSSVSLRIERWWREEKHHEPLELEDVSSSFSDKISEEICISAAKMANKLEVDAVFVYTKGGHMASLLSRCRPDCPIFAFTNSTSVRRRLNLQWGLIPFRLTFSDDMESNLNRTFSLLKARGMIKSGDLVIALSDMLQSIQVMNVP

SEQ ID NO: 128505 - protein, 167 aa, Triticum aestivum
  unsure (1)..(167): unsure at all Xaa locations
  Clone ID: PAT_TA_22923.pep
KDDESLRRWKEQLLGSVDLNSVGETLEPDVKIMSLSIQSPGRPDIFLPLPVEPXSGKGVWFTLKEGSPYKLKFTFSVSNNIVSGLRYTNTVWKTGIKVDSTKEMLGTFSPQPEPYAYVTPEXETTPSGMFARGXSYSAKTKFLDDDRKCYLQINYTFDIRREWPSSG

SEQ ID NO: 128506 - protein, 122 aa, Triticum aestivum
  Clone ID: PAT_TA_22924.pep
HSVVAAEVRGKATAQTGRTSKRPQMPSSVPTEKAPTQSKATPSKPQKALPKIKVVIPIASGAATSGTSAYMNEDEEMEDAVTSNSAPPNVIDLPDDDEDVPLTPMGRRNRKTSTGKAPQSSR

SEQ ID NO: 128507 - protein, 69 aa, Triticum aestivum
  Clone ID: PAT_TA_22925.pep
KRCVKAQSFYCWKLLKKLDGQENKKEPKGMPFLCKGRTQKLAPLPAMAQLQTQCGTLFVRIKVVAFTLT

SEQ ID NO: 128508 - protein, 152 aa, Triticum aestivum
  unsure (1)..(152): unsure at all Xaa locations
  Clone ID: PAT_TA_22926.pep
METIRCCIACILPCGALDVVRIVHSNGRVEEISEPVLAGEIMKAYPKHVLRKPPSTCPSDGGGGIVVQKPVILPPNAELQKGKIYFLMPVMAPAPDKAAAKPKAPAPPPSAAPPAASGRRGGSGSXRAAARTDAPAASLQSAEGEKERLLAN

SEQ ID NO: 128509 - protein, 139 aa, Triticum aestivum
  Clone ID: PAT_TA_22927.pep
GVAYPRAHAVAVPVTAPSQQPQVPTQQRSYAAVPRAVVAGVTPRPEHPPRGVPIAPHPQLKVNAVPAVTPSPAVTPSLAVTPSPAVTPSLVVTPSPAVTPSPAFTPFPQEHVTTKERESTKENASTVVINDRKVNVFRQ

SEQ ID NO: 128510 - protein, 159 aa, Triticum aestivum
  Clone ID: PAT_TA_22928.pep
NGLFFSSIISWITVCYSITWWLTTIVKEAHRLHQIELREKEHLKFLRLLLKDFMIKYGIDTENWILIQFATALKIIVLCPWSISQMKAIEDHKGSLLLYRNSTHKGSLLHLQKLMMLAMVRGRNHEGTVGLQGAQTLILRFAYNFVCRFVWLGVCSLFL

SEQ ID NO: 128511 - protein, 171 aa, Triticum aestivum
  unsure (1)..(171): unsure at all Xaa locations
  Clone ID: PAT_TA_22929.pep
LQLLLPGCPGSPAKRLGACPSAPQPCCAPPGISRWPARHPDKAPSXTRPLAPSSHAFESVQASDAAADLSSRAGPRPTVPAGPAAASXGSTLRALVSQHGLAVPGIVAELHPDXSSPLTGAHLGARISQHGLPDAGSRVPPDAALAAPSARSSGDGSINSRTSEGSCQGSP

SEQ ID NO: 128512 - protein, 168 aa, Triticum aestivum
  unsure (1)..(168): unsure at all Xaa locations
  Clone ID: PAT_TA_22930.pep
FFFFXVEMVLGADRVGRRRRCYNRQQWELQAAMARWKAVTMELICWDGGTTVVAELQRWLVVEMGPCPLLHPQGRRELQWQPRPRRRPHARRRRLGAARLHEQTDGDLARDDGDLVQRACTSKPTASAGHGAADERMLCGRAGDRRVRMRSSGCAGLYPLLLFSFLFR

SEQ ID NO: 128513 - protein, 131 aa, Triticum aestivum
  Clone ID: PAT_TA_22931.pep
MIHRAVVLGATCPCFLFGKNAQFLGSGTLAGSCTTHCMLWGLLTSFCCLCTGGLVLAVPGSAVACYACGYRQALRTKYNLPEAPCGDLTTHLFCHLCAICQEYREIRERTDSGTSSAPDVTPPPVQTMDEL

SEQ ID NO: 128514 - protein, 279 aa, Triticum aestivum
  Clone ID: PAT_TA_22932.pep
SVVAAEVHGFQGHHLDLRLVRNQWLLLDPGAECLMSEANEDKTSGDFKEMGGRLAGEAVAFLKKKVDKLARHGGCKELKLSFVGHSIGNIIIRTALAEPALQPYLKNLYTYMSISGPHLGYWYSSNSLFNSGLWLLKKLKGAQCIHQLTFSDDQDPQNTFFYRLCKSKTLENFKNIILLSSPQDGYVPYHSARIELCPAASADNSRKGQVFTEMLNNCLDQMRAPSSETRIFMRCDVNFDQSAHGRNLNTMIGRAAHIEFLETDIYARFIMWSFPELFR

SEQ ID NO: 128515 - protein, 138 aa, Triticum aestivum
  Clone ID: PAT_TA_22933.pep
TMGSEEHDWGHRCGSQQVFQEDGDTDGDDGGGGDDDDDEAQQQEAAMMEPPSENAMPIVMVDTEAQPSETVLAVEQTGEVIPMIMDPPAPTAGPPHPASTGTGRTRRPCYGWISESESDSDYEEYLALRQKQVHVPAK

SEQ ID NO: 128516 - protein, 140 aa, Triticum aestivum
  unsure (1)..(140): unsure at all Xaa locations
  Clone ID: PAT_TA_22934.pep
MTQVTAVSADIVLHNAFVVTMDGALTVLRDGAIAVVGDRIAAVGPSADVLGAFPGAAQTLNLAGRILLPGFVNTHVHTSXQLARGXADDVDLMTWAAREDLGPTSLTMTEGGLLXSTLLCGIELIRSGGSQSSARIRSAV

SEQ ID NO: 128517 - protein, 202 aa, Triticum aestivum
  unsure (1)..(202): unsure at all Xaa locations
  Clone ID: PAT_TA_22935.pep
MAGGDDLKLLGAWPSPFVTRVKLALXLKDLSYEDVEEDLYKKSELLLKSNPVHKKIPVLIHNGAPVCESMIIVQYIDEVFAGSGPSLLPADPYECAVARFWMPYVDDKLVAPWRQWLRGKTEEEKSEGKKQAFAAVEILEGALRECSKGGGFFGGDSVGLVDVALEGVLSXMKVSKGVXRDQIFDAAKTPLLAHWVGALQRA

SEQ ID NO: 128518 - protein, 230 aa, Triticum aestivum
  unsure (1)..(230): unsure at all Xaa locations
  Clone ID: PAT_TA_22936.pep
MAGRDDLKLLGTWPSPFVTRVKLALAXKGLSYEDVEEDLYKKSELLLQAHELHKKIPVLIHNGAPVCESMISLQYIDDVHPGTGPSLLPADPYERAIARFWMAYVDDKLVAPWRQWLRGKTEEEKSEGKKQAFAAVEMLEGALRECSKGGGFFGGDGVGLVDVALGGVLSWMKVTEVLSGDKIFDAAKTPLLAAWVERFSELDAAKAALPDVGRLLEFAKAREAAAAASN

SEQ ID NO: 128519 - protein, 94 aa, Triticum aestivum
  Clone ID: PAT_TA_22937.pep
RHRGWRLGGRRHDGHLHSPVDEDAVLANHGARLPERRRLSRSFGDLSSGHSFTSSRWCHRSRRRQSLPFTPLTLFHHVRRTTTLVLATITPPLK

SEQ ID NO: 128520 - protein, 108 aa, Triticum aestivum
  Clone ID: PAT_TA_22938.pep
SAPGASAGFRPARPWRSFGSCTPGPLPRAARPGNDFFRGLLDDTDSRVAYYSAAFLLKRMMTEEPDVYQRMLQSLISKAQQCNNEKLLENPYLQMRGILQLSNDLGVQ

SEQ ID NO: 128521 - protein, 189 aa, Triticum aestivum
  Clone ID: PAT_TA_22939.pep
MALRLSVSSPQSTASSPAISSCRPAACGRFLACVAASQKRSLMVVSGSDGRGVAPVKSGGLETATTGADEVEAPTAAVAVTGQVTEVCKDTFWPIVKAAGEKPVVLDMYTQWCGPCKVMAPKFQEMSEKDHDVVFLKLDCNQDNRPLAKELGIRVVPTFKIFKDGKVAKEVTGAKIDELARAIEEVKSS

SEQ ID NO: 128522 - protein, 446 aa, Triticum aestivum
  Clone ID: PAT_TA_22940.pep
SARAQRQDTRKRGRKTRNLHLNEAYSRLNDLIEDGLSEESASKLTSSIVSLVSFDGEKIYSQSTGIVVENDQFSASFLTSKDLIRKKSAFVPGLQIKVYLPNREVVNGLVQYYSAKWRMVVASAKPSPHLVTACLGNIMQAESSSGLFAITCCYKTGNLLVTTGTLASSPSGLEGIMQSTCQISVDGSGGPLVSPDGNIVGMNLCTEESTTPFIPTDQIYDCLRKLAIRTYLENFTPLSSSSEGISSLDTIIGSSSEGSENKNQDANVEWCDLSQELASKLSPSIVSLASFDGETLHSECTGMVIDSESCSASFLTTGSLFGSLDPELWSKVVIKVRLPNDEVVHGWLDYYMSKNNIAVVTTDSLLVPYFHLRVACLDNNVRVESAAGVLAVRRYFDSGKLVYTGGSLTGGIQNKELNSSLTGGIQNKELNFSTCKINEVASGGPL

SEQ ID NO: 128523 - protein, 118 aa, Triticum aestivum
  unsure (1)..(118): unsure at all Xaa locations
  Clone ID: PAT_TA_22941.pep
MERCTIERQCITMFIYQHRVHPRQLIYSYSLALVFPCFNCRSPPRLQTTLEEDILGVAPSAPHKKVPGRYSDTVSCCLASQCLNHLWRRAGLAPRRRDRDRGQDHAQERSPGPXESHG

SEQ ID NO: 128524 - protein, 316 aa, Triticum aestivum
  unsure (1)..(316): unsure at all Xaa locations
  Clone ID: PAT_TA_22942.pep
RGPSGADGGGSQVEQAGDAELGWGLLGDAYDRCGEVCAEYAKTFYLGTQLMTPERRKAVWAIYVWCRRTDELVDGPNSSYITPKALDRWEKRLEDLFEGRPYDMYDAALSDTASKFPIDIQPFRDMIEGMRLDLWKSRYRXFDELYLYXYYVAGTVGLXMTVPGDGDCSRTLKASPRDACYNAALGLGIANQLTNILRXVGEDSRRGRIYLPLDELAQAVLTEEDIFRGKVTDKWRRFMKGQIQRARLFFDEAEKGVMHLDSASRWPVLASLWLYRQILDAIEANDYNNFTKRAYVGKAKKFLSLPAAYARAALSP

SEQ ID NO: 128525 - protein, 406 aa, Triticum aestivum
  unsure (1)..(406): unsure at all Xaa locations
  Clone ID: PAT_TA_22943.pep
APRAASGRTATAEGPVSGGRPFEPASGLLERPGRTGGRWPGPTGNGRAPCGAKVGLNSGSWTPGEHMRLIPYIQKYGHANWRALPKQAGLLRCGKSCRLRWINYLRPDLKRGNFTVEEEETLIKLHNMLGDRRFKIAACLPGRTDNEIKNVWNTHLKKRVAASAGEQKYGGAKGKKNTTCADVPAPSPSRTSSTTTTTTTTTNCSSGESGEQSNTSKELELELELEKIEIPMLDLGFDLDMLLDTVTNTHCPAISSAPTSRCSSASPTCVVDDGALLDLPEIDIVPELWSIMDGEGGAGACAETAQVPWSNAAPCDGKGPEASAATADDEDGKEWWLEDLEKELGLWGPIDDYQYQQPDXKACADPLSASVDDPVSSYFQAGPASATSTIHGPEASAVLTDIPMGL

SEQ ID NO: 128526 - protein, 84 aa, Triticum aestivum
  Clone ID: PAT_TA_22944.pep
NVTEFDTDPLALLNLENTNHEPVSAYRMEDLSAHIQRDQVASGVIREEKEEGVEGTNPSLELPKAGGEQRGGGRCRHGVGGGRG

SEQ ID NO: 128527 - protein, 201 aa, Triticum aestivum
  Clone ID: PAT_TA_22945.pep
APSAGGVGREADGGLEFLLDPVDRFPLREESADNLEHPDPVPLALLPRCEIRGRKNASPTRSPQSTGEVNHEAPGWTKVEAGEYTALEQSIQKYAEEPSKSVVKPELGLSFDLSGEAYDFYNLYSWVVGFGIRYGKSRLNDKSTKIMQEILSGCAGKPEVKNSRSCRCSDKTSLYDMPFGLFVRVNHHFQSVILVGVRRIS

SEQ ID NO: 128528 - protein, 53 aa, Triticum aestivum
  Clone ID: PAT_TA_22946.pep
LYLGLFNSSFPDMNYLITPLFIFFAGGQGLGKFHQRDSRQMAKKFVLVSTQGK

SEQ ID NO: 128529 - protein, 174 aa, Triticum aestivum
  Clone ID: PAT_TA_22947.pep
HGQTLNSNKMSIVPYYFSTVFSARTSDISNKNTHSICTMGGHLGQNYLAPLRVLWSRLDLQGESLEQSPVQPGGSGLRHSLGDEIVQLLLLLLDLRCMVVSFIQGTGGSGMLLVLGAKPLPWMHRRAQHPLGRRAEGSRHRRRPCGSDRIGARLGLGLGFLAVRLPPPRRRIDN

SEQ ID NO: 128530 - protein, 198 aa, Triticum aestivum
  Clone ID: PAT_TA_22948.pep
HEENVMLACDFDLNFVHVSSGWEGSAPDAEVLHSAIESGFQVPRGKYYLVDGGYPNTPSFLAPYSGIPYHIEEQEQRSCPARDYKELFNLRHAQLHGHIKDAIGLLKMRFPVLKVATSYRLETQLKIPAAAVVLHNIIQRQEDAEGPSVNQTIPIDTRESGNAAHGHVVSALNNQCDTGGALRDDIAKRMWADYVINM

SEQ ID NO: 128531 - protein, 140 aa, Triticum aestivum
  unsure (1)..(140): unsure at all Xaa locations
  Clone ID: PAT_TA_22949.pep
RLFQNLTLRDKWYHSRCAAGPSPVDLLWDQISSVFTHDQKECQWQGGFENPINMAHNFEKNGSTMHKMTLLMVLQTISKQMTWSQGLYLMTCYTFRGFSEPQYWRKIIWVRYGAAFLVYQLFCNSSVPFNRYIYNXKHAG

SEQ ID NO: 128532 - protein, 62 aa, Triticum aestivum
  Clone ID: PAT_TA_22950.pep
HASEGLMFSWWLCGTYTGIFRQELQKRYHLKNSPRAGDEHVREPRRPRPCQPRKRIIQQGRA

SEQ ID NO: 128533 - protein, 255 aa, Triticum aestivum
  unsure (1)..(255): unsure at all Xaa locations
  Clone ID: PAT_TA_22951.pep
MAVAGHQSRYIELPMDXTPTGEDIRPGELNQPVHVPQLEGRRCGECGQVLPGTYEPPAAEAWSTGSFGWTDGPESGRTAVLCPCVLFGRNVEAVXPRSIPWTTRCVWHAIFLXKAGLTLAILTAIFHAVDPRSAFLVGEGRVFSCWLCGTYTGIXVKNSSKRYHVQKSTCXPCRAHCCLHWCANCQGHREKEGAGWTDHSAVAMTVVXQPPPVQEMSMSENRDAPAPANPENGSSNKAELEARNSDHDAVDVIPL

SEQ ID NO: 128534 - protein, 112 aa, Triticum aestivum
  unsure (1)..(112): unsure at all Xaa locations
  Clone ID: PAT_TA_22952.pep
AMTELEALNLSYNSLSGPLPTTDGLXKFPGALAGNPGICGGEGCTMDATMPEGKIPRNNRHGWLSDWHXENGWVSLGAFSISTMTSSFVSLATLLCSPKXKEFXFRPVRIEY

SEQ ID NO: 128535 - protein, 81 aa, Triticum aestivum
  Clone ID: PAT_TA_22953.pep
VVQHERFPWTPHVVLIPWLHDPIYLSVFAFPCAILLLLVYLFHLRICDSLSTLLTLANILHQIFVPLSSPSSTISLICVGV

SEQ ID NO: 128536 - protein, 176 aa, Triticum aestivum
  unsure (1)..(176): unsure at all Xaa locations
  Clone ID: PAT_TA_22954.pep
SCRIRHEVSQRQRSSRGVDLAGWARPGAGAPRRPPATSSSVSTCSSPERCPRLDLAEQGHEVLGHGMGITIVLVEMKNVLLFGCYHRCSFRLNIAMSVSLRNEYIRFKHHVMGHHKDFSALXSDVYGLGSCFCLSTSLEVHPPNSNGGVSVPSCYTDPQLSIFKXIGXPXILLKKK

SEQ ID NO: 128537 - protein, 331 aa, Triticum aestivum
  Clone ID: PAT_TA_22955.pep
RQVKKSENNKHGLLPVETPISNDSVMCKPIKQAGRKEEHAEGGPNGMAVVDGLALAVQILAKPAEYFNVADVIQESSDQWQQGDVQFELKAHGGTEDRSKLTEMVSLPDNTWEKHPATDSPRRYHVEAQRNVGIRYGYRERAGRGRFFHESPAPSRARWMPKYISHPQSDAQYDGVSEWLQDSHQFLLDNSQGLDSKPIQIADRDAGMDLQGGEGNVGMSFRDENPLIWNETEWEYQPLFPAPHRVGQQHGNTSDDGQRGRGRHSEYRQQHGDASGDGQRGRGRHSEYHYPEPVRSRDATPDIQRNPGGADNHQYPAYLRAGMHTERRYYI

SEQ ID NO: 128538 - protein, 360 aa, Triticum aestivum
  Clone ID: PAT_TA_22956.pep
MAVPRRSLDGRLFWVLGLVCAMYQIFFVRSAAGQTAQLSVNASPQNTQMIPENMFGIFFEEINHAGAGGLWAELVNNRGFEAGGPNTPSNIDPWLIIGDESNIIVATDRSSCFATNPIALRMEVLCESSGNDVCPPGGVGIYNPGFWGMNIEEAKVYKVSMYIRSSDSMDLTVSLTSSDGLQNLAAYTITAGWAGFKEWTKVEFDLQSSERNSNSRLQLTTRTSGIVWFDQVSLMPSDTYMGHGCRKDLASMLANLKPKFLKFPGGNYVMGNYLSNAFRWSETVGPWEERPGHFNDVWGYWTDDGLGFFEFLQLAEDLGACPVWVVNDGASRNEQVPSATIAAFVKDVVDGIDFARGDPG

SEQ ID NO: 128539 - protein, 427 aa, Triticum aestivum
  Clone ID: PAT_TA_22957.pep
MGANCCIAAKQRPEPSVASVEVSAYRTRHSPSWSFRWDNRTHIEDIMENAALFSNHSSGNIRPELKSGSIAPTEGHPNEDNLSDVFRGVKCQKPDKKMEASKRSKAGPQAVQSTASNSPPEAKSCKSSDMVNVASDIKTSKSLPSTPPLVSRTDPSSSRCHSLHVDSFSMRKARRSPGHQLCRQISDSKIPSLKSFSESSYAGGRPSSSMLSTYSNDPFGGGSQHGGSSDGWSTRTFSDLVASSQRERWSVDSELFGSISSKIARSNDSHATALSPDEGICKLCSKLLKERSTWSAHDLGVVAVLFCGHAYHANCLDSTTCESEKYDPPCPVCTHGEKGAAKLFGKLDSKIKSRKSKNVMSDTDIDRISKHKRSMREPRLGTSSSMKDSFRRPFLKRHFSIGSRPPRSVLGSEPTGKKGFWARHWRE

SEQ ID NO: 128540 - protein, 147 aa, Triticum aestivum
  unsure (1)..(147): unsure at all Xaa locations
  Clone ID: PAT_TA_22958.pep
SRXEGXXYPGXAQXLXGHLVVTVTPGLLHPTRSXVCGNLLAFGCXYDGETGRSRGYGFRLLLPPKEEMDQAIETLNGTKSKAGRSGSTWPWGRDTRELDRFFTLEKPASGFMQCFLTMQITEQQMSHRLLVEAHFENSDTWFLHRLI

SEQ ID NO: 128541 - protein, 121 aa, Triticum aestivum
  Clone ID: PAT_TA_22959.pep
LFLCSAQRGVLRLTGTCAFPCVGGLSASVETFGSPGATRAARRRRPAPAGRAAAPRRPGPPEPGPGARRREAQAARPYGEFVKGKSARKEWKARREGLVDLCCSGVGAAAFVGFLVMLTCR

SEQ ID NO: 128542 - protein, 115 aa, Triticum aestivum
  Clone ID: PAT_TA_22960.pep
GRVGDLVDVSAKSIGKGFQGGIKRHNFKRGLMTHGSKSHRALGSIGAGTTPGRVYKGKKMPGRMGGTKTKIRKLKIVRIDNDLKVVMIKGAIPGKQGNLLRITPAKIVGKNIPKS

SEQ ID NO: 128543 - protein, 264 aa, Triticum aestivum
  Clone ID: PAT_TA_22961.pep
MAMAAASIGGALGFLAPRRRGVSFAAAVGRRRPSLAVVRAASYEAGVGVMATKVGMMTYFDPENGKPVPVTVVGFREGGNVVTQVKTAATDGYDAVQVGYHGVREDKLTRPELGHLGKASAPPLRHLQEFRLVAVDAFDPGQALEFNELFKEGDLVDVSAKSIGKGFQGGIKRHNFKRGLMTHGSKSHRALGSIGAGTTPGRVYKGKKMPGRMGGTKTKIRKLKIVRIDNDLKVVMIKGAIPGKQGNLLRITPAKIVGKNIPKS

SEQ ID NO: 128544 - protein, 364 aa, Triticum aestivum
  unsure (1)..(364): unsure at all Xaa locations
  Clone ID: PAT_TA_22962.pep
MARAPLLAALVVAVVVASSLGHGASAAEPPGARGLSFDFYRRTCPRAESIVRGFVQDAVRKDIGLAAGLLRLHFHDCFVQGCDASVLLDGSATGPGEQQAPPNLTLRPSAFKAVNDIRDRLXRECRGAVVSCADSLALAARDSLGAARGPHYRVPLGHRDCRPPGPPHGALSDPPAPFPNVPSLPARRRRRGHPATRLRTIPGGHTIGRAHGASFEDPRFPPPDLTLNPPLPPRLKGTCPAKGTDRRTVLDVXRTTNVFGRQLLDQSSVSRGGCXSSPDQDLFTQSTSPGPSVRALCTEATRDFFXEQFGVSMGKMGQMRVRTSDLGEVRRNCSARNPGPAAADELQWPSFVQTIVDAAAERLG

SEQ ID NO: 128545 - protein, 263 aa, Triticum aestivum
  unsure (1)..(263): unsure at all Xaa locations
  Clone ID: PAT_TA_22963.pep
PTRPVVDEIHLRRFDGLLEREGAHRCVVASITVKAPVREVWNALTAYEKLPEIIPNLAISRIILRDNNKVRIVQEGCKGLLYMVLHARVVMDLREKREREISFEQVEGDFYSFKGKWRLEQLGDQHTLLKYMVETKMHKDTFLSESILEEVIYEDLPSNLCAIRDYVEKAEAERGNSIIHLDGPTNPDTVPMYYTEGRQPEQASVQFSSTSTRQRSKVPGLQKDIEVLKSELGSFIAKHGQNGFMPKRKHLRXHGRVDIEKAI

SEQ ID NO: 128546 - protein, 83 aa, Triticum aestivum
  Clone ID: PAT_TA_22964.pep
SCSGQANFGCVENSCAIKTSSCKGSGGGQVDCSPGIQLAFSGTDKHEAVLNSWYEVSKLKQYSLFGLFSNLKDSLAGQFSNFF

SEQ ID NO: 128547 - protein, 259 aa, Triticum aestivum
  unsure (1)..(259): unsure at all Xaa locations
  Clone ID: PAT_TA_22965.pep
AARRATQFTVPTAARTPATSSRAADVLVLALRLLPGAPPGRGDGNGGYAPRPPATASRGDEFTFGLALDGRGAFLAGRRVALPPREXLSTAPTAAPFSGSSRPPPSRFRPSTLSPPSPWPCHIXGLTVAFWGRKCPSRXRTVLVGNSSVTVTGFTLVFEFHKGTLQNLFWKADGCSSCSGNPNFGCVENSCAIKTSSCRGNGGGQVDCSPGIQLAFSGTDKHEAVLNSWYEVSKLKQYSLFGLFSNLKDSLAGQFSNFF

SEQ ID NO: 128548 - protein, 118 aa, Triticum aestivum
  Clone ID: PAT_TA_22966.pep
MAEEGKVIAIHSQEQWSTKIEEAGSSTNLVVIDFTATWCGPCRFISPILDEIAKKLPSVTFLKVDVDEMKSIAEEFSVEAMPTFVLMKEGKVVDKVVGAAKEELSGKIAKHSATACAK

SEQ ID NO: 128549 - protein, 215 aa, Triticum aestivum
  Clone ID: PAT_TA_22967.pep
MSCFSCFGPALEAEGGEPVPDAKDPRAKDGAVSDRAGSDKLRLQGGSDPKNNHLTIPRDGSSQNIAAQIFTFRELAAATKNFRQDCMLGEGGFGRVYKGRLESGQAVAVKQLDRNGLQGNREFLVEVLMLSLLHHTNLVNLIGYCADGDQRLLVYEFMPLGSLEDHLHDVPPEKEPLDWNTRMKIAAGAAKGLEHLHDKASPPVIYRDFKSSNIL

SEQ ID NO: 128550 - protein, 97 aa, Triticum aestivum
  unsure (1)..(97): unsure at all Xaa locations
  Clone ID: PAT_TA_22968.pep
SPPRSPTRSSPSSPASASPAPTSPPSSPSTRGSSAPAWRGPWRPESPSXGSSASRAPRSRASSRSPCAPSAAAPSGATSTSGSRSSAPTRSSSRPSR

SEQ ID NO: 128551 - protein, 161 aa, Triticum aestivum
  Clone ID: PAT_TA_22969.pep
MAAQKVVLRVPTMTDDKAKQKAIEAVADILTFDSILALPYPLLPPPTPLRAPEAPMAAQKVVLRVPTMTDDKVKQKAIEAVADIYGIDSIVADLKDNKMIIIGEMDTVAIAKKLKKVGKIDIVSVGPAKEEKKEEKKEEKKEEKKEEKKEEKKEEKKEEKK

SEQ ID NO: 128552 - protein, 283 aa, Triticum aestivum
  unsure (1)..(283): unsure at all Xaa locations
  Clone ID: PAT_TA_22970.pep
MATEVDQTFFAWSQGETTDLGVSEGVSVSQTLNHGSVSFGRFELESLSCEKWSVFSNDKRHEEFVKLNGLVAQKKAYFEEYYKKIRELAAPQLRRPQTALPPQDRGHGPVSSRTELLPHEELETPTGSGTIVYDYVEEAAHETTSDQGMQCYHDHEDEDFRNELPSSMLGSDATIAQLSDQPGRDHAPGGNPAAASVALAGLGHEGIGAAYENARVSRRNAEKDPRLRYASLIIPKSVKTVAGSTLDRTSVTKTPXSAKPSMTTNQKTKTNNARSSECGISRR

SEQ ID NO: 128553 - protein, 136 aa, Triticum aestivum
  unsure (1)..(136): unsure at all Xaa locations
  Clone ID: PAT_TA_22971.pep
RRHNTNVSNGXRLVVLSYGDAVELVMQGTSILGAESHPFHLHGFNFFVVGQGFGNFDPAKDPAKYNLVDPVERNTVGVPAAGWVAIRFRADNPGVWFMHCHLEVHVSWGLKMAWVVQDGSLPDQKLLPPPSDLPKC

SEQ ID NO: 128554 - protein, 416 aa, Triticum aestivum
  unsure (1)..(416): unsure at all Xaa locations
  Clone ID: PAT_TA_22972.pep
VPVVLPQRWLPDTDAIVTTALMFGGAPNIAHPFPINGPPAPLYNCSATDTFKLKVEPGKGALLRLMHGARIVDAVCHPANHPLTVVEVDALYVKPFTPGTLPVSPGHAAPVVRNTVPAPAAACVAIRARPDSPRGAGHAFPPGGARLLGPENGVGRAAPGPPQPVPCSLPRPIFPNVRKRLRLLQFPQHIRPLLLACLRACVHNCLCLCVARARGWCHSSAFLAVFSSTFMSSPRLINCCEVXLITSKRLRTFISGLLIXVYAANFPAMPLSPFNYTGTXPPNNTHVATGTKLLALSFNTSVELVMQDTSILGIESHPLHLHGFNFFVVGQGFGNYDAVNDPDKFNLVDPVERNTVGVPAGGWVAIRFLADNPGVWFMHCHLEVHTTWGLRMAWQVQDGSKPSQKLPPPPSDMPKC

SEQ ID NO: 128555 - protein, 118 aa, Triticum aestivum
  Clone ID: PAT_TA_22973.pep
RHEAQAPPGDGEVAAASTVLDAIATNKKSEDNVMAMESNIQSQQTEVTATDETDSDDIEGNYSDDGDDDGDGDDKMKYTIEFQKHKEGGSGSAPAAPATAATVVTSSAPTGSTFLAVQ

SEQ ID NO: 128556 - protein, 239 aa, Triticum aestivum
  Clone ID: PAT_TA_22974.pep
YFSHSGGARPGRSRKGVRRTNPRGRRTIGQNGAVPGHGRGRLAARGDQPWRRGEKKGKGKRPGQHLPPDASRPRRRSLYFTVSCKFPQRRARLPLAPPALVLGLMLAGNPLSPDASLGRPRSTTASCSPATGSRRRILGRPTLVLGIVFTGNPRSPPHPWATVLTGHGNPGGDGRSTPSSSSRRTSPSICSPVMPIPLPRPSVEENGDNSVVSQQTAVVAKIGAGSSKPRNGSSKNIGN

SEQ ID NO: 128557 - protein, 97 aa, Triticum aestivum
  unsure (1)..(97): unsure at all Xaa locations
  Clone ID: PAT_TA_22975.pep
MKIRRSRLFHWPSELGAGVIPLTTNRTYYFNHHVERYKRVLCFIXQXXETVPPLAPGACCCPPFPSDLTCFTLCEVVYLQLYKAISSSQLYLATPIT

SEQ ID NO: 128558 - protein, 566 aa, Triticum aestivum
  unsure (1)..(566): unsure at all Xaa locations
  Clone ID: PAT_TA_22976.pep
HEKEETSNSVSSNGLDPNLDDASDEEKFSCADPEFFNFDELRDVSQFRPNQIWAVYDSHGCMPRFYARITKVKMAPKFIVHFVWLELDPTNEAELAWSRAELPVACGHFKHGTSDTAKEANMFSQTISCAKSKTKNSYEIYPRKGEVWALHKGWDIGWSSDADSHTDFEYELVQVVTDFTTSTSIIVVPLVKIKGFVSLFMQSKEATPCVIPQDNTLRFSHCVPHHLMRGTEREGIPEGAIELDPAALPLNLEEAFASVVLESTVKGKGVHSMYAGSSRGINSGGGSEKVGEVPHATCMNTGLFTRATKEENKEHHTPSTVEGVDVNEESDGIVQDEFECPDSEFYEFTEIRSIQKFEPGQIWALYSDMDKFPNYYAIIKKVDLKNNKVQVKWXLDLCPRGEEEKRLTGKEDRPLACGIFTVSGENDAIKTYTGTQSFSHPVCSSPTGREKEFEIIPLPREIWAVDMRRGAGWTAHDFKNCDYELVEILTHTDSSIQVKLLRKVDGHRTVFRREPSVETICKDEYLKFSHQIPRFHLTNEKGGKLRGCLELDPFSVPERFLGIDSV

SEQ ID NO: 128559 - protein, 86 aa, Triticum aestivum
  Clone ID: PAT_TA_22977.pep
FVCCLQHVYKESVRVLCQAITSIDYTCLNHDRPKPCYGASTLNTSPELVAPPFSFDLPSCTHEQKRQTNYDLLPPFGITRPKTECI

SEQ ID NO: 128560 - protein, 138 aa, Triticum aestivum
  Clone ID: PAT_TA_22978.pep
ILSIALSHNLSSYVVCKPTNARQEKQQWRCSSVRWRSWWPSPSWRGQPSRTPPRPQPLPWARARDQQWPCRSTPAAGRLAASPTRPEPKPILTTWAAPLCRRSHRERPEPRSGPTTLNSRPGSAARPPPLPPQRTTAG

SEQ ID NO: 128561 - protein, 161 aa, Triticum aestivum
  Clone ID: PAT_TA_22979.pep
NHIVHLDVNRHIYFMEYNMVPKMTDFGISRCFDETWPGYYFKRDGISVSRLSLSKALKLFFSGFTFILWIHYLLISCRGYVLREVLFDGIVAFNWNKYTLSRDVDHYRGTDEDNVLLSDQPSPQPQEPSMLNGADAAVFPSAAAACFGPVIHNHRGRVHRR

SEQ ID NO: 128562 - protein, 194 aa, Triticum aestivum
  unsure (1)..(194): unsure at all Xaa locations
  Clone ID: PAT_TA_22980.pep
MAAQTGAVLLLVGLLALATMASSNTEGDILYSQRQVWKDPNNVLTSWDPTLVNPCTWFHVTCNLDNSVTRVXDLGNAGISGTLIPQLGQLKNLQYLELYGNNMSGPIPTTLGNLTRLVSLDXYDNHLTGVIPSSLGAVGTLRFLRLHGNKLAGXIPASLARLDEPCSTRSFQENMLSGTVPLGDPLACSCRGLD

SEQ ID NO: 128563 - protein, 237 aa, Triticum aestivum
  unsure (1)..(237): unsure at all Xaa locations
  Clone ID: PAT_TA_22981.pep
ARRGAASPGLTSPSSPPIHPAAPDNPPIDAASFTHTPYYCEENVYLLCKELIRAGLADPAGNDLYPIFISNEEKKIPLWYQKASRTNDGFVLWDYHVICIQSRRNKGDVLDLEWDLDSSLLFPCPFLQYVVDAIQPLAFGDSIYGRLFRVVHGPVFLRSFASDSCHMKDPLADATGWPPWGVPMGAPDGGPFSPKVYIALSTNDVGDLESVVNDVYHNEHGVVINETLLPMFFSXVA

SEQ ID NO: 128564 - protein, 198 aa, Triticum aestivum
  Clone ID: PAT_TA_22982.pep
MRPWRTRLLFWGGFNVHRQRKWDRTRRRRWTRFLLFGLFDHRWWRWRDHYAPPRREVPKPDVEPKPELPPVPKGEEPPKTELPPPPTGGIPPKPVSPPLPTGELPPKPEPELLPKTDEPSKPEQPPLPTGEIPPKPEVELPPKTEEPPKPELPPPPTGDLPPKPDVGLPLKPDLPPLPTSELPPTAQPPLPNPAEPKP

SEQ ID NO: 128565 - protein, 303 aa, Triticum aestivum
  unsure (1)..(303): unsure at all Xaa locations
  Clone ID: PAT_TA_22983.pep
ASGIASMSSSLAVLLLGVLLLSRGGVGNAARHLAEAEYPPVPPNVPAPLPKPDVPPPLPAPEVLPKPGLPPRPWPRPGSSLLPKPRVPPLPTPEEQPKPDLPPLPAPDVLPAPPLPAPDVLPKPELPTPDXAGPSRSCRRCPNRRSQPTVPEVPKPDVEPKAVXPPVPKGEQPPKSDLPPLPTGEIPPKPVRPPFPTGELPPKPEPELLPKTDDPPKPERPPLPADDVPPKPAVEPPPRPGLPPLPPASLPPKPAQPPLPAPAEAKPGPVSSSSESNQASASVLALCLVASATVLALHPGIHP

SEQ ID NO: 128566 - protein, 173 aa, Triticum aestivum
  Clone ID: PAT_TA_22984.pep
MCLHYQFTQMYAISFLTNSYWRIKLSRNQQNVRITLERLSIFVNMQPYESYFLKDVGLPLWPLDPASLSNLKKDYSFEMSLHYEFAQMYVISFLTDSYWRIKLSWNQQNVHITLQRPSFFVNMKPYESYFVKYARLPAARHHLSSVHLRSFAIHHDAAEPSPSISQVRRSFGG

SEQ ID NO: 128567 - protein, 187 aa, Triticum aestivum
  Clone ID: PAT_TA_22985.pep
LVPNSARGFKEVWNIVARYMNARGSRFDKKNKMLILPSATMAALPLAERAILVKPIPFFDHLQALFSDCLVDGASMTDLLTDADLNDDQMETQDPLNMMVVHADTGDPHEAGLDKVVLGGEDECHEVAVISAVGTVPCEVMSGTSAPSAEPSGSAESTIAALKPSLKQCKIVKQSKSKSKATGCCAT

SEQ ID NO: 128568 - protein, 164 aa, Triticum aestivum
  Clone ID: PAT_TA_22986.pep
MATMSLAAASPLTASTPRGLAVPAPRAPPFLVPRAFGAPATRFAGLAAAPRPSGRGDAAVVRMAKREQELEEIRAMETENLEQEVVDLKGELFLLRLKRSARQEFKSSEFGRMRKRVARLLTVRREREIEQGINKRNSRKLDRKWKLGIVVGPPPSLREKKEEE

SEQ ID NO: 128569 - protein, 157 aa, Triticum aestivum
  Clone ID: PAT_TA_22987.pep
AVKTLANPLSSPRLHYPPSTLSSRASLIAPARRRLHHLLLSLLASSLAQEGGPSGGGILSVDGEGGHERRRHLVRGWQTCFLPPPLLLSLASSATLTPLLFSRSSHGGGGRARQGGGGRERRSGRAGRASSSPSTSPRERDISLQLYSMNDSSFVCK

SEQ ID NO: 128570 - protein, 132 aa, Triticum aestivum
  Clone ID: PAT_TA_22988.pep
QARFRQGLLVSLQSQTADDHHRRTSPLAGMGFLAAAVGLTHINDGGDSRRRLGRIQATASKSRRQWRGREGSLDPIRCSLLLRVRSGLLLGSGCAPPLPIPDVSMAPWRRVEGGGLGEEGVPSSAGGGARVG

SEQ ID NO: 128571 - protein, 138 aa, Triticum aestivum
  unsure (1)..(138): unsure at all Xaa locations
  Clone ID: PAT_TA_22989.pep
RXXXPWIKXXXXXIQXXATKRVLRXXXIXXXMHIPXDXXRXXSINELSQHYTYLQECDQESRWACPRPAPARAGGGLALPLAVAPAHLCRPPQARRRSRVVLTRCMPRALSVYGLWDVLRRPLVGPSACSLGRVPLDT

SEQ ID NO: 128572 - protein, 133 aa, Triticum aestivum
  Clone ID: PAT_TA_22990.pep
ESCLPHALSNTFLEAGCGHRLILKCSTSRGWSFALVCVCIFFCRRWWCCQSSRSSGLIGFPLCFLEGGHQDSLHRHGKISFFLVCHLQVSATCSTSKIIHRTSGFSGLSRPGYHPHGATHAASGQTCRRPSRS

SEQ ID NO: 128573 - protein, 511 aa, Triticum aestivum
  unsure (1)..(511): unsure at all Xaa locations
  Clone ID: PAT_TA_22991.pep
MVDTLSEEKIIGYFKNKSILITGSTGFLGKILVEKLLSVQPDLNWIHDPVRAVLPPPAKHRVGPEVRGQELYGLLGEQHGACLQSLVCKKRVPVAGEAVTPSFGADSANVVERRLXQELEVIVNGAATTNFYERYEVALDVNVVGVKHMCNFAKMCPNLEVLLHVSTAYVAGEKHGLVLESPFRDGDDXLRDLGTHLEIDPELNLAKDLIKQLEADDELLPKSQRKAMKDLGVTRARHLGWPNTYVFTNSMGEMVLVQLKGPHDLPVVIVRPSIITRVQNDPLPGWIEGTRTIDTIMIGYAKQNLTYFLADLNLTMDVMPGDMVVNAMMAAIVAHSSSLLEKTQSHPEPHAPAVYHVSSSRRNPAPYNVLHEAGFRYFTEHPRVGPDGRTVRTHKMTFLSSMASFHLFMMLRYRLLLELLHLLSVLCCGLFGLDTLYHDQARKYRFVMHLVDLYGPFALFKGCFDDVNLNKLRLAMTSNHGSLFNFDPKTIDWDDYFYSVHIPGVLKHMLN

SEQ ID NO: 128574 - protein, 134 aa, Triticum aestivum
  Clone ID: PAT_TA_22992.pep
MKSFKKEFTLEERANESAAMIAKYPGRIPVIVERFSRSNLPEMEKRKYLVPCDMPVGQFIFILRSRLHLSPGTALFVFVRDTLPQTANLMGSVYDSYKDKQDGFLYMCYSSEENLGVTSAERNLGVRQPPNVHT

SEQ ID NO: 128575 - protein, 346 aa, Triticum aestivum
  unsure (1)..(346): unsure at all Xaa locations
  Clone ID: PAT_TA_22993.pep
MISSISLLDSSHQLIHKLYRKCWPSNSNAKLNMHSTAKSGGKSMRLKMALLKPHATDFKRNHQAHEEDNVFYKLVYRLPESLSCLYAXSEPVRKKKQQKQXTVPSNRFGVILEWEGVVGEDHDPDLEPRAWDVLSLEEAKSFPPDEMLKEVEEMRTDQADKNLXGRSSDAMEGATSAARLEALGLFLRATVYLLRPGGLDSLNALVPSDRPRAAAAARPKMYLEEGLQAVGLQGYFDVVVAAEDFRRGKPEGDMFEVAAEQLGLEPDACLVMGSSNLTTESCAYRXGMRCVAVASRHPAYELHAANHVVRWLDQLSVADLQRLANGEVLGRRGRRSDMDMEIVIEE

SEQ ID NO: 128576 - protein, 81 aa, Triticum aestivum
  Clone ID: PAT_TA_22994.pep
MSTRGSQDWRTESGGQGAGTGSLFFPRGNNTPCRTWTLRGSGHGNLSVCPAAVRLNQRPGHSTVKIAFALLSYTHSSHVFP

SEQ ID NO: 128577 - protein, 89 aa, Triticum aestivum
  unsure (1)..(89): unsure at all Xaa locations
  Clone ID: PAT_TA_22995.pep
HQGISPTAPPAPPGTPPPGPQGWLPQGPQAHERPASPPSPSDRNPXTAPTSTPPQHEFPSLYPLPRPREQPSPHARRDQGPRVFFFFFF

SEQ ID NO: 128578 - protein, 140 aa, Triticum aestivum
  unsure (1)..(140): unsure at all Xaa locations
  Clone ID: PAT_TA_22996.pep
RRHPSLIHGLRRENLRSSPLRCRRGGPAGNLPRHAAAAAAPPXARPRAASTQSPRRRTPDADDAQVPAGSPSTHGSKQQEHETGGPCPKPSIGRPSGTPRLVRHAEXLINKXTNGTNEARCPLVXKCHGMYSRTIHACSC

SEQ ID NO: 128579 - protein, 98 aa, Triticum aestivum
  unsure (1)..(98): unsure at all Xaa locations
  Clone ID: PAT_TA_22997.pep
XAIGGVYXXLGNGTGPPGRERADEGAGPVRGPAGGRVPTSAGSPPDDDGRARRVRLRRRRRRRRVFVVLRVRQARQGMTVPPCRSLFVGVSVXTGNWS

SEQ ID NO: 128580 - protein, 120 aa, Triticum aestivum
  Clone ID: PAT_TA_22998.pep
MQAVAGIRRGLTIDPAGEEEAPAQRFGRLVRESPVVIFARRGCYMAHVMKSLLAAVGAHATVIELEGPAEERAAVEAGGHAAVPALFVGGAPVGGLEGLMGLHLSGLLVPRLREVGALRA

SEQ ID NO: 128581 - protein, 200 aa, Triticum aestivum
  Clone ID: PAT_TA_22999.pep
KGPPFFFFFFFFFFFFFFFFGFFFFFFFFFFFFFFFFFFFFFKQVGKQRGIFFQTAKLLMMSVKLNTTGVVLSKVIITFRSNLFGHNTVDRVHLVVFPTRAVQLIYPVVSHSTPLIVLKLQSVMVSHMYMHGVEDEDEACTHSCKRVAGDGEEEAPAQRFLPGGRPASASFVASSGRADLPQRNSTQPRRVAPKQSNNHI

SEQ ID NO: 128582 - protein, 151 aa, Triticum aestivum
  unsure (1)..(151): unsure at all Xaa locations
  Clone ID: PAT_TA_23000.pep
NSRPRRRYPRLAKIVCSATLTQDPSKLSQLELHHPLLLNSGKKRYRIPTKLESYKLICTSNIKPLCLIVLLQELRGEKCXVFTKSVDDSHRLSTLLGIFPMTCPLSLSESSSLQRESTRRKTLAAFKEGKIDVLIGSDIRARGGRIESTRP

SEQ ID NO: 128583 - protein, 101 aa, Triticum aestivum
  Clone ID: PAT_TA_23001.pep
INLYYFIFFSRRSIMPSRLIVTLLIEGAFLSCYNYCSQKNNKHILLVCDTKRRRRKEMIITRIRGEGRGRLINQSACLDYLRRVFSSDVARLSWPAAQKAS

SEQ ID NO: 128584 - protein, 69 aa, Triticum aestivum
  Clone ID: PAT_TA_23002.pep
RICGDPHSVMRFAFIEFSGEEGSRAQLNLGGTMLGFYPPRVDPGEATFKSGNPKFLPATEHEIVMGIRT

SEQ ID NO: 128585 - protein, 306 aa, Triticum aestivum
  unsure (1)..(306): unsure at all Xaa locations
  Clone ID: PAT_TA_23003.pep
MPAGGARSSGCRGSWTAGLSEGPFWKVRAFEAPLETGDFDRARVEPRDFDTKRVHPKFLHTNATSHKWAFGAIAELLDKAVDEXICNGATFVKVDKSINLKDSRPMLVFQDDGGGMDPEGVRQXMSLGFSSEKSKTTITMYGSGFKTSTMRLVADGIVFTRTVRRSYASLRRTMQDDIVVPMLEFEVRDAHILPFPFPAHHNGPWGLGSLRDWAPCSSMVLLRPPFAAMDVLLPQFKDIESHGTKVVIYDLWMNDDGLLELDFDDDDEDILLRDQAKATAGTTKIQKEIIEQHISHRLRFSLRAYT

SEQ ID NO: 128586 - protein, 248 aa, Triticum aestivum
  unsure (1)..(248): unsure at all Xaa locations
  Clone ID: PAT_TA_23004.pep
AFTSLVYPALILGYMGQAAYLTKHHDFDSSYQIGYYISVPEAVRWPVLVLAIMASVVGSQAIISGTFSIINQSQALSCFPRVKVVHTSAKVHGQIYIPEINWMLMVLCIAVTVGFRDTKHMGNASGLAVITVMLVTTCLTSLVMMLCWHRPPALALAFFVFFGSIEALYFSASLTKFLDGAWVPLLLALILVAVMFVWHHTTVKKYEFDLHNKVTMEWLLALCDRLGMVRVPGIGLVYTDLTXGVPGN

SEQ ID NO: 128587 - protein, 179 aa, Triticum aestivum
  Clone ID: PAT_TA_23005.pep
FPLPDLAAAEYLLRDEVNQSLLCAVAQSSNSGAGETAVTVQEEFDHSFKRGALSNSEQSTDKDDGHAPDSSSRFQLPEVTICQQLVNGEASQTLVCTAAESGIGDVGDPPPTIQVDINSTCNGMALSLPTSEQSTGKDDPQAPGWTKRYTIVDVCFCFKDMTILSGLYIYIPPNFTEKY

SEQ ID NO: 128588 - protein, 181 aa, Triticum aestivum
  Clone ID: PAT_TA_23006.pep
MEEGGDASLEARPGVLLVGAPGVGKRTILSRLIGTEVPDTSDLSSGVLCQGWKIDTKYYSADISIWTTHLEEGFSLGSLPHLDQLAALIMVFDMNDEPSLLTLRNWVGNIDVQRFEVLLCIGNKADLLCLAIAHVEYRRRMCKRLASQVVIHPEYLDFGINENVGCGVFSQGEPQIEVSDS

SEQ ID NO: 128589 - protein, 82 aa, Triticum aestivum
  Clone ID: PAT_TA_23007.pep
PNTGFRRQGSFYVHVIAFKLSRLSTLQSSELFWQPLAHPSERSGGSLSRSVTPTSVNVPAQPSHCLLLYCSWRSVRLLKQGA

SEQ ID NO: 128590 - protein, 338 aa, Triticum aestivum
  unsure (1)..(338): unsure at all Xaa locations
  Clone ID: PAT_TA_23008.pep
RRRSFCINSLHRAAIGKVQGVNTEGEVSALKKAVCLKACRELHAVGALTDYLLPEFGFPCEEEPDIVVEKYQHEQPEYFPEEFVYNWLYFSRLGIYYCYKISVEGCLKTTYCPNDILLAVKCDLGPDFVSTSLKLFGEQDNASVAMKYVGNIHLNQEQVVMARRFQTSILSLLINKDHSEVINAVKYSHEMQVSTGIVYLLLPLVSGKVDWCSIKFFDLASXMMPSNKDIRHCHSCKQVDLLQTKDGPLCRCMLQNSIVCTPHNSKFYAVNGVLALDSDARLHLRDGRALTYINYFDTRHGLSLTHENQPLLAARNPVEVRNFLQKRHYKKKKKKTRD

SEQ ID NO: 128591 - protein, 227 aa, Triticum aestivum
  unsure (1)..(227): unsure at all Xaa locations
  Clone ID: PAT_TA_23009.pep
LAYVQKPNVRQRQNARYLTATVHEVRQANRVVEVDEMWRAREKQLELESXKLKGXSKERGDSRGEKRKGDSRNMSSSSKIEEGTAYNSSYSDQDDGLGDDEVEKFLHSRVKRGRGAVGSRMDEPGPYLKASSHCRDKEPSPDIRLEEKWEHRVQGPERPLFLRSKSLDDCWHGKTLDDKPSSSCEPHRKKENKKERRSEKKERKERKDKKKAKHRHRHHHHKSRRRE

SEQ ID NO: 128592 - protein, 132 aa, Triticum aestivum
  unsure (1)..(132): unsure at all Xaa locations
  Clone ID: PAT_TA_23010.pep
EDWLYEEGDDETEAVYTSKLEELKKLVDPIEYRCKDEEARAEATRELLKRIVDHRMAAKSLSAPERDAIDNECTKVELWLEXRAPQLQEPLPKDVDPVVWAHEIKKKEEELDMSCSKIVTSRARGHDNDDGC

SEQ ID NO: 128593 - protein, 192 aa, Triticum aestivum
  unsure (1)..(192): unsure at all Xaa locations
  Clone ID: PAT_TA_23011.pep
SCRIRHADCFSVLKNQEGRSRCRLKVLVLRRGVTSRCATAVGRRLPVSRREERQRGKGGQVVGFAPRAVPQGAGPGWVLAAAVFADHRVVSGCGAWRCAGRRRDAGAVAGSRQEPRMRAEALGPNTDSPRRVVRLVQGAEGQRFINPGARLSAARSGPVPXSLPPGPPCRDXNSPSPXLXAXXGILSVQKKK

SEQ ID NO: 128594 - protein, 371 aa, Triticum aestivum
  unsure (1)..(371): unsure at all Xaa locations
  Clone ID: PAT_TA_23012.pep
MLQIRLSKIGSSDSGAAASGAAAGASGGAPAKSAAAAAGGAPESVTVACPDHLVIADLAVAKSLGAVTNSAIAATRAIGRRSRRPLGERVHICSRCEFPIAIYGRLIPCEHAFCLACARSDSSCYLCDERIQKIQTVKMMEGIFICAAPMCXLKSFLKKAGFMSHVPAAHANLLQTNTEKEERNEPDAPNISRASGGDAQRQSQMPEASTARAPPRRGVSPTSSSHMQEREDRSRYHQSREREHTPLRPPMLSKPPSFHGRHYPPGDTRSENNTPQGFDRPYSWAHDGTPGXATPLRQEPDHGXKDKQQVMPNSPFMFSPNASSSSKTXMMPXMNMNQPLIPNASFSYPVQQDGIPQYLIAPFQATAKRIK

SEQ ID NO: 128595 - protein, 144 aa, Triticum aestivum
  unsure (1)..(144): unsure at all Xaa locations
  Clone ID: PAT_TA_23013.pep
ARVIXTXYWXELGTGPPPIGRHGKGAAPGAHAIFFFWEESHCCRYTSPQSNSACGDLAGVYTYIQRQCSGVSTGAVLSCPSKTRARYLMYVCNHMNTGTCISYVHVSQAVCWDVGVVRYLHLIKPVQAQTASDDMESAPRNRAT

SEQ ID NO: 128596 - protein, 118 aa, Triticum aestivum
  unsure (1)..(118): unsure at all Xaa locations
  Clone ID: PAT_TA_23014.pep
TQVLGPRWXGXQRPRSSILLRRQQVPPGFSAPESPSPPKHPIAESVPSPSTTCFTSSYAHPAGAAASCASRSAPIQAESQGLYQAPLDRPINKGKSKVRADPNPRITAHGRCPREQGS

SEQ ID NO: 128597 - protein, 76 aa, Triticum aestivum
  Clone ID: PAT_TA_23015.pep
RISICGHLEFKKGMIWTGSTSSRFEKHTFLFPESYDCGDTTHAAFSHVVSPNKWLCAVCSEQRFIDNLFRSKKKKK

SEQ ID NO: 128598 - protein, 158 aa, Triticum aestivum
  unsure (1)..(158): unsure at all Xaa locations
  Clone ID: PAT_TA_23016.pep
MSPYNFTYVLIGDSGVGKTCLLVQFLHKEFHPVLELNLDTERGDRMITIDNKXPAKLLIWDTPGRDAFRSLTTPLYDVAVGALLVYDITRRETFNPLPFWRLDATRDAPPPGTIMLIGNKCDLSHSRAVSYEEGEQFAKDHGLLFMEASAKTAQNVVX

SEQ ID NO: 128599 - protein, 183 aa, Triticum aestivum
  Clone ID: PAT_TA_23017.pep
HISSLSLSPSSPPPAAATARPAWWCATQHLHPLHFTTAPPSTSSSTAHIHHPPLHHPSTNTTIAISRALPDPGLVPRATLPSAAAPSSPLPAAALLPRLAAAPSYCSLNLFAAASPLLAPQPAASSSPNSATTPPFPLPSPAAISLSPTSLLLPLLNPLLSLLLFLFSLNACCCFLSTPLLLL

SEQ ID NO: 128600 - protein, 159 aa, Triticum aestivum
  Clone ID: PAT_TA_23018.pep
MSDRELPPPLRSIRITGDGRCLFRSVAYGACIRRGKQSPSDSVQKELADELRAKVADEFIKRRGDTEWFLEGNFESYVRKMRKPHAWGGEPELLMCSHVLGMPITVHMYTKGADNPRIIAEYGQEYGKDNPVRVLYDGYGHYDALQPSLVRTQPRLRGA

SEQ ID NO: 128601 - protein, 174 aa, Triticum aestivum
  unsure (1)..(174): unsure at all Xaa locations
  Clone ID: PAT_TA_23019.pep
MASTSTSLSLAFCPLFRPTPQPQSQPRHLDPKFPKPLRLSLAPALSCAAPLAAVPDGVAIDDIIEKDWSFLNASGSHLPRALAAGAXLSPASRVLAATPTASFVSALLSESPCELLXAAHESRFMLGGTXEDHDQVRCFHLKEGEGARQARSGSLAGGCARSRGWGAPAPDGSG

SEQ ID NO: 128602 - protein, 244 aa, Triticum aestivum
  unsure (1)..(244): unsure at all Xaa locations
  Clone ID: PAT_TA_23020.pep
MENHQLPYTTQPPATGASGGAPVPGVPGPPPVPHHHLLQQQQAQLQAFWAYQRQEAERASASDFKNHQLPLARIKKIMKADEDVRMISAEAPVLFAKACELFILEAHHSASWLHAEEXNKPRTQQRKDTTAASSRTDVVDFLVDIVPREEAKXEPGSAALGFATGGVGAAGGGPPAGLPYYYPPMGQPAAPMMPAWHVPAWEPAWQQGGADVDQGAGSFGEEGQGYTGGHGGSAGFPPGPPSSE

SEQ ID NO: 128603 - protein, 129 aa, Triticum aestivum
  Clone ID: PAT_TA_23021.pep
MSHQKREASSSNEDWASKRPKGAATSTEKDCQVETASSQETNGEKRDTSQKGSNLPLDPCISDEKSATILEVPSQQEMILTSVEADAAEDKGCRHTMEDAWVVLPDASMGSPGNLRSAHFAIYDGHGGR

SEQ ID NO: 128604 - protein, 202 aa, Triticum aestivum
  unsure (1)..(202): unsure at all Xaa locations
  Clone ID: PAT_TA_23022.pep
RCSRPEVEXFALEIGFWFNXGGFXIRSYSDMLKEISXGTTKXLEDIYDSGYGAAXLEDIMSTNICQVPSKNVSTASNKRMKVSSCTSTMDGPTTSGSHVPASGGALGSSSHDRGAAPTREISFGDQRIVPTGAEKPAARIDSETLALNRDSAMQRYKEKRKNRRYEKHIRYESRKLRADTRKRVKGRFVKSNEALSAGSNGG

SEQ ID NO: 128605 - protein, 444 aa, Triticum aestivum
  unsure (1)..(444): unsure at all Xaa locations
  Clone ID: PAT_TA_23023.pep
MDPQTFVRLSVGQLGLRLPGASARKACHCEIRLRGFPVQIAAVPLENSSEXNIDPHANAAVFSLDEPGLKALPTSRWFRAPEPPYLEIVVYVSRRDGGGHCVGLKRRLVGAVRVDVGPEWRDGKPVLLRHGWTGIGRAAELHVRVRVEADPRYVFRFEDEVALNPQVVQLHGGASQPIFSCKFIRDVRRASQPDHLGGQYWSSSGSGVEKETDMAGRRRERKGWKVAIHDLSGSAVAAAFMATPFVPATGCDTVARSNPGAWLIVRADTTGSSESWQPWGRLEAWRECAAPAGGKDAVCLRLHLLPERRDACVLVSETPLSCDKGGEFSIDMDRQSVLPEDAVASETPSASSYCAASMGESCAGGGFVMSCSVQGEAATSSRPPLVHLAARHVMCMEDAAMFLALAAAVDLSVKACRPFRSKTAPAKKKPAGGSSSPDPLELDT

SEQ ID NO: 128606 - protein, 185 aa, Triticum aestivum
  Clone ID: PAT_TA_23024.pep
GSVLEVDVARLACSSSSKDALAPFSRRIKNLSGEELVGAAASPRRRLVLHGFPGGAEAFELVARFCYGGGGGVTVTAANACAVRCAAQYMEMGDSPAATAASTAPSLVKVADKALEDMPHWPWHCVVDAVKQCQSLFPLAESTGVFDKVVGALLAQMAIPAPGDATPTSSSPESSAFRFSCDTKC

SEQ ID NO: 128607 - protein, 106 aa, Triticum aestivum
  Clone ID: PAT_TA_23025.pep
PPQMMEGEEEVPSVTASPAPSYCASPDVNTKADNFIERFRAGLKLEKINSYREKLQIQEGSTVTMAEEDGEFMIIGSLFEDDDDDMSLPETPATATAGAAAVAVGF

SEQ ID NO: 128608 - protein, 157 aa, Triticum aestivum
  Clone ID: PAT_TA_23026.pep
MGVGVGMAGAFSLPSSRPPRQLAAAAGPAAASPPRLLIHQHHGGPPYRREAPEKKAARTKARTTAAASGVVTAGVQRLLRGIKTFFAMYDGEEEDEEEDREIVIGYPTDVQHVGHIGWDGINKVGGMVGAFSLPSSLSLRQLEIAMDPGAATTTCIN

SEQ ID NO: 128609 - protein, 77 aa, Triticum aestivum
  unsure (1)..(77): unsure at all Xaa locations
  Clone ID: PAT_TA_23027.pep
MDPTSAAFDNAYYRMLQSGRGLLSSXEVLLTHPKTRRFVALYAARQDAFFRAFVSSMLRMSALNQPGEVRANCRRHN

SEQ ID NO: 128610 - protein, 123 aa, Triticum aestivum
  unsure (1)..(123): unsure at all Xaa locations
  Clone ID: PAT_TA_23028.pep
EPVNLSSPDSGSDQQNRRHTGRRRRAKQRTNRRRRKHELNHDSIPCSSYATEIEAEGGGEWSRVVVWGLTDCRGRSHILGTVSGAEFLQPGGSTSSRAAATAVELQLLFPLVGLISSLXXQXX

SEQ ID NO: 128611 - protein, 247 aa, Triticum aestivum
  Clone ID: PAT_TA_23029.pep
MAVDYGSREERWSLAGATALVTGGSKGIGHAMVEELAGFGARVHTCSRNAAELEECRRRWEEKNLQVTVSVCDVSIRGSREKLMETVRETFNGKLDILVNNAGQLLFKPTAECTAEEYSNLMTTNLESSFRSTQSPPSSLTPLYMAGGGAGLFLSSPAAACAAAEYSNLMTTNLGVELPSQANSHALFSYTLLLPEEAASSTCPLMGGQLALVRNLCYHKTSSKNSYIMERGSTYCATTTNTPPLNG

SEQ ID NO: 128612 - protein, 134 aa, Triticum aestivum
  unsure (1)..(134): unsure at all Xaa locations
  Clone ID: PAT_TA_23030.pep
QVDETLLPQVSPNITTSTDQKGRGITVSSLRMNHLPTYTVHLEPEVYTKHDLKSRNWEETACRRAGCIGLCYLLPVSSAAPSCKLPQAYSKAWKKPGPKSXQFPXXFPXCDIWRSNPFXANPVGAALMIMEEXW

SEQ ID NO: 128613 - protein, 143 aa, Triticum aestivum
  unsure (1)..(143): unsure at all Xaa locations
  Clone ID: PAT_TA_23031.pep
RFRFQFVDGFCRPSGGERFIVFTTNGFDMLDPALTRRGRMDMHIEMSYCRFGPFKVLAXKNYLKVEXHVLFDEIRQLLDDTDTSPADVAHNLMPKCKKRRRDDSDRSSSDVARMDADTSLAGLVETLKKARRESVTAPAAVKL

SEQ ID NO: 128614 - protein, 211 aa, Triticum aestivum
  Clone ID: PAT_TA_23032.pep
RHQITSYTVYHKLIPVEQNSYTLFQSLLARGGPIALVDPVCPLPSRDDPTPARGCRLLRRRAEVAPAPALPRLLPPLPLAGVLAVLSSRPRFLLPGTVALGSLPVRSLGHAVSRSCECGLRLWVACDAQERFHEADNEDDAGENGSDDEPGEMGDGQLCVICLRKRRRAAFVPCGHLVCCCNCAKRVELMDEPLCPVCRQDIQYMLRVYDS

SEQ ID NO: 128615 - protein, 85 aa, Triticum aestivum
  unsure (1)..(85): unsure at all Xaa locations
  Clone ID: PAT_TA_23033.pep
DGAAVGRPSRTNAKYIEDVWHVGVRVKGAVTKEELTRCVREVMDDGKGYRTNAXSWSHKAKKAMSAHGSSDTNITHFLSKLRLGK

SEQ ID NO: 128616 - protein, 157 aa, Triticum aestivum
  Clone ID: PAT_TA_23034.pep
QCSWIDAKPSGERPPPPLEARRRGPGQHHPGASVLNGPEVAVPNVMSAATVDPHRTVGRRRRQRLHRPGAGGRPVHAASHALPGVVVGWIRPPPRLDQRSGLQGRHDLRGGWVRCTAKGGLAREGRQGARGFRWSGAGRVSRGDRRGPRRLPAVEEG

SEQ ID NO: 128617 - protein, 196 aa, Triticum aestivum
  unsure (1)..(196): unsure at all Xaa locations
  Clone ID: PAT_TA_23035.pep
EKFGLHKDVYFDKGCGTSRPGLRASSSCQPEHLSPIKDDPWVTSVPFVPLVEFPNSASPSNSPYDPLADSMDPPKVESGNILKSSNISCSISSQHTAGNGVIDGDINKSLIYADKLARNMSAKGSNEFAGLVAPGKERSSLDGDTLVKAFERTKDGAIDEKTKDYFRIHWAEHVXXLLKPIWXXXXLSKDAHKLIV

SEQ ID NO: 128618 - protein, 267 aa, Triticum aestivum
  unsure (1)..(267): unsure at all Xaa locations
  Clone ID: PAT_TA_23036.pep
VWVLEITVAVAYESSISGPENSVLWNESMGVAEGRSTYLGAAPIVHCLENYKPHVVITSRVADAALFLAPMVYELGWNWNDFEKLAQGTLASHLLECGCQLTGGYFMHPGDAYRDFSFEQLRDLSLPYAEVSYKGEVCVGKAKGSGGLLSYSTCAEQLLYEVGDPANYITPDLVVDFSDVQFHQISQDKVHCKGAKPSDLRRPEKLLQLFPTPNGWKGWGEISYXGQECXGALSSRYLVRSWMNERYPGIEEEIIAYVMGYDSFEAN

SEQ ID NO: 128619 - protein, 244 aa, Triticum aestivum
  unsure (1)..(244): unsure at all Xaa locations
  Clone ID: PAT_TA_23037.pep
YQERADVILREHRPLYPNGPAGGGVEESVALYTNAPAXGGGGISTGRKNELTLQKLLIDRENIFWQANAKNSAIPGSQNLSTNANKKNRXREVVRRAFNNTWNTKLDEPAPPVSAPAPSGSEIALYRVAHSRAGDKGNDLNLSIIPHFPDDIGRLRTVITPEWVKGSLSPLLDRSXVPDDGVIERRNNLLERVLVEIYDVPGISSLNIVVRNILDGGVNCSRRVDRHGKTLSDIILCRKVILPP

SEQ ID NO: 128620 - protein, 101 aa, Triticum aestivum
  Clone ID: PAT_TA_23038.pep
VPPNLPSKPEGGGTIQKPKGHSELDHKEPLTEAPKVQVSPSLPSKPECRGTIQKPKGHSGLDYSKWDKVEDDSSEDDEDDEEDDLPRYKFNRAAARARTVK

SEQ ID NO: 128621 - protein, 213 aa, Triticum aestivum
  unsure (1)..(213): unsure at all Xaa locations
  Clone ID: PAT_TA_23039.pep
MFAIHRQHLCSLPQIIQLEDDPYNNRTPEPLDRRVAEPSGAWERCSHVRSAPVLPGDPCVRSRARLEVISQGFKKILFLRLHFSKVVNAHSVRQPEWEGSPNLIQKSGLISTLISTHFSTAVQKPMPRPADVNINSAMYPGVPPXPVQPPKLLKFVDXRRWCVGPQDLPGYWVVSGXAKLHLERGKISLRXVRYSLLTAMLPDDEDYALDDEF

SEQ ID NO: 128622 - protein, 236 aa, Triticum aestivum
  Clone ID: PAT_TA_23040.pep
MASANGNENAMVHESEMVVDDEMIHGNEMVHSGEMIHEHDMVQGNEMVHGDEMVEGRGMVHDDEMIHGNEMIQVSDMIHGHEMVQVNDMVNGDEMAHGHELVSAEVTPPTISRRRRKKSLVWEHFTIEPVPGERGCQRACCNLCKATFAYSSGTKIAGTSHLKRHITLGSCPMIKSQERKLAMSSIGGVTDNDGEGTVERPSKRRYRYTGFANATFDQDRSSSHSAKLIILHDYPL

SEQ ID NO: 128623 - protein, 302 aa, Triticum aestivum
  Clone ID: PAT_TA_23041.pep
TTLETCDDNYNESPSAEDWKKLEAACNYLKFLYDSAHSIMAAANPTSNLFFHEAWKLQLELSNAITHEDPVFSSIAKEMHERFDKYWKDCNLVLAIGVVMDPRFKMKLVEFSYSKIYGVEAAKYVKVVDDALHDLYKDYVAQPLPLTPAYGAPGEVNKNGPANANNNAVTPPSTGDGLLDFDMYLSEIAISQPSKSELEQYLEEALTPRIQDFEIVDWWKLNTLKFPTLAKMARDILAIPMSMVSSGCSIFAAATTGSRMLDDYRSSLRPEIVEALFCSKDWLQYAPPPPPEAQGSVAVKME

SEQ ID NO: 128624 - protein, 409 aa, Triticum aestivum
  Clone ID: PAT_TA_23042.pep
MLSDVDWDVFGSATKNNYLLEGQLFVVRCYAHILDAAAQDVIALIHGVIYSIRESIKFIKASPSREEKFAEIALQLEIPSTKTLCLDVTTQWNTTYLMLLAALDYRQAFITLETVDDNYNEAPSAEDWKKIEAACNYLRLLYDSAHSIMAAGNPTSNIFFHEAWKLQLELGNGSAHEDPIFSSIAKDMYERFDKYWKDCNLVLAVAVVMDPRFKMKLVEFSYSKIYGVEAAKYVKVVNDSVHDLFKDYVAQPLPLTPTYAEQGKTDNATANGNNTQATQPSAGDGLQDFDIYLSEIATTQPSKSELEQYLDESLTPRIQEFDILNWWKLNMQKYPTLSKMARDILAIPVSMVTGGTSIFSAGTGCHVLDDYRSSLRPEIVEALVCAKDWLLNSTAAPEAAPGSGLLKMD

SEQ ID NO: 128625 - protein, 320 aa, Triticum aestivum
  unsure (1)..(320): unsure at all Xaa locations
  Clone ID: PAT_TA_23043.pep
AIAGSSERENSARXGCPGCRLDEINKSKTGIPYLNFFYVWVVCLCAALPIQSLFPYLYFMIRDLEVAKQEQDIGFYAGFVGAAYFLGRTISAVPWGIFADKYGRKPCIVISILSVIVFNTLFGLSTTYWMAIVTRGLLXGLLCGILGPIKAYASEVCRKEHQALGISLVTSSRAIALVIGPAIGGFLAQPAKKYPNLFSEESIFGRFPYFLPCFVISVLAAGACLACIWLPETLHMYHDDKVEAIEEMEAQVADSTSEDRKAKQSGSCRMASTKNLLKNWQLMSAITLYCVFSLHDTAYLEIFSLWAVSSRKYRGLSFTS

SEQ ID NO: 128626 - protein, 256 aa, Triticum aestivum
  Clone ID: PAT_TA_23044.pep
MASNSSAAAAAAFFGMRDGDQQDQDEAADITAAAAAPPPPPAAPPGSGGTSRRGEPRAGRAAEGVRLATTATTAKSRGAPPLPPPGAHPEKKRHLPGNPDPDAEVIALSPQTLMATNRFVCEVCSKGFQREQNLQLHRRGHNLPWKLRQRSGKEVRKRVYVCPESSCVHHDPSRALGDLTGIKKHFCRKHGEKKWKCEKCSKKYAVQSDWKAHTKTCGSREYRCDCGTLFSRRDSFITHRAFCDALAEESAKARAP

SEQ ID NO: 128627 - protein, 144 aa, Triticum aestivum
  Clone ID: PAT_TA_23045.pep
YFLRQAGLAQKKRRSRRFLLVERNGDRGATERRHRLKPDVTSSVDAMGLTFPALSLGASRPRPDAALPPCLTLMPSCSVAVVGAEPRTEAPSFPGPGCHMQILLRQAPDLGAKDLVRRPPRKTDQQAGAAAGSSPPFFGNIKVT

SEQ ID NO: 128628 - protein, 175 aa, Triticum aestivum
  Clone ID: PAT_TA_23046.pep
SSQGGKQKVELKVSKIIVIGESDPTSFPIQKKRASREFLRTVAHLRPRTNTFGAVARVRNALAYATHKFFQDSGFIWVSSPIITASDCEGAGEQFYVTTLLSNSAEGGCLVNSIPSKDGRVDWSQDFFCKPAFLTVSGQLNGETYASALSDIYTFGPTFRAENSNTSRHLAEFWM

SEQ ID NO: 128629 - protein, 154 aa, Triticum aestivum
  Clone ID: PAT_TA_23047.pep
MACHLVAACVPRLAVVSSSASGDPVRRIRRRAPGSRSQKAPTAAPPQPSVAEVRRAIGAADDPSASGRDKQSGFMELLASTPIGQPESDAERRIREAAEWVVDNTEARAQEGQKSILVLCMKIFPLWLFLMLTALGVINLPFDIPGLDMDDLLM

SEQ ID NO: 128630 - protein, 176 aa, Triticum aestivum
  Clone ID: PAT_TA_23048.pep
STLIQGGEIQMASACFFARCVSVPAHLLAIPTPLAITTRRYTEEEGGTSFGNSPPFLPLILPSPAPESPRTRRGTRRRRTHRSKRTPRSRRLRDKMASACFFARCVSLPARLLAHPTPLAITSCRLRRLGAEGARPVCAAGRMLGSVRYGTGAALGPKEAGAEVAAVPPSVPVRVA

SEQ ID NO: 128631 - protein, 129 aa, Triticum aestivum
  unsure (1)..(129): unsure at all Xaa locations
  Clone ID: PAT_TA_23049.pep
CRDAVWRRYPSHSHWTGGHQVGSMSMDIATLRPRTEXXCGKQQLGEGGFGAVYKGTLPDGKEIAVKRLSKSSTQGVEELKNELVLVAKLKHKNLARLVGVCLEHQERLLFSQSGPPRCPVPILFGSRLP

SEQ ID NO: 128632 - protein, 210 aa, Triticum aestivum
  Clone ID: PAT_TA_23050.pep
MATSTMGAAAADLEARQLRILRRVEDLELAAQQHRLGALSLSDPEAEVEAGDTEERLSALLAARGVHDFAFRRVPADYYDRPLEERRDLLAADSVAQLCKSIVMVNTKAAADVVDCSNPKNSKYYVVIVQYMARLNAENIKNFLYTLNESQIPKKRFNMRPPPGAASLGLSRGVPSGVACIAVSSVIPLILVGASAVGDVLFRGLNSMTI

SEQ ID NO: 128633 - protein, 152 aa, Triticum aestivum
  Clone ID: PAT_TA_23051.pep
MDIHRSVCTAAVVLLLLSFSSFPKPSAGSAARAELVTWKCDNGTYYGENSTYQSNVRSLLASLAANASRSLFPVGFATAVVGASPDMVWGLGLCRGDTTNGTECASPAWTRAGVPSEGQGLGALIFASLLLATARDVPQTGSVWEQQSPKTA

SEQ ID NO: 128634 - protein, 155 aa, Triticum aestivum
  Clone ID: PAT_TA_23052.pep
SDLGSDLALSTPMPSSPSSSAASVDAPPPPEPPHAPYSPSRAGLSPPPPEVYSSYHPEDAHLPYAPPPPPARHELPDDIGFGFHPPPSLVRASEFLWEDRPSSSTASSSFLPDAATRYRQLLEQTGSRWLRSRPTGRFRSDLPPLSSEAQPLGAS

SEQ ID NO: 128635 - protein, 163 aa, Triticum aestivum
  unsure (1)..(163): unsure at all Xaa locations
  Clone ID: PAT_TA_23053.pep
MEEGKDKNNTTEKGLFSNMMHGYPPHGGYGYPPQGYPPPGVPYPPPGAYPPPPQYGYPQPGGYPPHGGXYPPVGYPGYGGRHGGHGYGGGHMGYGGAYGGGSNALGHNHAGHGYGHYGHGGHGYGHHAPGHYHGGHGWGHHGHGYHHHHHHGKHGYGKFKKCR

SEQ ID NO: 128636 - protein, 138 aa, Triticum aestivum
  unsure (1)..(138): unsure at all Xaa locations
  Clone ID: PAT_TA_23054.pep
MPRDQVDLSPGQLHKLADLIHRQEVQKLQELEFESYAEQEKXLSDAKDARDMVYHILDSTQEMIAQAEAPXDDATKQDIAKDVYGYCTMAIGTSLKFVRSYNTRXTYLDKLKXHSDDFIKQLKWLMQHPPRGAGAASC

SEQ ID NO: 128637 - protein, 98 aa, Triticum aestivum
  Clone ID: PAT_TA_23055.pep
KEIANKVGFVYQLNISPRTRGVDEEIFVVDLKKGAVSTGKYEGTPDAAFTFTDDDFLAIASGKLNPQMAFIRGKLKIKGSISAAQKFTPDIFPKPSKL

SEQ ID NO: 128638 - protein, 122 aa, Triticum aestivum
  Clone ID: PAT_TA_23056.pep
MEASKLKAARLLEQMSAHLATDAGKEIANKVGFVYQLNISPKKMGVDEEIFVVDLKKGAVSTGKYEGTPDAAFTFTDDDFLAIASGKLNPQMAFIRGKLKIKGSISAAQKFTPDIFPKPSKL

SEQ ID NO: 128639 - protein, 145 aa, Triticum aestivum
  Clone ID: PAT_TA_23057.pep
GPTSPPPPPLPSPVPQSCSPSAAIEASKLKAAGLLEQMSAHLATDAGKEIANKVGFVYQLNLSPKKMGVDEEMFVVDLKKGAVSTGKYEGTPDAAFTFTDDDFLAIASGKLNPQMAFIRGKLKIKGSISAAQKFTPDIFPKPSKL

SEQ ID NO: 128640 - protein, 81 aa, Triticum aestivum
  Clone ID: PAT_TA_23058.pep
QHTVKSNHDLGCSCFLIQTLAACGTACLSCFFLILLFVFPAFRCCRPPFFVQTNNGINLVCKYPDLMCLFIQLSLKKKKKK

SEQ ID NO: 128641 - protein, 278 aa, Triticum aestivum
  unsure (1)..(278): unsure at all Xaa locations
  Clone ID: PAT_TA_23059.pep
AAASTIMKDISQGXERIPVSVLNSISDEHPMPYIYMSRLKYPPNYQPAPPAGCACVGGCSDSKLCACVVKNGGEIPFNDKGCIIAAKPLVYECGPSCKCPPTCHNRVGQKGIKFRLQVFKTKSMGWGVKTLNYIPSGSFVCEYIGEVLDDEEAQKRMTDEYLFAIGHNYYDESLWEGLSRSIPSLQNXPGKDEETXFAVDASKMGNLLNFXNHSCTPTLCTKVLYVMMTRCPHTCPCLRRFHWPDYIHSTSLGWLMMGLGHKAWAACGPCCIRVLGRT

SEQ ID NO: 128642 - protein, 233 aa, Triticum aestivum
  Clone ID: PAT_TA_23060.pep
LPLPVGRRRRRRPGAPGAAGGGALHGAPGQDGPAVVARLPRRGEPRPEPHPHQVGHPRPPRRRPLRALPLRRTIIMWVTSGAHAHLNFGQSHYAGYFANRTTVVGGNTPVEQSQDDEMKKFMARPEEVLLQSLPSQMQAIKVMATLDILSSHSPDEEYMGEYAEPAWLAEPMVKAAFEKFSGRLKEVEGTIDQRNNNPENKNRCGAGIVPYELLKPFSEPGVTGRGIPNSISI

SEQ ID NO: 128643 - protein, 105 aa, Triticum aestivum
  Clone ID: PAT_TA_23061.pep
MCHSPSGSRATARSGRVEEFADAATEEGGESKLSALLYDVSQQVQDSLQSMLKMTGEIEQCSDEIEVEIEQAKEGVADKYRVLEEEKERFQKVALAALNILSGGI

SEQ ID NO: 128644 - protein, 134 aa, Triticum aestivum
  unsure (1)..(134): unsure at all Xaa locations
  Clone ID: PAT_TA_23062.pep
MAAAAPAGEPEVIRDKAAMRAWSRRQRAEGKTVVLVPTMGFLHEGHLSLVSAAAAVPGPVAVVVSIYVNPXAMFAPTEDLATYPSDLAGDLRKLASTGXVHAVFNPPDLYHRGAAVSGRPAEGSRRRRCLFPAW

SEQ ID NO: 128645 - protein, 92 aa, Triticum aestivum
  Clone ID: PAT_TA_23063.pep
TREDRTHLPTSSFPRPPPLEPARRPSPDPISLTVLPPPPFYPTFPAPAWKRSRLDSPPLPSPPPPPFYPTFPAPACQIRAPASATIFNYWVC

SEQ ID NO: 128646 - protein, 215 aa, Triticum aestivum
  unsure (1)..(215): unsure at all Xaa locations
  Clone ID: PAT_TA_23064.pep
GRQESTLQSRHCQVHRQELLRHLISYLSRGSLYKLLHRSGAREVLDERRRLNMAFDVAKGMNYLHRRSPPIVHRDLKSPNLLVDKKYTVKVCDFGLSRLKANTYLSSKSLAGTPEWMAPEVLRDEPSNEKSDVYSGPVLPWELMTLQQPWCNLNPAQVVAAVGFKGRRLEIPKDLNPQVAALIESCWANEPWXRPSFANIMXLWRPLINKARVPH

SEQ ID NO: 128647 - protein, 152 aa, Triticum aestivum
  unsure (1)..(152): unsure at all Xaa locations
  Clone ID: PAT_TA_23065.pep
RPDRHPAQKRASPPVPPARLWLGRGGEAAVPGGVHPRRPHRRRRPCPHGRSPLLAEVAEVAEVNTAPAGLQHILLVCPSSPLSILXCVDLIGLFDSMLPREEDANGGTFNGLTDHLPDXRRYGXRAQXLHASSAPRGYGDTRADKGPRPNRN

SEQ ID NO: 128648 - protein, 123 aa, Triticum aestivum
  unsure (1)..(123): unsure at all Xaa locations
  Clone ID: PAT_TA_23066.pep
MAPLLFKDMRSLSCSSPASTAICPSLERQPIFRPQKAGASPLFQVPAEPRAHRQDGRKGQQAXHHHRAGVANGELASPAGSTRFLLSGCAAVDEIQEVATAAAAPPAAAPGGGDSERKDPCCC

SEQ ID NO: 128649 - protein, 134 aa, Triticum aestivum
  Clone ID: PAT_TA_23067.pep
LAAPSGASKPRTLPAAGDLLLGGSRRTDQISGAAHCSGEGRAPHRSTPLTDRSLAGSFSTFCSVWTMAETPVSAVLRNVGTLAVQGDYFLMRGHPWKWTSLKDDRMRLQGYLKRRRRANEDLGNASAAILDEQD

SEQ ID NO: 128650 - protein, 122 aa, Triticum aestivum
  Clone ID: PAT_TA_23068.pep
ERATRPPPPACPAARPPRAAAGVRPSPGPEGWGLSWPWRRPARGPPPGAASCVLGFLPSSPCCCLMAGFLALLGGAAVVRTQTAAQVCPLQSVQAVDSSRSHSEAYAHADGISGCCVSFYNS

SEQ ID NO: 128651 - protein, 120 aa, Triticum aestivum
  Clone ID: PAT_TA_23069.pep
LKTTCVVLVTSTYDSTTIFPSQKDGLHAPSVLDSTAKLLEPLRENQLGYPSPVASFARLHSSLEGVFFTSFPFFPIGSSASLQMLSLVLEASRLTPLGAYHLHLSPLHPSLQFLLQFCAN

SEQ ID NO: 128652 - protein, 170 aa, Triticum aestivum
  Clone ID: PAT_TA_23070.pep
RQRIQSTKDGLSPSKRVDAALRRAPAFAAACDAAFDRCLADAQHAFSGVRPYQLADASEHLHSALRGSLPIVRRWVPSPPPRVRVDSALRVSGLEGAAELSRDQFGEFAAELFREAVLAGAAEAALVRAPAGAAGILGVAIVSRAGAGAAGKLVAVYTAGVAAAVYLSLG

SEQ ID NO: 128653 - protein, 144 aa, Triticum aestivum
  Clone ID: PAT_TA_23071.pep
QAATAARTDAAKDAILTAEESRKAAHHTTAQEDGLGQPKSGSAPEQNQGDASISERSDHASQKTEHDGQKVEIKGPVHSESLTNLPFEFYHYYHGSSYDLGTLIEVRRMWDSFIRPGGSRIPGHWVQPPPPANDVWASYLVQPK

SEQ ID NO: 128654 - protein, 767 aa, Triticum aestivum
  unsure (1)..(767): unsure at all Xaa locations
  Clone ID: PAT_TA_23072.pep
CLEKDMEMMEFGDQTEIGERGINLSGGQKQRIQLARAVYQDCDIYLLDDVFSAVDAHTGSEIFKECVRGALKGKSVVLVTHQVDFLHNADIIYVMKEGTIVQSGKYDELIQRGSDFAALVAAHNSSMELVEGAAPVSDEKGETPAISRQPSRKGSGRRPSSGEAHGVVAEKASARLIKEEERASGHVSLAVYKQYMTEAWGWWGVALVVAVSVAWQGSVLASDYWLAYETDAENAASFRPALFIEVYAIIAVASVVLVSGRSFLVAFIGLQTANSFFKQILNSILHAPMSFFDTTPSGRILSRASSDQTNVDLFLPFFVWLSVSMYITVISVLVVTCEVAWPSVIAIIPLLILNLWYRGYYLATSRELTRLESITKAPVIHHFSETVQGVMTIRCFRKGDGFFQENLNRVNSSLRMDFHNNGANEWLGFRLELAGSFVLCFTALLMVTLPKSFIQPEFVGLSLSYGLSLNSVLFWAVWMSCFIENKMVSVERIKQFVNIPCEAEWRIKDCLPVANWPTRGDIEVIDLKVRYRHNTPLVLKGITLSIHGGEKIGVVGRTGSGKSTLIQALFRIVEPSEGKIIIDGVDICTLGLHDLRSRFGIIPQEPVLFEGTIRSNIDPLEEYSDVEIWQALDRCQLKEAVTSKPEKLDASVVDNGENWSVGQRQLLCLGRVMLKHSKILFVYEATAWPSWTVDSQTDAVIQRIIREDFAECTIINRRSLEHWFKSTQTGRLXVADERNXDRPSTLIERPSLFGALVQEYANRSSDM

SEQ ID NO: 128655 - protein, 148 aa, Triticum aestivum
  Clone ID: PAT_TA_23073.pep
PKANAEAFENGWFHSRGRGVPPPGGHIEVKDRAKDIIISGGENISSLEVEKAVYLHPAVLEASVVARADEQWGESPCAFVTLKDGVDGSDEAAMAANVIKFCRERLPGYWVPKSVVFGPLPKTATGKIKKHELRAKAKELGPVRKSRM

SEQ ID NO: 128656 - protein, 199 aa, Triticum aestivum
  unsure (1)..(199): unsure at all Xaa locations
  Clone ID: PAT_TA_23074.pep
TTSGPGSSARNSHRLRDLCCDLQAQRNATSLLKCLLFALPALLVLAAGVLLVLRFAVTPQVKAYVEDARLISFVLVDTRPASAATTGPSFLYNVSISVALTVRNTNGAMGIKVHKAPRGHFLFHDRRLYNVTVADEGHKHKPLKRKCPSSRPAGETPVRGPPGGGRGVHVTECDGGGQSGDPLSGXVISXXQQXPAGXX

SEQ ID NO: 128657 - protein, 185 aa, Triticum aestivum
  Clone ID: PAT_TA_23075.pep
SEGTALFASSSQNKALTRLSTAHAKMKLRHEVLKIDVEAALQVLNFAIFHKELTDMEDREQRETEKQQTEQDAGAGGDNVDGPGGASGGNADVHGSSDDPMDVDGGSGNASNDQDVSSQRMEAFEAILGQHVLANHVDQMSIDEVEQTVNRDAAVAYTRGQVEFILERMQDANRIMIRDGVVRII

SEQ ID NO: 128658 - protein, 99 aa, Triticum aestivum
  Clone ID: PAT_TA_23076.pep
MLPMSHFLGAMSGTRHPFGPPNQDRPRHEPLVLSSVPCTTTREPPFLLGPSQESPLRSLQLTLPAEMIFQEEAMLKHRLSSTQETTSMPDLGAVRLTRV

SEQ ID NO: 128659 - protein, 109 aa, Triticum aestivum
  Clone ID: PAT_TA_23077.pep
LLLLVLDKLHLMKTITILAITTYYPIACLPKWSTPMSKCSRNSKSSVHFDREVTSIPPSDPSQPYRSQIYESEAQTERFPDCLASCLVIDFSRLNMHRNDQPSLQVFPA

SEQ ID NO: 128660 - protein, 199 aa, Triticum aestivum
  unsure (1)..(199): unsure at all Xaa locations
  Clone ID: PAT_TA_23078.pep
RPPGARVLPLREAPRPVAVAVAGGQAPRASHVQLREAPRPVALALAPGAGHVPLQQPPGPAARPPGAGHVPLQQPPRPLRRRRPPSPTPAKGPALRHVRLQASGWEQSLASPSPSPKAGRRGAARXGALQTPGKRMDKAGRKXYFNXVTGRPTTRTQLAAQRGDPSPIIPSRQITRARFTSGESPPVQAPGRRACPKVH

SEQ ID NO: 128661 - protein, 124 aa, Triticum aestivum
  Clone ID: PAT_TA_23079.pep
MEAKIAAPALLSLVALTLLAHTLLLHRPRATAWFLSAVDTFRFDGRRLVELVTRRNMILLCNAILLVILRDAGLLAAPARPRSSDAVTAGGAACSSSEARPQPKSRRISAAAGATGDDEGRLEA

SEQ ID NO: 128662 - protein, 127 aa, Triticum aestivum
  Clone ID: PAT_TA_23080.pep
MRNPPGRHLLRVATRAVRSSSGFGGASTSATSPGAASSGGRPRSRGGGGGGMLLRATSPPPPSAVAAAACRESRTLRRDGEDDWEEVVVAAVDGAAPGAGDAEVDSDYRVVFWSPPTGDEVRAVFSS

SEQ ID NO: 128663 - protein, 146 aa, Triticum aestivum
  Clone ID: PAT_TA_23081.pep
PNKCINEEDTCHHIQSTAEQHCYLKSSRDSYIFKRYTFYCIVHLRFLEIQAWGMSKFVSLHCCRTATWLQIGLGSLSCKGRWSSPMRPYRRSTEVQPHVATEAQWQGAAAGHHDLDLWALVLQRRKQRGRGAGEGGGERDPPNFFS

SEQ ID NO: 128664 - protein, 109 aa, Triticum aestivum
  Clone ID: PAT_TA_23082.pep
YLQRRCGMLVALAAAPVEDASAGCAGALCGVTTFFLASEFFSPGTSLVCITSSEGDAEPPGGATYVGRSSELVFSRGTPLVDMLFGLGEALILNWASAPPPGDPWSRAP

SEQ ID NO: 128665 - protein, 58 aa, Triticum aestivum
  Clone ID: PAT_TA_23083.pep
SRTYDTISSSILLYCCCTFIIASFISTVCYDNCILIPTVATISTVCYNCTLHTNSMLR

SEQ ID NO: 128666 - protein, 167 aa, Triticum aestivum
  unsure (1)..(167): unsure at all Xaa locations
  Clone ID: PAT_TA_23084.pep
HNFSXVGXFAVXXXVSLXXMFXDXXXXCXLPGRLXXXSKXGXXFEXFSXLXPPCSXXIXVXICSQSLSXXAXTLXFSAAVRXXTDXXRSDRRTGAXVFPITTTNXRRCPGMXXGSLXFRPRXVGSFXPVXAVPKPTDWVQQLDKXPIXLGFRIAWAIVVXQLXQAAL

SEQ ID NO: 128667 - protein, 309 aa, Triticum aestivum
  Clone ID: PAT_TA_23085.pep
ISSCRFSASGSNIASSSTDGTVRIWTYDSSTPSSKNATIYCGAEVSALSWECRSDRLLLIGTANGGIKAWNADAKRVVCDLSTSKDFPSVLDLKCSPVDPVFVSAAASRRHGSTIFDRTGFASLTVWHMKTWKPLTVLPLGEDPPAITSLCFNHNGKILAASATDGMIHMFDMSAGLQITGWPAHDSPVSSVLFGPAETSIFSLGSDGKIFEWSLHNQGQIIWSRDCSRFCNPESFNKRMHEVALDSNGKRLLATSGLVRAPIYQVQGHERGLRTLPHTAPITSVDWHPTRPIYVTGSEDHSVRVTSIL

SEQ ID NO: 128668 - protein, 161 aa, Triticum aestivum
  unsure (1)..(161): unsure at all Xaa locations
  Clone ID: PAT_TA_23086.pep
ADIAHLPPSAAAAAPDLPKQVRPAGQNKKGGGHARVHHHHASAADKEAAKKHHHLDINTLRGHTDCVTALDFSSDACNLATVCADGVVRVFRIDDASSKTFKILXINLPAGGNPNCHPLTQEGSSSVCCGNKSAVKXSLXMVSDVGXPPXGGNKQQGNFSP

SEQ ID NO: 128669 - protein, 118 aa, Triticum aestivum
  Clone ID: PAT_TA_23087.pep
DIDELCGKDDAWWGVRGYMRDNFNHSNEAISHKEHFQNSRLVESVLDLYWELPPVAGPSLTHQTRYDPARASDPIIEDGRRGLFQRIGLSRLDASVFNGYTQMAYVQISGTMLRREDD

SEQ ID NO: 128670 - protein, 176 aa, Triticum aestivum
  unsure (1)..(176): unsure at all Xaa locations
  Clone ID: PAT_TA_23088.pep
MHHHPAKPPRNGSRTVVLPGRAEIVHCDLKPTNVLLDDDMNAYLGDSGIASLNXHSKLKSTXKLGLKGEQLGYIAPKSNAQSGPGIHPWGLFYSFWDNTPWEMLNWAKRPTDPMFXNESTWVTXVEKDYPDXIIHIIDAPCXGECKAISKRTLGQESGYDPFFHPANPLPGHSPRE

SEQ ID NO: 128671 - protein, 131 aa, Triticum aestivum
  Clone ID: PAT_TA_23089.pep
TVGENNEKGKTELRASSAEPEASKSTFYPFFMSSVVAGLVPPFSDFFYVVLRHYRLQALHLHPNSVLFLSIFAFYCEAYVGVMPSVALLRHFFLLPNQTTVIPLGCANFIASRARPTRSPKAGKEGRGLQE

SEQ ID NO: 128672 - protein, 191 aa, Triticum aestivum
  unsure (1)..(191): unsure at all Xaa locations
  Clone ID: PAT_TA_23090.pep
VTHKWHYTPRWKNAGGALFPPLRPPHFVMASRLPRAVPFAPGRFSPALSPGLTDPPPFTATGARGGGSPGAQLGVPPRFSSVVCQPRLQRPGGSLGPRAAPPWAPRYXGPWGAASKRADPRGQTLGGXSQXPXATHFEQLEHIDWXNERXWALSITNLKESXMVSYNLXYGPIGPXPLTVQQPXXGSXWQL

SEQ ID NO: 128673 - protein, 135 aa, Triticum aestivum
  unsure (1)..(135): unsure at all Xaa locations
  Clone ID: PAT_TA_23091.pep
MNIIPCSIXKTLKGLYDISGVEVGQHFYWQIGGFQIHAQVLITSWVVITILLGSVVIAVRNPQTIPTDGQNFFEYVLEFIRDLSKTQIGEEYGPWVPFIGTMFLFIFVSNWSGALLPWKIIEXTHGELXTPXNDI

SEQ ID NO: 128674 - protein, 187 aa, Triticum aestivum
  unsure (1)..(187): unsure at all Xaa locations
  Clone ID: PAT_TA_23092.pep
MEELKPEFTKDGSVDLRGRPVVAARTGRWKACSFLXGYEAFERMAFYGVASNLGGVXLRRRCGKETVPSVRSVNNWXGTVWMTPIAXGAYVADAFLGRFRAFTVSSLIYXSGMVLITLAXSLKPLHPQCTAGGDCPPRPGAVPSCTRGSKHGIARVDNPNSTSADNHWTPEPSKALLNGGVTPGLSV

SEQ ID NO: 128675 - protein, 410 aa, Triticum aestivum
  Clone ID: PAT_TA_23093.pep
NLACSSLIKYNKVEAAIYLQGGAILPVGRPIKHVGEASLHDDLSLIVSLDENGKAERVLFEDAGDGYGFTQGNYLLTYYVAQVHSSVVSVKVLKTEGSWNRPNRNSKISILPGGRAMISSHRVDGQELHITMPARSRGPNARPTRAPTLTPPLRAIPPSPARDEPCTREGAELSKIPIDLKSGDWLLKVVPWIGGRIISMTHAPADSQWLHSRIEINGYEEYSGTEYRSAGCTEEYKVVRRYLEHSGEEESISLEGDIGGGLVLQRHISILKDNPKIVQINSSIQARSVGAGSGGFSRLVCLRVHPTFTLLHPTEVVVAFTAINGSKQEFFPESGEVTLEGDLRPNGEWMLVDKCAGVSLVNTFDPSQVSKCLVHWGTGDLNMELWSEERPVSKDTPLTICHQYELRQTC

SEQ ID NO: 128676 - protein, 115 aa, Triticum aestivum
  Clone ID: PAT_TA_23094.pep
MAPAATIRGAARALLVVAVLVLAARGASAALSCSTVYNTLMPCLGYVQSGGVVPRACCGGIKKLVSTARSTPDRRSICTCLKNVGSGAAGGPYVSRAAGLPGKCKVPLPFNCNSN

SEQ ID NO: 128677 - protein, 186 aa, Triticum aestivum
  Clone ID: PAT_TA_23095.pep
MAARLPLAACIVAFHLCLLLLQSSALRRLSEAAESSLVRHGVGMRPAYHFLPAKNWQNDPNGPMYHNGVYHMFYQYNPLGAMWQPGNLSWGHSVSRDLVNWDALDTALDPTAPFDYNGCWSGSATILPGGIPALLYTGRIDADKEVQVQNVAFPKNPADPLLREWVKPAYNPVIPLPADVPGDNFR

SEQ ID NO: 128678 - protein, 132 aa, Triticum aestivum
  unsure (1)..(132): unsure at all Xaa locations
  Clone ID: PAT_TA_23096.pep
MSRHPSTKWAQRLDKVYLTIELPDAKDVKLNLRPDGHFNFSAKAPADGMQYELDLELFDAVSVEESQAAVAPRAICYLVKKAEAKWWPRLLKKEGRPPVFLXKVDWDKWQDEDDEEAGFGDFGDMDFSKLDM

SEQ ID NO: 128679 - protein, 233 aa, Triticum aestivum
  Clone ID: PAT_TA_23097.pep
MAGEGDIKLLGMVVSPFVVRVRMALHMKGVSYEYIEQDLFNKSELLLRSNPVNKKVPVLIHGGKPICESLVIMQYADEVWSGKGASILPADPHERAVARFWAAYVDDKMFPAYIDIMKAATEEARAEKAKEALVGLANLEEAFAQCSKGKPFFAGDSVGYLDLAVGCNLFWLEAIRKMFGVTFFDVGKTPLLAAWAERFAGTEMAREVVPDADSAVVFAKKLQARFGSNTSAK

SEQ ID NO: 128680 - protein, 112 aa, Triticum aestivum
  unsure (1)..(112): unsure at all Xaa locations
  Clone ID: PAT_TA_23098.pep
GPPARPSPPPRPPRRRPRPSRRRRXHGPPRVERHDDAAPXARPCRRPGPTPRTRAPTPRSTRAPTAPSAARSGACGRRRRRCRPSPPPPPPAPSPRRPPGKGKGNGRSMYHS

SEQ ID NO: 128681 - protein, 164 aa, Triticum aestivum
  unsure (1)..(164): unsure at all Xaa locations
  Clone ID: PAT_TA_23099.pep
DGFRFETIPDGLPRSEHDATQDIWALCEATRRACPXXLRELVERLGRTEGVPPVTCVVADGAMGFAVHAAKDMGLPAYLFFTPSACGFLXYLNFDQLVKRRIPAIQEMKSCFTNGYLDTPVDWFTGMISNLRLPDFPTFIRTTDPDDVMLTININHCLLPAPAA

SEQ ID NO: 128682 - protein, 190 aa, Triticum aestivum
  unsure (1)..(190): unsure at all Xaa locations
  Clone ID: PAT_TA_23100.pep
PHAVFELVSNGTVNDILHGGNNAPLKLDVRLSIVAESAQGLAYLHSQARIKILHGDVKPANILLDENCMPKIAGFGISRLIIGDKEYTGRIIGDMNYMDPIYLQEGLLTLKSDVYSFGVVILEVISRKKAIYSDNHGLVRSFLEVHKEGKKATELFDKDIAVTTGDLEILNCLAEIAVECXNLDVDQRPR

SEQ ID NO: 128683 - protein, 241 aa, Triticum aestivum
  Clone ID: PAT_TA_23101.pep
MACWLGAAYRVAAAGVLRSERQRLSLPQALTAAKRAGVLEQQPEEAARSVRAGQGCVASPTTAKVIDNQTDSEVAMGYTMTQICDRFIEFFMHEKPETKDWRKILVFREEWRRYRPHFYKRCQVRIDVETDTSVKQKLIVLARKVKKIDDEIETHMELFTELRENPTDINAIVARRRKDFTGDFFRNLNFLVNAYNGLDERDAIARLGAKCLSAIHAYDCTLQQLDIDSAQSKFDDILNSS

SEQ ID NO: 128684 - protein, 301 aa, Triticum aestivum
  unsure (1)..(301): unsure at all Xaa locations
  Clone ID: PAT_TA_23102.pep
AWRRRRPRPRPGPPPPPPSSPLAPATTPPAAPAPSAPAYFAAPAALAAPTDPRSPVTVSVRAAWDGPLSSERLIMRGCDVKVTKKPKEHSEDTVGRAEYHNAPELRXLDVRLSTRVGDLSKGPKLSRCEVTLXFTRLYGVVSPERSELASCATKDAAAAVVKRKLRKIKEKETDVRHLKGTKEWQASGLSDVEDESEAEELEDDDDDELVEVIGAEDEETVLTKVVRTKVFEMAPLTVDEALEQLENVDHDFYAFRNEQTGEVNILYKRKEGGFGLIIPKQDGHVDKATVNAKEKEHPVAG

SEQ ID NO: 128685 - protein, 181 aa, Triticum aestivum
  unsure (1)..(181): unsure at all Xaa locations
  Clone ID: PAT_TA_23103.pep
MSVPVAYQGNTSAAVADWLNKGDNAWQLTASTLVGLMSVPGMVVLYGGVVKKKWAVNSAXFMALYPFPAVWVFAGSSGAYKSPSGHELSPSRGKARPALHKLLPRPRSLPGNANTAPTGAPYGMVDLFPMARLYSMRPPAATRRRPRPLALNSRGLRPPRSLPSGASLLGISRWGKHPLPL

SEQ ID NO: 128686 - protein, 131 aa, Triticum aestivum
  Clone ID: PAT_TA_23104.pep
FRCCSQDTRLVPRPVNLARTMNREFANVIVRGSTSSSKFYSLLRVNLKQHLFHRSAAAAEKARPSTIPSLEPLPEHKINFSTPPNTEGTTDLHFFSLLKGQAEGRVMFADPCANPVMYDIDMDARRCHAGD

SEQ ID NO: 128687 - protein, 162 aa, Triticum aestivum
  unsure (1)..(162): unsure at all Xaa locations
  Clone ID: PAT_TA_23105.pep
MSSSRSSSPAMQQMLALMALFLLLSGGVHAQVVPAVISFGDSTIDVGNNNYLPGAVFKANYAPYGXNFRRHRATGRFSDGKIVTDITAETLGFRXYAPPYLNPLASGKNSSTGANFGPPRPATPDDTAAFYDATPPRSTPLPRGGVKTGGVAGRKPTSPPYS

SEQ ID NO: 128688 - protein, 180 aa, Triticum aestivum
  Clone ID: PAT_TA_23106.pep
MSASIYSTKVDAESAMTTNGRDVELLPFVNDKHGGVIIEMTTPMDPQVFSASLKSLLSKWREQGIRGVWIKLPISLANLIQSAVEEGFWYHHAEETYLMLAYWLPNTPHTLPVNATHRVGVGAFVMNDKREVLVVQEKSGVLKGLGIWKFPTGVVEPGEDINIGVVREVKEETGVDAEFV

SEQ ID NO: 128689 - protein, 118 aa, Triticum aestivum
  unsure (1)..(118): unsure at all Xaa locations
  Clone ID: PAT_TA_23107.pep
ELXPIFGHFSISGLLAPVSEGPEKLSSYESGIEPMGGAWVQFRIRYYMFALVFVVFDVETVFLYPWAMSFDVLGVSVFIEALIFVLILVVGLVYAWRKGALEWSLTEYLAKKKKKKHA

SEQ ID NO: 128690 - protein, 135 aa, Triticum aestivum
  unsure (1)..(135): unsure at all Xaa locations
  Clone ID: PAT_TA_23108.pep
MSLASLSGKDPNPSSAPSALRSITRSVDRNGHKYPDGNAGYEMVPAKEQNPDPSRIATLSNRMVSFPSFISDSGTMTISTPGGAPPXPRRRGISSAAINGFRHTRGWGYLHKGSTTGTAAFGAGSTGKRKSITST

SEQ ID NO: 128691 - protein, 186 aa, Triticum aestivum
  Clone ID: PAT_TA_23109.pep
MELTAWPPLLLLITLSLSLAASLLFLLSSRHGVEKKATGKELPPGPPALVFLAKFLALRRSIFHLEPLLRELHARYGPVISIRLFRALVFVSDRRLAHRVLVQGGATFADRPRLFEPGLLFTSGSRNINAAPYGPYWRLVRRNLASEALHPACVSQFAPARRRMRDVLVRDLSARGAGGDPVEVRT

SEQ ID NO: 128692 - protein, 93 aa, Triticum aestivum
  Clone ID: PAT_TA_23110.pep
GYQGRLPVQQGGCNNKFRLSIQGKKFYIFFLNKQFNYVHCRVTLKRSLQQNIIENEVSHCEYLVDALVLLNVAPLFLLTIHVCKFYGIISQEM

SEQ ID NO: 128693 - protein, 98 aa, Triticum aestivum
  Clone ID: PAT_TA_23111.pep
ATPSPSTARHGRPPPSRSVLHARSILTLPRNVHPCSDPSPGTPLLKPSAAARCVVMQSAFTHRSAPRTRPPTIRLRPRLQSNFSAIGHDMNHHTALLN

SEQ ID NO: 128694 - protein, 122 aa, Triticum aestivum
  Clone ID: PAT_TA_23112.pep
SIFGAGAGVLVDLLAPAHTAAKEFRVDGSFPRRCCRVVAVASSVGGEVEEGEDQETVVAEVRRKVDEGAHVVLGRDVFVLWVRAGFDAAFAMGIVLVLGRITGDELDGVLGEELLLEATSPV

SEQ ID NO: 128695 - protein, 259 aa, Triticum aestivum
  Clone ID: PAT_TA_23113.pep
AWPPAPPGVELESGDRNSRRRRCPPRRRWRGNPRALGGRRRSGLPGPGGSSSSASSAPPPRPSPLATFVKVLIGSTLKLNKVQTTSSWRKTSKSSTGGTFSDDARRRYYQRMQQEFEDEQEKDQRIRHMQSVFNRETNKFRKSYESWKENGPPGGYNYIPRDDWYWQSDTPNSENKNRRTYTPAGPRGYPMSHHYTVLGLDRSRGTPYTDAEVKSAFRTKAMEVHPDQNQDNRETAEEEFKEVVKSYEAIKLERKNNAS

SEQ ID NO: 128696 - protein, 180 aa, Triticum aestivum
  Clone ID: PAT_TA_23114.pep
TIDHTHQETRQIKKTRGGRENQMAFSEAQEELVLRSWKAMKPDSESIALKFFLRIFEIAPAAKPMFPFLRDAGEDAPLESHPKLKAHAVTVFVMACESATQLRKTGDVKVREATLRRLGATHVRAGVADAHFEVVKTALLDTIEGAVPEMWTPEMKAAWEEAYDQLAAAIKEEMKLAAAA

SEQ ID NO: 128697 - protein, 137 aa, Triticum aestivum
  unsure (1)..(137): unsure at all Xaa locations
  Clone ID: PAT_TA_23115.pep
MAASLQAAATLMPAKIGGRASSARPSSHVARAFGVDAGARITCSLQSDIREXVASKCADAAKMAGSPSATLPPRLRRERGGGAPKRLTSTKFQSKTYMEVXKGTGTANNCPTIDGGSILPFKGGISNEEFAWSHSLR

SEQ ID NO: 128698 - protein, 170 aa, Triticum aestivum
  unsure (1)..(170): unsure at all Xaa locations
  Clone ID: PAT_TA_23116.pep
GAGARAGGGRGRDVHLIAEAATDGGAGWGGDCAVYRHGAGDLVVLPDGAALPVSLKVXEHDVLTVSPIKDLAAGFRFAPVGLVDMFNGGAAVEGLTYSLLADGEEAVGLVSMEVRGRGRFGAYSSVRPRSCTLGSXRPEFSYDASSGMVILELESMPLPKERVHRIAIEL

SEQ ID NO: 128699 - protein, 112 aa, Triticum aestivum
  Clone ID: PAT_TA_23117.pep
MGSASDGSREHLLDVGGLAAGGPKIRVRGLRRRAEASGEEILRGVDLDVPRGWVMGVIRPQRQRQSTLLRALNALGNPPRAPLTSNGPNLMDFSAPPQVSLPTPRIFGPWKP

SEQ ID NO: 128700 - protein, 145 aa, Triticum aestivum
  unsure (1)..(145): unsure at all Xaa locations
  Clone ID: PAT_TA_23118.pep
SPPPLHPPPRDPPKSPSHPTSIPRSPPPEPPLPFIPXSNNSRAPVLSPKQQPGARDPSSTPGPPSRSTGPSRSSPPPATXATAAPLAPRXPPPSLKTSSRAPLAESRHGTPSAVPPRPCTLPGPPARARPAAAPNLRCRRLFVRT

SEQ ID NO: 128701 - protein, 155 aa, Triticum aestivum
  Clone ID: PAT_TA_23119.pep
AGLPLTNRSQRSPSPKPRETSASVLGVTLDTLGRPRMQAISSSGDCLGPSLLPLLLPLPKLRVPPKGWKNGDMSTLSTDSMTRTATTPMCRFRYLLYVDVVEVWLLCLLTCLTVLVFSCALKHNSASTTIVPLGSVQRSLAIEEKSLDWMMYLSC

SEQ ID NO: 128702 - protein, 136 aa, Triticum aestivum
  unsure (1)..(136): unsure at all Xaa locations
  Clone ID: PAT_TA_23120.pep
HASDSPKASSRIASPVRASRCCGLTPERPPGFEASSDATPAAVTAPTPLSDVHSAPNITVIPPVPTLAALKIRTPSRLAGPLLSSSCADAGEDRELPPGLDSYYTPTTSPLARDFEVSKDWPETLTPLFAXGSPXR

SEQ ID NO: 128703 - protein, 254 aa, Triticum aestivum
  Clone ID: PAT_TA_23121.pep
AFHEDSMIRVAIRTLTLNVYHVGDESVNRFVSRVPLSDYFSDMVKHFQKQCIDLDKLVVRSARNAEPVLMASIEDAIVQIEDALYYFSDVMSSGIPDLGNFITENILQLLVFRIVLPSLQRQRTDLWISVSTSMYLLCCILHIFKDKDMASTVAAALFHQPDCPDRKQGTPNGCTSEHDHGISENQVSNTSAEDQSNADKPTSSSSAHLQCLPDHPSASDFCQGNTLREHLLSYITGGRWFPSFGFFVLICYII

SEQ ID NO: 128704 - protein, 169 aa, Triticum aestivum
  unsure (1)..(169): unsure at all Xaa locations
  Clone ID: PAT_TA_23122.pep
GLPPRGPLGINARPSARIIAKSFSRTKDMTWRPDLFSDSMAASGIETGTKLYISNLDYRVSNEDIKELFSEVGHLKRFAVHFDGYGRQNGTAEVVFTRRSDAIAALKRSDNVLLDGKSMNFEXKKMTWGLSMTPRINVAGASNGRATERVVMTPETVGGGGGFSTKAFE

SEQ ID NO: 128705 - protein, 85 aa, Triticum aestivum
  Clone ID: PAT_TA_23123.pep
MTKLRYSRFLLSGHIFLVLSVIWALATADVPAGQRPAGCPATCGDVDIPFPYGVGKQCALHDGFNLNCTTVEGVEMPLAGNIQGD

SEQ ID NO: 128706 - protein, 209 aa, Triticum aestivum
  Clone ID: PAT_TA_23124.pep
SSNVDLYRSAAASWRDTIQVGFGPTRADTERIPPVCRSEIVEWEAHTTAVARAVMALLSEGLGLSEAALEEASCLEGKVMVCHYYPVCPEPERTMGLVPHTDPGVLTVLAQDGVGGLQVKHTNEDGESYWVDAKPVPGALVINVGDLLQIMSNDKYTSVDHRVVMNSREEARVSIVFFNPGKRGDSVFYEPLRLVSSENPAKYRSFTMS

SEQ ID NO: 128707 - protein, 122 aa, Triticum aestivum
  unsure (1)..(122): unsure at all Xaa locations
  Clone ID: PAT_TA_23125.pep
FKSYREGLMSPQTETKAGVGFKAGVKDYKLTYYTPEYETKDTDILAAFRVSPQPGVPPEEAGAAVAAELLLGTWTTVWXTDGLTXLDRYKGRCYHIRPVAGEXSQWVXYVXYPLDLFEKVRY

SEQ ID NO: 128708 - protein, 196 aa, Triticum aestivum
  unsure (1)..(196): unsure at all Xaa locations
  Clone ID: PAT_TA_23126.pep
GIRHEDGSLIVSACGFASPSRXGVLVHSRQWTPPSAPVSVVAYVNLESSDRKIVGNFATFESAVLGVANTSQLQALRRSRPRPAKPSIPGPPPPTGSLMIEHDKALGLWAMKLPSADTVVVKRTLAKVTEHPEGLPCADETSDFEKHRKEFWSSIKPAHFGVKIGSRSILGLVWCLSTAIFVGILAGFSFGRSLLL

SEQ ID NO: 128709 - protein, 210 aa, Triticum aestivum
  Clone ID: PAT_TA_23127.pep
SDRPLYVLSSFICRYYSTWGHVATLAEEIKKGADSVPGVEVTIWRVPETLPEGVLAKMHAAPGRQDHPVITAGQLAEADGVLFGTPTRFGMMAAQMKAFFDSTGGLWKEQSLAGKPAGVFFATATQGGGQESTALTAVTQLAHHGMLFVPVGGTHGAGMLIMDEVKGGSAYGAGTFAGADGSRVPTGAELALAEHQGRYFAGIAKKLKSV

SEQ ID NO: 128710 - protein, 210 aa, Triticum aestivum
  unsure (1)..(210): unsure at all Xaa locations
  Clone ID: PAT_TA_23128.pep
LDQSFFFLAASIFRYYSTWGHVATLAEEMKKGAESVPGVEVTVWRVPGTLPEDVLGKMHAAPGREDHPVITAKQLAEADGILFGFPTRFGMMAAQMKAFFDSTGGLWQEHSLAGKPAGIFLATGTQGGGQETTALTAITQLTHHGMLFVPVGYTHGAGMFAIDEVKGGSPYGSGTFAGKDGXRTPSDAELALAXHQGKYFAGIAKKLNAV

SEQ ID NO: 128711 - protein, 206 aa, Triticum aestivum
  unsure (1)..(206): unsure at all Xaa locations
  Clone ID: PAT_TA_23129.pep
MATKIYIVYYSTWGHVATLAEEMKKGADSVPGVEVTVWRVPETLPEEVLGKMHGGPGXREDHPVITASQLAEADGILFGFPTRFGMMAAQMKAFFDSTGGLWQAQSLPGNPAGVFLATGTQGGGQEATALPRLTQPTHHGXLFVPVGYTHGSGMVAMKDVKGWQPVGXAGTCAGADGSRLRSQGELRRAAHQGRASAGVPNRLRAV

SEQ ID NO: 128712 - protein, 111 aa, Triticum aestivum
  unsure (1)..(111): unsure at all Xaa locations
  Clone ID: PAT_TA_23130.pep
MARWTVLLVVLLAVTVAVADDSGEKCTGECGNPCGIPCTYSSPPPPEPALPPPVYYPPPAPVLLAAXLPRPXYPXPTXTVRLPAAPQRWLHARAXQPTPXKPXXYTRRLGG

SEQ ID NO: 128713 - protein, 287 aa, Triticum aestivum
  unsure (1)..(287): unsure at all Xaa locations
  Clone ID: PAT_TA_23131.pep
KRLGSRRLQAATQTDGSILLFRPMENAMRMQTGAERMCMPAPPVEQFVDAVKQTVLANKRWVPPTGKGSLYIRPLLVGSGAGPRPAPAPAGTALLFASPVRYSFTXSCCPNSLVISXSRPRSTPGGTGGVKTIGNYASVLMAQKIAKEKGYSDVLYLDAVEKKYLEEVSSCNIFVVKGNVISTPAIKGTILPGITRKSIIDVALTKGFQVEERLVSVDELLDADEVFCTGTAVVVSPVGSITYQGKRIEYAGKQGVXGAVSRQLYTSLTSLQMGQVEDPMGWTVQLN

SEQ ID NO: 128714 - protein, 163 aa, Triticum aestivum
  unsure (1)..(163): unsure at all Xaa locations
  Clone ID: PAT_TA_23132.pep
FGWCHEGGELLLPYDYFPMGKPGTSYCSPMPRRPRTRHRRSHGKRRYMIICGVASALHYLHHGKQQRGSSTGMSKPSNVMLDEAYNARLXGDFGLAPCHPSSDGSDTPLRRKPGPGPRPGALEASSPVVPPSSQARRLRRLCRPGGLLGHPAGLPCRAQECHG

SEQ ID NO: 128715 - protein, 171 aa, Triticum aestivum
  unsure (1)..(171): unsure at all Xaa locations
  Clone ID: PAT_TA_23133.pep
MAPKAEKKPAAKKPAAEVAEQAEKAPVPAGKKPKAEKRLPAXKSAAGKEGGDKKGRKKDKKSVXETYKIYIFKVLKQGAXPDIXISSKGMSIMNPXIXNDIFXELPGEAXKLARYNKNPHQLPGDPNSLRFSSPGESPTPLSKGQGVPLTTRSSGQGPPVSLTLFPSSASL

SEQ ID NO: 128716 - protein, 113 aa, Triticum aestivum
  unsure (1)..(113): unsure at all Xaa locations
  Clone ID: PAT_TA_23134.pep
MPSVKASPASRAAKSTHLSGSGEGSAEHSKQNWSNKVINSAGTKMSDSMQRKCKNVISKLWRRIGKEGHQKIPNIASWWRKXENSSSKGXAGSTLDLQEIQLRVDGLEYSGVT

SEQ ID NO: 128717 - protein, 244 aa, Triticum aestivum
  unsure (1)..(244): unsure at all Xaa locations
  Clone ID: PAT_TA_23135.pep
MAAASSSSCGGAGCGTHCSSSTSSSVEDAPEGILGRLSISGAAASCGKCGGGAVVVVAGGVGLCGECLRAQLFGKFKLAVTSNAMVRPTDSVLVAFSGGPASRVALQFIHEMRSKAIESWDASNSQALPVFNVGAAFVDESVLLSKPECEVEQATEDIKSLVSSLLPGDKAMHIASLDYVFSSESKDGESRLRELVGMIADDTGREDLLQCLRMLSLQKIALENGYTKIMLGSCASXIACHVLS

SEQ ID NO: 128718 - protein, 103 aa, Triticum aestivum
  Clone ID: PAT_TA_23136.pep
NISQAEPPFLFLPRLASSARSAMPSWRALARRHRHVIPSPSRELGTSTGSRSCDHEFREQERQLTKQARHLPAMIPASPDSVLLRHLGPAGLRGRHLGAPELG

SEQ ID NO: 128719 - protein, 155 aa, Triticum aestivum
  Clone ID: PAT_TA_23137.pep
LVPSCRIRHEIFQAVPVSDWRFGSIEAKYRRVLHWAPTATTLLLPLILNARSAQASRRQEDVPEAAQLPSTNSAAPTRSAAFLDRRQPPHPPHRSRTCRKIILPLLIRVGISYHPSDPKIDESGNLSPASYQNPFRPNPLRAPRHPLPWHRGHKH

SEQ ID NO: 128720 - protein, 124 aa, Triticum aestivum
  Clone ID: PAT_TA_23138.pep
GIRSPKCKPSCFHCVLPFSLTQRSSPNPSTTTSGERGKQGHEGDRRGGTARRSPTSAAQGGGGCGLRNSAQLDDERRAGRRRLRPQERRAARLRAPRGPRDAVAARSGVQFADERRGEATALGK

SEQ ID NO: 128721 - protein, 160 aa, Triticum aestivum
  unsure (1)..(160): unsure at all Xaa locations
  Clone ID: PAT_TA_23139.pep
MPKRTTHTYSSEDALPEGPESDLFVYYCKHCASHVLITDTLLQKMPKRKTDRAHVLDKAKHLARLNVKDAGKILLKRGEGKLEKQFRMTCVGCDLFVCYRSEEDLELAPYIXMLVDGALSPVAAETNPHDAPVPPCITQLQGGLVQVAIEVEDRAHRSIT

SEQ ID NO: 128722 - protein, 238 aa, Triticum aestivum
  unsure (1)..(238): unsure at all Xaa locations
  Clone ID: PAT_TA_23140.pep
MAKRPGGGPKSEGASQESGANAAPELSTAEKQELQNKMAKLMAMLDEVDRKYKHYYHQMQNVVASFDMVAGPGSAKPYTXAVALQTISRHFRCLKDAINDQINVIRKKLGEEENSSSKEGKLTRLRYIDPQPRQQRAFQQYGMIPQNAWRPQRGLPENSVTVLGARPSEASPPPSPKXIPEKLMLARQTGLTRSQISNWVINARVGEWRPRPGDSKKDGRGGREPETTASGAEEGRFR

SEQ ID NO: 128723 - protein, 219 aa, Triticum aestivum
  Clone ID: PAT_TA_23141.pep
MAPVKVFGPAMSTNVARVLVCLEEVGAEYEVVDIDFKAMEHKSPEHLVRNPFGQIPAFQDGDLLLFESRAIAKYVLRKYKTNGVDLLREGDLKEAAMVDVWTEVDAHTYNPAISPIVYECLINPLMRGLPTNQTVVDESLEKLKKVLEVYEARLSRHEYLAGDFVSFADLNHFPYTFYFMATPHAALFDSYPHVKAWWERLMARPAVKKLAAQMVPKKP

SEQ ID NO: 128724 - protein, 214 aa, Triticum aestivum
  Clone ID: PAT_TA_23142.pep
MAAEEPKKVEVEAAPEPEAAQPAVPAAEPEAPAKDVTEEKAVIPAPEPAAEEEKPPADDSKALVVVEKVADEPVAEKPTDEKAAHGGSNDRDLALARVESEKRNSLIKAWEENEKTKAENKATKKVSAILSWENTKKANIEAQLKKIEEQLEKKKAEYAEKMKNKAAMIHKEAEEKRAMVEAKKGEELLKAEEMAAKYRATGHSPKKVMGCFGA

SEQ ID NO: 128725 - protein, 219 aa, Triticum aestivum
  Clone ID: PAT_TA_23143.pep
MAPVKVFGPAMSTNVARVLVCLEEVGAEYEVVDIDFKAMEHKSPEHLVRNPFGQIPAFQDGDLLLFESRAIARYVLRKYKKNEVDLLREGDLKEAAMVDVWTEVDAHTYNPAISPIVYECLINPLMRGLPTNQTVVDESLEKLKKVLEVYEARLSKHDYLAGDFVSFADLNHFPYTFYFMATPHAALFDSYPHVKAWWERIMARPAVKKLAAQMVPKKP

SEQ ID NO: 128726 - protein, 80 aa, Triticum aestivum
  unsure (1)..(80): unsure at all Xaa locations
  Clone ID: PAT_TA_23144.pep
FATTKLAKLNQGSHQFHAPCFSPETKGVGFDLNTYQQTDTGPFSELIEHLQFLSLFLFRPTILCPVSVCLISWTLRXELA

SEQ ID NO: 128727 - protein, 172 aa, Triticum aestivum
  Clone ID: PAT_TA_23145.pep
QPIPGLATPLLPPSPSPPPAAAAARPAWRCAFQPSTAPSLPAAASPPPTPRRRSHSTTTSSASLQPAQPCLALLLLPLRPPAATTPSLHRPCCCPESPSPACCAFSLPPLPAAAISPASSLPSLFLGNPAAPRCRAALPPSLALSLSLSPSLPLSLLRFPIPHLILYAIKIF

SEQ ID NO: 128728 - protein, 161 aa, Triticum aestivum
  Clone ID: PAT_TA_23146.pep
MPNNFSSNETSLITLNQKRQLSDPLSYAEVNADAGQTSPTNIVAMGLDEADYEDNVSEDGSLVRETEYTIGRRNIMNSNSDMIDDTKMHRGPSRTARSTLTKSAQPAISRSKPRDAVLKTPSHTRTLSNQLGGRLFRPRQPKDGRSRARSSCFGMYLYGDW

SEQ ID NO: 128729 - protein, 194 aa, Triticum aestivum
  Clone ID: PAT_TA_23147.pep
GRGVDMQLGLAIDNPKATLAVKRRLACEMVKYWQQIKDSIPELPLSDGWAKKHTLFVKWKYAEAKAAAYYFHGLILDEGNTEKSQEMATSSLQASEEFLKESKRASEVFHSTPPTSRISTPFGTTKHLLDMIPQETLSKLQNNQDLNTQERTSNTGVSRIITPPPPLPDFPLALNPEEYELPQLDPLLKKEANH

SEQ ID NO: 128730 - protein, 176 aa, Triticum aestivum
  Clone ID: PAT_TA_23148.pep
FIGSSSPRSHNLCYSSPSGAIFPAPSLTAPRVLYCFCVDEATAMAATSCTLVSALVVGRRRGPSCQRAAAGGVVRCSLDRKVSDMAINAPKGLFPPEPEHYRGPKLKVAIIGAGLAGMSTASRALGTKGHEVDLYDSRTFIGRQGLVLLVRQAREPTSALVLLVVQHPSPPIVGWG

SEQ ID NO: 128731 - protein, 158 aa, Triticum aestivum
  unsure (1)..(158): unsure at all Xaa locations
  Clone ID: PAT_TA_23149.pep
TKYRVGGWVSLDEEMRLDVQRIWKRNMGRDDRCISDHGKEARFPFLDESVIKXLLEIPLWDIAKLDEPVGKGDKXILREVAKLLGLQEAAFLPKRAIQXFGSRIARESNRKNFGSNRAANLASGRQRGRSTSVTTDGAKQTYLVLPRCCIATCSQRHK

SEQ ID NO: 128732 - protein, 193 aa, Triticum aestivum
  Clone ID: PAT_TA_23150.pep
VENMCYFDADEKRYYPFGKRSGTQVVQQFGIPNLFDLPIRPTLSSSGDTGIPEVVADPQGDVSKIFQNLGVCVVQQCAKIRQQVSTAVSYDRSIRAIRVKVPDSDEEFFLHPATVRRNDRSAQSVDEWTGEQKVQYGDVPEDIEPEEIRPMGNYAVSITWPDGFSQIAPYDQLDMLERLVDVPLPATAAVASS

SEQ ID NO: 128733 - protein, 175 aa, Triticum aestivum
  unsure (1)..(175): unsure at all Xaa locations
  Clone ID: PAT_TA_23151.pep
QGQEARPRIRVQPVGVHHRLLWPAHLQGSLHISITHRPRGRRRCPAAGLRKPHQASRPSMEPTVLSLPARARSAFSHHLMKEASDYHPMLFSRFSNYSSSPPAQEGGVQRLNVRRLCHKGVQCSTPAGRFHRPGLGSSPFPGGLRPRSAGRWCWARRRQVNRGPHWXVXRQGRAT

SEQ ID NO: 128734 - protein, 115 aa, Triticum aestivum
  Clone ID: PAT_TA_23152.pep
QVVGGSVMGELLASGPVMVIAATFGNATYERLPLDQDAEEGAVLSGSEGAATQLEQQGSGAARPCPRRCTPCRKTPPGDMFGQWGQGRPWRRPPPNVILSAAPANRIARAVPLPC

SEQ ID NO: 128735 - protein, 183 aa, Triticum aestivum
  unsure (1)..(183): unsure at all Xaa locations
  Clone ID: PAT_TA_23153.pep
IFLRARADLQEWLFEEARTNALAAVLRATTPMLEAVSRALSAAPLAVQSPGVELRLGQKVRLKVHGYRAVICGMDPXCCDSGSGSETPGVQKLSKGPNQPFYQVLVDVYADPELLVAYVAGGNLSEAEESEKGRFEHPYTEFLFYGEDTARDFIPVKQLREKYXQPRYEASGDENDDDGTTNS

SEQ ID NO: 128736 - protein, 179 aa, Triticum aestivum
  unsure (1)..(179): unsure at all Xaa locations
  Clone ID: PAT_TA_23154.pep
MGDTLICTQICRPSQNTELFLQCNALPYFHTSRPWRVIHSLPYSARPAHAPRSADKRTNRILLPSLPSVRHCTRSRQLVFARTCRWQTVTTRPLWFHSCPSNSVDLLLSETSSSTAFTMSLLRSFTTRLNKTETTVNDAPLGRAASQRNGKPIYRSQISSPLSXVSTTNMLSYLGRDHA

SEQ ID NO: 128737 - protein, 170 aa, Triticum aestivum
  unsure (1)..(170): unsure at all Xaa locations
  Clone ID: PAT_TA_23155.pep
HLSLQPGLALPPPHAHAHGRTQLLLRSLCALCLSPGSLARGERKREAREVGDHRSGGFCLVERPQAPPRPNHRASAFFRRAPLPRWRPNHLLSASLDPLRHLPAPDRYRRHRINTASPATGTPPLFSSPLPRPSRASAAQRSAEPWSAERERERXRERGKMXNQESXMDG

SEQ ID NO: 128738 - protein, 211 aa, Triticum aestivum
  Clone ID: PAT_TA_23156.pep
LLDSGIHWGAAPVVKGIRDATLDLLHILVAVHAEVYSGARPLLEKTMKILVEGLVDIFLSASDENKAKDLRMLDANGFCQLMLELEYFETVLNTYFSTEAQQALKSLQESLLEKACESGSEDAASDDKQVPSVSPDDLLALAQQHGSDLLQGELERTRLNIACFMEPTLQSGSKTSAYSSYQAPAPPPAQVSSPSFRRQQTNSPIVSRRRR

SEQ ID NO: 128739 - protein, 132 aa, Triticum aestivum
  Clone ID: PAT_TA_23157.pep
PLLLATDRGVRQNPSVRPLFCSWCFHIGAARVESIPGGGWGRPLVFLLSSLEFAHVPRSLLRLCLAPCLPLGKGRKSCRFLATFSPSSSPSRSFHRPRSKEISRLTSNLVGFRGLGIHSVLAELWWWRQRWN

SEQ ID NO: 128740 - protein, 159 aa, Triticum aestivum
  unsure (1)..(159): unsure at all Xaa locations
  Clone ID: PAT_TA_23158.pep
SLSLTPPPPPASATARPAWWCASPPIHISITKRRSPPAPISPAIPARLHLLLILLAAPFAYLAVVLLPDVLHAALLLLLCFPSPSASTSCFLFPKLCCCSFPLLNVPAAALLLLTLLLFISGPPTCCWLLSNNDPRAAALPPPPASEWRXSRSSPAIPP

SEQ ID NO: 128741 - protein, 97 aa, Triticum aestivum
  Clone ID: PAT_TA_23159.pep
RGRGRGRSQSLARIISMSSDARRPAALLQIALLVVVAAVIMNSSVCLGAAVGTGDLDPTHPTCGTNCPSSGQPYGRRCSKIYGCSRDGPPATAGDQP

SEQ ID NO: 128742 - protein, 149 aa, Triticum aestivum
  unsure (1)..(149): unsure at all Xaa locations
  Clone ID: PAT_TA_23160.pep
LGVLGSPIRAPLALSAEFNLLSSNPPAFSLLFKPRLGDFSLANSVRSPPVPDSPALPLSHKLSDLTNGDDHDHEGHKEFSLKXGTXFAANATAAGNTGGGVGMLLSGDAPHHQGACCPLWEQARRRVRSGWRGAPVPTGAPANGRCRKN

SEQ ID NO: 128743 - protein, 232 aa, Triticum aestivum
  unsure (1)..(232): unsure at all Xaa locations
  Clone ID: PAT_TA_23161.pep
MSCGVGQGGWLLDYGLVEEEIQASDFIYMVDDPPVSSVILGFDAPRREDAAAAAQDNSGAKKRSRPESSAQPGTKACREKLRRDRLNERFNELCAVLEPGKPPKADKVAILSDATRLLDQLRAEAQKLKASNESLQDSIKSLKSEKSELRDEKTQLKAERERLEQMLKGVSVXPPPAAAAAPQFHPAAAYAHAGKFVPAYAAGYPPPAAFWQWIPPTSLDTSKDPAHWPPVA

SEQ ID NO: 128744 - protein, 161 aa, Triticum aestivum
  Clone ID: PAT_TA_23162.pep
RKLGNLLFFAFPTRCLFLGVVKIWAGGRSALPAGDDLQDLSVSFSSDKGHQVNHFGYMGGKESDRMLMTVESSIGERQSSVVEASDVWSQPSNENFRQCIVSNSHKKQDSRSNGYILINANGGLNQMRFGICDMVAVAKILKATLVLPSLDHTSYWADDSE

SEQ ID NO: 128745 - protein, 123 aa, Triticum aestivum
  unsure (1)..(123): unsure at all Xaa locations
  Clone ID: PAT_TA_23163.pep
QSVVNPLATVAGGDHFPGRHPSEFAHAPWVHYTLVQIPHASEASGYHTHIRQHRKYNQSDMFLQASTESGKSAKQANSQEVQSKFKLTLAYYTXWVAGKRGGQDRFCMHFIHQLHAIPSSFLS

SEQ ID NO: 128746 - protein, 84 aa, Triticum aestivum
  Clone ID: PAT_TA_23164.pep
DRHRRPPRGRPGHRAPLSRRTVPGSSWVGWRGIPGADGRPETVMDALPADVLGIVLRRLDGASLAAAGCASAGFRELANDPDAW

SEQ ID NO: 128747 - protein, 130 aa, Triticum aestivum
  Clone ID: PAT_TA_23165.pep
MGDDGAEGEAPRCVGCGRRVRTLFVQYSAGNIRLMKCDVCKAVADPYIECEFMIILIDLILHKTRAYRHLLFNKLHIGSSIDKGILCQFILMHIVLDAFSKNNKADGDSSRNTLSTICNCTEVLGDALLG

SEQ ID NO: 128748 - protein, 167 aa, Triticum aestivum
  Clone ID: PAT_TA_23166.pep
GSAVHTHPLHPSPTRSAKCRRRSPSRTPRRSPSPSSRATPGAPTPTPSPWPSPSPPGRRPPPPAPSSPRATPTTSTPGPRRRSATPTGSRRWRGIRRFLGARPGGCSPATVSTGRPRWPFRPQAARCRSESGAYKVAKGGGSCCSSSPPAVGPPAVMVRRPSGRCSV

SEQ ID NO: 128749 - protein, 164 aa, Triticum aestivum
  unsure (1)..(164): unsure at all Xaa locations
  Clone ID: PAT_TA_23167.pep
NNSIQTALGRAPPCVAAPRPATACSSHTAGRRSRQLRAHMQAATVAPRALPGRALPQPHVSFSDTHRPRSTCEPHTHRREVLIDPPPWPRAHRHSPVALGDGGGAKIPWSCSHGGSSIIRPSWLLXFWVGVSVWVRCGQRHGXNSLLWVPXRGCGRGLLSFKGL

SEQ ID NO: 128750 - protein, 108 aa, Triticum aestivum
  unsure (1)..(108): unsure at all Xaa locations
  Clone ID: PAT_TA_23168.pep
CWSIGGXGRGAAFVVAKRRLTIMSCTRNVRGLILGSSSPIYGTRDEEEAASSSGQEIINCLLGIMGCITALVKIGLLCAAETPKDRPAMQDVYADAITIKEAFSALQG

SEQ ID NO: 128751 - protein, 170 aa, Triticum aestivum
  Clone ID: PAT_TA_23169.pep
FHLTQRARSHLLFPFSAGYESHASVLFNAGDVIIVTLLSSSAADHSERPEVLGTPGAVLRRAAGGVGPLAAELRRASPASIDNFDPSCNCLHPVLEPASPGATTGCSDAGTSSTASCNLAVSSTGTTVLRCYYRLCRVLEPVIFFAGNLLLFATSPSFFFFAPSDLLEPG

SEQ ID NO: 128752 - protein, 158 aa, Triticum aestivum
  Clone ID: PAT_TA_23170.pep
MATADGQSQPAATEPSPSPAKRKTDTDSEISPLDPPAKAARPGADEEAAAEAKARVADKGKGKMVVDEEEEGDEESDEEEDDEEVEGDGDESDGLCEDPLSEVDLNNILSSRTRRCSPAQPGAYLVPPEEAAEDDEDDEDADVDMAPGEESGDGEESD

SEQ ID NO: 128753 - protein, 193 aa, Triticum aestivum
  Clone ID: PAT_TA_23171.pep
MAAAAASVGGGAAPFVWKTYRMVEDPGTDGVIGWGKGNNSFVVADPFVFSQTMLPAHFKHNNFSSFVRQLNTYGFRKVDPDRWEFAHGSFLRGQTHLLRNIVRRGTAVGGGGGGKRKDAVAAGLTDDDMTMVATEVVRLKKEQNTIDDRVAAMWRRVQETERKPKQMLAFLLTVVGDRDTLQRLVGNSGNAAG

SEQ ID NO: 128754 - protein, 79 aa, Triticum aestivum
  Clone ID: PAT_TA_23172.pep
FDYFSKKNLLHIVCRHLKSGNRKILLIPENREILFVLGTPHRCIIYTPWVAVGGSQSVGRKAAMVSSPCTSAATSLIMS

SEQ ID NO: 128755 - protein, 213 aa, Triticum aestivum
  Clone ID: PAT_TA_23173.pep
MIGSFLPLPTTITTTSGRPLPPRATTPTLPFPTTPLRLRRRPARVSVSSSSSWRHEEGAGSTNGSLPGLRRVGEEEEEDDESCPVECVTEFKTDEELRRFLERSRATGALVVVDFFRPSCGSCKATEQGFMKLCKGSGDHGSPVIFLKHNVIDEYDEQSEVAERLRIKVVPLFHFYKAGVLVESFATRDKERITAAIAKYTSPEQEPETEPEE

SEQ ID NO: 128756 - protein, 109 aa, Triticum aestivum
  unsure (1)..(109): unsure at all Xaa locations
  Clone ID: PAT_TA_23174.pep
SAYASEGRDGLLWWRDLARCAAGDVSAALVQANQTLEDQCRLHSAPPLGTVLAVLDGHAGHAAARFACDHLVPTLLEAASGPGGVTXDAIRDAFAGHGGPSSAQVSQWD

SEQ ID NO: 128757 - protein, 424 aa, Triticum aestivum
  unsure (1)..(424): unsure at all Xaa locations
  Clone ID: PAT_TA_23175.pep
IRHEHQYTPGRPVSVSALQPSDTFPRRPHASAPAEQAVMASECGFNTLDALIDATVPAAIRAPPMQFTGKFDAGFTESQMLEHMAHLASMNKTYKSFIGMGYYNTHIPAVILRNLMENPAWYTQYTPYQAEIAQGRLESLLNYQTMVADLTGLPMSNASLLDEATAAAEAMAMCLGIVKSKKKTFLIASNCHPQTIDICQTRATGFDINVVVSAAKDFDYSSGDVCGVLVQYPGTEGEVLDYAEFVKDAHAHGVKVVMATDLLALTTLRPPGXEIGADIAXVGSAQRFGVPMGYXAGPHAAFLATSQEYKPADAPAALFGVSVDSSGEPPPRPPWRTPDQAQPPQSGRTANGPPAHALLPHATAVYGSQPWGRVGLMAWRSTVHPLFPIGFESFGKTGAKLGLLYHRQINFCALCLWPNRGAPK

SEQ ID NO: 128758 - protein, 154 aa, Triticum aestivum
  unsure (1)..(154): unsure at all Xaa locations
  Clone ID: PAT_TA_23176.pep
THAATSESSLTRILSHRSKPLSRHLAHRQRLWRPRRLAATASPARGSAAGRPSSXSDADAGLGCSFNELHVLHRHGPRRSSSPCGGRPPPQCRXEDDEEAAEFDFGQADVRRRAVLLPAACRRRTAPPPVRAWRRVXXVVARFLLRAEHXXLRR

SEQ ID NO: 128759 - protein, 195 aa, Triticum aestivum
  unsure (1)..(195): unsure at all Xaa locations
  Clone ID: PAT_TA_23177.pep
GDAPDKVYAIGVCRXDXNASACQXCIAATFXDAXKLCPYNRGAAIFYDICLVGFSDRDLLVARTNSDDQEVQLYNAQNVTSDVXKFNATVYKLLGSMAGVRRNXTRRGKFATGTIGFDDTYPNIYKHGCGCTXPDLTPWAXCRACLVRHQLPRMPARLHPRYAGXARITGLRCSVRYEVYPFYNGAIMLXCRTRW

SEQ ID NO: 128760 - protein, 44 aa, Triticum aestivum
  Clone ID: PAT_TA_23178.pep
TALVISILLTGWVYLFSFNHQIFVSGGISSYRITIMCAHFWTRK

SEQ ID NO: 128761 - protein, 95 aa, Triticum aestivum
  Clone ID: PAT_TA_23179.pep
PFSSVFTRGIQPPFPRNLLPKKNKNGSNGNCVRGKKSQKTCSPSQARPRHRDHMRCAYSSISPFFVTFEVDLIQSTISVSGAGYAPETHRMAFPP

SEQ ID NO: 128762 - protein, 340 aa, Triticum aestivum
  Clone ID: PAT_TA_23180.pep
MGGAAAATGAARWIQRLSAARISTEALERGQSRVIDASLTLIRERAKLKGELLRAMGGVKASATLLGVPLGHNSSFLQGPAFAPPRIREAIWCGSTNSSTEEGKELNDPRVLTDVGDVPIQEIRDCGVEDDRLMHVISESVKTVMDEDPLRPLVLGGDHSISYPVVRAVSEKLGGPVDILHLDAHPDIYDCFEGNTYSHASSFARIMEGGYARRLLQVGLRSITKEGREQGKRFGVEQYEMRTFSRDREKLENLKLGEGVKGVYVSVDVDCLDPAFAPGVSHIEPGGLSFRDVLNILQNLQGDVVAGDVVEFNPQRDTVDGMTAMVAAKLVRELSAKISK

SEQ ID NO: 128763 - protein, 89 aa, Triticum aestivum
  Clone ID: PAT_TA_23181.pep
LTLRHVISLLDQVEDVAKVPARIENLMAEKQLYAAVQLHVQSMLMLEREGLQAVGALQDVRSDLTKLRGALFYKILEELHCHLYNNGGI

SEQ ID NO: 128764 - protein, 190 aa, Triticum aestivum
  unsure (1)..(190): unsure at all Xaa locations
  Clone ID: PAT_TA_23182.pep
AYAAREAGGGAVXILHCIEAWGPDEXRRAYXAIARFERDXLDRLXIMPGASELCGFLHARQIRRGLITRNVKDAXDLFHQRFGMTFVPALSREFRPYKPDPAPLLHICSTWDIPPTEVIMVGDSLKDDIVCGKRAGAFTCLLDETGRYAPHDSLPEDFKPDFMVSSLPQVLSVLEEHFDVAPVSVAESRI

SEQ ID NO: 128765 - protein, 259 aa, Triticum aestivum
  Clone ID: PAT_TA_23183.pep
DINFSLEDYDDIKQMGNLTKEEFVHVLRRQSTGFPRGSSKYRGVTLHKCGRWEARMGQFLGKKYVYLGLFDTEEEAARSYDRAAIKCNGKDAVTNFDPSTYAEEFEPAASTGDAEQNLDLSLGSSGGSNKRGSLDGGGGGDDDGAAGSDQRVPMAFELDWQTAAAARSTKAKFDQNLTHHQMPPPALQASHMPFSPRHHQFMGNGDPGTAGGLSLTVGAGGGAGRWPPPLHHQYQPPHPQQHQQQQQQRLLQGWGNVVP

SEQ ID NO: 128766 - protein, 150 aa, Triticum aestivum
  unsure (1)..(150): unsure at all Xaa locations
  Clone ID: PAT_TA_23184.pep
MSMFTSSSSGVPSPSPEAGSSMVRAARQPQPQAFDYFVVLDFEATCEKGARIYPQEIIEFPSVLVDGATGDLDXAEFRTYVRPQDQPALTDFCRDLTGIPAGGLDGGVSLELRLQRRVAAGLGVGRTGGRPVRPSRGGAPACPHRARDSR

SEQ ID NO: 128767 - protein, 178 aa, Triticum aestivum
  unsure (1)..(178): unsure at all Xaa locations
  Clone ID: PAT_TA_23185.pep
HKDLDQLARSMERLPGVPTKVEFADIKKATGNFHEAMKLGGGGFGTVYRCTLTASASKTERPMDVAVKRFXRDVQNRCYDDFLAEVSIINRLRHKXIVPFVGWSYNKXRGRYLCSSSMTKRQAWGHPFPKVRQMAPGYNKGQRTGTAFGKWQPLRISRFGSQQRYWHIRINFGPLNLL

SEQ ID NO: 128768 - protein, 321 aa, Triticum aestivum
  unsure (1)..(321): unsure at all Xaa locations
  Clone ID: PAT_TA_23186.pep
RHEGVFDTQGDESSTYKEMIVSLLTGPRVRNISDFVPALSRLDLQGVQARLRRVHRQFDGLITKLLAEHAATAEERAREGRLDFVDRLRXQQHDEDEDGETITEVNIKGLIFDMFTAGTDTSSIIVEWAMAEMINNPSIMARAQEEMDRVIGRDRRLEESDIANLPYLQAICKEAMRLHPSTPLSLPHFSFEECEVDGHHVPANTRLIINIWAIGRDPAAWEDPLEFRPERFLSGPAAKIDPMGNNFELIPFGAGRRICAGKLAGMVFVQYFLGMLVHAFEWRLPDGEDKVDMAETFGLALPKTVPLKAVVKPRLVPAAYT

SEQ ID NO: 128769 - protein, 144 aa, Triticum aestivum
  Clone ID: PAT_TA_23187.pep
MHGRLQTARSIDEVIQIHDFFLQKCLKECLLLLPELLMKVEKLKALCLQYATSIQLLIPSIEVAAPESKSKSLSSRARAKRSQDRDEQLKLASENAVMSQSILKFESEFNAELQSLAPTLSKSSQAEPYLTHLAQCILGVGIDQ

SEQ ID NO: 128770 - protein, 333 aa, Triticum aestivum
  Clone ID: PAT_TA_23188.pep
MGSAGTICTDKTGTLTTNHMVVDKIWIAEVSKSVTSNSSLEELNSAISSSAWSLLLQGIFENTSAEVVKGSDGKQTVLGTPTEIAIFEYGLSLQGYRDAEDRSCTKVKVEPFNSVKKKMAVLVSLPGGGHRWFCKGASEIIVEMCDKVIDQDGDVIPLSDDRRKNITDTINSFASDALRTLCLAFKDVDEFDENADSPPNGFTLIIIFGIKDPVRPGVKEAVQSCITAGIIVRMVTGDNINTAKAIAKECGILTDDGIAIEGPDFRNKSPEEMRDLIPKIQVMARSLPLDKHLLVTNLRGMFQEVVAVTGDGTNDAPALHEADIGLAMGIAGT

SEQ ID NO: 128771 - protein, 355 aa, Triticum aestivum
  unsure (1)..(355): unsure at all Xaa locations
  Clone ID: PAT_TA_23189.pep
MASPATPRPALIRPRASRSRSQLGAVSLASDHAAATASSGRRRDFVFVVNPSGANGRTGKQWKQLLPFLHTRLADQCNICECITSGPSHAIDVTREAIKDGADAVIAVGXDGTLHEVVNGFFWKGSPVRALDRGPDHLTALGLIPLGTGSDFARTFGWSNDPRRAIDRIVRGVKSKLDIGMMEGPNGDPHFFINVADIHLSAKAGYFASMYKRFGNLCYVLGALAGFWVHTNRDLSEMVNGGEWKGSPVRALDRGPDHLTALGLIPLGTGSDFARTFGWSNDPRQAIDRIVRVGVKSKLDIGMMEGPNGDPHFFINVADIHLSPNGDVFVQSDGEHFGFLPTKFSVLPGAVDFFS

SEQ ID NO: 128772 - protein, 98 aa, Triticum aestivum
  Clone ID: PAT_TA_23190.pep
MSCGGCSGAVKRVLTKMEGVESFDIDMEQQKVTVKGNVKPEDVFQTVSKTGKKTAFWEAEATPVPEATPAADAVPAPEATPAADAAPAPEVTPANTVA

SEQ ID NO: 128773 - protein, 110 aa, Triticum aestivum
  Clone ID: PAT_TA_23191.pep
MASETVVLKVAMSCGGCSGAVKRVLTKMEGVESFDIDMEQQKVTVKGNVKPEDVFQTVSKTGKKTAFWEAEATPAAAAAEAAPAAPAPEAAAPTADAAPAPEATPANTVA

SEQ ID NO: 128774 - protein, 245 aa, Triticum aestivum
  Clone ID: PAT_TA_23192.pep
IIHTLFIPLRCCQLVSNIVQTAQTCMTLSTTISWSFQRSRRHQLCVPIKRRCWPGLPPVQARRTLLGPRPLHPRRRAAVAASTTVSARVAWGARSGLGVPEGRRLPPWLETGGNTASGVASAATVALGAGTASAAVAAPATLVSTLSADAELFPQVRETLSTVVLHSPGMAGASVLMRIQSEARDALRSGENAPERPPRDLRRSLPPCGEQTRRRWRAAQAEIIRSTAGDGDRWSRREILMLPSR

SEQ ID NO: 128775 - protein, 316 aa, Triticum aestivum
  Clone ID: PAT_TA_23193.pep
MASSNTGEPSTAPQPNRWYDLRLGSSCRDPALTTKFCTLRYEFKPASIDKTQAGSLQKSKDNRVTVEFHNNQPGRPKVAFEGSQEEYKDNDGVLFFDGETFRLERLHRAVKRLRHVRVPGESTSLAATTTGMGESHSPPLAKVGKLPATNKPSIHPVPVEVEHIDIGEPENPGPRNSNRSSTYQPVTTDPFSSSPDPNDQDENLDILGDDDNGSPNNMASAQGTSYRGFDINLPNQLDMDDEVADVDVNDEAEEGLNAAEALRAQVNAEGQQVEQATSSSSGSSSGSGSGSGSGSSTSGSDGSDGDSPSSGGDVDI

SEQ ID NO: 128776 - protein, 167 aa, Triticum aestivum
  unsure (1)..(167): unsure at all Xaa locations
  Clone ID: PAT_TA_23194.pep
LPGDNVGFNVKNVAVKDLKRGFVASNSKDDPPARAANLTALPRGWHRPARIGAGAAPGPDSPPPLLAVLCAELGDQRSDKANLGRELGRALPKFLKNGDAGIVKDDSHQSPRLWKTFATXPPLGRFAXVRDNEEQTGGWLGGIKGRGRKKDPTGRQGLPKGCHQERK

SEQ ID NO: 128777 - protein, 101 aa, Triticum aestivum
  Clone ID: PAT_TA_23195.pep
RGRGRGTGSGDRVEYFPVQVISKLCGGDMQSLVDPQLHGDFDLKQAERVCKVALWCIQDDESDRPMMGEVVRVLEGLQEIDMLPMPKLLAAITGRPNGTSV

SEQ ID NO: 128778 - protein, 111 aa, Triticum aestivum
  unsure (1)..(111): unsure at all Xaa locations
  Clone ID: PAT_TA_23196.pep
LSIAHQEMYIAPSPDDSGLQTPSHPKKGPAPPRVGCSRAXAPASWLVGWSVRIRSLSRTRRPGAFEYPXSWEACSRPVPRPGRGEACGPHVVYFWVXNPSGILXIRKHLXG

SEQ ID NO: 128779 - protein, 83 aa, Triticum aestivum
  Clone ID: PAT_TA_23197.pep
EDEEHILLIGKLIVYMRSHESHEELIILELQTKRAEQEKAHIRADRRRGGYGHGRPPSAATPSGRHAHRVSSLQPAAGQEAVA

SEQ ID NO: 128780 - protein, 171 aa, Triticum aestivum
  Clone ID: PAT_TA_23198.pep
LIARSQDRSINLLISFYPFVRGTSRLRRESRGGRNSSSQLLQTCPVIVCGNCRSPEWPPLAIERPCRLPPLSSAVMWRIEAPEGAASTRLQRRASSTMGCLSRLHRALVLRRWSAVEAEGPCVLGAGGSRRHSRVSGRWSGTVVPSSSRPNCSLEEACVITCKDEERERSE

SEQ ID NO: 128781 - protein, 131 aa, Triticum aestivum
  Clone ID: PAT_TA_23199.pep
AKNSTAPPSLTLPPAPRTRGPSASTALQRRSTSARCRRLRHPMVDDALLCRRVEAAPSGASIRHMTADDSGGKRQGLSMARGGHSGDLQLPQTMTGEVWRSWLLEFRPPRDSRRRRDVPRTKRKETNQEID

SEQ ID NO: 128782 - protein, 162 aa, Triticum aestivum
  Clone ID: PAT_TA_23200.pep
RAPDADRRTSAASARVSGTVGGRHRQTLHRAPRGRSWGRLEVAVAAAEERAGRARGMVPAAELRGWRASGVPDQRGGLPEQQRGGRRGSPHPGENSSGHPTTGLYGKAPRLALRQTLSCRALRCHGRLLGLRGHPHEAAATTPSSADSGPCGDPDEVKARLK

SEQ ID NO: 128783 - protein, 254 aa, Triticum aestivum
  Clone ID: PAT_TA_23201.pep
MEDTTFPAGITGMEVGGVVFGASATPPHSSKILFLGGAGERIGPRHGTLKLVTVIGVYLEQSAVPFLTSRWQGKPAEELAGSADFFRDIVAGPFDKFTQVTLVDTLTGQEYSDKVTENCVNIWKSSEHYSVDEGHGSAATSELKAIFYPASFPTGSTIFFTHSADGVLQVAFSDDTKVPEQESARVDSRALSEAVLESIIVANPCSPPSSSLLSARISYLIRRDVSWLSASVISHETSDRPMDDSLDNMKPYYS

SEQ ID NO: 128784 - protein, 124 aa, Triticum aestivum
  Clone ID: PAT_TA_23202.pep
TVTVAGRRRTGPAVSQSDRLTSLPHLPSVSQIGSPVGRSTPRQRPAVEVTWNPTGSAMVELRRMTGGRRPSLLHPSAAQMPGKLDPGQQGQSPARRPRYAGEVGRGGREGGCGGVQRNEVGIIV

SEQ ID NO: 128785 - protein, 155 aa, Triticum aestivum
  unsure (1)..(155): unsure at all Xaa locations
  Clone ID: PAT_TA_23203.pep
LQALYFCVPFREQLLEYYANNKSASDGEENMLTCLADLFSQISNQKKKTGVIAPKRFIQRLKKQNELFRSYMHQDAHEFLNFLLNELADILEKECKANKETPQNSSSNXSSNGPINGQPNGSHKEPETTWVHKCFQGILTNQTKCPEMWPSLMEE

SEQ ID NO: 128786 - protein, 105 aa, Triticum aestivum
  unsure (1)..(105): unsure at all Xaa locations
  Clone ID: PAT_TA_23204.pep
TSGSSSEVXGVVPEAICGGAGSFEIDFTRPKPQAYMPAYTAAPPSHGVTMQQASPVDMGYLTVPERPVAVTGEGRVARLMRYREKRKNRRFEKTIRYAVQKAYAE

SEQ ID NO: 128787 - protein, 169 aa, Triticum aestivum
  unsure (1)..(169): unsure at all Xaa locations
  Clone ID: PAT_TA_23205.pep
XEXLAYMHSESTXXXXHGDVKPANIXXNDEFTPKISDFGISRLIVTDMQHTGNVIGDMSYMDPVLLPTGLLTKKSDGYKFGVVLLEPLAGKKASHPDKNSLLRNFLDAYTKDKSVIELVDKELAEVDREILDNLGEMIMQCLNLDVNQRPEMTDVAERLRDMVKRFNAQ

SEQ ID NO: 128788 - protein, 168 aa, Triticum aestivum
  unsure (1)..(168): unsure at all Xaa locations
  Clone ID: PAT_TA_23206.pep
ACLSLHVAGRLLAWQRAGPLLXLPERAVACCSARKMRLWEMSLAAALGGAVDDACGLWPPWLLVPPLAGVWLVSCCLPAACRCRLQLPHICCFAATCMRELGGRPPAYVLLAAATLLLERWHAGEPENERCAPEAGGAQALRRQAAAAARVLRRRASNLHGCVPVYGS

SEQ ID NO: 128789 - protein, 248 aa, Triticum aestivum
  Clone ID: PAT_TA_23207.pep
ATNQKLNCQVNRLLLFCKVHCDDGWHVKERNTFDILVSFIEENQHIFPEQSRQEAVIVVNKIVSNILDCTKQKETHESDANASEEMIYLAAVLRLMGSSFLEVLRSIREMRAAGDRHHENHILLRISETIGLLGQYEANGLNIHDLFGMTEKSVDKENTSVLMLFHFASLFALCLRMRFGFLWKACIVMIMMAMNLVIDEDRSLSAFQFLIASKELAIYSIDQEDSLKGSACRKSSTSIALQYLPGRP

SEQ ID NO: 128790 - protein, 173 aa, Triticum aestivum
  unsure (1)..(173): unsure at all Xaa locations
  Clone ID: PAT_TA_23208.pep
TDRKHRILAKIFHRTLELHPESSQPPSXDETVFGHRIRRVTLVPKSLDAIRRILSPVLLVLLFQLSYESVEILGRFLLPLLLLRDLAYLGEAGICLRLLEGRCFSVGTAALARTATAGRRSLPFGAALALPADGRVLRLAAQLGRRPSAGHRSSSDLITGGWTEFDDLLIGLA

SEQ ID NO: 128791 - protein, 168 aa, Triticum aestivum
  Clone ID: PAT_TA_23209.pep
MGIWGWPWGRRGLSGFGSASTAEDIAAGIDASHLTAIVTGATNGIGKETARVLALRGANVIIPARTLESGMKVKESLAEEVPSSKLHVMEMDLSSLDSVRSFAGSFNSSHKHLNALINYAGIMACPFQLSQDGIELQFTTNHLGHFLLTNLLLDKMKSTAKETGMQGR

SEQ ID NO: 128792 - protein, 74 aa, Triticum aestivum
  Clone ID: PAT_TA_23210.pep
HNPPSVHSCSRDPSPRSISPRSTQSSCAGAADRFRPCLFLSVAAVEMRLPHTLIAASSTPHTRRGRSHLNSCSQ

SEQ ID NO: 128793 - protein, 157 aa, Triticum aestivum
  Clone ID: PAT_TA_23211.pep
MAAEGKVPTLAEEYSLPPKEVPVEKPAEEKSATITEASPADEPAADVEEKSETPEVKEPEAEETVPAAEESDAAPEETEEKPEIVIETAPADFRFPTTNQTRHCFTRYVEYHRCVAAKGDDAPECEKFAKYYRSLCPSEWVERWNEQRGNGTFPGPL

SEQ ID NO: 128794 - protein, 153 aa, Triticum aestivum
  Clone ID: PAT_TA_23212.pep
ILLSSMTNWQYFPSQEICLLQISLLATGMLLKTICSKQTLDLLMDDDYIGLDDLFAPGETFSYDFSGETFSYDLPGGTFSYLSVPNNQFSQYPLDQSSNGLHYGDGATQSTFLASGPLPPLEPMPSTFDDMPSVSNKPASSYCLNPAMKDPFS

SEQ ID NO: 128795 - protein, 112 aa, Triticum aestivum
  Clone ID: PAT_TA_23213.pep
CCRFWFGCPSLSDAALDGSWVLVPAVDGPTMVFVSWHGCCSIEEAGTCWVSDHEQKTGQVTELSLLLYRRETVFCWFGRCLIWVEMLQSTVVHCNSYHVRCRVVYKPNDNLA

SEQ ID NO: 128796 - protein, 376 aa, Triticum aestivum
  Clone ID: PAT_TA_23214.pep
SGEPFLVVFHLLCSSLDTEHKRPTAVMAQACLPPGFRFHPTDVELVSYYLKRKIMGKKLFVEAISEVELYKFAPWDLPDKSCLQSKDLEWFFFCPRDKKYPKGSRTNRATPNGYWKTSGKDRTIELNSRIVGLKKTLIFHEGKAPKGNRTDWVMYEYKMEDPTRPETLVSAGFSKDAYVLCKIFKKSGLGPRIGEQYGAPFDENEWENLDVGSSIFSFAPSSGVEDPQVESSALATAIVMQEPSAPQQSVQFSEHVNICSDEVNDAPPEIDGILLDELAKFLDDSPNDDVVLPENSGLPPMSELEAQAFEINTAELYDQLAGLSQSGDMSTVNFPASNGDVIENNLQQANSGLAMDDDYIGLDDLLAPGETFFYVS

SEQ ID NO: 128797 - protein, 128 aa, Triticum aestivum
  Clone ID: PAT_TA_23215.pep
SARTYRIPPITHSTIPASLVRRPRMPSMAASPREFYGKKYKPPAHRPTKRWKIMGGNRGFNRTNIARPMQELPDTRNHHRSSTAPSSAGNSSPEQSLLWGTNCYPAPPPWGKFHGSMSPATAGRPLAP

SEQ ID NO: 128798 - protein, 60 aa, Triticum aestivum
  Clone ID: PAT_TA_23216.pep
IIRRKTQNLNSTWFHLLITLPLTYFLQIKLEVKTTIDQLHGVRKKCKMDRDNGVNVPLGP

SEQ ID NO: 128799 - protein, 106 aa, Triticum aestivum
  Clone ID: PAT_TA_23217.pep
RSRIIESSLQLSWWWDRRVSASYSWLASIFLVMVLSRELLGVLDFQADGGRVLGAGCGQLCILMYEFWLCPYGVLVCLLFFFQLKPICDNRLMDAANFVFLWGLCP

SEQ ID NO: 128800 - protein, 124 aa, Triticum aestivum
  Clone ID: PAT_TA_23218.pep
MEVQARHGFLPTGRQQHLHGHGQAHQQPPAGEDEWWEYFPCPFCYIEVEVPFLCDHLQKEHCFDMRNAVCPICADNLGADTAGHFREQHSQQLALRKSSSSRAGAAAADTQPYGGGGSCCTVLG

SEQ ID NO: 128801 - protein, 225 aa, Triticum aestivum
  unsure (1)..(225): unsure at all Xaa locations
  Clone ID: PAT_TA_23219.pep
LVPNSARCSSLHLSTTLQALLIFVVLAVLLGDVHGRHHCDTFSCGHLHNISHPFRQQGDPHRCGVQSYELVCTXXARAIIQINTATYFVTEINYTDSSFWVVDANLDMNNSCPLPHWDQLPYFIGIQRSGKAPGGGLLPSTPSAGSSVERSRAVPLPPPSARSRAPAPACAHPVVVGDCARPCLLRLLRLGHALVGSPLVVSLTIMPLVNTELPLVLRWSHLMAC

SEQ ID NO: 128802 - protein, 90 aa, Triticum aestivum
  unsure (1)..(90): unsure at all Xaa locations
  Clone ID: PAT_TA_23220.pep
FGRFLVELFMWWPYRMMACCKHGVMFHVKSLVHLLSACFTCKFLRKDVLGLHTKLKLWMLVXSLSIASDXGXXXQSELHGXISXPXIKNC

SEQ ID NO: 128803 - protein, 165 aa, Triticum aestivum
  Clone ID: PAT_TA_23221.pep
MWESVALTLAGAAGNSIGKVLQKKGTLILPPLSFKLKVIRGYALNRLWISGFLLDMCGAALMLTALSQAPVSVVQPIAGCGLAILCVFSHFYLKEVMNGLDWIAITMAGLGTIGVGVGGEEQKVEEIPLFSIPWLVLTFVPVCGPPHTGPLTYQRPTRERTKYEI

SEQ ID NO: 128804 - protein, 136 aa, Triticum aestivum
  unsure (1)..(136): unsure at all Xaa locations
  Clone ID: PAT_TA_23222.pep
IFQPKQRHDGTVAWLAACMXAALADPSSEPRTYQAARRIPHWTEAMEHEYQALLRNQTWTLVPPQSRVNVIDSKWVFKVKRHSDGSIERYKARLVARGFRQXRFGLDYEDTFSLXVKPTTIRLLLSLAVTRGGSLT

SEQ ID NO: 128805 - protein, 348 aa, Triticum aestivum
  Clone ID: PAT_TA_23223.pep
PTSQNVDSVPPLPEDKPPTPPPLPSSPPPLPRPQCPVIQGSQVQGALHVAPDRVEPDTLRNVQDQHPHSIANNRGNMDPCAVPFQPPPPYTSGCAGHPNQMHPPPPLPPPPPPPPAAPFHPPGPHGNFSGPPVPPHGNNYHRPPAPPPPNNAYHLQPPPPHPPPPHPPGPNQFPYMPPEHQQRAQPWNCNPPYPEGYQYNGHDRGHPPYDRRHHFDDRWHHFDDRGRRFDDGGHHFNAGGHHFDDGAYHYDYRGHHFNDRGQMHHEPMDRGRFPPHFGPDPPYPDHFEASSSHRGRPSDGPPGPCTDWSMPPRRSKYPPGSRHSMEPPMSHEGGWRRHGRHNNDRFHR

SEQ ID NO: 128806 - protein, 271 aa, Triticum aestivum
  Clone ID: PAT_TA_23224.pep
MAAVDDIIGSSAGRWSLHGRTALVTGGTRGIGRSVVEELAALGAAVHTCSRKEAELGERLKEWEARGFRVTGSVCDVSVRDQRELLLQDVAGRFAGKLDILINNVGTNHRKPTTEYSADEYSFIMATNLESAYHLCQLAHPLLKASGVASIVFISSVSGVVAISSGSIYGMTKGAMNQLAKNLACEWAKDNIRINSVAPWYIKTSLVEEDLAKEDFVDSIARRTPMRRVGEPEEVSSLVAFLCMPGSSYITGQTISVDGGMTINGMYPTEN

SEQ ID NO: 128807 - protein, 121 aa, Triticum aestivum
  Clone ID: PAT_TA_23225.pep
MDGAIEEPLHKDYYKVLEVDYDASDDNIKLNYRRLALKWHPDKHKGEDDVTAKFQEINEAYKILSDPITRLEYDFSGCYEVNQYTAREYLSRFKGMILTCNGLGIEHSSKWARHLREWEPH

SEQ ID NO: 128808 - protein, 134 aa, Triticum aestivum
  unsure (1)..(134): unsure at all Xaa locations
  Clone ID: PAT_TA_23226.pep
APSSCVVRRTSVAXRYXVVQSARMXGAAGLAGEVQSEXLXVGGVQTRCLSGVGGSASWRAERQKLTAMQWTLAHGPGRAAKRVQTPPSSRAARARQQQRRPDVVXWSLSSRVLAGMWLKTVRNPDVKISAAGST

SEQ ID NO: 128809 - protein, 229 aa, Triticum aestivum
  unsure (1)..(229): unsure at all Xaa locations
  Clone ID: PAT_TA_23227.pep
MEKYEPVREIGSGNFGVAKLMRNRDTRELVAMKFIERGYRIDENVFREIVNHRSLRHPNIIRFKEVVLTPTHLGIVMEYAAGGELFERICDAGRFHEDEARYFFQQLVCGVSFCHAMQICHRDLKLENTLLDGSPAPRLKICDFGYSKSSVLHSRPXSTVGTPAYIAARRLLSPPPYAGGHAAVRPSGLIRGGLPGGXLPGRGAVDPFDGPPTGPRVTSVQYKIPEYVH

SEQ ID NO: 128810 - protein, 157 aa, Triticum aestivum
  unsure (1)..(157): unsure at all Xaa locations
  Clone ID: PAT_TA_23228.pep
MAPTVMASSATSVAPFQGLKSTAGLPVSRRSNGASLGSVSNGGRIRCMQVXWPIRGHQEFRDLSYLPPLNTXGLLKQVDYLXFRSKWVPCSXFNKVGFIFXEHNQSPGXYYDGRYWTIWXLLFPGAPTHTGXNEVEESKKDTCPYSSFRQIPCSVMP

SEQ ID NO: 128811 - protein, 162 aa, Triticum aestivum
  Clone ID: PAT_TA_23229.pep
LPPLAVAGFPSVAFSVCTVWRSRHGTVCGSLLPAGLRIVAPAGLLDDAGSVSPRSLGRAAPRFILSPDMKLLFVGLLARIPARGRSGHASFGRAIQRYIQKPDKKQLLLCLLDWMTGQGYSVDSSSRNLLLKNAQLFGQKQLIAEILSKQQAASRITNKLID

SEQ ID NO: 128812 - protein, 172 aa, Triticum aestivum
  unsure (1)..(172): unsure at all Xaa locations
  Clone ID: PAT_TA_23230.pep
MGRAPCCDRAAVKRGPWSPEEDDALRDYMQRHGNTGSWITLPKXKAGLKRCGKSCRLRWLXNYLRPDIRHGGFTDGRRTPSSTPSNSQLGSKWSLDRVAAGSRRTDNDVXKNNWEHKLKEAPRRAPPPPSQPPPRRPPPPAPPGAAPPSPPAAPSRPLRRGARQLPCPDPRR

SEQ ID NO: 128813 - protein, 127 aa, Triticum aestivum
  Clone ID: PAT_TA_23231.pep
SPKCWIPDRPLPAQRHLVLHLPRRKHGAGQPATPTRGPATGPPSNPSTQSKASSPRSAAESGGETAGGRSPPRRRWEGIKAGRRDLGAGGARSSRGGEREATRWRTRRRRRSGNCLTVSGLVNRFVS

SEQ ID NO: 128814 - protein, 54 aa, Triticum aestivum
  unsure (1)..(54): unsure at all Xaa locations
  Clone ID: PAT_TA_23232.pep
CSXNILNKWGLIKTRAKRQYSDGPPTTLLPDPRNNXKCPVIYFISRFFLPRYYK

SEQ ID NO: 128815 - protein, 155 aa, Triticum aestivum
  unsure (1)..(155): unsure at all Xaa locations
  Clone ID: PAT_TA_23233.pep
MASIAGSAVSFAKPVKAINTNSLSFSGARRGNAFLRLQPVPMRFAVCCSXAKQGYSGEGCGIVKKQLXVPEGTEXCGTTXFLTLGADHWDTVXRLVMGXEEESRLSVEETSAQAISTLEDAATLNGQLSLRIILKGGLILMMGLVTISTWADVAT

SEQ ID NO: 128816 - protein, 141 aa, Triticum aestivum
  Clone ID: PAT_TA_23234.pep
MAFGEGGGDATAPLISSDGPKRHLNIVRNGNEWTASAHVITAVIGSGVLSLAWSMAQLGWVAGPGMMVVFASVTALQSTIFADCYRSPDPEHGPHRNRTYAHAVERNLGSNSAWVCQFLQQTALFGYGIAYTITASISFRF

SEQ ID NO: 128817 - protein, 266 aa, Triticum aestivum
  Clone ID: PAT_TA_23235.pep
MAATPLDSAWEWLITNFSEFQLATVVTFVLHESVFFLSGFPSLLFERFGLFAKYKIQKKSNTSDYQNRCVMRLILYHVCVNLPVMIFSYPAFKFMGLRSSLPLPHWTVIVSQVLFYFILEDFIFYWGHRALHTKWLYKHVHSVHHEYATPFGLTSEYAHPAEILFLGFATVVGPALTGPHLFTLWLWMVLRVLETVEAHSGYHFPWSPSNFLPLYGGSDFHDYHHRVLYTKSGNYASTFVYMDWLFGTDKGYRKTKAIEGEEGKHL

SEQ ID NO: 128818 - protein, 158 aa, Triticum aestivum
  unsure (1)..(158): unsure at all Xaa locations
  Clone ID: PAT_TA_23236.pep
IYIHHADSFFPTPTYRSPLSRICINCTSGQTTLVFEAPRRWWVVITSKPDMPSPTRGICIPVRWISFPNWGIWFSPRADIPPQPADMVLQTMDTQRPREVTGPLTMVPPPPRVGTRLPPIQPGPSFRPPPRPSPHQPRGIPSQLGGYMFGAXXKKRFN

SEQ ID NO: 128819 - protein, 166 aa, Triticum aestivum
  unsure (1)..(166): unsure at all Xaa locations
  Clone ID: PAT_TA_23237.pep
AKDTSAIIHRSGPCPVRGWRRAPVTTDRAASVDHPSGSGSPPPPPPPPAPGHRRDSRGPLPSPRPPPPALQRGDHHGHGEPEVVGEEAAGVAVAVATTSYQHQQYELAVMVAALTHVISSTQTGGLAGAXAXGNKVLXRSRFFNAATFXKAFFWGFLLTXLEXLAX

SEQ ID NO: 128820 - protein, 74 aa, Triticum aestivum
  Clone ID: PAT_TA_23238.pep
MSCSCGSSCGCGSNCNCGKMYPDLEEKSGATVQATAVVLGVGPATVQFEEAAESGEAAHGCSCGASCKCDPCNC

SEQ ID NO: 128821 - protein, 219 aa, Triticum aestivum
  Clone ID: PAT_TA_23239.pep
SNPPITYSSSINKKYNSKTEAVELLHLLAALLTALPPEQVAPLRRRSGQRHEGRPCRGALQLGRRRRPSLQHRDGLSWSWGPTLRLCRKMAVGLGCTRPSTEEFGGHRVKAPGQSVPWRRLGRANGQCGPWDRRGWNQADPRWVLGRRVFEWDPLQLPMVQWVGMRLWVICAVCYSSVELGNWRPTCLGLGACGMGCNRKSRVICKILCLCARSLYVCL

SEQ ID NO: 128822 - protein, 89 aa, Triticum aestivum
  Clone ID: PAT_TA_23240.pep
MITRSKLVEQLRDYQIRSQHKRDLIGAISWGLLCCLLIVSSYMMLYFRHFWLSAVIISVGILLPAGLYILRQRKLAKKRERRLLLPLSM

SEQ ID NO: 128823 - protein, 681 aa, Triticum aestivum
  unsure (1)..(681): unsure at all Xaa locations
  Clone ID: PAT_TA_23241.pep
EGDLXAEERLRRERSRERGLGVTRYEWRARRSGGPSSRAGIVVPLPSGVYFQDLSGSEPVLKLQSSSTSPIIDPHLSPDGTMIAYVRDDELQCKTYNFGFDDGETRQLTYGARESGKVHGLAEYIAQEEMERKMGFWWSPDSKHLAFTEVDSSAIPLYRIMHQGKSSVGLDAQEDHAYPFAGAANVKVRLGVVSSGGGEVTWMDLLCGEPNGAHGDEEYLARVNWMHHNALAVQVLNRAHTKLKLLKFDIATGKREVLLEEEHDIWITLHDCFTPLDNGVSSKHPGGFIWASEKTGFRHLYLHDKNGECLGPITQGDWLVDQIAGVNESSGLIYFTGTLDGPLETNLYCTNLFPDWSLPLQAPKRLTRGTGRHSVILDHQLLRFIDVYDSVKSPPVILLCSLLDGSVIMPLYEQPLTVQPLKKFQQLSPEMVQFTGKDGTSFYGTLYLPDEKKYGPPPYKTLVNVYGGPSVQLVSDSWISTVDMRAQYLRSKGILVWKMDNRGSARRGLHFEGQLKYNIGHVDAEDQLAGTEWLIKQGLAKPGHIGLYGWSYGGFLSAMCLSRFSDTFCCAVSGAPVTAWDGYDTFYTEKYLGLPSEHSDAYEYGSIMHHVKNLRGKLLLIHGMIDENVHFRHTARLINSLMAERKSYEILLFPDERHMPRQLDDRIYMEERIWDFVERSL

SEQ ID NO: 128824 - protein, 227 aa, Triticum aestivum
  Clone ID: PAT_TA_23242.pep
AAPGFLFLPPRSPPLPPTLLSCTALLKLQSSPTVHHHRALYLPSCRSFASPPRVTHPTPPPLTLISTPSPFPFCSRRVPAVSTPSVISGIVSFVGLADGRREMSRGRSPEPLDFFIWTVEDVGLWLEEINLGGYRQVFEENSVNGEYLESLSMFTTEQILRFIRRCHMKWGDFITLCKELRRIKVACLKGEQEVRRPWWAPSCLSVVFVRAAKRNRQSRVVSLKLEP

SEQ ID NO: 128825 - protein, 194 aa, Triticum aestivum
  Clone ID: PAT_TA_23243.pep
KLAAAGVTSRKETAMSRPHAVLIPYPAQGHVTPLLNLAKVLHSRGFYVTFVNSEYNHRRLLRSRGEDSLAGLDDFRFETIPDGLPPMENEDVTQDVPALCTSFATHGAALFRELLARIDGDGRPPVSCVVTDGVMSFALEVAGERGVPALVFWTTSACGFMGYLHFFELVERGFVPLKDVLPPPNRYLHATGIT

SEQ ID NO: 128826 - protein, 111 aa, Triticum aestivum
  unsure (1)..(111): unsure at all Xaa locations
  Clone ID: PAT_TA_23244.pep
PKRPSPKAVHFPHLCKLKDHGRIQLVTGYITFCTVSAPKVLQDLLKTEPGGALSEETMSPMNFDEGAXAAQEVWXLTPRSQQIRNSTTXPPXAARRXTRWXLLXXPTXING

SEQ ID NO: 128827 - protein, 213 aa, Triticum aestivum
  Clone ID: PAT_TA_23245.pep
FNQAKGLTSQLLPAMRNVQAALAGLGLADAVKVTTPIAFNALKKSFPPSKSLFQDDIAQSVMSPMIDFLEQTGSYLMANIYPYYTYTSQSDTINLNYATFRPNDGVVDDGTGVRYDNLFDAQLDAVYYAIDNLRASSTKRTVETLLRGAHRRHVPVVTGESGWVLLLPTGGGGQARENARALLPRPPSSSAAGAAPAPRAARALRRCRRRISV

SEQ ID NO: 128828 - protein, 237 aa, Triticum aestivum
  unsure (1)..(237): unsure at all Xaa locations
  Clone ID: PAT_TA_23246.pep
MQRNGVMECSVCHSKVVAGTPRSISRAYDKHHNKITSKFRALKFLLVVGDCMLVGLQPILVFMSKVDGKFQFSPISVNFLTEVAKVIFAIVMLIIQSRKQKVGEKPLLARSTLIQAARNNVLLAVPALLYAINNYLKFIMQLYFNPSTGKMLSNXLKGTGSLAVLLKFIMRRRFSVIQWEALALYTLLGSASINYRTAPTGGAAFGLPITAIAYIYTLIXVTVPSLASVYNEYAMKS

SEQ ID NO: 128829 - protein, 187 aa, Triticum aestivum
  Clone ID: PAT_TA_23247.pep
VSSYRAGRPGWFCRAVTSFRSPGLSGEGRVGNLTRFPRSRTGVLHGWLAGAGVFGQNTLVGGAPVKTPAGAPRQSGTGGAGGARHPPARSYHGPLPQGISRSGGRWAQDPPAFTAESGTAKHRPESKRPNRSGSKLPPSPPSTAVKVGPKLAPSPQKPPGGGGRGGEGGAGASKQPKPKPSCNHCSI

SEQ ID NO: 128830 - protein, 70 aa, Triticum aestivum
  Clone ID: PAT_TA_23248.pep
MEVASNRGLARYPYLAHDSADGCLHLSHSERMAIANSKVSVLSRVVNAVDSFNTNSRVQTLEDPKMDKTT

SEQ ID NO: 128831 - protein, 76 aa, Triticum aestivum
  Clone ID: PAT_TA_23249.pep
MALTNFIVTAAVVGGALLLFTTDVRKSGAVFRRNARQIRQWLEEDTASAASKSAKEAVPPPRKLDTEVPKDKPKDH

SEQ ID NO: 128832 - protein, 139 aa, Triticum aestivum
  Clone ID: PAT_TA_23250.pep
STARQASRNIRFSSVSAGAAWVGQNNESTRIKANVNLNPRLARVASSLRNMDWNPGHSKLILSLLAVIPCAAPSAPGSPGGGEAPLASAKAANRRADAWAWDGAVGEDAGQGRRGRWAGPEARGPPSGGFGRRWPGAAT

SEQ ID NO: 128833 - protein, 184 aa, Triticum aestivum
  unsure (1)..(184): unsure at all Xaa locations
  Clone ID: PAT_TA_23251.pep
MAAILSSAAPTTPTPPRARRPRQAPRNRRLPLGGPAAGLFTTLGLNGGSAALAAPLSYEEMLRLSSDTAGGGGDGFSLPDLGLGGLVDFVAQNPLVVAAGLAVVAVPLAVSQVLGGASKPYETVSVKAAYRRLLEEPDAQLVDIRPLKDAREVGSPDISGGTKKGGGRLPLQGXKXNXFLXKPP

SEQ ID NO: 128834 - protein, 158 aa, Triticum aestivum
  unsure (1)..(158): unsure at all Xaa locations
  Clone ID: PAT_TA_23252.pep
SHQSNTHSRRDEDALTRSARPPPLLSPRRRGQRRALSGPDVQRLPPRRQWRRCSPSRPPSGTPTTSRRWTPDNPCCDWVRLHLATTSPGASXXLAVFPGRQTQRXHPNAFAGFQTWKTNLAQLPGSXAYTPASEXPTSXXDPWKXXGXXXSGXLKXTP

SEQ ID NO: 128835 - protein, 261 aa, Triticum aestivum
  Clone ID: PAT_TA_23253.pep
SCRIRHAGGCRHQVNLNFKLIHLPFLFLTFRKMSNNKQCVAETGEGLSSSTSGMLRGATTGGGVIHQSMRRGYDSRKFSYDVGVARSSASVDFGATRMDRLDPDRAMMLFNNIREKYGVHKLAPEQMWAFDKALFFSHTINGASVLQPNEGVFFVGKRSYAMGLALSVLGTDARRFFRTYADEIREVNRQILNEVDHMDYGKSDKYNQLMQVARARGMEAYPDLAHDSADACSWLTLEQSRVIARSKDRVLDGLEPDPYKR

SEQ ID NO: 128836 - protein, 180 aa, Triticum aestivum
  unsure (1)..(180): unsure at all Xaa locations
  Clone ID: PAT_TA_23254.pep
VLVSRKKVTLDPRAEQLRCIPTARPCRPCRAPRLGPARPSGPRAPAPHRRSRXCWLHHEYRGTPRPALLTPACRPMGPAPGCSAGRTASSATIAGRHRPRRAHHPYPGLAVAQLPVTSGNKAPRRAPAPPRPDRHGARQLFXCALHAVEXVXPGPGSSAXGLGVSAASSEXSSAPGPXPG

SEQ ID NO: 128837 - protein, 205 aa, Triticum aestivum
  unsure (1)..(205): unsure at all Xaa locations
  Clone ID: PAT_TA_23255.pep
CVYDRVLAGVKASDALVIKTCFEMEGPYINYLTAQHGKPVLVTGPVVPEPPQGELEERWAKWLSSFPDNAVVFASFGSETFLPAAAATELLLGLESTNRPFLVVLNFPKGTDTKAELAKCTPPGFAERTKGRGVVHXGWVQQQHILRHRSVGCFVNHAGLSSVVEGLVAGCRLVLLPMKGDQYLNAALFARDLRVXAGRWRGATA

SEQ ID NO: 128838 - protein, 187 aa, Triticum aestivum
  Clone ID: PAT_TA_23256.pep
MPPLTTPKSGDALFASVERVNAELFTLTYGAIVRQLLTDLEEVEEVNKQLDQMGYNIGTRLVDEFLAKSNVSNCADFKETADTIAKLGFKMFLGVTATVTNWDAEGTTCSFVLEDNPLVDFVELPDTCQGLQYCNVLSGVIRGALEMVSMKTEVTWVRDMLRGDDAYEMRVKLTKQVPEEYPYKDDD

SEQ ID NO: 128839 - protein, 234 aa, Triticum aestivum
  unsure (1)..(234): unsure at all Xaa locations
  Clone ID: PAT_TA_23257.pep
HQFRSGAGPLSPLISLARHRPRSRRCRLPRPPSPAHPLFASGERIDHTFTLLLQVATAKLGYKVRSERLWASSAANGPQDFKQPGARAAAPAYSISRYFSTVIDGLKYTSSHELVKNDGXSVATIGISDHAQGHLGEVVFXELPEAGTKVSQGGAFGNVESVKATXSDVNSPISGEVVEVNSKLSEXPGLINSKPVRGGVGMIKVKPSSPAELEGLLDSAKXYTKLAGEEEDAH

SEQ ID NO: 128840 - protein, 190 aa, Triticum aestivum
  Clone ID: PAT_TA_23258.pep
PPRHGIVLRSPLPLPLPHGIRAEHHRVHARAPSPLAPLLLLLPPAPFRRRAPSGSGALLLCRAPARGRALARVRCRGAVKLVGEGEFEAEVMQSDLPVLVDFVADWCGPCRLVAPVVDWASEEYEGRLKIVKIDHDANPQIIEKYKVYGLPALILFKNGQEVPGSRREGAINKAKFKDYIEPLLETSNVA

SEQ ID NO: 128841 - protein, 100 aa, Triticum aestivum
  Clone ID: PAT_TA_23259.pep
FLLCLVLWNINSHALLFITMARGIEHIFPPIFHCTYANGPTQRSGQSQPSIMIQISDSSMKLNSKCCRTYAAINHKHICHIYVYIREAASITKLTGQIAP

SEQ ID NO: 128842 - protein, 166 aa, Triticum aestivum
  unsure (1)..(166): unsure at all Xaa locations
  Clone ID: PAT_TA_23260.pep
RARSSSRAPLNYTQGGPRRHNPQAASRGASSTMDRAALPAAVEPKKKGNVRFAFACAILASMTSILLGYDIGVMSGASLYIQKDLKINDTQLEVLMGILNVYSLIGSFAAGRTSDWXGRRFTIVFAAVIFFAGALIMGXSVNYAMLMFGRFVAGIGVGYXLMIAPV

SEQ ID NO: 128843 - protein, 150 aa, Triticum aestivum
  Clone ID: PAT_TA_23261.pep
HWFVICLGSHNRGVAMATAQGLVVPSIKKVQSLSILEITKELSRLHEMALQNRLSTNDITGGTITLSNIGAIGGKFGSPVLNLPEVAIIALGRIQKLPRFDDDENVYPSSTINVTVGADHRVVDGATVARFCNEWKSLVEKPELLLLHMR

SEQ ID NO: 128844 - protein, 147 aa, Triticum aestivum
  Clone ID: PAT_TA_23262.pep
NRAREELSFELGRAPTDEETMKKVGLSPARYRDVVRMTRPTYSLHSRNRVTQEELIKEVTDVDAIGVDTHKHNRLLRLAIDDLLDSLKPKESVVIRQRFGLDGRGRRTLSEIAGNLRISREMVRKYELKALMKLKHPTRVDYLRRYM

SEQ ID NO: 128845 - protein, 128 aa, Triticum aestivum
  unsure (1)..(128): unsure at all Xaa locations
  Clone ID: PAT_TA_23263.pep
MAIYIAREATKLWRKVCAETSVELQLLFEKWHLLLAGIVFQYIHGLAARGVHYLHRPGPILQDMGFMALPELGQDKGYLSETVFTCIFLSFLVXSFHPFVYHSKRFYTVLLWRRVLAXLVASQFLRII

SEQ ID NO: 128846 - protein, 167 aa, Triticum aestivum
  unsure (1)..(167): unsure at all Xaa locations
  Clone ID: PAT_TA_23264.pep
GHGRGSRAPAAPSTPPRKEPRPARDVARRRPPRRAVGEPEPPTGSQRGATLFGGRALGNHGTENGAVRPAKRFCLHRALRPDPFRAAGSSSSIPHKSLCLLRMRHLKMTRTSLRLDGGKTVWPLANCCPDXATLGDTDPETNXGRRWNXMSRGVSXLPPCSGXTRPS

SEQ ID NO: 128847 - protein, 131 aa, Triticum aestivum
  Clone ID: PAT_TA_23265.pep
SCRIRHEAVPVTTVRSNGNFLLASSSCASSPSSSGGATALVSGHPAISPGRQGSSPKQFAQSSRNPPRSTWKIGPRTASGTFPSQGNTGKGNNDQLGSSAADQFGCLPLPTSPSGTPSSATDLSLVLDINK

SEQ ID NO: 128848 - protein, 171 aa, Triticum aestivum
  unsure (1)..(171): unsure at all Xaa locations
  Clone ID: PAT_TA_23266.pep
SPASGPVGSTRHKGSPNHQSDPRGARAPHAGSPRRRQVGRLLRRSSRGGHGGIQWAEEVRPRALTSSSPTSARASPAPPPQPDTSSLRPTEALRRRPATGVRQRATAAREVWXGVCTGSRRSTALRQPPTPXXSTGNGDSRPAEIHLQASLLXPTSFTLTQSSQGTALPPL

SEQ ID NO: 128849 - protein, 226 aa, Triticum aestivum
  unsure (1)..(226): unsure at all Xaa locations
  Clone ID: PAT_TA_23267.pep
METAAAVSVPRSACRAALPFPAPLKLQGRVALPRRALPGAPRQRLVARCAAADDSAAAELPIEKRFAAFPAVMDINQIREILPHRFPFLLVDRVIEYKAGEYAVAIKNVTINDNFFPGQLPGPPDNTPSPXHFPERPLMPGVLNAEAMAQGGRXNFCCAGVVDPRSRSHFTAGGTLVMRMTLTKYHTKFGLAKMEGKAYVGGDVVCEGEFLRISRHWVNRICLCAM

SEQ ID NO: 128850 - protein, 127 aa, Triticum aestivum
  Clone ID: PAT_TA_23268.pep
RLSSMELTLGDMVHSVEATISVKVVGGEWPQGFRGVFTATTASIDEEKIELLDFGDDKLPVAADGSIQLSRSVVSVEDDGQLRVSVMARHLVDRSVRRASGVLAAKTSSRSYAKLEVFSCKMEVTVA

SEQ ID NO: 128851 - protein, 148 aa, Triticum aestivum
  Clone ID: PAT_TA_23269.pep
MATAKAAGEEPALGIPYNPAQAQGSYYYPPDPYAAGRVPPNAIYAGAPKGVPLQHTMFRDTPAPFHCQSCGDAAVTSVRSKPSVASVVACMMPFFLGVCFLCPSMDCLWHKQHYCPSCGEMVAEFQMDDRCIVVDPTSWTEPSFDVPA

SEQ ID NO: 128852 - protein, 117 aa, Triticum aestivum
  unsure (1)..(117): unsure at all Xaa locations
  Clone ID: PAT_TA_23270.pep
LHWCKFSSLHYVCTYLYWYTFSINPTYLVYFLGAILPPFPSTLPFDSFVVPQTLMFTQASRWASNTLRPPGTSPGXSRRRLLGRPLIXSRTRKFPRNKQVAXHPPERSTVXHPLEPS

SEQ ID NO: 128853 - protein, 134 aa, Triticum aestivum
  unsure (1)..(134): unsure at all Xaa locations
  Clone ID: PAT_TA_23271.pep
PAGLAXDVTQSRMFYGPGGPYALFAGKDASRALAKMSFEPQDLNGDTSGLGPFELDALQDWEYKFMSKYVKVGTIKKAAPAEDGTTSTSPETNETVTAEAETEKAPAXEHKPREVSSEEVKEKEATADAVSAES

SEQ ID NO: 128854 - protein, 225 aa, Triticum aestivum
  Clone ID: PAT_TA_23272.pep
MAVAELWETLKQAILAYTGLSPTAFFTAVAVAAALYHVVSGIFAPPPPPRQRPREEPEAEPLPPPVQLGEVDEEELRQYDGSDPKKPLLMAIKGQIYDVTQSRMFYGPGGPYALFAGKDASRALAKMSFEPQDLNGDTSGLGPFELDALQDWEYKFMSKYVKVGTIKKAAPAEDGTTSTSPETNETVTAEAETEKAPATEHKPREVSSEEVKEKEATADAVSAES

SEQ ID NO: 128855 - protein, 164 aa, Triticum aestivum
  Clone ID: PAT_TA_23273.pep
RIGVLNNRRKKRRVDSAGVGVKSAEGSLDVKSNEKAQPQRRKLFRIPPEAVQVLRKSFAESELPTREVKENLSTELGISFEPLDKWFKNTRCAALRDRKAEGNSRVAGPSKRSRQSAGKSGSSGKIDPVDNSYLLPVPEIISVPTHPQGIPERKPESTSKLQGG

SEQ ID NO: 128856 - protein, 259 aa, Triticum aestivum
  Clone ID: PAT_TA_23274.pep
AGNEPERALRILAKMRRLDLKPHIWTYEIMFSLFGNVNVPYEEGNMLSHADVSKRISIIEMDMLNHEIRHSFVSMKNLIRAFGAEGMIDEMLRYLNVAENVLWNMDPYQKSDLYGIVLHALVKAKETPKAIRTFKIMRSWGLPTNTAIYSIMIECCKLLPCVKSAGALLSLMFRDGCCPTVVTFTSLLKVVLAKEDFEGALDLLDLCITEGIQPDIEIFNTILSEANAKGNIHVVEYIIECIHKSKRFPINQRLGTHFG

SEQ ID NO: 128857 - protein, 175 aa, Triticum aestivum
  unsure (1)..(175): unsure at all Xaa locations
  Clone ID: PAT_TA_23275.pep
MGRAPCCEKMGLKRGPWTPEEDKILVAHIHSHGHGNWRALPKQAGLLRCGKSCRLRWINYLRPDIKRGNFTDEEEQSIIQLHQLLGNRWSAIAARLPGRTDNEIKNVWHTHLKKRLDLSAQEQHQEAKKRKKPAAAARKRDGKVKMRKLDALTAXAAPVLSSPERSVSSTLTEST

SEQ ID NO: 128858 - protein, 278 aa, Triticum aestivum
  Clone ID: PAT_TA_23276.pep
MGRAPCCEKMGLKRGPWTPEEDKILVAHIHSHGHGNWRALPKQAGLLRCGKSCRLRWINYLRPDIKRGNFTDEEEQSIIQLHQLLGNRWSAIAARLPGRTDNEIKNVWHTHLKKRLDLSAQEQHEEAKKRKKPAAAARKREGKIKMRKLDALTAKAAPVLSSPERSVSSTVTESTSTASAAAEQHGNSGSSASASASVKEECFTSSEESEEFQIDESFWSETLSMPLDDINDVCMEPHDAFGKPTGAADGDMDYWLKVFMEGGDDDNNNDGALDLPQI

SEQ ID NO: 128859 - protein, 148 aa, Triticum aestivum
  Clone ID: PAT_TA_23277.pep
IMFIIQTHFLVLQTSSHFYYFPATANRMTHKLAHILITNSSILSLHIICSLLILAMTFSILCFSLSACFSASFSSPIPASPHPERFSLIPSCTPPSASIPRRRASERRRHPSRLVAEEKGEQRKSSHRCASTPAAPWPPTLIQLLVAG

SEQ ID NO: 128860 - protein, 82 aa, Triticum aestivum
  unsure (1)..(82): unsure at all Xaa locations
  Clone ID: PAT_TA_23278.pep
TQSXSAXCATXCATASPVVAXPCRLSPFPVVGAAEHGNCHDRCRGHEDENQTHDGPGGVLQGSGGNASSHSVVQHPNHCMSC

SEQ ID NO: 128861 - protein, 223 aa, Triticum aestivum
  unsure (1)..(223): unsure at all Xaa locations
  Clone ID: PAT_TA_23279.pep
MKLFCDEVLATVVPIAVYWVYSGVYMWLGQCQSMDRYRLHPRKEENGKNLVSKRDAVKGVVLQQLLQAATAAAMFTLVGESTATATGRAPQRTWTGTCLTVACQIGVAMAVLDGWQYVWHRCMHLNRFLYRHVHSWHHRLVVPYAFGXLYNNHRGLLLDTMGGALGFLASGFPPPSPSSSARSPPSRASPPTAHGLPGKVHRCFWRVHISQQCHYGNFEPLRK

SEQ ID NO: 128862 - protein, 143 aa, Triticum aestivum
  Clone ID: PAT_TA_23280.pep
YSHGFLAKDKHDGIVAGGGSGGGRVQEGARHGGHGEARTPCWRAAWRGKLLPDEMRAAVRLGRCVRALPLQALPKKQRHTIVIPAGCSAAFRLRRRVQPRNDLFRPGAHLTGLPRLNRKSKSRSPRRATATKEPAGSASWTTS

SEQ ID NO: 128863 - protein, 148 aa, Triticum aestivum
  unsure (1)..(148): unsure at all Xaa locations
  Clone ID: PAT_TA_23281.pep
MAAKEPMRVLVTGAAGQIGYALVPMIARGVMLGADQPVILHMLDIEFAAEALKGVKMELIDAAFPLLKGVVATTDVVEACTGXVNVAVMVGGFPRKEGMERKDVMTKNVSIYKAQASALEAHASPNCKXLXVANQQTQCSLRRSCSSS

SEQ ID NO: 128864 - protein, 204 aa, Triticum aestivum
  unsure (1)..(204): unsure at all Xaa locations
  Clone ID: PAT_TA_23282.pep
LASPVHANAVLPQAVGSEPGPAGERHRRQWHGGRRQHLRPLRARQVHHPAPLQRHPNRPRDGEGEAEPGGPLRGGKKTKHGKTTTPPHLASCGADADPGAPPPVAARHRSRALRCCRRPAPLEPARVRSIHFECNSWVYPYKKTAADRLFFVNTSYLPSKTPXXLVLLRDEELRSLRGDGKGERKDWERIYDYDRYNDLGNPDN

SEQ ID NO: 128865 - protein, 111 aa, Triticum aestivum
  unsure (1)..(111): unsure at all Xaa locations
  Clone ID: PAT_TA_23283.pep
GPCRARLPLHGRDPRASAGPRAGAPREGGRQTAAGAGPRGGRGGARPTGAPHPXSAASITQARVIAXTGTGPGAAGHRPVPGAWSRRGDGGGGATAGTGRPRGRCWRCTWR

SEQ ID NO: 128866 - protein, 106 aa, Triticum aestivum
  unsure (1)..(106): unsure at all Xaa locations
  Clone ID: PAT_TA_23284.pep
MPPKIDPNEIKVIHLRATGGEIGASSALAPKIGPLGLSPKKVGEDIAKATGDWKGLRVTVRLTIQNRQAAVSVVPSASSLXVIKALKEPPRXDRKKVKNIKHSKFR

SEQ ID NO: 128867 - protein, 184 aa, Triticum aestivum
  Clone ID: PAT_TA_23285.pep
MMARRQRGFRLGRKLLGLWRWALCNRRRRGYARLQRCQLGAGAKPSHAAVGSAKLQQQQQLVVLPRERDEPRRMLGWGRSLARRMRLLPRRGERLLEDAGEATTPKGQVAVYVGGDEPGGESMRYVVPVVYFNHPLFGELLREAEEEFGFEHPGGITIPCAATRFERAAAMAAAGGGRKAPGWW

SEQ ID NO: 128868 - protein, 320 aa, Triticum aestivum
  Clone ID: PAT_TA_23286.pep
FIQCWRAIEGASHLFHISGNGTNQNSEFRLWGHEGPVTCLSLDSTRIYSGSWDMTVRSGDRAEMKCVQKFMHADWVLALAPHGNTVASTAGRDAYVWDIGNGELTTIISNAHVGNAYSVARTHLAGVLFTGGEDGAIRLFDVSEISDDENIKPAATWLPHSGPVHSLAFEYPWLVSASSDGRIALIDLRKILTPLNSSKRRFRVKPFDPSTVEPPQRMLHGFGCYLFSVGIGADRIICGGEDGSVRVWNFSEALEIEKKAQALRSLRQENRMRRRKAQVEMNANGRRVDHCSVAMKRNPLKGDKSVTWQIKRPISDKVKS

SEQ ID NO: 128869 - protein, 156 aa, Triticum aestivum
  unsure (1)..(156): unsure at all Xaa locations
  Clone ID: PAT_TA_23287.pep
MTKDVASGDTQSPIKLIELLLKLSSPAASSRVIGKNKRGRPQGAGGAYECGGGGRRFATFQXALGGHRTSHERPRVRAHGLELLLGARPGKARAPMQLHRCGTCRHAFPTGQALGGHMRRHRPGVAAGDVDGDGHVVVDLVPVCVRLSMTMPIGLL

SEQ ID NO: 128870 - protein, 118 aa, Triticum aestivum
  Clone ID: PAT_TA_23288.pep
MKRTDNNNSSVVNEGQEVFHSDDWAGHFETKRLGRGVQDELIQKTDLPDDAGSRAQSDEADSKTASQYVSALLEEPRAVSAPAEPARAQMHDEQLSSSPPEWEHVLKEDFFLPGNHLK

SEQ ID NO: 128871 - protein, 256 aa, Triticum aestivum
  unsure (1)..(256): unsure at all Xaa locations
  Clone ID: PAT_TA_23289.pep
MKSLNRASPSHSAVHQNSDALVNRPGHEASTNQSSDYANGSAPDISRLSLASSEARESSLEERHAGSNVQTSEQSTDEAFQASLLNGDSQDHVGSSSVNGSLPNSGQLDGECDDANGMVRVPGDRTNYSSDASGEVADGGPSVSSAPQRENVMLPRLGDLRMRGQFVRRQPSDRGFPRITSPSSMDARGDLSAIENQVRKLIDDLRSDSIEAQRSATSEIRLLAKHNMENRIVIXNCGAINLLVGLLHSTDAKIQE

SEQ ID NO: 128872 - protein, 142 aa, Triticum aestivum
  Clone ID: PAT_TA_23290.pep
RHRGLFRSGRGVYPPLATSNTATQRRPPLATSNTATRRRPINPPLPLATTPLSCPQRAGRRCRFSGERGGGGSAQDDLPGSAHLIRSASRRTPLKAMWILWTKGRRLPKSRGEEMWSRGHRARDRCGFQGFVGKEKKDGRVG

SEQ ID NO: 128873 - protein, 232 aa, Triticum aestivum
  unsure (1)..(232): unsure at all Xaa locations
  Clone ID: PAT_TA_23291.pep
GHIGSHITTERSQDFYLKILLYSSYSWFSIRRGNHHKSKNFQYNTXRTFTXSRQGVRAEEKRGEKFSYSRPKTRCGCDARMKISLTNGIYNVYEFKEAHNHSLATGNMPQYLRSHRNRATKVTAEEGGPAARPRSASPGDGSCGLQGRRAARLRSHWAEGRHGRRDGEQFADERRARGTTEMTRSPRKTTSRMSQLAAMSRTLLLGHASKSRSRRSPSRCLPAVEKLLLWLW

SEQ ID NO: 128874 - protein, 114 aa, Triticum aestivum
  Clone ID: PAT_TA_23292.pep
PTRPRISSPLPVAICLRRPEPRRAFDPLLLLPPALDRITLTAWIGPPGVAEEKERRGLERGLGACGGGGGGGSSRACRLQRRLGGGVEVEHLAHSRSGRGQRFGGQQCTVAELW

SEQ ID NO: 128875 - protein, 265 aa, Triticum aestivum
  unsure (1)..(265): unsure at all Xaa locations
  Clone ID: PAT_TA_23293.pep
GTRPTGRLPRVLHSGKPDGLMDEIPTFVVDPLPAGKDRGYIVLNRPWAFVQWLQRAKIEEEYILMAEPDHIFVKPLPNLAFDNDPAAFPFFYITPSEHEKIIRKYYPEERGPITNVDPIGNSPVIIKKTLLEKIAPTWMNVSLEMKEDQETDKAFGWVLEMYAYAVASALHGVQHILRKDFMIQPPFDKKLDNTFIIHFTYGCDYTLKGVLTYGEIGEWRFDKRSYQDRPPPRNLTLPPXXGVPTNGVTLVKRAMKLPQTFXRWG

SEQ ID NO: 128876 - protein, 151 aa, Triticum aestivum
  Clone ID: PAT_TA_23294.pep
DPRGVVAEALLNTDRRHRADLYDDVEWIWSMQGTSADRARWGRTCLAGSHWSMRAFVLVRVVVAMAGAGRGRRIQRRGGWSAPSPMTASDSDVQTAGPAAGSGAVQVRSWARRGTAPAAVRERTSVAAPAMGERRRASVRDREDMGSRRGF

SEQ ID NO: 128877 - protein, 245 aa, Triticum aestivum
  unsure (1)..(245): unsure at all Xaa locations
  Clone ID: PAT_TA_23295.pep
MASKGERDVEIHVSSPPPDDRDAARPLLPAACEAYSVSAAILPFFFPALGGLLYGYDIGATSGATISLKSPTSSGTAWYDLSSVQTGLVVSGSLYGALIGSATAFTIADFLGRRRELVVSSIMYLIGALLTAVAPNFLIMVVGRFLYGIGIGLAMHAAPMYIAETAPSQIRGMLISLKEFFIVLGMLLGYIVGNLFVEVISGWRYMYATSAPICVIMGIGMCWXPXSPRWLCIANKEKEAGKEMC

SEQ ID NO: 128878 - protein, 54 aa, Triticum aestivum
  Clone ID: PAT_TA_23296.pep
DSGPIVLAFGIGGPGGGPYGGGGGGGGGPRGPRTLSDLRSNDQSSLPACGSCCG

SEQ ID NO: 128879 - protein, 266 aa, Triticum aestivum
  unsure (1)..(266): unsure at all Xaa locations
  Clone ID: PAT_TA_23297.pep
MASRIASRLLRRSSPTLGLLRSYAHXXNYSSQLSGLIPVGPQSSKLTRRNNYFPNASPYQLWSRSFASDNGDKFEAVVPFMGESVTDGTLANFLKKPGDRVEADEAIAQIETDKVTIDVSSPEAGVIEKFIASEGDTVTPGTIVAIVSKSAAPAETHVAPSEEAPQKESPPVKAEEKSPKAEEKPTKVEPPKKQAPKPTPSKTSPTEPQLPPKERERRVPMPRLRKRIANRLKDSQNTFAMLTTFNEVDMTNLMKLRSDYKDEFVK

SEQ ID NO: 128880 - protein, 56 aa, Triticum aestivum
  Clone ID: PAT_TA_23298.pep
TMISTLNLFAVPLFVRLNMYNLWSACLMWIEVFYFFTVYACFVFSCVFFVIPEVCN

SEQ ID NO: 128881 - protein, 70 aa, Triticum aestivum
  Clone ID: PAT_TA_23299.pep
QVVYSDDDKTLAKQREEIKRMTAEFDQSMKDISKNLDDMDLAERRSKEDLANFHRRLDNMQKLLVNYARV

SEQ ID NO: 128882 - protein, 51 aa, Triticum aestivum
  Clone ID: PAT_TA_23300.pep
RERVEEKEGIPPVQQRLIYAGKQLADDKTAKDYNIEGGSVLHLVLALRGGY

SEQ ID NO: 128883 - protein, 110 aa, Triticum aestivum
  unsure (1)..(110): unsure at all Xaa locations
  Clone ID: PAT_TA_23301.pep
GNNRSVMPLDVLGRTRATLMYSTSIXPWPTGPGNLGKFHRDGDRSLQLLVFNEECLVSASHQLALTTSLPFVHTARRSYRLNGPVKCSDRXRRGRFAAPDVARSPLNLII

SEQ ID NO: 128884 - protein, 169 aa, Triticum aestivum
  unsure (1)..(169): unsure at all Xaa locations
  Clone ID: PAT_TA_23302.pep
SWDTTLSSYCDMQRVLFEEEQSAYNQAMLQEYLXMGKMHPLTSMHHTSTYNASLCKLMEYCLTPAITVLQXDRFERKRTSGWAMLVEEHKQLEAEQSTKTGLLTVRCPEGLPMGITSPKGPRTITFKQDKGAYNPNTTEEVPDALLPILHGGYPILGLPDLLERKLSSG

SEQ ID NO: 128885 - protein, 54 aa, Triticum aestivum
  Clone ID: PAT_TA_23303.pep
IRMYLILKRDLIHPYYDKFKTRILRRREYFRRLKSEVGVLTTTHPYMFITLPSN

SEQ ID NO: 128886 - protein, 145 aa, Triticum aestivum
  Clone ID: PAT_TA_23304.pep
MAAPRAVVLCVLLAVAVANAEAASVIVGLAKCADCTRKSMKSEEAFKALQVAIKCKNSAGEYESKAVGALNGTGAFSVPLAADLHGADCVAQLHSASSNAPCPGQEPSKIVPVSEGSTYGVVAGDNTGTPSAASPECAFMSLCRP

SEQ ID NO: 128887 - protein, 84 aa, Triticum aestivum
  Clone ID: PAT_TA_23305.pep
KKWLPIYWTPYFLLGFVKIQFDKLDPSVWFITFLILSFVLSICRCCLTVKGLTEKFKEKDTSYSGSATFSYEAFMLTVLPFIIA

SEQ ID NO: 128888 - protein, 221 aa, Triticum aestivum
  unsure (1)..(221): unsure at all Xaa locations
  Clone ID: PAT_TA_23306.pep
MRECISIHIGQAGIQVGNACWELYCLEHGIQPDGQTNGDKTIGGGDDAFNTFFSETGAGKYVPRAVFVDLEPTVIDEVRTSAYRQLFHPEQLISGKEDADNNFARGHYTIGKEIVDLCLDRIRKLADNCTGLQGFLVFNADGGGTGSGLGSLLLERLSVDYGXRSPSLGFTAYPSPXVSTSVVEPYNSVPATHSLVEHTDASILLDNEAIYDIWQRSWTIR

SEQ ID NO: 128889 - protein, 152 aa, Triticum aestivum
  Clone ID: PAT_TA_23307.pep
MSLIAGEEFQHILRVLNTNVDGKQKIMFALTSIKGVGRRFSNIVCKKADIDMNKRAGELSAEEMDRLMAVVHNPRQFKVPDWVLNRKKDYKDGRFSQVVSNAVDMKLKDDLERLKKIRNHRGLRHYWGVRVRGQHTKTTGRRGKTVGVSKKR

SEQ ID NO: 128890 - protein, 181 aa, Triticum aestivum
  unsure (1)..(181): unsure at all Xaa locations
  Clone ID: PAT_TA_23308.pep
MRECISIHIGQAGIQVGNACWELYCLEHGIQPDGQTNGDKTIGGGDDAFNTFFSETGAGKYVPRAVFVDLEPTVIDEVRTSAYXQLXHPEQLISGKEDAANNFARGHYTIGKEIVDLCLDRIRKLADNCTGLQGFLXFNAXRGGTGLASVVLLDACRDYGRSQLGYRVPPSGVPCGRPHQG

SEQ ID NO: 128891 - protein, 124 aa, Triticum aestivum
  Clone ID: PAT_TA_23309.pep
TQPAKLLLSLRHLRSSRPFHLLFHNRPPSRSEGLRTDQPPPHHGVRRGVPGSLAVTQCGADLGVRPHQAFDALMAPSTRYRDERAVFCLLRLPRTTDATSSHRLAQHQHRPLLTGNPPFPACQI

SEQ ID NO: 128892 - protein, 52 aa, Triticum aestivum
  Clone ID: PAT_TA_23310.pep
APGAYDKKAPPGYVRNVVADPDAAPLARASSTEVKYTSAFSDENPNAACAVM

SEQ ID NO: 128893 - protein, 72 aa, Triticum aestivum
  Clone ID: PAT_TA_23311.pep
STNTCMLLVYVRPCLVPNKSPTYKLKSVKVTYFVKRTYSLRSELLIAEMNVSTCILVLDTSISETSNSERRE

SEQ ID NO: 128894 - protein, 160 aa, Triticum aestivum
  Clone ID: PAT_TA_23312.pep
GSAMNVVGSLCVYAAICCKEGATPRWPGSRVAWEGFTDASDADLVAEHEIWAAVDPFTKNEAFNCSNRDVFKWKQLWPMLADHFGLEWAGYEGEDGRFIIADAMARKEAVWAEIVQENELVTTELKEITNWWFVDAVLNFEVEHLDSMNKSKEHGFLGFR

SEQ ID NO: 128895 - protein, 98 aa, Triticum aestivum
  Clone ID: PAT_TA_23313.pep
DQEQWLMISIIRLLHIGVTLFSLSMTLLNLCDCVNNRCTYVTALQEEKKTQLQLAPGSEKLQAPSPHLFQTYALYSVAELLIFSELLPLSRNTCHQNG

SEQ ID NO: 128896 - protein, 69 aa, Triticum aestivum
  Clone ID: PAT_TA_23314.pep
LTLELSKLLISPIICTGLLSNIDESVASESFFSSLVFVIAASCFILSICRQRRPYVRYIRESDLLGHLN

SEQ ID NO: 128897 - protein, 53 aa, Triticum aestivum
  Clone ID: PAT_TA_23315.pep
AWSRPRYICYSLTGKKTQLQLAPGSKKLRAPSPHLFQIDAPYCVAELLIFSEL

SEQ ID NO: 128898 - protein, 121 aa, Triticum aestivum
  Clone ID: PAT_TA_23316.pep
RPRSSPRPPSPWSSPRPWSAWPPRPTRPPCRPPPAPPPRRPPPAPPAPPRPSPPCSSPPRRSATSSARRAPIWRPVWCRGARAHALLFWHLLLWVHGRSGATSFLGSRSVVDGVCTVTILN

SEQ ID NO: 128899 - protein, 88 aa, Triticum aestivum
  Clone ID: PAT_TA_23317.pep
KSCTIFLPFHLRLDRHSLSWYMKRLSGILRFSYYKIIVSNCSKIIRFRIRLDCQTHAVEYKTITVEKKEKQLSIMTEAIKQVSIMTHE

SEQ ID NO: 128900 - protein, 65 aa, Triticum aestivum
  Clone ID: PAT_TA_23318.pep
IGHRGGGDMRFREEMLLPAYTSSYVSTRLDLPYSPRFTVLLVVPRPLAPACFFCCTMLILLLVSI

SEQ ID NO: 128901 - protein, 116 aa, Triticum aestivum
  unsure (1)..(116): unsure at all Xaa locations
  Clone ID: PAT_TA_23319.pep
GYIIVYKFIQDLHFFVTXGDEENELILASVLQGFSDAVGILLRNNVDKRTALENLDLIFLCLDEVVYGGIVLETDGNVIAEKVSGHGLEGAGSFTEQTISQALATAREHFARSLLK

SEQ ID NO: 128902 - protein, 87 aa, Triticum aestivum
  Clone ID: PAT_TA_23320.pep
FSTLPGLHSDHVDLNCFFKVCRRIRCARPVSSNFAPRAGAAASETRVPARLPAIHGCRRGCERDTGPGAAASETQVSNLYTVRFWLN

SEQ ID NO: 128903 - protein, 116 aa, Triticum aestivum
  Clone ID: PAT_TA_23321.pep
VHRCTGVTEILGAPSHPRYPAVVNDERLHEHVENVGRSLLGPDKVKPGEKIMAGEDFAFYQQLVPGVMFGIGIRNEKVGSVHSAHNPHFFVDEDVLPIGAALHTATAEMYLSGRSA

SEQ ID NO: 128904 - protein, 131 aa, Triticum aestivum
  Clone ID: PAT_TA_23322.pep
AGFAAGSPRTSLSLFTNPSRWPRHVFTFQNWRGIFERFDRDRSGRIDAPELRDALLDLGYSVSPTVLDLLVSKFDKTGGKNKAVEYDNFIECCLTVKGLTEKFKEKDTAYSGSATFGYEAFMLTVLPFLIA

SEQ ID NO: 128905 - protein, 62 aa, Triticum aestivum
  Clone ID: PAT_TA_23323.pep
VISRLSAQSFSLFLHLNHLLKMSNIRTYSVRSELLVSEMDVSRIKICLDTSISATSNSERRE

SEQ ID NO: 128906 - protein, 165 aa, Triticum aestivum
  unsure (1)..(165): unsure at all Xaa locations
  Clone ID: PAT_TA_23324.pep
MTSAMSWWWAGAVGAVKKSQDESAASSFQSVALVVGSTGIVGTSLVDILPRQDTPGGPWKVYAVSRRPLPPWCPPPSPAVTHLQIDLADPAAVAEALTPLADITHVFYAAWSSHPTEAQNREANSAMLRNVLSVVVPGCPALAHVCLQTGRKHYVGPXEAVGKLG

SEQ ID NO: 128907 - protein, 97 aa, Triticum aestivum
  unsure (1)..(97): unsure at all Xaa locations
  Clone ID: PAT_TA_23325.pep
SRWVLNDRLGKKXVRVKCNEDDTIGDLKEVGGGARRGRAPEKIRIQEVGTTSNKDHITSKDYEVHDGXGLRLYYNTAALSPLLKLADSHGSSLPVFN

SEQ ID NO: 128908 - protein, 193 aa, Triticum aestivum
  unsure (1)..(193): unsure at all Xaa locations
  Clone ID: PAT_TA_23326.pep
MAAPRALALCVLLAIAVANAEAASVVVGLAKCADCTRKNMKAEEAFKALQVAIKCKNSAGEYESKAVGALDGTGAFSVPLASDLHGADCVAQLHSAASNAPCPGQEPSKIVPVSDGTTYGVVAGENTATSSAASPECASMTLCGPXIKKHIIEHFXTIKKPVPPKPEAQSPSPTRTYGPRAPSPEPKAASPEL

SEQ ID NO: 128909 - protein, 95 aa, Triticum aestivum
  Clone ID: PAT_TA_23327.pep
PTVIDEVRTSAYRQLFHPEQLISGKEDAANNFARIDHKFDLMYAKRAFVHWYVGEGMEEGEFSEAREDLAALEKDYEEVGAEGGDDEDGEEDDDY

SEQ ID NO: 128910 - protein, 166 aa, Triticum aestivum
  Clone ID: PAT_TA_23328.pep
MAAPRALVLGVLLLIAVSNTEAASVVVGMAKCADCTRKNMKAEEAFKGLQVAIKCKSVHGDYESKAVGALDRTGAFSVPLAADLHGADCVAQLHSAASEGTTFGVVAGAKTNVLASPECASATLLGPIKKHIIEHFHHKKPVPPKPEPKPQPHPDYGPVPKPEPKP

SEQ ID NO: 128911 - protein, 120 aa, Triticum aestivum
  Clone ID: PAT_TA_23329.pep
MQGDQAEKRGKVKKGWLAVRVGQAEQQGDGFRRFVIPIAYLYHPLFQRLLEAARDTYGYNSAGPLWLPCSVDEFLRLRALVDRETAHSHSSSSHRVHVQAGGHQQHGYSFAPCTRAKVTS

SEQ ID NO: 128912 - protein, 103 aa, Triticum aestivum
  Clone ID: PAT_TA_23330.pep
FNLIFLLFPYTTNNFQILSSERGEQGLILHASRFAFGSCGFELFLQSLPSDQVCEACFFKLCPRCRRGCQRDTGAGEASSDPRVPARLRARHRSRRGTVRLVV

SEQ ID NO: 128913 - protein, 69 aa, Triticum aestivum
  Clone ID: PAT_TA_23331.pep
IHSFLRQVIPNGGSNFVGRIIQELFGCPTHTLQNFDEGLVCFNRTLFYRVDTLNKLLTNFIFVKKKKKK

SEQ ID NO: 128914 - protein, 179 aa, Triticum aestivum
  unsure (1)..(179): unsure at all Xaa locations
  Clone ID: PAT_TA_23332.pep
MSLIAGEEFQHILRVLNTNVDGKQKIMFALTSIKGVGRRFSNIVCKKADIDMNKRAGELSAEEMDRLMAVVHNPRQXFKVPDWXLNRKKDYKDGRXSQVVSNAVDMNSRMTFKRSRNQEHRGLRHYWGXFRGQHTKTTGRRGXTVGVSKNDNSDKDLHTCIRLVINLRCPVNDTWIFCL

SEQ ID NO: 128915 - protein, 148 aa, Triticum aestivum
  Clone ID: PAT_TA_23333.pep
SFCLALVNDWRRRRLENLLRPPLWSASVHRSCLLRPATATPPALLPSTLCPSRWGDGTGVAILLLPRSRLHPQDLHLPMMTTARRSCSSSSKIQEPPLLFEFCITRTNTEEHPSFAVVFLPDYPDLTTKPIDSIIDAVLLSHQLLMYC

SEQ ID NO: 128916 - protein, 112 aa, Triticum aestivum
  unsure (1)..(112): unsure at all Xaa locations
  Clone ID: PAT_TA_23334.pep
NGKIHVPGQANNAYIFPGFGLGVVMSGAIRVHDDMLLAASEALAQQVTEENFEKGLIYPPFSNIRKISAHIAASVAAKAYELGLXASRRPRPKDLVKYAESCMYSPIYRNYR

SEQ ID NO: 128917 - protein, 147 aa, Triticum aestivum
  unsure (1)..(147): unsure at all Xaa locations
  Clone ID: PAT_TA_23335.pep
GASKTYPQXQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDDVLLGQIKTGFADGKDLILSVMSAMGEEQICAVKEIGGGK

SEQ ID NO: 128918 - protein, 237 aa, Triticum aestivum
  unsure (1)..(237): unsure at all Xaa locations
  Clone ID: PAT_TA_23336.pep
ASWWWEGAVGAVKKSQEERTELSFQSVALVIGSTGIVGTSLVDILPRDDTPGGPWKVYAVSRRPLPPWSPQPSPAVTHLLLDLADPVAVAEALKPLTDITHVFYAAWSSHPTEAQNREANSAMLRNVLSVLVPGCPALAHVCLQTGRKHYIGPYEAIGKIPVPDPPYTEDMPRLDYPNFYYDQEDVLFEEVSRRDGAVSWSVHRPSVVFGFSPRSAMNVVXSLSVYAAICRKEGAML

SEQ ID NO: 128919 - protein, 177 aa, Triticum aestivum
  unsure (1)..(177): unsure at all Xaa locations
  Clone ID: PAT_TA_23337.pep
TEAGRQAPQQLHSPPIIPRSSRRSPHRPISTPPPATSALRPPAPHPARPSPPLPRPAMSWWWAGAVGAVKKRQDERAAAAEPTFQSVALILGSTGIVGTSLLDILPRDDTPGGPWKVYAVSRRAPPGWSTPPPSPAVTHLXLDLADAAAVRDALGAAXTDVTHVFYAAWQAQDEDAT

SEQ ID NO: 128920 - protein, 133 aa, Triticum aestivum
  Clone ID: PAT_TA_23338.pep
GRILLNEHWIQDLPYDRTGELQNLVSFVHDNLDLCKWAALATVATQALSLLLAMVLRAMVSPTSSDYDSDEDFVVIRRPLLIAQGAPSYLPTTADPRGVHPNLWSSSMRQKYGLNSSGDYTYNTLGQNAAPPQ

SEQ ID NO: 128921 - protein, 152 aa, Triticum aestivum
  Clone ID: PAT_TA_23339.pep
MSLIAGEDFQHILRLLNTNVDGKQKIMFAMTSIKGVGRRFSNIVCKKADIDMNKRAGELTPEELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 128922 - protein, 70 aa, Triticum aestivum
  Clone ID: PAT_TA_23340.pep
DPISWSSCCHEEQQVHAHPHARCRSLLRSGFRKTESQDSGTRPHPYCVLISTRARFLSQFVFLYLNDLVI

SEQ ID NO: 128923 - protein, 108 aa, Triticum aestivum
  Clone ID: PAT_TA_23341.pep
MEDEAATKRRRTEGHSGLSDEPGLSSFHMEDFPEDIRPVILSLLSLKEVARTSIVSRNWTKLWMHHPNLCFDGTKDRSTDEDSVKIERAKFIETVNSIIQLSVTRRSC

SEQ ID NO: 128924 - protein, 158 aa, Triticum aestivum
  Clone ID: PAT_TA_23342.pep
QRILLLQYDKEMEAIDFRHYSIKLQPVGVSRKIRKLMQNNQVPDLRDLKDVSDYVTKAGYGSESEPDDEAATVSLASDIDKLNRASRKSAVRLQEIGPRMTMRLVKVESGLCSGDILYPQSVGKEDVKEGQEEEEIEDAGDMMELDDGTEEDDWVDEE

SEQ ID NO: 128925 - protein, 208 aa, Triticum aestivum
  Clone ID: PAT_TA_23343.pep
MVAPRALVLAVLLAIAVANAEAASVVVGLAKCADCTRKNLKAEEAFKGLQVAIKCKNVHGEYESKAVGGLDGTGAFSVPLAADLHDADCVAQLHSAASNAPCSGQEPSKIVPASEGTTFGIVAGDSIATRSAASPECASMTLCGPIKKHIIEHFHHKQPVPPKPEPKPQPHPDYHPVPKPQPHPDYHPVPPTPTYGGGGGGGGYHGHH

SEQ ID NO: 128926 - protein, 213 aa, Triticum aestivum
  unsure (1)..(213): unsure at all Xaa locations
  Clone ID: PAT_TA_23344.pep
MATPRALALCVLLAMAVANTEAASVVVGLAKCADCTRKNMQTEEAFKAVQVAIKCKNSAGEYESKAVGGLDGTGAFSVPLAANLHGADCVAQLHSAVSNAPCPGQEPSKIVPVSEGTTYGVVAGENAATPSAASPECASMTLCGPIKKHIIEHFHHKKPVPAEAGSPKPKPHPXTAPCPKPEPKPQAPPGLPPSPSHAPPTAGGGGGGYHGHH

SEQ ID NO: 128927 - protein, 93 aa, Triticum aestivum
  Clone ID: PAT_TA_23345.pep
MAAQDTPMITEDDYETQQKKQAAADVLFNYSQFVMVCIGEGVRPTDLRLHLMKEISGMPTSLKEEPRQAAASPDSSGEPSSSGTMKEDRSEIP

SEQ ID NO: 128928 - protein, 133 aa, Triticum aestivum
  Clone ID: PAT_TA_23346.pep
MQEIELLWIGFLDSTTPSVWNYLSQKWMYLNGILVLDTSIFATSNSERREYLLQALNRTSLYWPVARPLHKRQDRVETTGFFVPSYTAIAAGRDFARFFRKITPAGCPFSLQTVQNLDRASLTSYPGLLVPNS

SEQ ID NO: 128929 - protein, 57 aa, Triticum aestivum
  Clone ID: PAT_TA_23347.pep
MLFHFTVFIWLNYLYNLAELPLQGLTEKFKEKDTAYSGSATFGYEAFMLTVLPFLIA

SEQ ID NO: 128930 - protein, 152 aa, Triticum aestivum
  Clone ID: PAT_TA_23348.pep
CKWGTYGKYNVKIRKDTRDKHQFCLRAVEVQCNESGKVHSVLHIEYPDWPDHGVPTSTDAVRQIQKRLHHIPREHPIVAHCSAGIGRTGAYITIHSSIERILLGDTSSYDLVETVKKFRSQRTGMVQTEQQYMFCYRAIADELKDLLSSSGH

SEQ ID NO: 128931 - protein, 150 aa, Triticum aestivum
  unsure (1)..(150): unsure at all Xaa locations
  Clone ID: PAT_TA_23349.pep
MSLIAGEEFQHILRVLNTNVDGKQKIMFALTSIKGVGRRFSNIVCKKADIDMNKRAGELSAEEMDRLMAVXVHNPRQFKVPDWSSNKKKDYKDGRSPKSSPNAVGHELKDDLRGQEDKEHRXLRHXWGXRFRGQHTKIREEKKDVGSQKG

SEQ ID NO: 128932 - protein, 211 aa, Triticum aestivum
  Clone ID: PAT_TA_23350.pep
MAVSRALVLGVLLAIAVANAEAASVVVGQVKCADCTRKNLKAEEAFKDLQVAIKCKNVHRDYESKAVGALDRTGAFSVPLAADLHGANCVAQLHSAASNAPCSGQEPSKIVPVSEGTTFGVMAGANTATLSAASPECASMTLCGLIKKHIIEHFHHKKPVLPKPEPKPQPHPDYGPVPKPEPKPQPQPDYHPVPPTPTYGGGGGGGYHGHH

SEQ ID NO: 128933 - protein, 104 aa, Triticum aestivum
  Clone ID: PAT_TA_23351.pep
MEAKFFRFLKLVGVGFKARTEREGRELFLKLGYSHEVQFTAPPAVRVFCFKPNIICCTGIDKHRVHHFAGAVRCSKPPEVYKGKGILYIDEVIKLKPGKKQQKK

SEQ ID NO: 128934 - protein, 217 aa, Triticum aestivum
  Clone ID: PAT_TA_23352.pep
ALVLGVLLAITVANAEAASVVVGLAKCADCTRKNIKAEEAFKGLQVAIKCKNNAGDYESKAVGALDGTGAFSVPLAADLHGADCVAQLHSAASNAPCPGQEPSKIVPVSEGTTFGIVAGNNIATPSAASSPECASMTLCGPIKKHIIEHFHHKKPVPPKPEPKPEPHPDYGPRAQAGVQAAAPPRLPPRPSHAYIRWRRWWIPRSPLTPICHHPAQH

SEQ ID NO: 128935 - protein, 214 aa, Triticum aestivum
  Clone ID: PAT_TA_23353.pep
LTPAMSWWWAGAVGAVKKSQEERTEPSFQSVALVVGSTGIVGTSLVDILPRHDTPGGPWKVYAVSRRPLPPWSPPPSPAVTHLHLDLFFPVAVAEALTPLTDITHVFYAAWSSHPTEAQNREANSAMLRNVLSVVVPGCPALAHVCLQTGRKHYIGPYEAIGKIPVPDPPYTEDMPRLDYPNFYYDQEDVLFEEVSRRDGAVSWSVHRPSAVFG

SEQ ID NO: 128936 - protein, 207 aa, Triticum aestivum
  Clone ID: PAT_TA_23354.pep
MAAATSSSLLGRRFLLLSRRFVASPLRSLSTTAPPSSHSAAGSDAEPDPEPPADQGNQYRSQPRPPITTRPLENGLDHGIYKAIMVGKVGQEPVQKRLRSGKTVVLFSLGTGGIRNNRRPLDNEEPHQYAERSSVQWHRVCIYPDRLGSLALKHVKTGSVLYLEGNIETKVFSDPITGLVRRIRKIAVRGNGRFLFLGNDGNGPKDK

SEQ ID NO: 128937 - protein, 236 aa, Triticum aestivum
  unsure (1)..(236): unsure at all Xaa locations
  Clone ID: PAT_TA_23355.pep
MTAPRALVFAVLLAIAVANAEAASVVVGLAKCADCTRKNIKAEEAFKGLQVAIKCKNVHGDYESKAVGALDGXGAFSVPLAADLRGTDCVAQAPQRLPPTRRAPAKEPSKIVPVSEGNNFGVIAGRXHRHAIRGVARVCXSMTLCGXIKKHIIEHFHHKKPVPPKPEPKPQPHPEYHPVPKPEPKPQPHPRLPPRPSHAHLRRRRWRWIPRTPLTPVIQSTTHPPSTEVPMVSCFE

SEQ ID NO: 128938 - protein, 73 aa, Triticum aestivum
  Clone ID: PAT_TA_23356.pep
MIEVVLNDRLGKKVRVKCNEDDTIGDLKKLVAAQTGTRAEKIRIQKWYTIYKDHITLGDYEIHDGMGLELYYN

SEQ ID NO: 128939 - protein, 210 aa, Triticum aestivum
  unsure (1)..(210): unsure at all Xaa locations
  Clone ID: PAT_TA_23357.pep
MAAPRALVLAVLLAVAVANAEAVSVVVGLAKCADCTMKNIKAEEAFKGLQVAIKCKNNAGDYESKAVGALDGTGAFSXVPLAADLHGXDCIAQLHSAASNAANAPXPRKPSKIVPVSEGTTFGVVAGAKTDTVASPECASATLCGPIKKHIIEHFHHKKLVPPKPEPKPQPHPXYGPVPKPEPKPQPHPDYHPVPPTPTYGGGGGYHGHH

SEQ ID NO: 128940 - protein, 388 aa, Triticum aestivum
  unsure (1)..(388): unsure at all Xaa locations
  Clone ID: PAT_TA_23358.pep
MATMAPTCIVFSVIVFLLLSNAITTQAGTFGSGKPKATNLILEACKNASGESQDTGVTKEFCLSTLQLDSRSAKAKDLRDLVVISIDILKGRVSDAGVKVKKMLQNAKKGTLTMYALSICELQYEKVVSTLNICQGTNAGSLPILFRAPPPRPAPSAARSRRAPRAPASKMRECISIHIGQAGIQVGNACWELYCLEHGIQPDGQTNGDKTIGGGDDAFNTFFSETGAGKYVPRAVFDDLEPTVIDEVRTSAYRQLFHPEQLISGKEDAANNFARGHYTIGKEIVDLCLDRIRKLADNCTGLQGFLVFNAVGGGTGSALGSLLLERLSVDYGKKSKLGFTRVPISXVSTSGASPTTGAGHPILVSKPMLHLVDNRAFSNWKRSLDIKR

SEQ ID NO: 128941 - protein, 250 aa, Triticum aestivum
  unsure (1)..(250): unsure at all Xaa locations
  Clone ID: PAT_TA_23359.pep
MARGSRPGRNGGGGGGCARCFLGFLLKFLAFLQVFAAVSAVLYAASILSRWARHHELHFDHLLPDLWFACVVMAAGLLYCAILLAGYVAAEVNSGCCLCFYTILAMAMMLLEAAVAGHLLLNEHWMQDLPYDRTRELENLVSFVNNNLDLCKWAALATVATQVFSLFLAITLRAMVSPTNEDCDSDEDFVVIRRPLLLAQGAPAYLPTTXDPRGAHXLGLWSSSMRQKYGLNSTSDYTYNTLDQNAVPPQ

SEQ ID NO: 128942 - protein, 176 aa, Triticum aestivum
  unsure (1)..(176): unsure at all Xaa locations
  Clone ID: PAT_TA_23360.pep
CDQLWIQPEMKQLSTAFNKLRKLTLRGIFVEFDIIWTLAFLEATPTMEILLIEVWDHACSAFVNDEERRSVFAEXXNPQWEMDFHCSKNGLLKELQFVGFRSLEQQFAFIRALLDRAPNLQAILLKGAEQCKYCDALETKSCCSTESSFPKSEDEQELVARRITDGKSSPRVIFHE

SEQ ID NO: 128943 - protein, 213 aa, Triticum aestivum
  unsure (1)..(213): unsure at all Xaa locations
  Clone ID: PAT_TA_23361.pep
MDAAASSAGQSAARVADLLRGFLAVQQRRAEAYSKLRSGFSEYMANGGECAYQQLCGNVTAEFNDCSTQILEMVSLLSKPSFCRGDLANLLKDVQACERDKLQLTARIQVLKKAGRPSERLVNHEHCRSSSTSQHVCANLKEITEASGTEXAEADAEYDAALKEAIQGIQEAVTSINEHMEEVRYEIDALEADTVDSRLSEVEEAFPDALLIE

SEQ ID NO: 128944 - protein, 206 aa, Triticum aestivum
  unsure (1)..(206): unsure at all Xaa locations
  Clone ID: PAT_TA_23362.pep
MAAPRALVLAVLLAIAVANAEAASVVVGLAKCADCTRKNLKAEEAFKGLQVTIKCKNVHGDYESKAVGALDGTGAFXVPLAADLHGADCVAQLHKRRLQTRGAPGKEPSXIVPVSEGTTFGIVAGDSIATPSTASPECASMTLCGPIKKHIIEHFXHHKKPVPPKPEPKPQPHPDYHPVPPTPTYGGGGGGGYHGHPLTPICHHPA

SEQ ID NO: 128945 - protein, 314 aa, Triticum aestivum
  unsure (1)..(314): unsure at all Xaa locations
  Clone ID: PAT_TA_23363.pep
MAHAGAAKPDPEKKSWADVEEEEEAKAKAEAEAELAAAAASSCSSSSAPIEPVVEAQAKQIEALSLSVPDDDGGAEGPPLLDDSDDSQIQAVTSGGTVYESATTFEDVKLTPELLKGLHDEMGFSRPSKIQAITLPMILTPPYRDLVAQAHNGSGKTTCFVLGMLSRVDPNRKMPQAICICPTRELAQQNKSVLMRMGKFTGITCACATPPAQKDYMPISKMAPVTDQVVIGTSGTLTKWITHKKLATREIKILVFDEAXHMLAEEGFKTDSLRIMKDIQNSAGGCXVLLFSAXFNEKVKEFVTKAIKDGNKYF

SEQ ID NO: 128946 - protein, 209 aa, Triticum aestivum
  Clone ID: PAT_TA_23364.pep
MAAPRALVLAVMLAVAVANAEAASVVVGLAKCADCTRKNIKTEEAFKGLHVAIKCKNVDGEYESKAVGALDGSGAFSVPLAADLHGADCVAQLHNAASNAPCSGQEPSKIVPVSEGTTFGVIAGAKTNALASPECASTTLCGPIKKHIIEHFHHKKPVPPKPEPKPQRHPDYHPVPKPEPKPHPHPDYHPVPPTPTYGGGGGGGYHGHH

SEQ ID NO: 128947 - protein, 73 aa, Triticum aestivum
  Clone ID: PAT_TA_23365.pep
MIEVVLNDRLGKKVRVKCNEDDTIGDLKKLVAAQTGTRPEKIRIQKWYNIYKDHITLKDYEIHDGMGLELYYN

SEQ ID NO: 128948 - protein, 190 aa, Triticum aestivum
  unsure (1)..(190): unsure at all Xaa locations
  Clone ID: PAT_TA_23366.pep
AAPRASLVLALLLAIAVANAEAASVVVGLAKCTDCTRKNIKAEEAFKGLQVAIKCKNVNGEYESKAVGALDGTAPXAASNAPCSGQEPSKIVPVSEGTTFGVVAGAKTNALASPECASATLCGPIKKHIIQHFHQKKPVPPKPEPKPQPHPDYGPVPKPEPKPQPHPDYHPVPPTPTYGGGGGGGYHGHH

SEQ ID NO: 128949 - protein, 190 aa, Triticum aestivum
  unsure (1)..(190): unsure at all Xaa locations
  Clone ID: PAT_TA_23367.pep
LTPAMSWWWAGAVGAVKKSQDERAASSFQSVALVVGSTGIVGTSLVDILPRHDTPGGPWKVYAVSRRPLPPWSPPPSPAVTHLHLDLADXSPVAEALTPLTDITHVFYAAWSSHPTEAQNREGNSAMLRNMLSVVVPGCPALAHVCLQTGRKHYIGPYEAIGKIPIPDPPYTEDMPRLDYPNFYYDQEDV

SEQ ID NO: 128950 - protein, 146 aa, Triticum aestivum
  unsure (1)..(146): unsure at all Xaa locations
  Clone ID: PAT_TA_23368.pep
LPSISCVLLNTNVDXGKQKIMFAMTSIKGVGRRFSNIVCKKADIDMNKRAGELTPDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 128951 - protein, 139 aa, Triticum aestivum
  Clone ID: PAT_TA_23369.pep
KPPPPPINPMALRSIARKLPALGARSPPMGPRIGPVHALSPAAGSRLMSHGGSGTGGQVVYSDDDKTLAKQREEIKRMTAEFDQSMKDISKNLDDMDLAERRSKEDLANFHRRLDNMQKVVNVALIVLVPTSIMIFLSL

SEQ ID NO: 128952 - protein, 107 aa, Triticum aestivum
  Clone ID: PAT_TA_23370.pep
GFLSLFVFYLCLFYRGRNCRNFYSKPVLLHHMHRTITLSDENSKTYLIWPQRQFIHHIQGKSTTTVYRPSSSSKRILPPSQNRLQKRLTLWDEGSTPPSGNTCYQNE

SEQ ID NO: 128953 - protein, 328 aa, Triticum aestivum
  unsure (1)..(328): unsure at all Xaa locations
  Clone ID: PAT_TA_23371.pep
MSWWWAGAVGAVKKRQDERAAAAEPTFQSVALILGSTGIVGTSLLDILPRDDTPGGPWKVYAVSRRAPPGWSTPPPSPAVTHLQLDLADAAAVRDALTPLTDVTHVFYAAWSSHETEDRNXEDNAGMLRNVLSVVVPNCPALAHVCLQTGRKHYVGPFEAIGKIPAPDPPYTEDMPRLDHPNFYYDLEDVLFDHVSGRDGAVTWSVHRPTVIFGFSPRSAMNVVGSLCVYAAICRKEGATLRWPGCKVAWEGFTDASDADLVAEHEIWAAVDPFAKNEAFNCSNGDVFKWKQLWPMLAERXRVGWARYEGRGQXVGLADAMTGKEAVW

SEQ ID NO: 128954 - protein, 161 aa, Triticum aestivum
  unsure (1)..(161): unsure at all Xaa locations
  Clone ID: PAT_TA_23372.pep
MSDSEEHHFESKADAGASKTYPQQAGTVRKNGFLVIKGRPCKXVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDIGPK

SEQ ID NO: 128955 - protein, 240 aa, Triticum aestivum
  unsure (1)..(240): unsure at all Xaa locations
  Clone ID: PAT_TA_23373.pep
MRVGSRVVVLVRDSAGYGAALADALRPSPGLTRGSSPFDLPLDKYGLNGEKASGXLVSFSDSSGSPQVSFFVLPDYRPPVAACAMNEILALISSEAPSIQPILIVPFITRPSGCFHGMVNATKTGQLTTLHAAEIGASNEFTHLLVDGIIKPPPSLQIRGEPIQCLLEMVRVLKIPTVLLVTSGGQHQGKSSSDSDLEVLQCVGDHVAKHINLEFSKETVIETGVEKSASIQEPWRELYL

SEQ ID NO: 128956 - protein, 241 aa, Triticum aestivum
  Clone ID: PAT_TA_23374.pep
DPRVRAALILEDEQEISDDMIPLSIGFESSKGIFTKVIPRHSTLPIKRTVKIPTWLDYGERKCIRIFFGEHVMVQHNILLGETQVINNRGSFQGCVYFELTLEVDKDYVVKVRCAGDEVPLSFPINPKDRLKENVDKAVKRALLDWTMTGTEIRARLGNLSKHTMNTLDDVLSVRKDELPEDLCKEALNALADLQKLLDGDLEMLKAKMLSAKSVESKILNWLPPSELRDSDHEDYEYRDA

SEQ ID NO: 128957 - protein, 161 aa, Triticum aestivum
  Clone ID: PAT_TA_23375.pep
MSDSEDHHFESKADAGASKTYPMQAGAIRKGGFLVIKNRPCKVVEVSTSKTGKHGHAKCHFVALDIFNGKKLEDIVPSSHNCDVPHVDRQDYQLIDITDDGYVSLLTESGNTKDDLKLPTDDVLLGQIKTGFADGKDLILSVMSAMGEEQICAVKEIGGGK

SEQ ID NO: 128958 - protein, 104 aa, Triticum aestivum
  Clone ID: PAT_TA_23376.pep
MESKFFRFLKLVGVGFKARTEQGGRELFLKLGYSHEVQFTAPPAVRVFCFKPNIICCTGIDKHRVHHFAGAVRSSKPPEVYKGKGILYIDEVIKLKPGKKQQKK

SEQ ID NO: 128959 - protein, 327 aa, Triticum aestivum
  Clone ID: PAT_TA_23377.pep
MAGYPPPPGSGYPYGAAGGYGAPPPSGQKPPKEGKTSSSSGPDPYHGAPPPQQPYGGGGGGYGAPPSYGQKPPKEGKTSYSSGSDPYHGAPPPQQPYGGGGGGGGGYGQQPYGAQPPSSAAPYGGPPAAQPYAGGGAGGYGSPFAALVPSTFPPGTDPNVVACFQAADRDGSGMIDDKELQSALSGFSSQSFSLRTVHLLMYLFTNTNVRKIGPKEFTSVFYSLQNWRGIFERFDRDQSGRIDAPELRDALLDLGYSVSPTVLDLLVSKFDKTGGKNKAVEYDNFIECCLTVKGLTEKFKEKDTAYSGSATFGYEAFMLTVLPFLIA

SEQ ID NO: 128960 - protein, 211 aa, Triticum aestivum
  Clone ID: PAT_TA_23378.pep
MAAPRALVLAVLLAIAVANAEAASVVVGLVKCADCTRKNMKAEKAFKGLQVAIKCKNVHGDYESKAVGALDGTGAFGVPLAADLHGNDCVAQLHSAASNTPCPGQEPSKIVPVSEGTTFGIVAGDNTATPFAASPECASMTLCGPIKKHIIEHFHHKQPVPPKPEPKPQPHPDYSPVPKPEPKPQPHPDYHPVPPMPTYGGGGDGGYHGHH

SEQ ID NO: 128961 - protein, 212 aa, Triticum aestivum
  unsure (1)..(212): unsure at all Xaa locations
  Clone ID: PAT_TA_23379.pep
MVAPRALVLAVLLALAFANAEAASVVVGLAKCADCTRKNLKAEEAFKGLQVAIKCKNVQGEYESKXAVGALDGTGAFSVPLAADLHGADCVAQLHSTASNAPCSGQEPSKIVPVFEGTTFGIVAGDSXPRPSAASPECASMTLCGPIKKHIIKHFHHKQPVPPKPEPKPQPHPDYHPVPKPEPKPQPHPDYHPVPPTPTYGGGGGGGYHGHH

SEQ ID NO: 128962 - protein, 148 aa, Triticum aestivum
  unsure (1)..(148): unsure at all Xaa locations
  Clone ID: PAT_TA_23380.pep
ALAAAVARARTTRRRRRQRRSRCRRRRRWAAWSTGLCDCFDDCGNCCITCLCPXASTFGQVAEIIDRGSTSCGASGALLRAXSMLLNGCQCVYSCFXAPRCAAHYGLQESPCADCCIHWVLQPCALCKNTPAQKGNELGWTQMESKDH

SEQ ID NO: 128963 - protein, 154 aa, Triticum aestivum
  Clone ID: PAT_TA_23381.pep
RRGGNPRFFCLALMNDWRRRLEDLLRPPLKSPPSTAPASSDRRLRRPLPSSLRRSAPRDGVTGPGSPSYYFPDLRLRPQDLHLPMTTTARRSCSSSSKIQEPSLLFEFCITRTNTKEHPSFAVVFLPNYHGLTTKPIDSIIDAVLLSHQLLMYC

SEQ ID NO: 128964 - protein, 107 aa, Triticum aestivum
  Clone ID: PAT_TA_23382.pep
MAYVERGVVKGKRTIWRLSIILDFFKAIVNFIRMFFLTMFSIEKTDSYKKGYGSGKKWDGGPGGGGPGGGPYGGGGGGGGGPRGPRTLSDLRSNDQSSLPACGSCCG

SEQ ID NO: 128965 - protein, 142 aa, Triticum aestivum
  Clone ID: PAT_TA_23383.pep
PQRPPRPDPRPPRPPLALLGSTSPPPCPCRVHWLPCSRRPRQSRGRAWQCSTCPRRRQRRRVLPVPLPPRGRVLLSPNRHPPLCRACRACHMSRMVYTGFTDMWSSRLRMRSTRMRTVHRAVPGSYRANGHHRRAVHALLGR

SEQ ID NO: 128966 - protein, 115 aa, Triticum aestivum
  Clone ID: PAT_TA_23384.pep
GPKEFTSVFYSLQNWRGIFERFDRDRSGRIDAPELRDALLDLGYSVSPTVLDLLVSKFDKTGGKNKAVEYDNFIECCLTVKGLTEKFKEKDTAYSGYATFGYEAFMLTVLPFLIA

SEQ ID NO: 128967 - protein, 427 aa, Triticum aestivum
  Clone ID: PAT_TA_23385.pep
ATPRLPCLFVLLLLLSTASAEYAQELLRRAEGEREWIIGVRRRIHAHPELAFHEHRTSALVREGLERLGVTARAVAGTGVVADVGSGMPPIVALRADMDALPIQELVEWEHKSRVDGVMHACGHDVHTAMLLGAAKLLHERKDQLKGTVRLLFQPAEEGGAGASHMIKEGVLDGVEAIFAMHIDYRMPTGVIAAHAGPTQAAVCFYVVKIEGKTGKAETPHLNVDPIVAAAFTVLSLQQLTSREDDPLHSQVLSVTYIKGGNSVDATPPVVEFGGTLRSLTTEGLYRLQKRLKEVVEGQAAVHRCTGVTEILGAPSHPMYPAVVNDERLHQHVENVGRSLLGPDKVKPGEKIMAGEDFAFYQQLVPGVMFGIGIRNENVGSVHSAHNPHFFVDEDVLPIGAALHTATAEMYLSGRSTQNEDGSVHSL

SEQ ID NO: 128968 - protein, 240 aa, Triticum aestivum
  Clone ID: PAT_TA_23386.pep
MRVASRVVVLVRDAAGYGAALADALRPSPGLTRVSSPFDLPLDKYGLNGEKASGELVSFSDSSGSPQVSFFVLPDYRPPVAACAMNEILALISSEAPSIQPVLIVPFITRPSGCFHGMVNATKTGQLTTLHAAEIGASNEFTHLLVDGTIKPRPSLQIRSEPIQCLLEIVRVLKIPTVLLVTSGGQHQGKSSSDSDLEVLQCVGDHVAKHINLEFSKETVIETGVEKSASIQEPWRELYL

SEQ ID NO: 128969 - protein, 141 aa, Triticum aestivum
  unsure (1)..(141): unsure at all Xaa locations
  Clone ID: PAT_TA_23387.pep
DADLVAEHEIWAAVDPFAKNEAFNCSNGDVFKWKQLWPMLAERFGVEWAGYEGEDSRFSLADAMAGKEAVWTEILQENELVTTELEEITSWWFVDAMFSIDIEHLDNMNKSKEHGFLXGFRNTVNSFNAWIDKMKASKVVP

SEQ ID NO: 128970 - protein, 162 aa, Triticum aestivum
  Clone ID: PAT_TA_23388.pep
METSVIVLSVVVGFFGVGSAVLGFIAEGTKLERNDIGVSRTECVYPGNPAFALGLVAALLLLAAQITVSAAGRCCGCCKPRGAAFSASRRNIGVVFAVLSWVATVIAEIYFVQGAAWNAPVTREVNTGCYFVRDGVFRRAAILSIIATVLGIKSYFLLRAAA

SEQ ID NO: 128971 - protein, 169 aa, Triticum aestivum
  unsure (1)..(169): unsure at all Xaa locations
  Clone ID: PAT_TA_23389.pep
MSLIAGEEFQHILRVLNTNVDGKQKIMFALTSIKGVGRRFSNIVCKKADIDMNKRAGELSSEEMDRLMAVVHNPRQFKVPDWFLNRKKDYKDGRFSQVVSNAVXDMKLKDDLERLKKIRNHRGLRHYWGVRVRGQHTKTTGRRGKMLVSQEAISCSQRSHSFHTCWFKI

SEQ ID NO: 128972 - protein, 93 aa, Triticum aestivum; identical to SEQ ID NO: 128927
  Clone ID: PAT_TA_23390.pep

SEQ ID NO: 128973 - protein, 397 aa, Triticum aestivum
  Clone ID: PAT_TA_23391.pep
LTPAMSWWWAGAVGAVKKSQEERTELSFQSVALVIGSTGIVGTSLIDILPRDDTPGGPWKVYAVSRRPLPPWSPQPSPAVTHLLLDLADPVAVAEALKPLTDITHVFYAAWSSHPTEAQNREANSAMLRNVLSVLVPGCPALAHVCLQTGRKHYIGPYEAIGKIPVPDPPYTEDMPRLDYPNFYYDQEDVLFEEVSRRDGAVSWSVHRPSVVFGFSLRSAMNVVASLSVYAAICRKEGAMLRWPGSRVAWEGFSDASDADLVAEQEIWAAIDPLARNEAFNCSNGDLYKWKQLWPMVADRFGVEWAGYEGEDSRFMLADAMAGKEAVWAEILQENELVTTELQEIANWWFLDAVFNVKCEHLDSMNKSKEHGFLGFRNTAKSFNAWIDKMKVLKIVP

SEQ ID NO: 128974 - protein, 246 aa, Triticum aestivum
  Clone ID: PAT_TA_23392.pep
MARGGRSEKSGGGCGRCCLGFLLKLLAFLQAFAALSAVLYAASILSRWARHHELHIHHLLPDLWFACAVMAAGLLYCAILLAGYVAAEVSSGCCLCFYTGLAMVMMLLEAAVAGRILLNEHWIQDLPHDRTGELENLVSFVNANLDLCKWAALATVATQALSLFLAMVLRAMVSPTSGDYDSDEDFVVIRRPLLIARGAPSYLPTTADPRGGHPNLWSSSMRQKYGLNSSGDYTYNTLGQNAVPPQ

SEQ ID NO: 128975 - protein, 214 aa, Triticum aestivum
  Clone ID: PAT_TA_23393.pep
MAAATSSSLLGRRFLLSRRFVSSPFRPLSSTAPPSSHSAAVSDAEPDPEPPADQGNQYRSQPRPPNTTRTLENGLDHGIYKAIMVGKVGQEPMQKRLRSGKTVVLLSLGTGGIRNNRRPLDNEEPHQYAERSSVQWHRVCIYPDRLGSLALKHVKTGSLLYLEGNIETKVFSDPITGLVRRIREIAVRGNGRLLFLGNDGNGPKIGEVKGVGYF

SEQ ID NO: 128976 - protein, 276 aa, Triticum aestivum
  Clone ID: PAT_TA_23394.pep
MSLTEVRIGEEVWLTCLSHALTTETEEVMGLLLGDVEPSSRGGSTAFIWGASPQMRCERKKDRVEVNPELLAAASAQAEVMTATIGKTTRVIGWYHSHPHITVLPSHVDVRTQAMFQLLDPGFVGLIFSCFSEDAQKVGKIQVIAFQSLDGTQNTQRAIVPVITNPVVNLESSWSSSENSLALIEGIEQDTGDSRASNGSKVWGRSQDMDLYPSLDTNHSARHLPIENAIVPFELENSAGPSIDQDGSDLSPSIQEALHRSTMDIRFWAFMFLREH

SEQ ID NO: 128977 - protein, 179 aa, Triticum aestivum
  unsure (1)..(179): unsure at all Xaa locations
  Clone ID: PAT_TA_23395.pep
MARGGRSEKGGGGCGRCCLGFLLKLLAFLQAFAALSAVLYAASILSRWARHHELHIHHLLPDLWFACAVMAAGLLYCAILLAGYVAAEISSGCCLCFYTGLAMVMMLLEAAAAGRILLNEHWXQDLPYDRTGDSRTRLLRQXTTRLCKWVALATFPIKALSLXLAMVLRAMVSPTSSDL

SEQ ID NO: 128978 - protein, 152 aa, Triticum aestivum
  Clone ID: PAT_TA_23396.pep
MSLSAGEEFQHILRVLNTNVDGKQKIMFALTSIKGVGRRFSNIVCKKADIDMNKRAGELSAEEMDRLMAVVHNPRQFKVPDWFLNRKKDYKDGRFSQVVSNAVDMKLRDDLERLKKIRNHRGLRHYWGVRVRGQHTKTTGRRGKTVGVSKKR

SEQ ID NO: 128979 - protein, 210 aa, Triticum aestivum
  Clone ID: PAT_TA_23397.pep
MAAPRALALAVLLAIAVTNAEAASVVVGLAKCADCTRRNIKAEEAFKGLQVAIKCKNVHGDYESKAVGTLDRTGAFSVPLAADLHGADCVAQLHSAASSAPCPGQEPSKIVPVSEGTTFGVVAGDNITTPSAAASPECASMTLCGPIKKHIIEHFHHKKPVPPKPEPKPQPHPDYGPVPKPEPKPQPHPDYHPVPPTPTYGGGGGYHGHH

SEQ ID NO: 128980 - protein, 175 aa, Triticum aestivum
  Clone ID: PAT_TA_23398.pep
SSFVKALCTFLVLFLVLTKVGQVIIFVRTRNSTKNVHNALTKEDYVCSSIQGSLDQAEREKVIQEFKDGYTKVLISTDVLARGFDQAQVNLVINYDMPIKYNTRDEPDYEVYLHRIGRAGRFGRKGAVFNLLCGQTDEVVMTKIEDYFQHKVPEVPNWKSEDNFETALKDAGLLE

SEQ ID NO: 128981 - protein, 324 aa, Triticum aestivum
  Clone ID: PAT_TA_23399.pep
MAGYPPPPGSGYPYGAAGGYGAPPPSGQKPPKEGKTSSSSGPDPYHGAPPPQQPYGGGGGYGAPPSYGQKPPKEGKTSYSSGSDPYHGAPPPQQPYGGGGGGGYGQQPYGAQPPSSAAPYGGPPAAQPYAGGGSGGYGSPFAALVPSTFPPGTDPNVVACFQAADRDGSGMIDDKELQSALSGFSSQSFSLRTVHLLMYLFTNTNVRKIGPKEFTSVFYSLQNWRGIFERFDRDRSGRIDAPELRDALLDLGYSVSPTVLDLLVSKFDKTGGKNKAVEYDNFIECCLTVKGLTEKFKEKDTAYSGYATFGYEAFMLTVLPFLIA

SEQ ID NO: 128982 - protein, 104 aa, Triticum aestivum; identical to SEQ ID NO: 128933
  Clone ID: PAT_TA_23400.pep

SEQ ID NO: 128983 - protein, 162 aa, Triticum aestivum
  unsure (1)..(162): unsure at all Xaa locations
  Clone ID: PAT_TA_23401.pep
MSDSEEHHFESKADAGASKTYPQQAGTVRKNGFIVIKNRPCKVVEVSTSKTGXKHGHAKCHFVAIDIFNGKKLEDIVPSSHNCDIPHVNRTEYQLIDISXEDGFVSLLTSDGNTKDDLRLPTDETLXGQIKEGFESGKXLVVTVQSAMGXEQICALKDVGPK

SEQ ID NO: 128984 - protein, 164 aa, Triticum aestivum
  unsure (1)..(164): unsure at all Xaa locations
  Clone ID: PAT_TA_23402.pep
MSDSEEHHFESKADAGASKTYPQQAGTVRKNGFIVIKNRPCKVVEVSTSKTGXSMGHAKCHFVAIDIFXMGKKLEDIVPSSHNCDIPHVNRTEYQLIDISXEDGFVXSLLTSDGNTKDDLRLPTDETLVAQIKEXFESGKDLVVTVQSAMGEEQICALNGFGPK

SEQ ID NO: 128985 - protein, 364 aa, Triticum aestivum
  Clone ID: PAT_TA_23403.pep
ITLDVGTNNEELLNDEFYIGLRQRRVTGQEYADFLHEFMAAVKQNYGEKVLIQFEDFANHNAFDLLARYGTTHLVFNDDIQGTASVVLAGLVAALKLVGGTLAEHTYLFLGAGEAGTGIAELIALEMSRQTKTPIDECRKKIWLVDSKGLIVSTRKESLQHFKKPWAHEHEHVGNLLDAVNAIKPTVLIGTSGKGQTFTQEVVEAISSFNEMPIILALSNPTSQAECTAEQAYTWSKGRAVFATGSPFDPVEYNGKTHVPGQANNAYIFPGFGLGVVMSGAIRVHDDMLLAASEALAQQVTQENFDKGLIYPPFSNIRKISAHIAANVAARAYELGLASRRPRPKDLVKYAESCMYSPIYRNYR

SEQ ID NO: 128986 - protein, 134 aa, Triticum aestivum
  Clone ID: PAT_TA_23404.pep
FRREKHVGMSKIKSPCPVFWQQKKHLCLKLINYSTHDHQKKEFMLAKACATEIRHLEHVCTTLEFKSTLMRRQPRDPTLGRSSASLLFPGPPHKRLCPRREPATITSRTWSENPRCYSLRPKKLVIKMDKKECI

SEQ ID NO: 128987 - protein, 223 aa, Triticum aestivum
  Clone ID: PAT_TA_23405.pep
MAAPRALVLAVLLAIAVANAEAASVVVGLVKCADCTRKNMKAEEAFKGLQVAVKCKNVHGDYESKALGALDGTGAFRMPLAADLHGADCVAQLHSAASNAPCPGQEPSKIVPVSEGTTFGIVAGDSIATPSAASPECASMTLCGPIKKHIIEHFHHKKPVPPKPEPKPPAPPGLRPRAQARAKAAAPPGLPPHPSHAHLRRRRWRRIPRTPLSLVYHRRPAQR

SEQ ID NO: 128988 - protein, 107 aa, Triticum aestivum
  Clone ID: PAT_TA_23406.pep
MAYVERGVVKGKRTIWRLSIIPDFFKAIVNFIRMFFLTMFSIEKTDSYKKGYGSGKKWDGGPGGGGPGGGPYGGGGGGGGGPRGPRTLSDLRSNDQSSLPACGSCCG

SEQ ID NO: 128989 - protein, 73 aa, Triticum aestivum
  Clone ID: PAT_TA_23407.pep
MIEVVLNDRLGKKVRVKCNEDDTIGDLKKLVAAQTGTRPEKIRIQKWYTIYKDHITLGDYEIHDGMGLELYYN

SEQ ID NO: 128990 - protein, 259 aa, Triticum aestivum
  Clone ID: PAT_TA_23408.pep
CPCWVCDSRARKLSNEQRSAIADYFRVYKGGENSLKKVSLTGPVLHPFLARSYTDVLKCFFEDKLLHSQQLFASEERCQKILELIPDENVASELHDKWQGNRRSSISKEDVNAARWEQLKTTLQSGKHKTQGLRRCVEEIVFSYTYPRLDMEVSKHMNHLLKAPFCIHPKTGRVCVPIDPNNCEDFDPMAVPTLSQLLGELNAAGMQIASENDLERTSLEKYIRFFRTSFLQPMLKACKEELEAAYSAKLQQSKNTLSW

SEQ ID NO: 128991 - protein, 185 aa, Triticum aestivum
  Clone ID: PAT_TA_23409.pep
MYPKPEDGPATGFPMSGGTARTGGGPGAYYQAAPATAAFAMQAAQAPLAAWSTGLCDCFDDCGNCCITCLCPCITFGQVAEIIDRGSTSCGASGALYALIMLLTGCQCVYSCFYRAKMRAHYGLQESPCADCCIHWCCEPCALCQEYRELKKRGFDMNLGWHANMERQGRTPATMPPLMHPGMTR

SEQ ID NO: 128992 - protein, 392 aa, Triticum aestivum
  Clone ID: PAT_TA_23410.pep
LRVRGRVGEPDQPSAPATAPLSKRCREPAFAVTGNATSSRGGGGLREKARAVTRLAGSGSRHTHADAQYSGGPVPGVAFDPFDIEADPPPLALTHEQIKLCKDALAHFERRSKQLDALSDEFQRLQGMRTMHPEMMKMSTVARDAANREKNRYIDVLPFDDTRVRLKSSATSQISGNDYINASFVKATEDNSVARFISTQGPLVRTFDDFWEMVCENQCPVIVMLTQYDSVKCDEYLPLQNGQGTYGKYDVKIRKDTRDKHQLCLRAVEVQCNESGKVHSVLHIEYPDWPDHGVPANTDAVRQIQKRLHHIPREHPIVAHCSAGIGRTGAYITIHSSIERILLGDKSSYDLVETVKNFRSQRTGMVQTEQQYMFCYRAIADELKDLLRSSGH

SEQ ID NO: 128993 - protein, 108 aa, Triticum aestivum
  unsure (1)..(108): unsure at all Xaa locations
  Clone ID: PAT_TA_23411.pep
MFGMRACGAAASWVVGWMGTDAHLYDDPEAVAIPALLDSHFNVDKVDALKRLLALIAQGXDVAHLFPQVVKNIVAQSLEVKNLVYLYLLHHTETTMEILCSESKTKLK

SEQ ID NO: 128994 - protein, 248 aa, Triticum aestivum
  Clone ID: PAT_TA_23412.pep
MARGSRSGRNGGGGGCASCCLGFLLKFLAFLQAFAAVSAVLYAASILSRWARHHELHFDRLLPDLWFACAVMAAGLLYCAILLAGYVAAEVNSGCCLCFYTILAMAMMLLEAAVAGHLLLNEHWMQDLPYDRTRELENLVSFVNNNLDLCKWAALATVATQAFSLFLAITLRAMVSSTNADFDSDEDFVVIRRPLLLAQGAPAYLPTTADPRGAHPGLWSSSMRQKYGLNSTSDYTYNTLDQNAVPPQ

SEQ ID NO: 128995 - protein, 239 aa, Triticum aestivum
  Clone ID: PAT_TA_23413.pep
MRVASRVVVLVRDSAGYGAALADALRPSPGLTRGSSPFDLPLDKYGLNGEKASGELVSFSDSSGSPQVSFFVLPDYRPPVAACAMNEILALISSEAPSIQPVLIVPFITRPSGCFHGMVNATKTGQLTTLHAAEIGASNEFTHLLVDGSIKPPPSLQIRSEPIQCLLEIVRVLKIPTVLVTSGGQHQGKSSSDSDLEVLQCVGDHVAKHINLEFSKETVIETGVEKSASIQEPWRELYL

SEQ ID NO: 128996 - protein, 573 aa, Triticum aestivum
  unsure (1)..(573): unsure at all Xaa locations
  Clone ID: PAT_TA_23414.pep
DAATGGGCLKDTYVXDRATEEQLVTPWTVSVASGYNLLRDPRYNKGLAFTEKERETHYLRGLLPPTVISQELQERKIMHNIRQYQLPLQRYMAMMDLQEGNERLFYKLLIDNVEELLPIVYTPTVGEACQKYGSIFSRPQGLYISLKEKGKILEVLKNWPERSIQVIVVTDGERILGLGDLGCQGMGIPVGKLSLYTALGGVRPSACLPITLDVGTNNEELLNDEFYIGLRQRRAIGQEYADFLHEFMAAVKQNYGEKVLIQFEDFANHNAFDLLARYGTTHLVFNDDIQGTASVVLAGLVAALKLVGGTLAEHTYLFLGAGEAGTGIAELIALEMSRQTKTPIDECRKKIWLVDSKGLIVSARKESLQHFKKPWAHEHEHVGNLLDAVNAIKPTVLIGTSGKGQTFTQEVVEAISSFNEMPIILALSNPTSQAECTAEQAYTWSKGRAVFATGSPFDPVQYNGKIYVPGQANNAYIFPGFGLGVVMSGAIRVHDDMLLAASEALAQQVTQENFDKGLIYPPFSNIRKICAHIAANVAAKAYELGLASRRPRPKDLVKYAESCMYSPIYRNYR

SEQ ID NO: 128997 - protein, 195 aa, Triticum aestivum
  Clone ID: PAT_TA_23415.pep
PATSGGNRRPARSVRAQRDPSVSHTRGKIRTTPPSPPMWIDPLQPSRRRRRPPPTPASSTAGDPFSSSPNPATCSSRSMQDRSELHYLRCSLSPDQIFLLRSGTSPAWLRRCSGDSDPTRRRCSSTGTLSMGSLPPHLILSPSHERCSFTATLTPSRSSCTPARLQHHQLDLDAGRGDAQPWASSTSASAFVAWA

SEQ ID NO: 128998 - protein, 259 aa, Triticum aestivum
  Clone ID: PAT_TA_23416.pep
TCICATGENSSILHYGHTAAPNDRTLNDGDMALMDMGAEYNFYGSDITCSYPINGKFNSNQAIVYNAVLKAHNAVISHMQPGLKWVDMHKLAEQTILESLKNEKIIHGDIADMMARRLGAVFMPHGLGHLLGIDTHDPGGYPEGLERPKEPGLSSLRTIRELKEGMVITVEPGCYFIDALLRPARDDPISSKFFNWEEIEKYKSFGGVRIESDLYVTAQGCKNLTNCPRETWEIEAVMAGAPWPPRASVTKAENGLPKA

SEQ ID NO: 128999 - protein, 364 aa, Triticum aestivum
  unsure (1)..(364): unsure at all Xaa locations
  Clone ID: PAT_TA_23417.pep
MASRLASRLLLRRPAAVLSLLQSSRHARHFSTQLLEGVPRLPKPTCERYFLRNASPYQIWSRSFASENGDLVEAVVPFMGESVTDGTLANFLKKPGDRVEADEAIAQIETDKVTIDVSSPEAGVIEKFIASEGDTVTPGTKVAVISKSAAPSEAHVAPSEETSQKETPPPPPPEKPKVEAKSPKVESVKPQASKLASPSEPQLPPKERERRVSMPRLRKRIANRLKDSQNTFALLTTFNEVDMTNLMKLRTDYKDEFVKKHGVKLGLMSCFVKAAVSALQNQPIVNAVIDGDDIIYRDYIDVSVAVGTSKGLVVPVIRDTEGMNLLTLXGDNXLXXXXLXGITVDEMXGGTQQGFKDLQLTSGS

SEQ ID NO: 129000 - protein, 260 aa, Triticum aestivum
  Clone ID: PAT_TA_23418.pep
SNVPADDIDWDISVDNNGIDWDIGAVEQPVEESGNGFGSYEIIDANIELAGSENYGVGASAYPSADKEGLTCDTSENQICWDISTDNPEESATVENAPTESGQYECLTEERSQLLEKEYRNNILDDLLEVKSFLILRSAEMRNADTSSLQHQVQAVSPFVLQQYAPERLENMLVEVSSAISLLTNQKTLDLIMILNSKRFLERLVSTLEEKKHHEVKLREGLGDLSVKRMELQNALSSSWPKQEAAIAKTRELKKLCEIS

SEQ ID NO: 129001 - protein, 174 aa, Triticum aestivum
  Clone ID: PAT_TA_23419.pep
AWSRPRYAAICRKEGATLRWPGCKVAWEGFTDASDADLVAEHEIWAAVDPFAKNEAFNCSNGDVFKWKQLWPMLAERFGVEWAGYEGEDSRFALADAMTGKEAVWTEILQENELVTTELEEITSWGFVDAMFNIDIEHLDNMNKSKEHGFLGFRNTVNSFNAWIDKMKASKVVP

SEQ ID NO: 129002 - protein, 210 aa, Triticum aestivum
  Clone ID: PAT_TA_23420.pep
MAAPRALVLGVLLLIAVSNTEAASVVVGMAKCADCTRKNMKAEEAFKGLQVAIKCKSVHGDYESKAVGALDRSGAFSVPLAADLHGADCVAQLHSAASNTPCLGQEPSKIAPVSEGTTFGVVAGAKTNVLASPECASATLLGPIKKHIIEHFHHKKPVPPKPEPKPQPHPDYGPVPKPEPKPQPHPDYHPIPPTPTYGGGGGGGGYHGHH

SEQ ID NO: 129003 - protein, 160 aa, Triticum aestivum
  Clone ID: PAT_TA_23421.pep
MSDSEDHHFESKADAGASKTYPMQAGAIRKGGFLVIKNRPCKVVEVSTSKTGKHGHAKCHFVALDIFNGKKLEDIVPSSHNCDVPHVDRTEYQLIDISEDGFVSLLTDNGSTKDDLKLPTDDAILTQLKDGFAEGKDLALTVMSAMGEEQICAVKDVGPR

SEQ ID NO: 129004 - protein, 201 aa, Triticum aestivum
  Clone ID: PAT_TA_23422.pep
MWKLSMMKCRRYRLHKCLPPGLNRRTRGQPVTQFSLDEDAVLEENWRIIRQCATPFCLDEDAAMEENRRTRSQFLTPLYLDEDAALEDNAAMPSHNTWNKRQRVAPLICLSPEREEGSSLQSNNAVQISQEPAKVVVPKEPNFTCPVCLNKLVEPSTTKCGHIFCAECIKQAIQFQKKCPTCRKALRKNNFHRIYLPNSDG

SEQ ID NO: 129005 - protein, 153 aa, Triticum aestivum
  Clone ID: PAT_TA_23423.pep
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGY

SEQ ID NO: 129006 - protein, 224 aa, Triticum aestivum
  unsure (1)..(224): unsure at all Xaa locations
  Clone ID: PAT_TA_23424.pep
MAAPRALVLCVLLAIAVAHAEAASVVVGLAKCADCTRKNMKAGEAFKAVQVVIKCKNSAGEYESKAVGGLDGXGAFSVPLVADLHGADCVAQLHXSAASNAPCPGQEPSKIVPLSEGTTFGFVAGENTATPSAASXECASMTLCGPIKKHIIEHFHHKKPVPPKPELKPQPHPDYGPMPKPEPKPQPHPDYHPVPPTPTYGSGGGGGGYHGHPLSQFYPRPAQR

SEQ ID NO: 129007 - protein, 155 aa, Triticum aestivum
  unsure (1)..(155): unsure at all Xaa locations
  Clone ID: PAT_TA_23425.pep
MSLIAGEEFQHILRVLNTNVDGKQKIMFALTSIKGVGRRFSNIVCKKADVDMNKRAGELSAEEMDRLMAVVHNPRQFKVPDWFLNRKKDYKDGRFSQPPXVVSNAVDMKLRDDLERLKKIRNHRGLRHYWGVRVRGQHTKTTGRRGKTVGVSKKR

SEQ ID NO: 129008 - protein, 185 aa, Triticum aestivum
  Clone ID: PAT_TA_23426.pep
SPFAALVPSAFPPGTDPNVVACFQAADRDGSGTIDDKELQSALSGYNQSFSLRTVHLLMYLFTNTNVRRIGPKEFTSVFYSLQNWRSIFERFDRDRSGKIDASELRDALLSLGYSVSPTVLDLLVSKFDKTGGMSKAVEYDNFIECCLTVKGLTEKFKEKDTAYSGSATFSYEAFMLTVLPFIIA

SEQ ID NO: 129009 - protein, 107 aa, Triticum aestivum; identical to SEQ ID NO: 128988
  Clone ID: PAT_TA_23427.pep

SEQ ID NO: 129010 - protein, 71 aa, Triticum aestivum
  Clone ID: PAT_TA_23428.pep
MARTLFGFVVAAALVLAVFMPALAAAQAPAPAPTSDASSVDQGVAYFLMILALVLTYLIHPLDASSPYKLF

SEQ ID NO: 129011 - protein, 533 aa, Triticum aestivum
  unsure (1)..(533): unsure at all Xaa locations
  Clone ID: PAT_TA_23429.pep
MAAAAEVWQLVGAAAATLLAAALVAAALGRQRQRRRRGAPVEGIPAPEDGCEVADGAWSAAVDGPTDVIIVGAGVAGSALAYTLGKDGRRVHVIERDLTEPDRIVGELLQPGGYLKLMELGLQDCVDEIDAQRVLGYALFKDGKNTKLSYPLEKFHSDVAGRSFHNGRFIQRMREKVASLPNVQLEQGTVTSLLEENGTVKGVQYKIKSGEELKAYAPLTIVCDGCFSNLRRALCSPKVEVPSCFVGLVLENCELPHANHGHVILANPSPILFYPISSTEVRCLVDVPGQKVPSIASGEMANYLKTVVAPQIPPQIYDSFIAAIDKXGSIRTMPNRSMPAAPHPTPGALLMGDAFNMRHPLTGGGMTVALSDIVVLRNLIKPLRNLHDASALCKYLESFYTLRKPVASTINTLAGALYKVFSSSPDKARDEMRQACFDYLSLGGVCSNGPIALLSGLNPRPLSLVAHFFAVAIFGVGRLMLPLPSPKRMWTGARLISGACGIIFPIIKAEGVRQMFFPATVPAYYRAPPEAEF

SEQ ID NO: 129012 - protein, 399 aa, Triticum aestivum
  Clone ID: PAT_TA_23430.pep
AAMSWWWAGAVGAVKKRQDERAAAAEPTFQSVALILGSTGIVGTSLLDILPRDDTPGGPWKVYAVSRRAPPGWSTPPPSPAVTHLQLDLADPAAVRDALTPLTDVTHVFYAAWSSHETEDRNREVNAGMLRNVLSVVVPGCPALAHVCLQTGRKHYVGPFDVIGKIPAPDPPYTEDMPRLDHPNFYYDLEDVLFDHVSGRDGAVTWSVHRPTVIFGFSPRSAMNVVGSLCVYAAICRKEGATLRWPGCKVAWEGFTDASDADLVAEHEIWAAVDPFAKNEAFNCSNGDVFKWKQLWPLLADRFGVEWAGYEGEDSRFALADAMAGKEAVWTEIIQENELVTTELEEITSWWFVDAMLSIDIEHLDNMNKSKEHGFLGFRNTINSFNAWIDKMKASKVVP

SEQ ID NO: 129013 - protein, 252 aa, Triticum aestivum
  Clone ID: PAT_TA_23431.pep
MSNTSGARRAARRQSLDGSADKVVVDLDASSPVAGNHHGLSVFPGARTSPIDVEALDDEVQALSPSQVPPPGVNRRTRGQPVAPFSLDEDAVLEENWRIIRQCATPFYLDDDAAMEDNRRTRSQFLTPLYLDEDAALEDNAAMPSHNMWNKRQRVAPLICLSPEREEGSSLQSNNAMQVSQEPAKVVVPKEPNFTCPVCLNKLVEPSTTKCGHIFCAECIKQAIQFQKKCPTCRKALRKNNFHRIYLPNSDG

SEQ ID NO: 129014 - protein, 177 aa, Triticum aestivum
  Clone ID: PAT_TA_23432.pep
MASCPSVKNILVLDAEGKRVAVKYYADDWPSASSKLAFEKSLFVKTQKTSARTEADVVMFDGYIIVYKFIQDLHFFVTGGDEENELILASVLQGFSDAVGILLRNSVDKRTALENLDLIFLCLDEVVDGGIVLETDGNVIAEKVSGHGLEGAGSFTEQTISQALATAREHFARSLLK

SEQ ID NO: 129015 - protein, 79 aa, Triticum aestivum
  Clone ID: PAT_TA_23433.pep
VFFFFFFFFFFFFTTVDTFSFHSCYSSLQHRQYMTLHHSFFCQALDEYISLQINSTILESKIRHQTPWCAILLDLASRN

SEQ ID NO: 129016 - protein, 219 aa, Triticum aestivum
  Clone ID: PAT_TA_23434.pep
RYDAVQVELGCGVGGAKLEVSYVVTLYPLSMATAVIVKNNGAKPVELTGAVLSHIKFDKRGGTAVEGLRGCPYCSHPPPAAGFALLTPAEAMKREESGWFGGGGGEEPRQGAWTVEENLYTILKKKVSRVYAAPPEERKKRIYSTAPSKFTTIDQSSGLGFRLVRMGFEDLYLSSPGGLYEKFGNDYFLCTGPASILVPVVVGPGEEWRGAQVIEHDNL

SEQ ID NO: 129017 - protein, 119 aa, Triticum aestivum
  Clone ID: PAT_TA_23435.pep
PGIKHFILRQTSLVAMESKFFQFLKLVGVGFKARTEQGGRELFLKLGYSHEVQFTAPPAVRVFCFKPNIICCTGIDKHRVHHFAGAVRSSKPPEVYKGKGILYIDEVIKLKPGKKQQKK

SEQ ID NO: 129018 - protein, 224 aa, Triticum aestivum
  Clone ID: PAT_TA_23436.pep
MAAPRASLVLALLLAIAVANAEAASVVVGLAKCTDCTRKNIKAEEAFKGLQVAIKCKNVNGEYESKAVGALDGTGAFSVPVAADLHSADCVAQLHSAASNAPCSGQEPSKIVPVSEGTTFGVVAGAKTNALASPECASATLCGPIKKHIIEHFHHKKPVPPKPEPKPPAPPGLRACAQARAEAAAPPGLPPRPSHAHLRRRWWRWIPRTPLSPVYHPPAKRRNW

SEQ ID NO: 129019 - protein, 210 aa, Triticum aestivum
  Clone ID: PAT_TA_23437.pep
MAAPRALVLGFLLVIAIANAEAASIVVGLAKCADCTRKNIKAEEAFKGLQVAIKCKNVNGEYESKAVGTLDGTGAFSVPVAADLHSADCVAQLHSAASNAPCSGQEPSKIVPVSEGTTFGVVAGAKTNVLASPECASATLCGPIKKHIIEHFHHKKPVPPKPEPKPQPHPDYGPVPKPEPKPQPHPDYHPVPPTPTYGGGSGGGGYHGHH

SEQ ID NO: 129020 - protein, 426 aa, Triticum aestivum
  Clone ID: PAT_TA_23438.pep
MSLTEVRIGEEVWLTCLSHALTTETEEVMGLLLGDVVSSSKGGSTAVIWGASPQMRCERKKDRVEVNPELLAAASAQAEVMTATIGKTTRVIGWYHSHPHITVLPSHVDVRTQAMFQLLDPGFVGLIFSCFSEDAQKVGKIQVIAFQSLDGTQNTQRAIVPVITNPVINPEPSWGSSDNSLALIEGIEQDTGDSRASNGSKVWGRSQDMDLYSPLDTNHSARLPIENAIVPFEPDNSAGPSVDQDGSDLSPSIQEALHRSTMDISGAEYKRKEVPLKVFPTRHLLKLDTTLSSYCDMQRVLFEEEQSAYNQAMLQNICDGKMHPLTSMHHTSTYNASLCKLMEYCLTPAITVLEDRVKENELRLAMLVEEAKQLEAEQSTKTGSPRRAMPGGTTSGITSPRGQDKYPSGRQGGPISPSSSGRRKAP

SEQ ID NO: 129021 - protein, 181 aa, Triticum aestivum
  unsure (1)..(181): unsure at all Xaa locations
  Clone ID: PAT_TA_23439.pep
VLTNKAIEANDGKPLPLVQKAFIGLTAGAIGACVGSPADLALIRMQADSTLPAAQRXRHYKNAFHXLASYDQSVELFRDKLGAGEYQTVIGASAISGFCAAACSLPFDYVKTQIQEXMNLDATGKYPYTGSLDCAMQTLKTGGPFKFYSGFPVYCVRIAPHVMMTWLFLNQIQKYQKKIGI

SEQ ID NO: 129022 - protein, 253 aa, Triticum aestivum
  Clone ID: PAT_TA_23440.pep
ADVIVLDDNFTTIINVARWGRAVYINIQKFVQFQLTVNIVALVINFVSACITGSAPLTAVQLLWVNMIMDTLGALALATEPPNDEMMKRPPTGRGESFITKVMWRNIIGQSIYQLVVLGVLMFAGENLLNIEGPDSKTVLNTLIFNSFVFCQVFNEVNSREMEKINIFRGLIGNWVFLGVISATVVFQVVIIEFLGTFASTVPLSWQFWLVSVGLGSISLIIGAILKCIPVKSGEISGSPNGYKPLANGPDDI

SEQ ID NO: 129023 - protein, 285 aa, Triticum aestivum
  Clone ID: PAT_TA_23441.pep
MEQHVLVALALSFVGGLSTSLGALLVIVNPSPDLKRLGLLQGFAAGLMLSISFLDLAHNALNSIGFLKANLWFFAGVLFFGFVVKFIPEPTFVPTTDASKKKTDDDGSGKDMMKKHRRQVLFSGIITAVGISLHNFPEGMAVFLGSVKGLRVGVNLAIAIALHNIPEGVAVALPLYFATKSVSFFLAYKSKWQAFKYATLSGLAEPLGVFFVAVLFPSNLNPEILEGLLASVGGVMAFLTLHELLPLAFDYAGQKQAVKAVFVGMAVMSASLYFLEISLPKEISL

SEQ ID NO: 129024 - protein, 155 aa, Triticum aestivum
  Clone ID: PAT_TA_23442.pep
RPGLHRPRFSIEKHKGAAALAGARVWSVDRSIDASGREDDRGGAQRPPGEEGARQVQRGRHHRRPQEARGGADRDQGREDPHPEVVHHLQGPHHPWRLRDPRRHGPRALLQLASSPRPLQVCHLSLPAMIALVAFQSQCLQSSMCGQNSSELLFK

SEQ ID NO: 129025 - protein, 48 aa, Triticum aestivum
  Clone ID: PAT_TA_23443.pep
MIYDVNSPLFRSFLSQKGGASSDKRKMEEQKPKDQRFKANENKPVMNE

SEQ ID NO: 129026 - protein, 243 aa, Triticum aestivum
  Clone ID: PAT_TA_23444.pep
GALEQKYARVRANPPEYRSNKLMNSNRISHNQSLKNPLAYRSTDNRKMNKRMRSLCACTGSEELVRGGGVQRVDEVGEHQRQDHQKVGNALVDRGRVAGGRRRGGLRGGEGRHEDGEEERGGGDETKKEKHKAAAALAGARVWSIDRSIDASGSEDDRGGAQRPPGEEGARQVQRGRHHRRPQEARGGADRDQGREDPHPEVVHHLQGPHHPRRLRDPRRHGPRALLQLASGHCRLVTYCCLR

SEQ ID NO: 129027 - protein, 153 aa, Triticum aestivum; identical to SEQ ID NO: 129005
  Clone ID: PAT_TA_23445.pep

SEQ ID NO: 129028 - protein, 160 aa, Triticum aestivum; identical to SEQ ID NO: 129003
  Clone ID: PAT_TA_23446.pep

SEQ ID NO: 129029 - protein, 438 aa, Triticum aestivum
  Clone ID: PAT_TA_23447.pep
MASRLASRLLLRRPAAVLSLLQSSRHARHFSTQLLEGVPRLPKPTCERYFLRNASPYQIWSRSFASENGDLVEAVVPFMGESVTDGTLANFLKKPGDRVEADEAIAQIETDKVTIDVSSPEAGVIEKFIASEGDTVTPGTKIAVISKSAAPSEAHVAPSEETSQKETPPPPPAEKPKVEAKSPKVESVKPQASKLASPSEPQLPPKERERRVSMPRLRKRIANRLKDSQNTFALLTTFNEVDMTNLMKLRTDYKDEFVKKHGVKLGLMSCFVKAAVSALQNQPIVNAVIDGDDIIYRDYIDVSVAVGTSKGLVVPVIRDTEGMNFADIEKGINSLAKKATEGALSIDEMAGGTFTISNGGVYGSLISTPIINPPQSAILGMHSIVQRPVVVDGSILARPMMYLALTYDHRLIDGREAVLFLRRIKDVVEDPRRLLLDI

SEQ ID NO: 129030 - protein, 445 aa, Triticum aestivum
  Clone ID: PAT_TA_23448.pep
MASRIASRLLRRSSPTLGLLRSYTHVRNYSSQLSGLIPVGPQSSKLTRRNNYFPNASPYQLWSRSFASDNGDKFEAVVPFMGESVTDGTLANFLKKPGDRVEADEAIAQIETDKVTIDVSSPEAGVIEKFIASEGDTVTPGTIVAIVSKSAAPAETHVAPSEEAPQKESPPVKAEEKSPKAEEKPTKVEPPKKQAPKPTPSKTSPTEPQLPPKERERRVAMPRLRKRIANRLKDSQNTFAMLTTFNEVDMTNLMKLRSDYKDEFVKKHGVKLGLMSCFVKAAVSGLQNQPIVNAVIDGDDIIYRDYVDVSVAVGTSKGLVVPVIRDADTMNFADIEKGINNLAKKATEGALSIDEMAGGTFTISNGGVYGSLISTPIINPPQSAILGMHSIVQRPVVVDGSILARPMMYLALTYDHRLIDGREAVYFLRRIKDVVEDPRRLLLDI

SEQ ID NO: 129031 - protein, 185 aa, Triticum aestivum
  Clone ID: PAT_TA_23449.pep
MYPKPEDGPATGFPMSAGTARTGGGPGAYYQAAPPTAAFAMQAGQAPLAAWSTGLCDCFDDCGNCCITCLCPCITFGQVAEIIDRGSTSCGASGALYALIMLLTGCQCVYSCFYRAKMRAHYGLQESPCADCCIHWCCEPCALCQEYRELKKRGFDMNLGWHANMERQGRTPATMPPLMHPGMTR

SEQ ID NO: 129032 - protein, 153 aa, Triticum aestivum
  Clone ID: PAT_TA_23450.pep
MQIFVKTLTGKTITLEVESSDTVDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGY

SEQ ID NO: 129033 - protein, 303 aa, Triticum aestivum
  unsure (1)..(303): unsure at all Xaa locations
  Clone ID: PAT_TA_23451.pep
MADAKQQQAAAPTGVWKTIKPFVNGGASGMLATCVIQPIDMIKVKIQLGEGSAAQVAKTMYVNEGFGSFYKGLSAGLLRQATYTTARLGSFRVLTNKAIEANDGKPLPLVQKAFIGLTAGAIGACVGSPADLALIRMQADSTLPAAQRRHYKNAFHALYRITADEGVLALWKGAGPTVVRAMSLNMGMLASYDQSVELFRDKLGAGEYQTVIGXASAISGFCAAACSLPFDYVKTQIQKMQPDATGKYPYTGSLDCAMQTLKTGGPFKFYSGFPVYCVRIAPHVMMTWLFLNQIQKYQKKIGI

SEQ ID NO: 129034 - protein, 139 aa, Triticum aestivum
  Clone ID: PAT_TA_23452.pep
MAPSLLAAAASPFLIHGATGSTSRRPVAAVAPGRRAASSVRMRAAIKCDPSKVEPQSDRVLVRLETIPEKSAGGVLLPKSAVKFERYLMGEILSVGVDVSEVEAGKKVLFSDINAYEVDLGTEEKHCFCRESDLLAVVA

SEQ ID NO: 129035 - protein, 234 aa, Triticum aestivum
  unsure (1)..(234): unsure at all Xaa locations
  Clone ID: PAT_TA_23453.pep
MRECISIHIGQAGIQVGNACWELYCLEHGIQPDGQTNGDKTIGGGDDAFNTFFSETGAGKYVPRAVFVDLEPTVIDEVRTSAYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVXVEPYNSVLSTHSLLEHTDVSILLDNEGIYDILKRXSLDIERPTYTNLNRLVS

SEQ ID NO: 129036 - protein, 445 aa, Triticum aestivum
  Clone ID: PAT_TA_23454.pep
MASRIASRLLRRSSPTLGLLRSYTHVRNYSSQLSGLIPAGPQSSKLTRRNNYFPNASPYQLWSRSFASDNGDKFEAVVPFMGESVTDGTLANFLKKPGDRVEADEAIAQIETDKVTIDVSSPEAGVIEKFIASEGDTVTPGTIVAIVSKSAAPAETHVAPSEEAPQKESPPAKAEEKSPKAEEKPTKVEPPKKQAPKPTPSKTSPTEPQLPPKERERRVPMPRLRKRIANRLKDSQNTFAMLTTFNEVDMTNLMKLRSDYKDEFVKKHGVKLGLMSCFVKAAVSGLQNQPIVNAVIDGDDIIYRDYVDVSVAVGTSKGLVVPVIRDADTMNFADIEKGINNLAKKATEGALSIDEMAGGTFTISNGGVYGSLISTPIINPPQSAILGMHSIVQRPVVVDGSILARPMMYLALTYDHRLIDGREAVYFLRRIKDVVEDPRRLLLDI

SEQ ID NO: 129037 - protein, 129 aa, Triticum aestivum
  Clone ID: PAT_TA_23455.pep
NLLIYHSRHAVQIYRNLKHSTGYLDSFQNDQADVHTTHFNIGVSHDWQLGLAGTGLSRRCSFVHYRLVLVGLEPLVFRLLLFHFPLVGGRAALLAEEGAEQGGVHVVDHLSSSSLLLLRCRRRRCEEPS

SEQ ID NO: 129038 - protein, 453 aa, Triticum aestivum
  unsure (1)..(453): unsure at all Xaa locations
  Clone ID: PAT_TA_23456.pep
MRECISIHIGQAGIQVGNACWELYCLEHGIQPDGQTNGDKTIGGGDDAFNTFFSETGAGKYVPRAVFVDLEPTVIDEVRTSAYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPTYTNLNRLVSQVISSLTTSLRFDGALNVDVTEFQTNLVPYPRIHFMLSSYAPVISAEKAYHEQLSVSEITNSAFEPSSMMAKCDPRHGKYMACCLMYRGDVVPKDVNAXAVATIKTKRTIQFVDWCPTGFKCGINYQPPTVVPGGDLAKVQRAVCMISNSTSVVEVFSRIDHKFDLMYAKRAFVHWYVGEGMEEGEFSEARXEDLAALEKDYEEVGAEGGDDEDGEEDDDY

SEQ ID NO: 129039 - protein, 160 aa, Triticum aestivum; identical to SEQ ID NO: 129003
  Clone ID: PAT_TA_23457.pep

SEQ ID NO: 129040 - protein, 268 aa, Triticum aestivum
  unsure (1)..(268): unsure at all Xaa locations
  Clone ID: PAT_TA_23458.pep
PTRPGQGSGESFKYASTRRRKGARKKNKRKTLSKRPEGHEKHNNSVNLYSSLKSAFFSLCTAFKQPAILRPMAWFFLSNAAVPNISTVMFYYQTEVLHLEASFLGTARVIGWFSLMLGTYIYNRYLKHKKLRNILMFAHLGLAIITVLDILLVSRLHMQYGIADXYMVLWGSALADAINQFKMMPFLILSGQLCPPGIEGTLFALFMSINNLSSTLGSFLGAALTSALNMSSVQFDNLTLSLTVQLMGTLLPIGFLFLIPRDVRGLTS

SEQ ID NO: 129041 - protein, 152 aa, Triticum aestivum
  Clone ID: PAT_TA_23459.pep
MSLIAGEEFQHILRVLNTNVDGKQKIMFALTSIKGVGRRFSNIVCKKADIDMNKRAGELSAEEMDRLMAVVHNPRQFKVPDWFLNRKKDYKDGRFSQVVSNAVDMKLRDDLERLKKIRNHRGLRHYWGVRVRGQHTKTTGRRGKTVGVSKKR

SEQ ID NO: 129042 - protein, 214 aa, Triticum aestivum
  Clone ID: PAT_TA_23460.pep
RFRHGSSESARPRRPAGARPSPNAEAASVVVGLAKCADCTRKNLKAEEAFKGLQVAIKCKNVHGDYESKAVGALDGTGAFSVPLAADLHGADCVAQLHSAASNAPCPGQEPSKIVPVSEGTTFGVVAGDSIATPSAASPECASMTLCGPIKKHIIEHFHHKQPVPPKPEPKPQPHPDYHPVPKPEPKPQPHPDYHPVPPTPTYGGGGGGYHGHH

SEQ ID NO: 129043 - protein, 160 aa, Triticum aestivum
  Clone ID: PAT_TA_23461.pep
MSDSEDHHFESKADAGASKTFPMQAGAIRKGGYLVIKNRPCKVVEVSTSKTGKHGHAKCHFVALDIFNGKKLEDIVPSSHNCDVPHVDRTEYQLIDISEDGFVSLLTDNGSTKDDLKLPTDDAILTQLKDGFAEGKDLALTVMSAMGEEQICAVKDVGPR

SEQ ID NO: 129044 - protein, 105 aa, Triticum aestivum
  Clone ID: PAT_TA_23462.pep
MRPQSKSTRPLQLSPGLGFRRSIDQSTRAGAKMIEVVLNDRLGKKVRVKCNEDDTIGDLKKLVAAQTGTRAEKIRIQKWYTIYKDHITLGDYEIHDGMGLELYYN

SEQ ID NO: 129045 - protein, 152 aa, Triticum aestivum
  Clone ID: PAT_TA_23463.pep
MSLIAGEEFQHILRVLNTNVDGKQKIMFALTSIKGVGRRFSNIVCKKADIDMNKRAGELSSEEMDRLMAVVHNPRQFKVPDWFLNRKKDYKDGRFSQVVSNAVDMKLRDDLERLKKIRNHRGLRHYWGVRVRGQHTKTTGRRGKTVGVSKKR

SEQ ID NO: 129046 - protein, 418 aa, Triticum aestivum
  Clone ID: PAT_TA_23464.pep
STPRPDKTIGGGDDAFNTFFSETGAGKYVPRAVFVDLEPTVIDEVRTSAYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPTYTNLNRLVSQVISSLTTSLRFDGALNVDVTEFQTNLVPYPRIHFMLSSYAPVISAEKAYHEQLSVSEITNSAFEPSSMMAKCDPRHGKYMACCLMYRGDVVPKDVNAAVATIKTKRTIQFVDWCPTGFKCGINYQPPTVVPGGDLAKVQRAVCMISNSTSVVEVFSRIDHKFDLMYAKRAFVHWYVGEGMEEGEFSEAREDLAALEKDYEEVGAEGGDDDDGEEDDDY

SEQ ID NO: 129047 - protein, 152 aa, Triticum aestivum; identical to SEQ ID NO: 129041
  Clone ID: PAT_TA_23465.pep

SEQ ID NO: 129048 - protein, 406 aa, Triticum aestivum
  unsure (1)..(406): unsure at all Xaa locations
  Clone ID: PAT_TA_23466.pep
MEHSAPAPEPMLLDEQPPTAVACEKKQQDGEAPYAEGNDAMTGHIISTTIGGKNGXEPSRRLRYMAERVVGTGSFGIVFQAKCLETGEMVAIKKVLQPXDRRSKNRELQLMRSMIHSNVVSLKHCFFSTTSRDELFLNLVMEYVPETLYRVLKHYSNAKQGMPLIYVKLYTYQLFRGLXAYIHTVPGVCHRDVKPQNVLVDPLTHQVKICDFGSAKVLVXGEPNISYICSRYYRAPELIFGATEYTTSIDIWSAGCVLAELLLGQPLFPGESAVDQLVEIIKVLGTPTREEIRCMNPNYTEFRFPQIKAHPWHKVFHKKMPPEAIDLASRLLQYSPSLRCTALDACAHPFFDELREPNARLPNGRPFPPLFNFKHELANASQDLINRLVPEHVRRQAGLAFVHAGS

SEQ ID NO: 129049 - protein, 337 aa, Triticum aestivum
  Clone ID: PAT_TA_23467.pep
MVAPRALVLAVLLAIAVANAEAASVVVGLAKCADCTRKNLKAEEAFKGLQVAIKCKNVHGEYESKAVGGLDGTGAFSVPLAADLHGADCVAQLHSAASNAPCSGQEPSKIVPASEGTTFGIVAGDSIATRSAASPECASMTLCGPIKKHIIEHFHHKQPVPPKPEPKPQPHPDYHPVPKPPPTAAMSLIAGEEFQHILRVLNTNVDGKQKIMFALTSIKGVGRRFSNIVCKKADIDMNKRAGELSAEEMDRLMAVVHNPRQFKVPDWFLNRKKDYKDGRFSQVVSNAVDMKLRDDLERLKKIRNHRGLRHYWGVRVRGQHTKTTGRRGKTVGVSKKR

SEQ ID NO: 129050 - protein, 451 aa, Triticum aestivum
  Clone ID: PAT_TA_23468.pep
MRECISIHIGQAGIQVGNACWELYCLEHGIQPDGQTNGDKTIGGGDDAFNTFFSETGAGKYVPRAVFVDLEPTVIDEVRTSAYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPTYTNLNRLVSQVISSLTTSLRFDGALNVDVTEFQTNLVPYPRIHFMLSSYAPVISAEKAYHEQLSVSEITNSAFEPSSMMAKCDPRHGKYMACCLMYRGDVVPKDVNAAVATIKTKRTIQFVDWCPTGFKCGINYQPPTVVPGGDLAKVQRAVCMISNSTSVVEVFSRIDHKFDLMYAKRAFVHWYVGEGMEEGEFSEAREDLAALEKDYEEVGAEGGDDEDGEEDDDY

SEQ ID NO: 129051 - protein, 161 aa, Triticum aestivum
  Clone ID: PAT_TA_23469.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDDVLLGQIKTGFADGKDLILSVMSAMGEEQICAVKEIGGGK

SEQ ID NO: 129052 - protein, 161 aa, Triticum aestivum; identical to SEQ ID NO: 129051
  Clone ID: PAT_TA_23470.pep

SEQ ID NO: 129053 - protein, 161 aa, Triticum aestivum
  Clone ID: PAT_TA_23471.pep
MADTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDDVLLGQIKTGFADGKDLILSVMSAMGEEQICAVKEIGGGK

SEQ ID NO: 129054 - protein, 98 aa, Triticum aestivum
  Clone ID: PAT_TA_23472.pep
MAAAKATLVCFMVMALATALLAVPGAVEAATCSPTQLTPCAPAIIGNAAPSAACCGKLKAHPASCLCKYKKDPNLQRYVNSPSGKKVFTACKLRLPSC

SEQ ID NO: 129055 - protein, 162 aa, Triticum aestivum
  unsure (1)..(162): unsure at all Xaa locations
  Clone ID: PAT_TA_23473.pep
AASTRPPRSGRRCPHQSLRCAHLQPGGDGDVREARARGRRWRPAEAAAPSSYTGRRGLVAHEAAGPGKGEKQGRYCSREAGRREGESSGGADADAAALHGGQLGGGRSLAARNPTCSPIPNRVCSPAGTLFSYDVRMVNARKITRPRMGFXGMYSSTEGWXT

SEQ ID NO: 129056 - protein, 181 aa, Triticum aestivum
  unsure (1)..(181): unsure at all Xaa locations
  Clone ID: PAT_TA_23474.pep
EVGRSQTYTPTADDIGHVLRFECAAVDTEKKVPAGPPTSIMTSRVIPAPTPXPRRLIQVNGDVLGHLDMDSQSSSFGTFTVLSYNILADAYATSDAYSYCPTWALSWTYRRQNLMREIIGYHADIICLQEVQLNHFEDFFAPEFDKHGYQALYKKRTTEVYAGVPHAIDGAPRPRIRFTKN

SEQ ID NO: 129057 - protein, 382 aa, Triticum aestivum
  unsure (1)..(382): unsure at all Xaa locations
  Clone ID: PAT_TA_23475.pep
GDHLTNKYRLTVAVTKNDDIELGGSPHIFTFEELEVATDGFSASRELGDGGFGTVYKGKLKDGRVVAVKRLYKNNYRRVEQFLNEVDILSRLLHQNLVILYGCTSRMSRDLLLVYEFIANGTVADHLHGSRSAERGLTWPLRLNIAIETAEALAYLHAVEIIHRDVKTTNILLDNNFHVKVADFGLSRLFPLEVTHVSTVPQGTPGYVDPVYHQCYKLTDKSDVYSFGVVLVELISSKPAVDMSRSHSEINLANMALNRIQNHEVVKLIDPELGYDTDPETKRTIDRVAEVAFXCLQLERDLRPSIKEVVEILTCVRDGDCRANSMKKKKASQKEDASLLKDGLQFSPDTVIHRFHSQSTNHSVASNASGLSITANAEKNAT

SEQ ID NO: 129058 - protein, 72 aa, Triticum aestivum
  Clone ID: PAT_TA_23476.pep
TDSDGAYLASKCRSIYYNTLHAMRHQRLVVYAASWGRQTALPYFAAAAGVSCCCMSARARSNCAQPRAEFGT

SEQ ID NO: 129059 - protein, 82 aa, Triticum aestivum
  unsure (1)..(82): unsure at all Xaa locations
  Clone ID: PAT_TA_23477.pep
MEVGNGGDSAAMEVEAAAAASGSPVPGGVARRLGLRNSIQTNFGDDYVFQIALVPXFSARAVSLSANALKFXAPTTGQYLGE

SEQ ID NO: 129060 - protein, 82 aa, Triticum aestivum
  Clone ID: PAT_TA_23478.pep
IEIDKIAIGLLHLSVFSPISSLFLAFANSCKYPPYGCPASFCVGLAETIVVSSASFYTYLFTWCSCSVEKRIQILYRFYNLV

SEQ ID NO: 129061 - protein, 344 aa, Triticum aestivum
  Clone ID: PAT_TA_23479.pep
MRGGRQDAAMAEGSVGEQMVHRTSTQINGGEWQWGGSRHNFVPSYPLRGEVITLAGRDYMEDSHVCIPNLAKNFGDNMVDDEVIAFYEGLGGHGGKQYVRDNLPRVIVEDAAFPLELEKAVRRSFVQTDSQFAEKCSVQDGLSSGTTALTAMIFGRSLLVANAGDCRAVLSRRGAAIEMSKDHRACCLNERKRVESLGGYVDDGYLNGQLAVTRALGDWHLDGLKEMGEPGGPLSAEPELKMITLTKDDEFLIIGSDGIWDYFSNQNSVDFARRRLQDHNDLRRCCKEIVEEAIRRGATDNLTAVMVSFHQEAPPQIRVNRTGRVERSISAEGLHSLRVLLEGQ

SEQ ID NO: 129062 - protein, 65 aa, Triticum aestivum
  Clone ID: PAT_TA_23480.pep
KLVIRDRNVGFLNYGTRDQADYRFFAAAFYAAHPLRPGGSVKFYINLFDSRDLVMDQKGGFCQFT

SEQ ID NO: 129063 - protein, 122 aa, Triticum aestivum
  Clone ID: PAT_TA_23481.pep
YFVGWKPEMISNFKELQTLETVHASKDLSLELKKMSKLQTVWIDDINASNCDDLFKTLSDMPLLSSLLLCACDEKETLSFQALKPTSEKLHRLIIRGGWAAGTLKCPIFKGHGKNPNFWGSK

SEQ ID NO: 129064 - protein, 170 aa, Triticum aestivum
  Clone ID: PAT_TA_23482.pep
MPPPCQTLCRLPATNLGLPWCPRSIPLPRLALAARRARAVAARASSSSSSPDSSFGSRMEDSVKKTLADNAVVIYSKSWCSYSMEVKGLFKRIGVDPHVIELDQLGAQGPQLQKVLERLTGQSTVPNVFIGGKHIGGCTDTVKLYRKGELATMLTELDIKVNHHDKIEHD

SEQ ID NO: 129065 - protein, 192 aa, Triticum aestivum
  unsure (1)..(192): unsure at all Xaa locations
  Clone ID: PAT_TA_23483.pep
PPPISTPVARPPPVRNHHQIPNPNHNPAFHRPPHPHHMPMPPPGPAWADSPVSAYMRILENSLFSATPPGAAAAAAAAAHAHAAAAAAAAGRGPPQHPYHPPPPPVPSPGILPSPTGFLNLLSPTPRSPYPLLSPGFQQPPPLTPNFPMLSPLPGTGILGPRXMPPPPSPRXYGPESPSGLLXTSGFFQLLS

SEQ ID NO: 129066 - protein, 192 aa, Triticum aestivum
  unsure (1)..(192): unsure at all Xaa locations
  Clone ID: PAT_TA_23484.pep
MASLSSLFLASAFLLAGSAFFYRYDTGSGNKTSATTTTHLHFYMHDDYTGPRPTAMRVVSGRAISTGDDATALKTAPRQFGDIVVLNNALTVGPSGGSARVGTAQGWAVRVSEGGIVSDLTLHLVLEACEHHGSSLTARGRIDMDAXLRESVLIGGTXGRFRYARGYMLTKNYDYSLATGGVLEIDLYVHHD

SEQ ID NO: 129067 - protein, 474 aa, Triticum aestivum
  unsure (1)..(474): unsure at all Xaa locations
  Clone ID: PAT_TA_23485.pep
IDDDEDKRSATAVHEKGFNFDDXXIMRGAWRNEPNPEACMEFFRCLAICHTVLPEGEETPEKITYQAASPDEAALVAAAKNFGFFFYXRRTPTXVMVRESHVDRMGSMQDVADEILNVLGFNSTRKRQSVVCRFPNGKLVLYCKGADNVIYERLADGNYDIKKTSREHLEQFGSAGLRTLCLAYRDLSMDQYKSWNEKFVQAKSSLRDRDKKLDEVAELIEKDLILIGCTAIEDKLQEGVPACIETLSAAGIKIWVLTGDKMETAINIAYACSLVNNDTKQFILRAQTDTIREAEDRGDPVEIARVIKESVKQSLRSYLEEARRSLSSTPERKLAFIIDGRCLMYALDPALRVNLLGLSLICHSVVCCRVSPLQKAQVTSLVRKGARKITLSIGDGANDVSMIQAAHVGIGISGQEGMQAXMASDFAXAQFRYLLIYSCHGRWXYLRLCKLHILLTXTDITLTSPVTSKLSGSY

SEQ ID NO: 129068 - protein, 144 aa, Triticum aestivum
  Clone ID: PAT_TA_23486.pep
QICAFVKQYRPRALALEQLEDVVVQTYYSAQSRRSCKQCFTLRFSKPVASKLQWTELQNLQLSGDCDRRTPINIHVRFVPESRVKGLESSVDDSMSAPPLRGVARRGYPVGRITMVSTPLNSRFTITVRAGEPTRPPTRPPTLP

SEQ ID NO: 129069 - protein, 374 aa, Triticum aestivum
  Clone ID: PAT_TA_23487.pep
AAFSFSEKSTGNRSNRFQARGFALSSGCFVLAGILVPGQLGSVAQLNEGRLLKKRPTEFRVDRVLQPFDSAKFNFTMGGLEEVLFRFEKGGGDSSYFLENAPSTEGDHAPSVVAINVSPIEYGHVLLIPRVLDRLPQQIDPESFLLALHMAAEAASPYFRLGYNSLGAFATINHLHFQAYYLSVPFPVEKAPTKKIPLAKCALNSGVKVSKLTNFPVRGLVFERGNTLKDLADVVTNACIWLQENNVPFNVLISDSGRRIFVFPQCYAEKQALGEVSQDLLDTQVNPAVWEISGHIVLKRRTDFEEASEASAWRLLAEVSLSEERFEEVKACIFEATGLTESDEEEESSESPYASSSSVPQASSHMSEGCLVLQ

SEQ ID NO: 129070 - protein, 154 aa, Triticum aestivum
  Clone ID: PAT_TA_23488.pep
MATLKDAVARKPILATIRLLVPAGAARPAPPVGPALGFYRLNLMAFCKDFNARTQKYKAETPMQVTLTAYKDSTFEFVVKSPSVSWFLKKAAGIETASTRPGHNVVSSLTLRHVYEIAKLKQADPFCKHMSLEALCKSIIGTANSMGIEIVKDL

SEQ ID NO: 129071 - protein, 169 aa, Triticum aestivum
  Clone ID: PAT_TA_23489.pep
SALTIAMYAAPMVAMRTVVKTRSVEYMPFSLSFFLFLNGGIWSVYSLLVKDYFIGIPNAMGFVMGTAQLALYMAYRNKKKLVVLKEEDEEKGAVHLMGQVELGQAKVPSLKKGLSLPMPSSLPSPLHGFGNLIKALSATPLELHSVLSQHERVGAKEEHHDDEHAYSSK

SEQ ID NO: 129072 - protein, 228 aa, Triticum aestivum
  unsure (1)..(228): unsure at all Xaa locations
  Clone ID: PAT_TA_23490.pep
FADDGMYLKGTFDDEFGRENWSERTRRVASKMSRSVVALASFIVESDSAEELKKRRKHFACSGVFIECDGSTTSVLTSSXLXLRTLGERKQXFILNWEIEVCLPSKRRVGLGHCNIVILHYNVXAVVSIMGVCSHRAAKLDEVSQTEVIGLGRGFMSGMLMATNGAVTGKCSKFDCKELWVSTCKISQAGIGGPLVDCDGNFVGMNFYDMEKTPYITRDIILETHEAF

SEQ ID NO: 129073 - protein, 155 aa, Triticum aestivum
  Clone ID: PAT_TA_23491.pep
MEAAALARLPEYASTTAPLTGKRWSLPRAQRRSPRAAALAPGVASFSSASPTTRPPRIQRRGPGTKCAGRRRRADIQSDTYVLLEPGMDEEFVSKEELEVRLRGWLERWPGGALPPDLARFDTVDDAVSYLVRSVCELEVDGEVGSVQWYQVQIE

SEQ ID NO: 129074 - protein, 190 aa, Triticum aestivum
  unsure (1)..(190): unsure at all Xaa locations
  Clone ID: PAT_TA_23492.pep
CKPTTTPMSTTDKLNAVDGVLLSSSDATEYRSIVGGLQYLTITRPDISYAVNRVCQYLQSPRDTHWXAVKRILRYIPXTVAHGLHIRPSDSXCLSAYSDADWGXAIPDDRRSTGGYAAXLGPNLIAWSAPETSYCPPYNTEAEYKAVAIAPSVIVCLLPCCYRQSPLRCPPAWLHNRAMPNNNCTLATSQ

SEQ ID NO: 129075 - protein, 211 aa, Triticum aestivum
  Clone ID: PAT_TA_23493.pep
LSVGDKPRRKRPDIDLGEGFYYYAGFGPGTKRRRTSSSGSVPEPPLPAEPLKEEAPDEMQLDFSAGQVQAANESDHQVVLAPSAHIVDEPGTAGMVGCDKESSDDGMQELPLPAKQPKEEAPSEMQLNFSAGQEQADDSNHQEAAASVRVVNKPTGNDGTTGIAGWDEESSDEEALGCNGEQPCDTKRKGPFKKRWRKPVKARSLKSLMMS

SEQ ID NO: 129076 - protein, 212 aa, Triticum aestivum
  Clone ID: PAT_TA_23494.pep
MSSSGICKHLKCVYKLVVDNFLAMITIPMAAATVVVAGRRLGPEEIVGQLRDLTPAHLFLFGFLPISAVAMYLISRPRKVYLVDYACFHGTHHYRIPFASFVEHARQLPTFSEGSIRFMSRLLEGSGLGEETCGPTPARYIPPHKYCTLDAAREEAELVVFSAMDELFSKTNVSLDTIDILVVNCSCFNPTPSFTDMIVNKYKLRGDIRSVH

SEQ ID NO: 129077 - protein, 108 aa, Triticum aestivum
  Clone ID: PAT_TA_23495.pep
MELRKRTIDYNPKRTRSNSTQLATSSSDGTVRLWNAAERTGALQIFLGHSSHVTSVDFHPKLTEILCSCDDNGEIRFWTVGQNAASRVSRVKQGGTLAAFLYLQSPLP

SEQ ID NO: 129078 - protein, 351 aa, Triticum aestivum
  unsure (1)..(351): unsure at all Xaa locations
  Clone ID: PAT_TA_23496.pep
ESCSLLRSNATPAGSFQATGPGADVNPFQPASSTSFGFEDTLGDLSFASNAAPGQQDIFGSTTSLPSGVSHATTSQQTPPAIVCSPTSPSITHAQSIFLRSYTVFSSSNPTCSSAKLAPSFAPPQPPQHAAPSFAPPQPPQHAAPTFAPPPPPQHAAPNLPSGPSNFYMQPASQNGAPPSYAPPQSSHLPPQHAPQQSFLPQTAAPAPQAPSISRGASQPFGAPNSVPSGXSTPLQSSLSAPPETLISALQVSQTQPVKKFEPKSTVWSDTLTRGLVDFNISGAKTNPHADIGVDFDSINRKDKRQDKKISQAPVVSTITMGKAMGSGSGIGRAGASAVAPPSNPMGAGRG

SEQ ID NO: 129079 - protein, 135 aa, Triticum aestivum
  unsure (1)..(135): unsure at all Xaa locations
  Clone ID: PAT_TA_23497.pep
EXPCQEFCPEIAVPPQXATLTREVXPRREWXVFVRGXXRXVNDSRXSPPPPPPPEAXGTSSSLRGRPPRRPGSRPGATSXGDDDFSLAPXLITPSPPAGGIATSQRRRRRAAYTERLRPPRSARHVRRRAGALSG

SEQ ID NO: 129080 - protein, 235 aa, Triticum aestivum
  Clone ID: PAT_TA_23498.pep
MVSQHGILLAAGLISDHFGPLVAMVCDCLLRHGALQLTEIVRRLKLPQGQVKNSLLVLIQHNCVQAFSSPRGDRTITLYLAIFDNVLHRLRFSKFISIIRADIPESEALIEGLLQNGRLTFDQLVGRTISKVPEGTIRPAREEIRMNFNRLVYARYVERCPKAEPYFNPQEDEQSTGARRRVPKTAEEVLSLEQKVVNTATLSDPERFSEIPYSMEDASKTNDGPHNAVAGAKRK

SEQ ID NO: 129081 - protein, 156 aa, Triticum aestivum
  unsure (1)..(156): unsure at all Xaa locations
  Clone ID: PAT_TA_23499.pep
AAYILGIKIYRNRSRRLVILSKDAHLDMFLKGFKNRSSQRRGSYLELXGVKLSKTQSLAHGRRKRKEEGRPYAFVIGSIRYAMLSTAPDVCLATCLARGYKGDLGMDHQIAVKIILRGIRXMFLDYGGDKEFDVKSYVDARLTPIWVALSRDTGYI

SEQ ID NO: 129082 - protein, 133 aa, Triticum aestivum
  unsure (1)..(133): unsure at all Xaa locations
  Clone ID: PAT_TA_23500.pep
XXAIRWLGTPFLLCVRAYDLGTCRNVDVTLMSSNPFPGXFSVAITRLVLCPALXLGCGPTTGILVGPLXGAPWAGSSTEMCSLVKKTQEPLLGWDSRKTGCSAYLHLTFCGCIPSVYKAIDVAGRFFRPSDSS

SEQ ID NO: 129083 - protein, 165 aa, Triticum aestivum
  unsure (1)..(165): unsure at all Xaa locations
  Clone ID: PAT_TA_23501.pep
MDTSTRAAKIPSLPQQTEINWDNLDMTKLYVVGAGMFSCVTVALYPVSVIKTRMQVASGEALRRNALATFKNILKVDGVPGLYRGFGTVITGAIPARIIFLTALEKTKATSLKLVEPLQLSESMEAALANGLGGLTASLCSQAVFVPIDVVSQXLMVQGYSGHVR

SEQ ID NO: 129084 - protein, 566 aa, Triticum aestivum
  unsure (1)..(566): unsure at all Xaa locations
  Clone ID: PAT_TA_23502.pep
MLSRLAARRPRPGSTRAAAYRSSAAASSSVLPDALDRSSDAYARNAAGVGGLLSDLRSRVSQVLGGGGAGAVKRNEGRGELLARPRIDRLLPSEAYFLRGSQQGRKPVLQEALPSGGIGTGIPRVHGRLXSVCLSAPANPVGYILKYRVFRMLLLCKSCIVRKLPCIYLXVDSGGANLPKQAEVFPDRDNFGRIFYNQAKMSADGIPQIAVVLGSCTAGGAYIPAMADESIIVKGNGTIFLAGPPLVKAATGEEISAEDLGGASVHCKVSGVSDHFAQDERHGLALGRNIVKNLHLAAKETSIHNSACDYQEPLYDVQELRSIAPADTKQSFDIRSIIARIVDGSEFDEFKKLYGTTLVTGFARICGQPVGIIGNNGILFTESSLMLLSXSIKPTQRNIPLIFIQNTFACMVGSKSEASGIAKAGAKMVMAVSCSKVPKITIIVGGSFGAGNYGMCGRAYSPNFLFMWPTARISVMGGIQAAGVLAQIEKNNRKRQGVEWTKDDEEAFKAKVVEAYDKEGSPYYSTARLWDDGIIDPADTRRVLSLCLSASAKPVPEDTKYGVFRM

SEQ ID NO: 129085 - protein, 292 aa, Triticum aestivum
  Clone ID: PAT_TA_23503.pep
AKNTPSPPPRARSRRGAAPTSPTPAHEASSPVEHPCVTLWEWWPVRVEGEERKLAVSGFTERNDAFTSAPIAHRYEPLTLQDEGGVVVLLHGSISLLRMRQNGFSVQICEQFMIGFPSWWETWDSHMESYPNCFIDPREGSAQFYLEKFQLGNFIQKFGPSFIEDLLNNAKNFPIDHLDAFTESSRFQEHNCGNDASTNENSAASDDARPATVANVEIGLTTSSTSQERDHVDIECNVSLAPAETYTGDETCKEAGNQNDTTHPDAREDNAGSHLFNSDWTCTMCPDHMPND

SEQ ID NO: 129086 - protein, 124 aa, Triticum aestivum
  unsure (1)..(124): unsure at all Xaa locations
  Clone ID: PAT_TA_23504.pep
RRRDLTARVVRRRAPGPDPGTSAPIWAPGGRPPGMVSLSAAREXKDERXRTCGRRRRMAFLAAAPKVGSFTVPTRARXGLWAYGLRAPPLPSRPGFXTWXXGPPXXMVLSLSRSDLLCFXTXXS

SEQ ID NO: 129087 - protein, 171 aa, Triticum aestivum
  unsure (1)..(171): unsure at all Xaa locations
  Clone ID: PAT_TA_23505.pep
MAMAQGQGQGAATSLPPGFRFHPTDEELILHYLRNRAAAAPCPVSIIADVDIYKFDPWDLPSQAVYGDCEWVLLQPRGIRNYPNGIXRPNRAAGPGTGKATGPDKPIHTPPPARRRRSRRLXXXKGAPQRHKMLVNHIRSRDPHTRQNYNSQLSGNMGTHSMKKENQVFFD

SEQ ID NO: 129088 - protein, 131 aa, Triticum aestivum
  Clone ID: PAT_TA_23506.pep
MADEEGCMYAVQLALSSVLPMTLKAAIELGLLETLVGAGEGTLSPEEVAAKLPAKANPEAAAMVDRMLRVAKPPTRSCPAWVEEGKDGTSPRRYGAAPVCKWVNPNEEGVSMAPWGIIAQDKFSMDTWCYF

SEQ ID NO: 129089 - protein, 202 aa, Triticum aestivum
  Clone ID: PAT_TA_23507.pep
MAAESSVPQTSSESAAHKMGFFRVPDLLVKLSTKCLIELDAVRSPTSPLDLKLFTGLATKSPRSSFLDAGAASQNQKILLGDRVGLGLVDSLSDENNPTPLGSRKVLGSEMRITEDIDTQKEIAVIKWQPSPLFHKLPRKSAAPTRWAASESLIFCQTEHKCLIDLDAVRSLTSPFRPEIVQRQAEQLIPDRLSLMPAQPLI

SEQ ID NO: 129090 - protein, 178 aa, Triticum aestivum
  unsure (1)..(178): unsure at all Xaa locations
  Clone ID: PAT_TA_23508.pep
IHAHARIMHGMLYAMHACLHASEVMDGTTGKKGFNPLSWIEQEKIVISDAAQRAHHEPEAARRRRETARAATLAASRHVADPTPAVVRHRPHRPGRPPRPIPRRAASSCPWHERAGRGAEHSSTLGAQEETLIMAGQLXKLXEXTSFSRLLQRNVMGXEELQVXXYTXSXIVAPIXXP

SEQ ID NO: 129091 - protein, 71 aa, Triticum aestivum
  Clone ID: PAT_TA_23509.pep
IERVAASTREQFNCLFLRGFDDILGCDTSHPGGPEGMTAWEGLGEVTKTTYPEVTHGLEKSTGICGRSCFL

SEQ ID NO: 129092 - protein, 100 aa, Triticum aestivum
  unsure (1)..(100): unsure at all Xaa locations
  Clone ID: PAT_TA_23510.pep
PGGRLRGGAGGERGRRGRRRPATASRKXYXEXRPRVKARFAXKRTDQDADGDDVDAEAHAVPSSTSXYLLDFGYGVVPSFLIRRPGAAGGRPRFHVLLLG

SEQ ID NO: 129093 - protein, 163 aa, Triticum aestivum
  unsure (1)..(163): unsure at all Xaa locations
  Clone ID: PAT_TA_23511.pep
RNPSWGATSSSTNLTRSPLTEQETQRSPPDQRSFLITPVQCFGNSGATDEFPLELRTQEVASSYSTVKDYTQAPSNIISCRRLLIIIRFFHLFNPRTPEPGASISANGSRHWYHHPHPRKVLETFWVGAVSGFGSSRSRGSRLHPTIPPHGQPPLPPGXXTXL

SEQ ID NO: 129094 - protein, 98 aa, Triticum aestivum
  unsure (1)..(98): unsure at all Xaa locations
  Clone ID: PAT_TA_23512.pep
TRGGKILWXLXXPPFXPVTSHDIQXSDXYXCALTTXIVVTWNIIICCIXXXSAMTSTXLTSPTGICLSRXLXSTXSSSITXLIQINLKSCCSTQVCMY

SEQ ID NO: 129095 - protein, 148 aa, Triticum aestivum
  unsure (1)..(148): unsure at all Xaa locations
  Clone ID: PAT_TA_23513.pep
MAQWNGMEQAATIAQLVGVDALGLISTIVQAAQTVQRNKETCQELVQDVQLINGLLRMLQNPEMMQREEIVNALNGLEGTLREAYSLVSSCQDCSTTYRIFMGWXHTDQFRRVKKKIAKHSASTYDLHADITVVPKNNMLSPSSSVVS

SEQ ID NO: 129096 - protein, 124 aa, Triticum aestivum
  Clone ID: PAT_TA_23514.pep
MSSGKVKAGELWNKSKDDLTKQLAELKTELGQLRIQKVASSGSKLNRIHDIRKSIARVLTVINAKQRAQLRLFYKNKKYAPLDLRAKQTRAIRRRLSPDEKSRVLEKTKKRTVHFPQRKFAIKA

SEQ ID NO: 129097 - protein, 124 aa, Triticum aestivum; identical to SEQ ID NO: 129096
  Clone ID: PAT_TA_23515.pep

SEQ ID NO: 129098 - protein, 424 aa, Triticum aestivum
  Clone ID: PAT_TA_23516.pep
SSRSKLTLTKGGTTWGWIHPSPPHQIPSISIHLSQSLRLVFSTSTQTWAAAAASDLESKAKEAFVDDDFELAAELYTQAIEAGPATAELYADRAQAHIKLGSYTEAVADANKAIELDPSMHKAYLRKGSACIKLEEYQTAKAALEVGSSYASGDSRFTRLMKECDDRIAEEASQVPVKNAAAAVASATSSGASSGATTVATEAEDQDGANMENAQPTIEVPSKPKYRHDYYNTPTEVVLTIFAKGVPADSVVVDFGEQMLSVSIELPGEEPYHFQPRLFSKIVPDKCKYTVLSTKVEMRLAKAEPVTWTSLDYTGKPKAPQKINVPAESAQRPSYPSSKSKKDWDKLEAEVKKQEKDEKLDGDAALNKFFREIYSDADEDMRRAMMKSFVESNGTVLSTNWKDVGKKTVEGSPPDGMELKKWEY

SEQ ID NO: 129099 - protein, 64 aa, Triticum aestivum
  Clone ID: PAT_TA_23517.pep
HASADGAAAYTKALGLELDLTEKGLGLRSRRFALLADDLKVTVANVEEGGQFTISGAEEILKAL

SEQ ID NO: 129100 - protein, 162 aa, Triticum aestivum
  Clone ID: PAT_TA_23518.pep
MAPIGVGSTLPDGQLAWFDENDQMQQVSIHSLAAGKKVILFGVPGAFTPTCSNQHVPGFITQAEELKAKGVDEILLVSVNDPFVMKAWAKTYPDNKHVKFLADGAAAYTKALGLELDLTEKGLGLRSRRFALLADDLKVTVANVEEGGQFTISGAEEILKAL

SEQ ID NO: 129101 - protein, 110 aa, Triticum aestivum
  Clone ID: PAT_TA_23519.pep
HKVRVIACDSRSAEATLPVPFEDLPRQPVDCEHGNPSFDVCDGDLVVVSEGGAKPPWNGDPSTFSLKIKPLRIQCICVCLLRPSATNFTGPCTLGMSVAHAFTDKGVINA

SEQ ID NO: 129102 - protein, 281 aa, Triticum aestivum
  unsure (1)..(281): unsure at all Xaa locations
  Clone ID: PAT_TA_23520.pep
MVHHISDEAADEPSITTQTPSNDPSQAPLVYKVGYPPPKNLATEFTETLRETFFHDNPLRQYKGQSXTEEVMMGLEXCFPIFGWGRDYSLNKFKGDLIAGLTIASLCILTDIGYSKLANLDPQYGLYSSFIPPLIYAAMGSSRDIAIGPVAVVSLLIGSLLQAEVDHVKNKEEYMRLAFTATLFAGITQAALGFLRLGFLIEFLSHAAIVGFMGGAAITIALQQLKYVLGIANFTRKTDIVSVMESVWRSVHHGWNWQTIVIGVSFLVFLLFAKYLGRDHA

SEQ ID NO: 129103 - protein, 223 aa, Triticum aestivum
  Clone ID: PAT_TA_23521.pep
SFSFPSIPMSRRAPPSIPSSPRSSPSPQPPALSLHSPPPFLYHVVVDPTAGLLLCLPPPVLFHVTVDPDRTLSLRAPCSPFQPIGHSRTNPSPRCSHPLLPPPPPPPTAIAPITWPPGDARVGPGKKVRACEGKQRGLVQRQMQAGSAVEGGSSAGTTGARRSCRRKCWRGRPWKKARWTEHQDQGKSRVVQVCLLSPPHSIFALSLIFPFVLWIRASVHHEE

SEQ ID NO: 129104 - protein, 213 aa, Triticum aestivum
  unsure (1)..(213): unsure at all Xaa locations
  Clone ID: PAT_TA_23522.pep
MWQSKPVLVLLLLAVSTAATVGKPLLTKVTKGVTSTALYTAPLSAGRPLVLDLSAPAITTPCSGQTTTVTVSANSTDGSNPISPGSFAATATCAAAPSGAVGVAGLARSSASFXGQVASTQKVXNSFALCLPSNGVGAASSRRSIFLTPPADGGITRSLRRVRSQPLREPVLLTPRIHHGPLPPGRGYVAPKILNPHLRTAYAWREACIENSW

SEQ ID NO: 129105 - protein, 287 aa, Triticum aestivum
  unsure (1)..(287): unsure at all Xaa locations
  Clone ID: PAT_TA_23523.pep
PTEQADKLVRASPYTGFVWIEYRAFLLDLADVAKARSXAERALRTLIVREEEEKLNVWVRRALRTMNCREVQQKLKVWVAYFNLQNEYGGRREDAVKKIFQRALQYCDPKKVHLALLGMYERTKQNELADELFDRMTKRFKTSCKIWLRRIQFSLTQGKDVEYIKSVVNRALLSLPQSKRIKFLTQTAILEFKCGVAEEGRSRFELILREYPKRTDIWSVYLDQEIRLGDXEIIRALFDRVTCLSLPPRKMKFLFKKYLRYEKAQGDEERIKHVKQKAMEFVEICRA

SEQ ID NO: 129106 - protein, 204 aa, Triticum aestivum
  Clone ID: PAT_TA_23524.pep
MAMAGGAPPAPLPVVGHQFCAPYVVPLTVTKKALSLSDGDFAITDANGAVVLKVKGAIFSIRSRRTILDGAGLPLLTMQEKVFSMHHRWEVFRGYSTNSGDLLFTVKTTSLIQLKTEMDVFLAGNTAQQVCDFKIKGSYFDRSCVFYLGDSNNMVAQMSRKLTVSNVLLGRDTFSVTVFPHVDYVFIASLVVILDEVHRDKRED

SEQ ID NO: 129107 - protein, 204 aa, Triticum aestivum
  Clone ID: PAT_TA_23525.pep
MAMAGGAPPAPLPVVGHQFCAPYVVPLTVTKKALSLSDGDFAITDANGAVVLKVKGAIFSIRSRRTILDGAGMPLLTMQEKVFSMHHRWEVFRGDSTNAGDLLFTVKTTSLIQLKTEMDVFLAGNTAQQVCDFKIKGSYFDRSCVFYLGDSNNMVAQMSRKLTVSNVLLGRDTFSVTVFPHVDYVFIASLVVILDEVHRDKRDD

SEQ ID NO: 129108 - protein, 77 aa, Triticum aestivum
  Clone ID: PAT_TA_23526.pep
SAESLYYNPAWHIIVSSWETIVYSPLLDLDRWAIPIASLLLFWLFYWRCFARRKRGSRSVLPLYKNSHKNSSRPRSD

SEQ ID NO: 129109 - protein, 213 aa, Triticum aestivum
  unsure (1)..(213): unsure at all Xaa locations
  Clone ID: PAT_TA_23527.pep
MAASPSLHAPRLLPLLPNPAPSLARPRRRFTAASAVPPSRNGSSAGTDWCPVPPEQRPVNEYEALAASQPFSWAAGDLRLYCSRLAFTGAAFALFVGLPVAAFGGRGGVRXDALHLALGATGSGILAVTLAVVRMFLGRALGRNRLPIXNGQYXDXGXXDGXIWVKIXEFLTXXXXLXXSFSVXPVXXXVXSPWVGLXVXXLXHLLPHLGWRT

SEQ ID NO: 129110 - protein, 112 aa, Triticum aestivum
  unsure (1)..(112): unsure at all Xaa locations
  Clone ID: PAT_TA_23528.pep
XEWYGPPXKIRTVSLEYSDEMKWFXXPLCVXFGMXGCPVVVERVHIWSSNEVMKPRRXQLEREXVLGGCIGGQGPTVLHQCWTNNRLLHLICREKKAPVLGGNWGLRLKGYL

SEQ ID NO: 129111 - protein, 104 aa, Triticum aestivum
  Clone ID: PAT_TA_23529.pep
SSNLPGFDLSGDAQLGTHLLYPIAPQGHLDCLAIGGRFKINLVAQKGTLTNTCNLLKLKNRYKCEVGKSFVQGQQSKRSWDDRSAEFEKSKQLYLICPAKRKKN

SEQ ID NO: 129112 - protein, 181 aa, Triticum aestivum
  unsure (1)..(181): unsure at all Xaa locations
  Clone ID: PAT_TA_23530.pep
QKKLNLPFPHSETPKGFRGFAVNLINLSAENLEIITSSGHGLRETLFYRLFGELQVYETRNDMRQAMPHLRNXXAISLDGGIIKGDGMLLLGYSDPEIIFPVMPDAPDILEDPEDVFTKVKKMNAEKNVLETVENKIRRAEENRQKLVMKXNKKKRKFDEMAEVMSQPSGSQLDQYHPVSQ

SEQ ID NO: 129113 - protein, 149 aa, Triticum aestivum
  unsure (1)..(149): unsure at all Xaa locations
  Clone ID: PAT_TA_23531.pep
MARTKQTARKSTGGKAPRKQLATKAARKSAPTTGGVKKPHRYRPGTVGAPGDXASTKKSTELLIXRKLPFQRLVPRNFARLXRTHSRFHPKPLLALQRRRPKATPSGVSKTQLXAIHAXXLHHPKGHPLPRXIPCEKAKLPLRTPYGVG

SEQ ID NO: 129114 - protein, 159 aa, Triticum aestivum
  unsure (1)..(159): unsure at all Xaa locations
  Clone ID: PAT_TA_23532.pep
SLAMADATAPRPLLRRALSFREPLLLIPHLVGFLGTVASAFFHSYASFLQSFARSILVPSPAAXAKCAYATSSAAHVAPCCEDVRAEEEEDNELRKEEVEAIMARIGLGVAGSGEGLKATWGTRVSRCTRGATPGGPRSRFTPDGHRDCRRLAARLPES

SEQ ID NO: 129115 - protein, 156 aa, Triticum aestivum
  unsure (1)..(156): unsure at all Xaa locations
  Clone ID: PAT_TA_23533.pep
MQIFVKTLTGKTITLEVESSDTIDNVKAKIQDKEGIPPDQQRLIFAGKQSEDGRTLXADYNIQXKESTLHLVLXRLRGWHAVLPSKTLTGKDITXEVESSDTSDNXKAKFQDKXGIPPDNTSILLGTLQDGARPDTTSRRTKSTGLKPLVEHFLKT

SEQ ID NO: 129116 - protein, 139 aa, Triticum aestivum
  Clone ID: PAT_TA_23534.pep
ALPLGFNKVITTWFIRGVKHTSAKAYHLESKNMTKQLVETIGEKTIMIHSLLLEQLGLLASSLSPSPFPSFLASRPGGGRSRRGPCPWTPRRGTRRRSSRRRSPPAPSSPSPISSSGGFGLLEVSSIHQPRLITWKVKI

SEQ ID NO: 129117 - protein, 145 aa, Triticum aestivum
  unsure (1)..(145): unsure at all Xaa locations
  Clone ID: PAT_TA_23535.pep
MEMFLPAILSDLLGRSVSFLVQRYLQQGSAEDSVQQLRLALLRAXVTVEEAEGRRITNXKAMLRQLDVLXREAMYGGHYMLDALTCGRGHAAADDAPAPGPRPLPAGRRANPPKRPASCRAGPAPPAVRGPRPIAPRGDSPSPLQ

SEQ ID NO: 129118 - protein, 185 aa, Triticum aestivum
  unsure (1)..(185): unsure at all Xaa locations
  Clone ID: PAT_TA_23536.pep
FFFFFLQIVEIVLRQGLVHPITCVPHLIALETDPVEGNSKLAHHLLIASDEKYPSFFESRLGDGLQMSFRFFETIVSNHNVVATNMKSNPIAFVKPGISRIYRLIRANRNSRNKFVHSIVRKFISDSRSYPTIGFLVYCVEVLASLPFTFSDEPLYLVYDINRVIXQIRAGAIVANLKNGTFMDL

SEQ ID NO: 129119 - protein, 248 aa, Triticum aestivum
  unsure (1)..(248): unsure at all Xaa locations
  Clone ID: PAT_TA_23537.pep
MRFHLCDALRLRLTWFPTLVTGVSSLDALDTDPKVENDEFGNEAREGFISVLTNAIPGVDEAMSFAEMLKLVQTMDYSVVVFDTAPTGHTLRSLPCPATRELGLQTWXTCRCLYAVNFLSLYETERLVQELAKFEIDAHNIIINQVIFDEEAVESKLLRARVKMQQKYVDQFHMLYDDFNITKLPLLPEEVCGVQALQNFSKHFLAPYRASLKRGSVEELEERVATLKSALQEAESELDRVRKGKQAA

SEQ ID NO: 129120 - protein, 234 aa, Triticum aestivum
  unsure (1)..(234): unsure at all Xaa locations
  Clone ID: PAT_TA_23538.pep
EAYPYIAQRLLTDESPRLRSALRYTIYGKTGVFDAERFIDVMQAFENFISAAKSGGGEDMKGNMAELGAIGXQPSTSLVPAFPMAISQPXRNPIKARAALSFLLSDRGDFFREFILDEIVKAIDAVSREQLLQIASSFGVRNPVPVFGMVPVRSGALLPTITEEDRIILNNVEKVVKFLSAGTANPTVNGDVNVVSLVQELLPVLPSITSKILPDVLSRLSSRVFARVIRESFL

SEQ ID NO: 129121 - protein, 61 aa, Triticum aestivum
  Clone ID: PAT_TA_23539.pep
MAELEGVFFSDFWMWCFIIYEWFYFFFFFFCFFFFFFFFFFFFFFFFRTNMCHFTVPKLTK

SEQ ID NO: 129122 - protein, 105 aa, Triticum aestivum
  Clone ID: PAT_TA_23540.pep
AAEPCLMNRELDPFLVISSRSTNGVSRRFIAHDEEHRQSRKMMEKKSHGGSGSWRQAPAPVRQLFWRVRRAMLRPKRCALSFGYDHKRYSPELSMTASPLPTASS

SEQ ID NO: 129123 - protein, 157 aa, Triticum aestivum
  Clone ID: PAT_TA_23541.pep
MAVASAWAKPGSWALAAEEQDDLPPPPPPVPASDFPDLATAATTKVPKKKKVQPVSLASFNSAKFVLPSSRGPTPDMLLSLPTGPRERTEEELGGARWGNVSRGSDEMRRGGSGTEDYGPSRADEADDWGVKKPMERRERMGGFGGDSISSRADDVN

SEQ ID NO: 129124 - protein, 137 aa, Triticum aestivum
  unsure (1)..(137): unsure at all Xaa locations
  Clone ID: PAT_TA_23542.pep
YNDNEQLGSTTKYMTHYTVPADQSDICLTGRYLGIVAIKSQDHLLALHGLIASTPWPPPCRTAPPQQDRRSIPKQQAQPHRHALLGRTRSASAYTGLTGVDRRTITRRQEGALLPCSPAVMSRPTPRKXXPPXXGGT

SEQ ID NO: 129125 - protein, 234 aa, Triticum aestivum
  unsure (1)..(234): unsure at all Xaa locations
  Clone ID: PAT_TA_23543.pep
XEIDQFINEXAILSQIIHRNVXKLFGCCLETEVPLLVYEFISNGTLYDLLHIDVSAKCLLLWEDRIRIAVEAAGALAYLHXAAAIPIFHRDVKSSNILLRXNFTTKVSDFGASRSLSLDXTHVVTIVQGXTFGYLDPEYYHTGELSXRRSDVYSFGIILGELLMRKKPIFINEQGIKQSLAHYFVEGLQQGVLMEIMDPQVVEEANQNEIDEIASVAEACLKTKEEKDYQERSG

SEQ ID NO: 129126 - protein, 255 aa, Triticum aestivum
  Clone ID: PAT_TA_23544.pep
MHQNLQNSQQMATAVQQQNFMPQNQPPLSHLPSEKLLAEISQDPQLLHMFQQQYLLSQLQLQSQPPVAPQPQPQLSMLDKMILLQQQQQQQQQQQQLQQRLQLEQQQLLLQQQHLVSHVAPHGHPNQQLDDPYGSKHTTLPAGDSMNLGVRTIQEVLEADRILTNHGTSQVSSQAFMSMRGMEGVGTSQSSVPTVPLPHEFFMGAPSKERFPHTQKLGNSASDNTQLSASMVNTINRSCRKVRGGFWKLSASWNK

SEQ ID NO: 129127 - protein, 260 aa, Triticum aestivum
  unsure (1)..(260): unsure at all Xaa locations
  Clone ID: PAT_TA_23545.pep
HEDIQVYIVYLGEHAGAKSKGAILDDHHALLLSVKGXTEEEARASLLYSYKHTLNGFAALLSEEEATKLSEKTEVVSTFRSDGRWSPHTTRSWEFVGLEEGLSKGWQPSGAHAGENVIVGMLDSGIWPESRSFSDEGLGPVPARWKGVCQGGDSFNSSACNRKVIGARCYLKAYDAHHGRLNTTNAYRSPRDHDGHXTHTASTVXGRTVXGVXXLGXFSVGTXSGGEXXXASSSXXVXWXILSPPXXQNTARIHGQPVDA

SEQ ID NO: 129128 - protein, 228 aa, Triticum aestivum
  Clone ID: PAT_TA_23546.pep
VLHLAMLDDATSLKVFLLLLRWATLPQPLTPPVFDAPPTLLLLPGAQDSPWPSALAQPREVPEPVADKGGSRAAAVVPRRKEAGSGGGSRDGASHGAGEVRTRWRDESTGQPPRGGDGVRGVTLLPPCCLSSLPATSFALSSASSPSTPPRRPCCPALARRRPDPNLEPRRHGREEETSEETRPRRGGETRPATWGRGEEAAVSEERVRLLWGSGKGARVQDALARGV

SEQ ID NO: 129129 - protein, 170 aa, Triticum aestivum
  Clone ID: PAT_TA_23547.pep
IHQDAGGAPRCRHHQGVPHSQIQTQPPTTDHKVGGYIHDYQIQRVLEIKSEADSVTRDKKFQELMKVLARQVVACPQVEYVSMDDIPESVVSKEKEIEMQREDLQSKPDNIREKLGEGRISKRLGVMALLEQPFIKDDSKTVKDLVKETIAGLGENIKVRRFVRYTLGEN

SEQ ID NO: 129130 - protein, 136 aa, Triticum aestivum
  unsure (1)..(136): unsure at all Xaa locations
  Clone ID: PAT_TA_23548.pep
MASIAGSAVSFAKPVKAINTNSLSFSGPRRGNAFLRLQPVPMRFAVCCSAKQDTVEKVCEIVKKQLAVPEGTEXCGTTKFSDLGXADSLXTRXEIVMGPXEESKIKCGGDECAXIATVEDAATSSDNLSLRILKEA

SEQ ID NO: 129131 - protein, 146 aa, Triticum aestivum
  Clone ID: PAT_TA_23549.pep
PKFRVGVFPWPSFSNRPGLPVDPVAPGSPPGAPGARRTEAPRAAARAAHAPYSGCPSGFALPDVEGKVYPGGCLESAAYNPTLAPVQTAIIAMIAASGGSAGDVVAAALVEKEGAVAAQEATARVFLAAVAPQASFHVYKYRSSDV

SEQ ID NO: 129132 - protein, 101 aa, Triticum aestivum
  unsure (1)..(101): unsure at all Xaa locations
  Clone ID: PAT_TA_23550.pep
ALLCSSVYSVVPREYISCALSWLIVYPAIAFLQSRRWIDIDSRRVLGPCKRSVFVPFLALFGMLLFSTIDRETNLVSTPVLALCKXXFYSFVKYRGLKVEY

SEQ ID NO: 129133 - protein, 134 aa, Triticum aestivum
  unsure (1)..(134): unsure at all Xaa locations
  Clone ID: PAT_TA_23551.pep
MAVQPPNPASPVPLVRAANLGGWLVTEGWILPSLFDGIPNNDLQDDTQLQFRSVTQXNAFIAVQNGGGAALVANRASASGWESFKLGRTDTNTFNFKVFXDQFVTTAGVNPGRTAAPGGKPQLVLVAQRTFEKI

SEQ ID NO: 129134 - protein, 96 aa, Triticum aestivum
  Clone ID: PAT_TA_23552.pep
VLPRWRYPGCEGISVVDELMDGKHASGGELEEAFYVFDRDEDGFICAGELWNVMRRLGWKEGAMYEDCVRMIHPFDEDGDGKISFIEFRRMMENAV

SEQ ID NO: 129135 - protein, 133 aa, Triticum aestivum
  Clone ID: PAT_TA_23553.pep
ADAERVTICRSPSLTYPAIAERLLRSRTLSPALSTGSDGGTFLAPSSASSSGLRTMPPLDSMCRRNIASRRAASIGRSSSERAKSGAAASSGGSMTRHEATRASSSRRRLPKERRENCAEGSEETGACASRRS

SEQ ID NO: 129136 - protein, 285 aa, Triticum aestivum
  Clone ID: PAT_TA_23554.pep
FRLIHKKLRGDSHAWGMRKRDLLLRRYWRREEDGTYVILYHSVFHNRCSPEKGYIRACLKSGGYVISPVSQGRQSVVKHMLAIDWKFWKSYLLTSSAKYITIRMLGRVAALRELFRAKNGNCACMEFSSGELMRDMGLPQGGNEPTKIETQSANECERLEGPVEGPQGGSKRHLSSTGSLVQLNDATDEFFDVPDESEYDQREAMWSSDESTHAADQRHAKLSSAAVFVRKLHDLAVQKRGYIDLQGAADADNGPCYYGHTLPKDSSCTMPSSWSMTDPTTFLIR

SEQ ID NO: 129137 - protein, 158 aa, Triticum aestivum
  Clone ID: PAT_TA_23555.pep
MEDGARRASILAKDDATCHGEESQSLLEVSQQPELKPRGSDWRPPAIILGLECLESMAFNGIATNLVVYIRSVLHGGIASSASIVSLWYGTSFFVPILGAGIADAYWGNYKTVLISLVMYLLGMVLITVGSFIPSAPALCNFGSCSSSKGTENLIFFS

SEQ ID NO: 129138 - protein, 205 aa, Triticum aestivum
  Clone ID: PAT_TA_23556.pep
THSSKPVAMAPRLSPFTRTSAVTNPRQLAPIVGLSHDGLTILEGKLKGLEGYVVGRMTKGRRGRIYIDDAGWGPEADSIEYGYRVPFGSIHVFIGKIGEPGPEPDIYTDPVETAQRARSTQVKPAMKRAFVGVIYGGEREDESEHGNETVVYSGDESSTGETESLYRMQDDQVRGCSDGDSIPDPPGPDQPGWNIHGRHTCGESL

SEQ ID NO: 129139 - protein, 139 aa, Triticum aestivum
  unsure (1)..(139): unsure at all Xaa locations
  Clone ID: PAT_TA_23557.pep
MSCLRSVSRPSWSLAISPRNNLIRTPFQRRLTSTQSSGFQGVEDNAFNRERKAVKDHAAATSDLWRKLSIYATIPALIIAGVNTWILWDEHWEHWEHLPTLEERVEYPYQNIRDQKLXGGDGDKTLFWXNDKVNYHKKD

SEQ ID NO: 129140 - protein, 142 aa, Triticum aestivum
  unsure (1)..(142): unsure at all Xaa locations
  Clone ID: PAT_TA_23558.pep
NFAVGLISGVVLGLVWSCKTVVGRWGIGCGPXEEVGPGLLLPRLLPGVEKRSRHTLPPTRXXRSXETRHPGGRGRSASDGDCLIAFPCSCVDGGGVGWRRRGGALSRPVSGRGPAHHVVPQLVQHLAQKLDLIGARTCVTRL

SEQ ID NO: 129141 - protein, 200 aa, Triticum aestivum
  unsure (1)..(200): unsure at all Xaa locations
  Clone ID: PAT_TA_23559.pep
MAAPALPLANHAAPTATARYLHRSQQLLQPKRQLPPGFLAARPLRQPRRPLSAVPETKEEDAKTAEEITEKYGLEVGLWKIFSSKEEEGGEEGXEGKPRKSRTEQAKELLGKYGGAYLATSITLSLISFTACYLLINAGVDVQQLLGKIGIATDETGGKVGTFALAYAAHKAASPIRFPPTVALTPVVANWIGKITKGGD

SEQ ID NO: 129142 - protein, 175 aa, Triticum aestivum
  unsure (1)..(175): unsure at all Xaa locations
  Clone ID: PAT_TA_23560.pep
MKSRTQSGRGGAMVADGGSKMERKEVEKNRRLHMKGLCLKLSSLLPASSSAHHLRHYSTSSSSSPPSSNKDAATQLDXLDSAAAYIKQLPGRVEXLKRRKQAAASGTAGCSSSVSAGDYKGPPLPPTALPVVDGPRRVGTRPGALAGGAGRPFRLXXXIAVLEXXXAXXVSXSXX

SEQ ID NO: 129143 - protein, 144 aa, Triticum aestivum
  unsure (1)..(144): unsure at all Xaa locations
  Clone ID: PAT_TA_23561.pep
DPFLDPDSHLPYGQVQCHPDTGPKEAFLAAATAACHPNPDAQVKFLTSCKEVLETALSLLRRDSHKLSTQDVQXLARLLSPESPYDHDSGDGTSSTPPQILPPWWGLADLYTVVSKGVNILLNKYEQMPNGDPRYEASYDLWCE

SEQ ID NO: 129144 - protein, 224 aa, Triticum aestivum
  Clone ID: PAT_TA_23562.pep
FGTSGYVTTDERLGKALFYWFFEAMEKPDEKPLVLWLNAGPGCSSVGFGQAQELGPFLVKKDVPELELNPYAWNQAANLLFLDSPAGVGFSYTNTSFEIDPPGDNSTAHGSYAFLVRWFQRFPQHKMKEFYIAGESYAGHYIPQLANVIVEENKKASKENYINFKGILIGNAYVDGDTDLQGIVDSAWHHAIISDTLYSAFLKSCDFSIEILSPECDAALSEFF

SEQ ID NO: 129145 - protein, 188 aa, Triticum aestivum
  Clone ID: PAT_TA_23563.pep
MLCRYMHVVDHPETKVDSTISSSTLSKELDVDDADLLALLLESDMTKCLRWDVRLLRLCMARTPCSRFLISGAAIVSQAREGSSSLRNLCGSPPFLLASNKSDHAVGGDMNCPGTTSLVGVSVPGVVVPDVTLPGNSLPGVVVPDAALPGNSLPGDDLSDIALPRNSLPGVVVPDAALPGVAPLRVAK

SEQ ID NO: 129146 - protein, 227 aa, Triticum aestivum
  unsure (1)..(227): unsure at all Xaa locations
  Clone ID: PAT_TA_23564.pep
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGKLXAQRAKSMKFKDGYMISSGQPVNEYMDAAVRHVLLRQGVLGFKVKICLTGTPRQAWPYTPLPDXCTIHPPKEEDELPPPALVRSK

SEQ ID NO: 129147 - protein, 101 aa, Triticum aestivum
  Clone ID: PAT_TA_23565.pep
LPRHAAATAFLADMQLHVISTSWLSNCYCCRCNQACIAMHASKTGLTQQSPPQTYRRVLMIPLLSCGSWNSTQPSAFVGMSAFSAACMPCSCFLISAFLSL

SEQ ID NO: 129148 - protein, 326 aa, Triticum aestivum
  Clone ID: PAT_TA_23566.pep
MATPNPPPQQDEPSSSADPKAKKDYSTAILERKKSPNRLVVDEATNDDNSVVALHPDTMERLQLFRGDTVLLKGKKRKDTICIVLADDTCEEPKVRMNKTVRKNLRVRLGDVVSVHQCPDVKYGKRVHILPIDDTVEGITGNLFDAFLKPYFLEAYRPLRKGDLFLVRGGMRSVEFKVIETDPAEYCIVAPDTEIFCDGEPVKREDEERLDDVGYDDVGGVRKQMAQIRELVELPLRHPQLFKSIGVKPPKGILLFGPPGSGKTLIARAVANETGAFFFLINGPEIMSKLAGESESNLRKASEEAEKNAPSIIFIDEIDSMSTRPR

SEQ ID NO: 129149 - protein, 261 aa, Triticum aestivum
  unsure (1)..(261): unsure at all Xaa locations
  Clone ID: PAT_TA_23567.pep
PKQGRVYDVWPVGSTNDEDGFLSIHAIHLSQQLVQHSIATQRGSSSGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERERRRKDNPEAMEEDEVDEVAEIRAAHFEESMKYARRSVSDADIRKYQAFAQTLQQSRGFGXEFRFPDQPAAGASSAAAADPFASAAAAADDDDLYS

SEQ ID NO: 129150 - protein, 463 aa, Triticum aestivum
  unsure (1)..(463): unsure at all Xaa locations
  Clone ID: PAT_TA_23568.pep
MAAPTPQGEASSSDPKSKKDYSTAILERKKSPNRLXVVDEATNDDNSVVALHPDTMEKLQLFRGDTVLLKGKKRKDTICIVLADDTCEEPKIRMNKTVRKNLRVRLGDVVSVHQCPDVKYGKRVHTLPIDDTVEGITGNLFDAFLKPYFLEAYRPLRKGDLFLVRGGMRSVEFKVIETDPAEYCIVAPDTEIFCDGEPVKREDEERLDDVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGXYVGADLAALCTEAALQCIREKMDIIDLEDETIDAEILNSMAVTNDHFK

SEQ ID NO: 129151 - protein, 360 aa, Triticum aestivum
  Clone ID: PAT_TA_23569.pep
AVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERDRRRKDNPEAMEEDDVDEVAEIRAAHFEESMKYARRSVSDADIRKYQAFAQTLQQSRGFGSEFRFPDQPAAGASSAAAADPFASAAAAADDDDLYS

SEQ ID NO: 129152 - protein, 815 aa, Triticum aestivum
  unsure (1)..(815): unsure at all Xaa locations
  Clone ID: PAT_TA_23570.pep
MAAPTPQGEASSSDPKSKKDYSTAILERKKSPNRLVVDEATNDDNSVVALHPDTMERLQLFRGDTVLLKGKKRKDTICTVLADDTCEEPKIRMNKTVRKNLRVRLGDVVSVHQCPDVKYGKRVHTLPIDDTVEGITGNLFDAFLKPYFLEAYRPLRKGDLFLVRGGMRSVEFKVIETDPAEYCIVAPDTEIFCDGEPVKREDEERLDDVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGYVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSSGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERERRRKDNPEAMEEDEVDEVAEIRAAHFEESMKYARRSVSDAXDIRKYQAFAXQTLQQSRGFGSEFRFPDQPAAGASSAAAADPFASAAAAADDDDLYS

SEQ ID NO: 129153 - protein, 461 aa, Triticum aestivum
  unsure (1)..(461): unsure at all Xaa locations
  Clone ID: PAT_TA_23571.pep
HASDRPNSIDPALXKIGRFDREIDIGVPDEVGRLEVLRIHTKNMKLAEDVELEHISRDTHGYVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERERRRKDNPEAMEEDEVDEVAEIRAAHFEESMKYARRSVSDADIRKYQAFAQTLQQSRGFGSEFRFPDQPAAGAASAAAADPFASAAAAAEDDDLYS

SEQ ID NO: 129154 - protein, 819 aa, Triticum aestivum
  unsure (1)..(819): unsure at all Xaa locations
  Clone ID: PAT_TA_23572.pep
MATPNPPPPQQDEPSSSADPKAKKDYSTAILERKKSPNRLVVDEATNDDNSVVALHPDTMERLQLFRGDTVLLKGKKRKDTICIVLADDTCEEPKVRMNKTVRKNLRVRLGDVVSVHQCPDVKYGKRVHILPIDDTVEGITGNLFDAFLKPYFLEAYRPLRKGDLFLVRGGMRSVEFKVIETDPAEYCIVAPDTEIFCDGEPVKREDEERLDDVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHAKNMKLAEDVELEHISRDTHGYVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVESRHQIFKACLRKSPLAKDIDLSALAKYTQGFSXGADITEICQRACKYAIRENIEKDIERERRRKDNPEAMEEDEVDEVAEIRAAHFEESMKYARRSVSDADIRKYQAFAQTLQQSRGFGSEFRFPDQPAAGAASAAAADPFASAAAAAEDDDLYS

SEQ ID NO: 129155 - protein, 818 aa, Triticum aestivum
  Clone ID: PAT_TA_23573.pep
MATPNPPPPQQDEPSSSADPKAKKDYSTAILERKKSPNRLVVDEATNDDNSVVALHPDTMERLQLFRGDTVLLKGKKRKDTICIVLADDTCDEPKIRMNKTVRKNLRVRLGDVVSVHQCPDVKYGKRVHILPIDDTVEGITGNLFDAFLKPYFLEAYRPLRKGDLFLVRGGMRSVEFKVIETDPAEYCIVAPDTEIFCDGEPVKREDEERLDDVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGYVGADLAALCTEAALQCIREKMDIIDLEDETIDAEILNSMAVTNDHFKTALTTSNPSALRETVVEVPNVSWEDIGGPENVKRELQETVQYPVEHPEKFEKFGMSPSKGVLFYGPPGCGKTLLAKAIANECQANFISIKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERERRRKDNPEAMEEDEVDEVAEIRAAHFEESMKYARRSVSDADIRKYQAFAQTLQQSRGFGSEFRFPDQPAAGAASSAAADPFASAAAAAEDHDLYS

SEQ ID NO: 129156 - protein, 227 aa, Triticum aestivum
  Clone ID: PAT_TA_23574.pep
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGKLRAQRAKSMKFKDGYMISSGQPVNEYIDAAVRHVLLRQGVLGIKVKIMLDWDPKGKLGPTTPLPDLVTIHPPKEEDELRPPALVEV

SEQ ID NO: 129157 - protein, 217 aa, Triticum aestivum
  Clone ID: PAT_TA_23575.pep
FVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGKLRAQRAKSMKFKDGYMISSGKPVNEYIDAAVRHVLLRQGVLGIKVKIMLDWDPKGKLGPTTPLPDLVTIHPPKEEDELRPPALVEV

SEQ ID NO: 129158 - protein, 100 aa, Triticum aestivum
  Clone ID: PAT_TA_23576.pep
EVRGRRGGGPGMAAMAWSSSWLEVLRSGSCSGGGWRQLVVEVCSPVIPTPSGALDPQVLLYGEELRRKHCLDQGQADDGGATGIVYLLGGVVVELRRHHD

SEQ ID NO: 129159 - protein, 141 aa, Triticum aestivum
  unsure (1)..(141): unsure at all Xaa locations
  Clone ID: PAT_TA_23577.pep
CWALNXEARVGIQLITETTCNLRSRNDGKWPVCPGGNASLTSIRTIANQRAEIYGLGRPRSSGRWRLLGGVGCSREGGAAGGSSCSTEGGAAGILYRRRGSGGFFGRLGAPRRTAGWALRGGRPAVMAAGRRRLGTLILFF

SEQ ID NO: 129160 - protein, 66 aa, Triticum aestivum
  Clone ID: PAT_TA_23578.pep
PSRPVADHRTRKTVRRSLVCAAAARPAHLRHHRHGCLLPLILNDDDEVRTGTAKQDMANPGSWLAG

SEQ ID NO: 129161 - protein, 219 aa, Triticum aestivum
  unsure (1)..(219): unsure at all Xaa locations
  Clone ID: PAT_TA_23579.pep
MEEGYYFSYASLCGALAVIVAGWLVYRWMNPPCNTGRLPPGSMGFPLVGETFRFFKPSPSIDIPAFYKQRLKRYGPLFKTNXVGQPLVVSMDAEVNRFIFQQEGKLFXSWYPDTTNIIFGKESLASCDGSLHKFVRSFAARLGGVDSLRDVLLAEMEQNVARSFAAWAAEPAGIEVKDAVSTMIFDLMAKKLIGFGPDSQXKLRKNLDVFFQGMVSSRC

SEQ ID NO: 129162 - protein, 228 aa, Triticum aestivum
  unsure (1)..(228): unsure at all Xaa locations
  Clone ID: PAT_TA_23580.pep
MEISTSVARCTRMPCSLQALVPTKARQTRRLTCKATGGRVDRRDVLLGLGSAAAAGLGAQRGRGAIAAPIQXAPDLGNCNPPDLPNTAPDTNCCPTSGTGIIDFVLPPASLGXPLRVRPAAQLXQNAEYLAKYKRAGAXMKQLPADDPRSFXKQQWRVHCAYCXGPNDKXGSPDLEIQSXQLLVFFPMDKFYXYFNKRFSAXYRXHPSAXFWNWXPPDGYLRLHRPPN

SEQ ID NO: 129163 - protein, 102 aa, Triticum aestivum
  unsure (1)..(102): unsure at all Xaa locations
  Clone ID: PAT_TA_23581.pep
HLHRPADPFRASVSTRTYSWASMVGRHWLFQADNPSLEWKKNYVGNLTSSFXEYIYLLLECERFSVLLVPVAPFCRCVYLLRGSNLKLRNTRETPIRNPRLA

SEQ ID NO: 129164 - protein, 135 aa, Triticum aestivum
  unsure (1)..(135): unsure at all Xaa locations
  Clone ID: PAT_TA_23582.pep
XEGSPSXSGAQRVGPLTPVVEVGVFEHNKQSMLLHHPRHLLRQMIDLYLQVPRMESLVAVEPSTICLPDLLYLSASLIKLSSAMLTTGELSSGLPSSRAEVERIAVGCDKQSFTLSSLSVMSMTPDGPHSNGTFF

SEQ ID NO: 129165 - protein, 305 aa, Triticum aestivum
  unsure (1)..(305): unsure at all Xaa locations
  Clone ID: PAT_TA_23583.pep
HEVPSPRAVLPAEGEAFLRSPGARTPGRARLGPAAALREAICSMKFHDIKEFSYKPPPASEDIFAVFEELRQREDTEEKEIGQCNGDIPIGHATKIHTVSPENDIFLEKPSKRYPHQPCARNEDEDDSGWETVSHVDEHGSRSPPGGSGPSVSRSVEETAHRXSGPDCDDNSENCRSISGISEVCSTTAELDRKRGPSFARLWRSSNNDNGRKKTGSGLLFGMLSSGRMSNSALSPTLKGSEVCTVSPSVGEWSPELVNPHVVRAMKGRIEWPQGAKKQSLKSKPLDSRFDGCKVQLRQALKQKI

SEQ ID NO: 129166 - protein, 120 aa, Triticum aestivum
  Clone ID: PAT_TA_23584.pep
EMRRSVEEFYRARDAAGVPRKYTHEIGRREPTYMDDFGEKYCDFPRVEGWRHELLGSFVRGMMENLETFRDDYQDSDSIHRAMQGWHLSCVQSSPPSCCSYAESQAAVPAQLVSVNQHND

SEQ ID NO: 129167 - protein, 137 aa, Triticum aestivum
  unsure (1)..(137): unsure at all Xaa locations
  Clone ID: PAT_TA_23585.pep
LXXDAVDACAEAXFTMGAPERRRADXGAXGSPSDDDDGALDSLTQPAPREDGEGGATWMPMSHSPQPGARPPPERRLGKWTARGSPHNGERLNAREGKGWEGKRTVALIQDPGGALVNLPTQTQGAREASDRALVLR

SEQ ID NO: 129168 - protein, 72 aa, Triticum aestivum
  Clone ID: PAT_TA_23586.pep
PFSPFIFRSNGYLRIHSLNAITELVSRVHLPSSQQVLRLKLISSWKSTFRSTTLVGTIRSYVPFPDFTPIYW

SEQ ID NO: 129169 - protein, 285 aa, Triticum aestivum
  unsure (1)..(285): unsure at all Xaa locations
  Clone ID: PAT_TA_23587.pep
MSLDSDSSSQGGDRRSFRQITRDRLLFEMLRSTRKDSKSAWKVLIMDKFTVKIMSYSCKMADITEEGVSLVEDLYKRRQPLPSLDAIYFIQPTKENVVMFLSDMSGRSPLYKKAYVFFSSPIQKDLVAQIKRDSSILPRIGALSEMNLEYFPIDSQGLITDHEMSFEELFWESAEGFNEYNACLNAMATRISTVFASMREFPRVHYRIAKTIDASTXDNTKGTWCPQKIAAGVWNFPSPYLTSPPDSPQSPASARLPGDPSPDQIAPIIHEWTYDAMCHDLLCMG

SEQ ID NO: 129170 - protein, 102 aa, Triticum aestivum
  unsure (1)..(102): unsure at all Xaa locations
  Clone ID: PAT_TA_23588.pep
MGTFLPGYAAYTATNGAXEAMTRILAKGVASKGITANVVAPGPVRTELFLAGKDEAFLKRVEAQSMGRIAETTDVAPVVAFLASDAAGWVNGQVIRVNGGFT

SEQ ID NO: 129171 - protein, 224 aa, Triticum aestivum
  Clone ID: PAT_TA_23589.pep
PPRVERAHSDLKKAADQHWSDGALEADLRRADTARPRRAMEDAFMALKFVRDIHDMMATKLQYQFITLEKNGKILKLFPREVSTDQIAAIEDAYLNMASALSEADGIDYTNPEELELLVAALIDLDAMDGKKSVSLIVECSSSPDVNTRKALANALAAAPSMWTLGNAGMGALQRLAQDSNPAVASSAARAIGELRKQWELEEGDSLRFVMNQNLISEETDSES

SEQ ID NO: 129172 - protein, 163 aa, Triticum aestivum
  Clone ID: PAT_TA_23590.pep
KLPIFVVKTNTMAPRVKAGKMIVGRDKLDAPSRKQPKVLEGEIEIEDDAPKRKPSLEEIDALEEARLAIEYIVIPGGEPVELLPRCSEIVARQLELVESYQLLAETFGTDPNSRLQILPVKIAKKSSDQGAQGPTSTKKNGSDLIVSENGGGFSFSRLPFLPK

SEQ ID NO: 129173 - protein, 68 aa, Triticum aestivum
  Clone ID: PAT_TA_23591.pep
SFLVGVAAWAMETEMLAGMRNIVGGVLHLQEELVDLGGDQRHVRRLVVLGHALQHQRCEQLRRVNEEL

SEQ ID NO: 129174 - protein, 95 aa, Triticum aestivum
  Clone ID: PAT_TA_23592.pep
PSPLLHTDLLPLAAHAGSRIQSGISSTPVFAQNRTTPVSSSTPLFRPQFPSASSTSASALSDLPRQLSLTFPAPFLCCRAWCFVASQVPLQNSRV

SEQ ID NO: 129175 - protein, 193 aa, Triticum aestivum
  unsure (1)..(193): unsure at all Xaa locations
  Clone ID: PAT_TA_23593.pep
EICPSPPPLSPKXPPRDPPRSPSPRFPPXPIPKALRSPLLPSSLFDPRGSHRIAVPLPRPRDPAPPSYSPCKSPRRWVPVXAQGAPRSPGIRFPRPPDLPAKRXSPXPPATVPPSAPPAHHAASPRPPAPPPPGPAPLPAPTAPAAAPPRGGSPPIGRSPVSWATPDLASLLFPALTAQQANAARWLAARNSE

SEQ ID NO: 129176 - protein, 115 aa, Triticum aestivum
  unsure (1)..(115): unsure at all Xaa locations
  Clone ID: PAT_TA_23594.pep
GRQXGRLXETSKCSLXKSVXXXQASSXDHEEQHHRISPXRVAXPYVAXEELLGQLRQLRSVFLQALGQQRGGGRGTCRREQHKPIILPDELQFLGLHRWIVLCIDFRFSFIALAS

SEQ ID NO: 129177 - protein, 335 aa, Triticum aestivum
  unsure (1)..(335): unsure at all Xaa locations
  Clone ID: PAT_TA_23595.pep
YFWCSALAAGCDVHRYYSSLLFLFSALQRTSKCCHLGLFGTQLGISMGPVRLFLLRIVLATTTSLFHLIGAFLVDXNPLYHVSYLVDECSIGFSGVIISMIVIETSLSGVQYRSVFGLFNVPAKWYAWILLILFQFLASNVSLLGHLSGILSGFAYTYGLFNYLLPGPSFYSSIEGLSMLSVCVRRPGFILCTGGTTYGQLPTHSNMSTPPSALINANFLRNISSWMPSRRTSTVQTSTNQEQEDPRFPGRGRTLASTGTEPTAREANANLHARHTAANTVRADATVTADQTDTFDEELKKLVGMGFERTQAEVALAAADGDPNVAIEILMSQQD

SEQ ID NO: 129178 - protein, 150 aa, Triticum aestivum
  unsure (1)..(150): unsure at all Xaa locations
  Clone ID: PAT_TA_23596.pep
ANAVVYRAIFLPANRTIAVKCLDLDRINSNLDDVRKEAQIMKLIDHPNVIKAYCSFVVDHNLWVIMPFMAEGSCLHLMKVAHPDGLEEPVICSILXKETLKALAYLHGQGHIHRDVXAGNILVDSPGVVKLGDFGVTSCLFDKXNXKVQE

SEQ ID NO: 129179 - protein, 82 aa, Triticum aestivum
  Clone ID: PAT_TA_23597.pep
LINITSSLQIYNTTVEGMEMKIASLGTNRKPAAECCSRAPTTGQKPISTTQKSLEQHDRKIKDYSKVQPSSSRRQREDTKRA

SEQ ID NO: 129180 - protein, 98 aa, Triticum aestivum
  unsure (1)..(98): unsure at all Xaa locations
  Clone ID: PAT_TA_23598.pep
HVHTAATSLHRRRDSLLPHCLAPPRARPPRRRRQSLARPLARNPISRRPPHRSPPRKAAGSSSQSGTARAEGGVGEGGDXXRREEGGXRXXAVXLXRH

SEQ ID NO: 129181 - protein, 279 aa, Triticum aestivum
  Clone ID: PAT_TA_23599.pep
MTICAGFDSYRASPADMRVVTSDGQSIAAHSYVLASASPVLERMIDRAQRGWGAECTIPVLGVSFDAVHAFIHFLYSSKSKVVPAEEEAVGANWAQLLALAHAYRVGWLKRAAEAAVSARLTPERAVDMLKLARLCDAPRLYMRCARLAAKEFASVEQSDGWRFARRHDAALELELLTLLEDADQRNERWARERAAQEACRQLGEAMASLEHIFPGDSGAKAGCADADAPCARAGCTCRGLQVLMRHFATCPKKMAPGGCARCKRMLQLPRAEFGTRPR

SEQ ID NO: 129182 - protein, 225 aa, Triticum aestivum
  unsure (1)..(225): unsure at all Xaa locations
  Clone ID: PAT_TA_23600.pep
CRSQSAGSIQSGVIAPVVSYMVDPRKGKKNASQIENIHQLRLLHNRYLQLRLVNARSEDVLSYQKATAENTIYNVWRNTSNLRDAVNLRRIMVQHHRQELKLYGILQEQIACLEQWPALEDENNLSFSRATEALXASTLRLPVTSGARVDAVSPKNAVSSAVDVMQXLGTAVWSMLSKAQXRACLISXFSQHKKRYALTMQTTAETGGTGYLRHYASDLANEPPG

SEQ ID NO: 129183 - protein, 120 aa, Triticum aestivum
  Clone ID: PAT_TA_23601.pep
LLAPLAPLLHPHALPFLPQIRRRAPPSPWLRRSRAYRHPRVSPPCPFASRASSSPSTPSAWSRGARQALAPPSDAPELTVDPRRPENLESSPGLLCNATLVTAVDAIVIDYLDDDPSFLA

SEQ ID NO: 129184 - protein, 268 aa, Triticum aestivum
  unsure (1)..(268): unsure at all Xaa locations
  Clone ID: PAT_TA_23602.pep
LASWDPAAHANHCNWTGVACEGAGAGRVVTGVSLPGLNISGNVPASVCDLANLTRLDLSNNNLTGGFPALYRCSQLQFLDLSNNGFDGVLPDDIGRLSRAMERLNLSANHFSGAVPTAVAGLTALKSLILDTNQFXGAYPAAEISKLAGLEELTLASNPFAPAPAPREFANLTNLSYLWMSGMNMTGESPKHYPCLLMPQMRATTAIDRPGETPAWAWPRPPLAGLYLFTNGLTXEASAQYLXGEFIEIDVSVXNSAXEITGRQWPQK

SEQ ID NO: 129185 - protein, 100 aa, Triticum aestivum
  Clone ID: PAT_TA_23603.pep
HRLTSLPPFPFSPPSNSSPPALHLPCSHLVAPVAARSAESPSHPSLSNPCLGFFPPLDWSLLHAHLFRDPSQPRLTYSPSLSDQPDQAPPVGSMAWVALL

SEQ ID NO: 129186 - protein, 191 aa, Triticum aestivum
  Clone ID: PAT_TA_23604.pep
MEIEATPLSPQQQAYNDGGGSDQRAGAGTGAKPLYRNPVVVVNFLLMAVGTVCGPLLFRAYFLHGGTRKWLTCLLQTAAWPLLLPPLCVSFFSRRRRQREESATEAAPLSLMSGRLLAATVAIGLVIGIIDFLYAYGLAYLPVSTSSILVSTQLAFTAVFALVVVRHRFTAFSVNAVVLLVVGAAMLGLNG

SEQ ID NO: 129187 - protein, 108 aa, Triticum aestivum
  unsure (1)..(108): unsure at all Xaa locations
  Clone ID: PAT_TA_23605.pep
HYLHQNCIVHLDLKPSXNILLDDNMXPKIADFGLSRCFDEKQSQVITENMAGTLGYMAPEFHRGDKCTITYQSDIYSLGVIIIEMLTGKKWYPGYPDVDNVRTISTVS

SEQ ID NO: 129188 - protein, 194 aa, Triticum aestivum
  unsure (1)..(194): unsure at all Xaa locations
  Clone ID: PAT_TA_23606.pep
MQRVSTKLHISLAELKAATDNFHHRNLIGVGGFGNVYKGALADGTPVAVKRATRASQQGLPEFHTEIVVLSGIRHRHLVSLIGYCNEQAEMILVYEYMEKGTLRSHLYGSDEPALSWKQRLEICIGAARGLHYLHSGYSEEIXHRDVKSTNILLGTDGGGSTGGGPFRAPAPRPALARFGPPLGGSREFVLTKT

SEQ ID NO: 129189 - protein, 70 aa, Triticum aestivum
  unsure (1)..(70): unsure at all Xaa locations
  Clone ID: PAT_TA_23607.pep
QYVTFFVKSXXPHKMDTIYXIHCTINLYSYLTVXKXTFPCPXISFLIRWXTXNLLXKKNXKTQGGXVQFP

SEQ ID NO: 129190 - protein, 163 aa, Triticum aestivum
  unsure (1)..(163): unsure at all Xaa locations
  Clone ID: PAT_TA_23608.pep
ISAGTXXXGPXXPXXGPXALIPGAAMGPGRPREGSRSRAPCSGWTRWTRAAPPRPRARAAAARGPAGGARRPRMRTSSAESTVTSTVKEDDDLSAANSSLGGSGVPLSSMAGGCSDELDRSVRARVWIAETGDRRSLYGSRADDACVYSGPRSGSSWEPAVCI

SEQ ID NO: 129191 - protein, 84 aa, Triticum aestivum
  Clone ID: PAT_TA_23609.pep
AQQLARVFETIGAFKVPRKGGKGKQIFGSVTAQDLVDIIKSQLNRDVDKRLVEVPEIREVGEYVAEIKLHPDVTAKVRLTVYAK

SEQ ID NO: 129192 - protein, 198 aa, Triticum aestivum
  unsure (1)..(198): unsure at all Xaa locations
  Clone ID: PAT_TA_23610.pep
MASPSCASTLPWTXAAAPPPSSAFSSPLRLQTRRAPSLVIVAQGRVKKYRQVILKDDIDEISGKKGDTMKVRAGFYRNFLLPKGKATLLTPDVLKEMQVEQERIEAEKKRVKEEAQQLARVFETIGAFKVPRKGGKGKQIFGSVTAQDLVDIIKSQLNRDVDKRLVEVPEIREVGEYVAEIKLHPDVTAKVRLTVYAK

SEQ ID NO: 129193 - protein, 136 aa, Triticum aestivum
  Clone ID: PAT_TA_23611.pep
SSGGYLQQSPRLHPRIPPQTPLRLPARRSRILVLKLLAISWERYLEQSSRRSHSFSLQVARQSTSSRQDADGTDNLAAPRGAGGDHRHHPLHRLPLTSQPARLAGCCVSCSLVVVVLLLRLSHTVIVYFVCSSCSV

SEQ ID NO: 129194 - protein, 136 aa, Triticum aestivum
  unsure (1)..(136): unsure at all Xaa locations
  Clone ID: PAT_TA_23612.pep
HSGTPGAAFPEAFQGPTGQRRLALRASEPPEAAESEGRSGPAGGGGRGGRRGRPTLAAAPGPGARRAGPGPGXPPPGHPWSGSSYVEGYPPPVPSYYPGPPPPXWAPIPYGHPFPATAPPGPYVPSAPWWTGGPSS

SEQ ID NO: 129195 - protein, 115 aa, Triticum aestivum
  Clone ID: PAT_TA_23613.pep
MAASVACAFFFDAEPAGEPGKHALDACALCAKRLARDSDVFMYRGDTPFCSEECRHEQMHLDAVSARQAARRLQRFSAETESQSHRGQRPSRKFAGHGSIRWQVPAASRMCPWQA

SEQ ID NO: 129196 - protein, 96 aa, Triticum aestivum
  Clone ID: PAT_TA_23614.pep
MACAFFFDAEPVDEPGVHSLDACALCTKPLARDSDIFMYRGDTPFCSEECRHEQMQLDAACARQAARAAARRQKQFSSGTGAGRAHRESWEVSVAS

SEQ ID NO: 129197 - protein, 112 aa, Triticum aestivum
  Clone ID: PAT_TA_23615.pep
MAAPVACAFFFDAEPVGEPGMPALDACALCAKPLARDSDVFMYRGDTPFCSKECRHEQMHLDAVFARQATRRLQRFSSGAESGRAHPGGVRLELTGESAKRHTCLTKKGYYA

SEQ ID NO: 129198 - protein, 96 aa, Triticum aestivum
  Clone ID: PAT_TA_23616.pep
MAASVACAFFFDAEPVGEPGMPALDACALCAKPLARDSDVFMYRGDTPFCSEECRHEQMHLDAVSARQAARRVQRFSAEAECHRGQRQSRKVSIAS

SEQ ID NO: 129199 - protein, 98 aa, Triticum aestivum
  Clone ID: PAT_TA_23617.pep
MAASVACAFFFDAEPAGEPGKHALDACALCAKRLARDSDVFMYRGDTPFCSEECRHEQMHLDAVSARQAARRLQRFSPETESQSHRGQRPSRKVSIAS

SEQ ID NO: 129200 - protein, 98 aa, Triticum aestivum
  Clone ID: PAT_TA_23618.pep
MAASVACAFFFDAEPAGEPGKHALDACALCAKRLARDSDVFMYRGDTPFCSEECRHEQMHLDAVCARQAARRLQRFSAETESQSHRGQRQSRKVSIAG

SEQ ID NO: 129201 - protein, 97 aa, Triticum aestivum
  Clone ID: PAT_TA_23619.pep
MAASAACSFFFFDAEPLSEPGMPAQDACALCAKPFARDSDIFMYKGDTPFCSEECRDEQMQLDAISARQAARRQQRFSSGTEARSGHQESRKVSVAS

SEQ ID NO: 129202 - protein, 143 aa, Triticum aestivum
  unsure (1)..(143): unsure at all Xaa locations
  Clone ID: PAT_TA_23620.pep
PPPPPPASCTALPHPELPKPHQLPTPXPNNRRPPPPPPPPRRAASAGPRPRPAARPGPRRGRGAAPPRRTAGPRRAAPPRPGAARCAATARAPPRPAAAGGPGGGRARAPGARGRAPGWRAPGGQRRRPGPGSARVRARGHCA

SEQ ID NO: 129203 - protein, 182 aa, Triticum aestivum
  unsure (1)..(182): unsure at all Xaa locations
  Clone ID: PAT_TA_23621.pep
MELSSLLPSLSPRRALRLSFSTASKTPRRPRPAAFACRADASPEGPITRRWFASLAAATAAVGISVAGGGGAGAVSTSRRXLGAARSGERLITLPNGINYYDIKLXGGAKALRIRVAVHTWQWXGITFMTISRLRYWVDPYGLMLESKEDVKRWIRVKDEIEQSWYVPYYLGKRIPKNMTVP

SEQ ID NO: 129204 - protein, 167 aa, Triticum aestivum
  Clone ID: PAT_TA_23622.pep
MGAHRLALLVFLATLPQLLLAGTTRYYTFNVTMQKVTRLCTTRAIPTVNGKFPGPKIVTREGDRVVVKVVNNVKHNVTIHWHGVRQLRTGWSDGPAYITQCPIQTGQSYVYNFTITGQRGTLFWHAHVSWMRATLYGPIVILPKSGVPFPFPKPYKDVPVVFGEWFN

SEQ ID NO: 129205 - protein, 150 aa, Triticum aestivum
  unsure (1)..(150): unsure at all Xaa locations
  Clone ID: PAT_TA_23623.pep
XXNHLLNTPIACTRHTQPSRCCXCCHCXAGVNQAQVAMTAAASELDRRAPSLAAHSSQCCPRGAAAALALPVPSPARRARTLLPVRMAFLARGLMTNEIRRDDTDATRPLLWDTLAAWHMLAVAAGTYRVTVLCRSTDDTWRWRCKLLKL

SEQ ID NO: 129206 - protein, 176 aa, Triticum aestivum
  unsure (1)..(176): unsure at all Xaa locations
  Clone ID: PAT_TA_23624.pep
WAVRAPVAPDADATKRFEGRAEAAVEXLLPEGFLDRTRARGMVVSSWAPQVEVLRHTATGAFVTRCGWNSTLEAVVAGVTMLSWTMYSEQGMNKVLVVEHMKLEVAMDGSHEWTVKSRKVEAKVRLVMESEHGKQIRERMAIAKVIAADALETGGSSAAAFVDFLDDLKISMLDVI

SEQ ID NO: 129207 - protein, 107 aa, Triticum aestivum
  Clone ID: PAT_TA_23625.pep
MAGGEARGGECGYYTTDDALSQVGFGRFQALVLAYAGVGWTAEAMEIMMLSFVGPSVKDEWGISGQQEGLITSVVFAGMIIGGCLGGVISDSYGRRSGALWLLSLDK

SEQ ID NO: 129208 - protein, 199 aa, Triticum aestivum
  unsure (1)..(199): unsure at all Xaa locations
  Clone ID: PAT_TA_23626.pep
MLPAPAAPAPPSRGQEHGGGDLCGRGEGVNETLWYEVNQRLARRQHDAPPHRLLIQSSSTMAAAALTCARALFISGRELRPVQPHLPGSSWFWSGSIRVRVKALMDRFVKELQKALDADIQDRIMKEREMPATXQERKREVAEREAVWKAELSRREMATSLGSCQQALFNFFGMSYLNCHDLALDSHMFLDLSVRSCGS

SEQ ID NO: 129209 - protein, 209 aa, Triticum aestivum
  unsure (1)..(209): unsure at all Xaa locations
  Clone ID: PAT_TA_23627.pep
MSAAAANVAVIGAGMTGAVCASLLAARGVAVTLFDSGRGPGGRRRAFREVMDDGTELRFDHGAPYFTVSNDEVVRVVGGWEARGLVAEWKAMFACFDRETGKFRDFDKEGTMKKYVGVPGMNSICKSLCQEDGVVSKFGVTIGKMDWLQDRSSWSLASLDGKDLGSFDFVVATDKNIASQKVSGLTGKPPPLDLSVFXHLSAMIQDXPV

SEQ ID NO: 129210 - protein, 173 aa, Triticum aestivum
  Clone ID: PAT_TA_23628.pep
MTSSYRPAATTSPEATAPVPKVEAEAAATAARNPSSPSGPPSPEMEATAEALTREEVLRRRRRRTARLVGVYRRLYWAMAEEVRARHRQYVWELGRSPLEAEQPPSAACSEAKPGPAAVPRRKKCGFTGCKVRAMPMAMYCHSHILSDPNQALYKGCGQIIKCNAQFCNQGKL

SEQ ID NO: 129211 - protein, 74 aa, Triticum aestivum
  unsure (1)..(74): unsure at all Xaa locations
  Clone ID: PAT_TA_23629.pep
FSRSACARTXHHIGSGKLGVHIIPPWHPISWELINIKQPATNVAPPAQTDWGGTPALAAQGRPAAHLSLHFAAA

SEQ ID NO: 129212 - protein, 88 aa, Triticum aestivum
  unsure (1)..(88): unsure at all Xaa locations
  Clone ID: PAT_TA_23630.pep
PPCSERSFFCXWTXIPVVXXAXLDKVXPTXAFIFXESSFKVWRRARTDYRELGVRRSHARSSEVAREERPAQEGGRPGVGERLRNVLE

SEQ ID NO: 129213 - protein, 261 aa, Triticum aestivum
  Clone ID: PAT_TA_23631.pep
MMKTLSKSACVPEVLCTCADQSYLGILLNCCLCCSLASILNAPLSESSARFYAASVVVALEELHRRSILYRGVSADILMLDRSGYLQIVDFRFAKNLEGERTYTICGIADSLPPEIVLGRGHGFTADWWALGVLIYFMLQSDMPFGSWRESELEPFGKIAKGRLIIPSAFSVEVGDLITKLLVVDENTRLGATGADAVKEHPWFDGIDWKQIADGTSRVPQEISNRIDIYVETLQQDLTVPPSILTEDPADMTTPEWIKDW

SEQ ID NO: 129214 - protein, 191 aa, Triticum aestivum
  Clone ID: PAT_TA_23632.pep
MAAARGQKALATLVRSLRSDSISNSNAPRLRHLPSLRRTFSLYDQINLIDNVPEDQLRFQTYDDTGFKINNVKYEGSLLIVENKILTWTPKTFADITAESLSIFKIVHPIPEILILGCGKYVQPVSPELRKFIRSTGMKLEAIDSRNAASTYNILNEEGRAVAAAARTLAVDSESLAAERCAPPLKSIELT

SEQ ID NO: 129215 - protein, 82 aa, Triticum aestivum
  Clone ID: PAT_TA_23633.pep
GTIRRRVASSAWPRTAVVTRELCRHPVRTVDLRATCTALNLSMASCSLPQCRAWPALAVAMAAERGKIHRAAHGVSISAPCC

SEQ ID NO: 129216 - protein, 93 aa, Triticum aestivum
  Clone ID: PAT_TA_23634.pep
MVGLLNRSRGLAEGVAVMICPMLLALALNIVDLNDEVYGHGVPIALIAMAGFTLITGICSFMVCCFIQGFPRSSVILAIISSACLIMLAYFIA

SEQ ID NO: 129217 - protein, 115 aa, Triticum aestivum
  Clone ID: PAT_TA_23635.pep
ECRRSNMVCMQLYTKEIECRPGASSAASILSRNVQTHGLDSKKSGGVKDLVRKICAWRDLMARMHDESLRYILSDQAIAALAVRVPKGRTEMCAVIAETEPSASTMHPSLSSHPL

SEQ ID NO: 129218 - protein, 565 aa, Triticum aestivum
  unsure (1)..(565): unsure at all Xaa locations
  Clone ID: PAT_TA_23636.pep
MAGGGTQQSLRKYLGALKDTTTVSLAKVNSDYKELDIAIVKATNHSERPSREKYIREIFLSISAARPRXADVAYCIHALARRLSKTRNWAVALKTLIVIHRALREVDPTFREELINYGRSRSHMLNMAYFKDDSSSGAWDYSAWVRTYASYLEERLECFRVLKYDVEXDPPRTRDLDTVGVLDHLPPLQQLLFRLLACQPQGASSYNVIIQHALSMVALESVKIYTAISDGTINLVDKFFEMQRNDAVRALDIYKRATNQSERLSEFYEVCKTIHVARGEKFLKIEQPPASFMQTMEEYVRDAPAMKDKAILAIEYNKEPEEEVKPTSPPPVSEPEVEQEPEPEPEPEPVKEEAPAAEPTDLLGLNETHPAVAEIDERNALALAIVPIDDVPKAAPAFENGVTGWELALVTAPSSNETAVASGKKLAGGLDLLTLDSLYEDANRRASQPASYNPWETTGAAPAPMMQQPAAMQDPFYGSNGYAAPHAVQMAAMAHQQQAFMLQQQMMMASHHPQAQQYHQAQAAPANPFGANPFAPAGAQHPYGGAGTGMMPLHAVQGNAYTGLI

SEQ ID NO: 129219 - protein, 61 aa, Triticum aestivum
  Clone ID: PAT_TA_23637.pep
PTRPDIGKFMYFGVDRFGVEDLCQIHLLWSHSSVPRLNMHVLASTICYISKGRGSRTHIFM

SEQ ID NO: 129220 - protein, 242 aa, Triticum aestivum
  Clone ID: PAT_TA_23638.pep
MSKLQLPADDSVALRVTHSNLASLASDIRVSQQTTVEALKEKLWKKTGTAVGSMRLELRDEAGARVADLDRDAAPLAAYSPYDGYRLHIIDLDPSSVTSGGWLEDTSLVEKYTISDEAYDKLGTNFRKFKEKMVSKNPVSDDKQSDNQMEELCANIKVGDRCEVEPGAKRGTVKFVGKAEALGRGFWVGVQYDEPLGKHDGMVKGVRFFECPQGHGVIVRPEKVKVGDFPERDPFDDEEDEI

SEQ ID NO: 129221 - protein, 285 aa, Triticum aestivum
  unsure (1)..(285): unsure at all Xaa locations
  Clone ID: PAT_TA_23639.pep
AFHPCFAHQLQLVLIAVAKDNEPCLWFFDHVSYLLNIVGVSCKRHDMLRDVRVQKCXEALEMGEIESGSGLNQEMGLARPGDTRWGSHFKTIMHIVSMYSTILEVLDAIGKDPSQKGEWTRIRGVAQAFASSEXLKTNHMMLVILGYTNELSKSLQKRDQDIVNAMTLVSLAKSRMQHMRSHGWEDFLAKLTLFCNKHDIQVPLWEDIYEPNRRSRRYYEVQTNDDRYRREVYLGVIDQTIQELDSKLPHLDSLPPPPATPGFDGDSSIQHQQQQSLLASSAPRS

SEQ ID NO: 129222 - protein, 84 aa, Triticum aestivum
  Clone ID: PAT_TA_23640.pep
MASSLLPAFTVRRGEPVLVAPAEQTPRETKTLSRTYIVSDVSHAGFKSVDFGWGEAVYVRPAKGGEGPIPGVTNYFSRSKNGKG

SEQ ID NO: 129223 - protein, 361 aa, Triticum aestivum
  Clone ID: PAT_TA_23641.pep
MVQPVFDAAVLSGRADIPSQFIWPEGESPTPDAAEELHVPLIDIGGMLSGDPAAAAEVTRLVGEACERHGFFQVVNHGIDAELLADAHRCVDNFFTMPLPEKQRALRHPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPLETLGTGPHCDPTSLTILHQDNVGGLQVHTEGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWIVQQQQPQPART

SEQ ID NO: 129224 - protein, 185 aa, Triticum aestivum
  unsure (1)..(185): unsure at all Xaa locations
  Clone ID: PAT_TA_23642.pep
MAQEQPNPDEVVLGQEINGARVVTLNRPRQLNGINDRVVYILAQLLEKWEKDDDAKLVIFKGAGRAFSAGGDLKMFYEGRSSDDSCLEVVYRMYWLCYHIHTYKKTMVALVNGLVMGGGAAMVAPLKFAVVTEKTVFATPEASVGLHTDCSFSYIHSRLPGYLGEYLALTGARLNAXEMIAAGLA

SEQ ID NO: 129225 - protein, 185 aa, Triticum aestivum
  Clone ID: PAT_TA_23643.pep
PRAPLGRAYPPNLHAAKKSPAPDSPWLTRILNKLPTIDKCFSAETVEEILKALDSEVSVDGNQWIAPVLKSMRRSSPTGLKITLRSVREGRKQSLQECLKKEFGLTMNILRSVITGDVYEGIRALSIDKDNAPKWSPATVEEVKNEDIDRVFEPFTSGHELQVPSDDSNRWSGKHEHTVYAKSSQ

SEQ ID NO: 129226 - protein, 149 aa, Triticum aestivum
  Clone ID: PAT_TA_23644.pep
SLSLPHPSFSTSGRRRGQAGVAVRHPTISATSSTTPPQPASLSFSATHPFIRTKSTSCNSPDRGPAVSNPSRARCRCLLLQPTAARCQPSLLLLSPHTSLVAALLQPAASSSSPPLLLSLLFLRSCCCSSEPLVRLLLIFSETPPTAGS

SEQ ID NO: 129227 - protein, 245 aa, Triticum aestivum
  unsure (1)..(245): unsure at all Xaa locations
  Clone ID: PAT_TA_23645.pep
MAAAAATTTTTATAATPSSRPLRAPPAPSTVHRQLRCHAGPSPSLLALRHRAARAPPARALLDKVTPFNFGEEEDDGGDDHPREECGVFGVVGDPEASSLCYLGLQNLPHRGEEGAGICAAGDDGKLKSVTGLGLVSDVFRDPAHLGSLPGQAAIGHXRYSTSGGQAQLCNVQPFLARYRVGQLAVAHNGNLVNYLPLRNKLEAQGSILNTSSNGGNLHLXAXXSRPWLPHLRAWSPSGRYSCFS

SEQ ID NO: 129228 - protein, 64 aa, Triticum aestivum
  Clone ID: PAT_TA_23646.pep
TGVMTITTPKKHEKEISPTESALPKDENVEPLVAFSRPPPLPPVLGPLIALSLFQTSSSDEDSK

SEQ ID NO: 129229 - protein, 153 aa, Triticum aestivum
  unsure (1)..(153): unsure at all Xaa locations
  Clone ID: PAT_TA_23647.pep
FXXXKXXXXXXXXXXXXXFXGXXXXXSXFPXXXXXRXXXVGXXLXKXXXXXXXXRLXGTXXLQQYSPENLHPRIRAPPRKRAAQRPPGAVGRQDDDGGXRDWPSWDSAMPQQQQMATLARTCVVSASTAAXTPQAVAGDRAYLHTLRSPRSSS

SEQ ID NO: 129230 - protein, 124 aa, Triticum aestivum
  unsure (1)..(124): unsure at all Xaa locations
  Clone ID: PAT_TA_23648.pep
TSRRQSLSLTVWRMSRGGFSVVSGGGASRWCLAVLASSLARPEMPPAAASWSWACCGRRRKKRRGRRRPRRVRAGKXGPVDSLHRPARAGRPPPPASPTGNLLGRXGFXPLVQGRAGLAGKKFR

SEQ ID NO: 129231 - protein, 79 aa, Triticum aestivum
  Clone ID: PAT_TA_23649.pep
RRGHDLILVLFGPQSALSFSFRAVPAARLQRGTATPCRWHAARLNLTPRRCTPAPAAGRRRRARLPGKNGTTGNWGFFP

SEQ ID NO: 129232 - protein, 93 aa, Triticum aestivum
  Clone ID: PAT_TA_23650.pep
RPNSTRIKTCPLHHRNPASTGAAPALVLMAGWSPALIISKVLLAIKAIITNPDPYNPRVESIARLYLTKRANHDEVAAETTLTSGSQGFLCPT

SEQ ID NO: 129233 - protein, 96 aa, Triticum aestivum
  unsure (1)..(96): unsure at all Xaa locations
  Clone ID: PAT_TA_23651.pep
LGPGGHTQCXRXVGXLPGFRGGFLGALXRRFAETRGLLXXLXFGEFQXGGAGHLLAXGFPGVRGQRIADAVGDWFYSRSGAAARAGPYPCDSTCYT

SEQ ID NO: 129234 - protein, 201 aa, Triticum aestivum
  unsure (1)..(201): unsure at all Xaa locations
  Clone ID: PAT_TA_23652.pep
MCSQXXSKNRSTRTWXXWKSHTXXLSWKRRCRYRQKNGAVHXXMVAATXANLGSACIAFLGFSPIGGKFSQSHSTELLWFHSIPNEPMPEPEISGAAAPTRTSKLLPLDEGPKIKLISSLHFFLLPPQENNRQPAELFLLPQARSTCLPSQQRAREQRSSPASRAGDDVGGAGGPINRREALLPQALRTRSASPSNLIPGR

SEQ ID NO: 129235 - protein, 287 aa, Triticum aestivum
  Clone ID: PAT_TA_23653.pep
MATAVTASATAATRFTRLAGVALRRSSCRPRTAVRFQRPGLTTTALLRPTELKPKDQGQPETLDYRVFLVDGADRKVSPWHDVPLRAGDGAFHFIVEIPKESSAKMEVATDEAYTPIKQDTKKGNLRYYPYNINWNYGLLPQTWEDPTAANADVEGALGDNDPVDVVEIGERRANIGDVLRVKPLAALAMIDEGELDWKIVAISLDDPKASLVNDVDDVEEHFPGTLTAIRDWFRDYKIPDGKPANRFGLGNKPTSKEYALKVIEETNESWEKLVKRKIPAGELSLA

SEQ ID NO: 129236 - protein, 170 aa, Triticum aestivum
  unsure (1)..(170): unsure at all Xaa locations
  Clone ID: PAT_TA_23654.pep
MAARALTAAGRRVAGQSQTRPTPLLASSRSGASMNHSSASAQPEEXRGDAHGPAAEAMTGAQVEAALNXEHVPTATVLPDAGRHAVGALDGGEDASWVPDQDTGVFVPADAGADAHCGGAHPAPPQRLYGGVGGPASVLGLAAGVREEEMEDVERPAMGLTDANDGSNNN

SEQ ID NO: 129237 - protein, 111 aa, Triticum aestivum
  Clone ID: PAT_TA_23655.pep
MATMGAGGAVKMIGGAKVERVLATAKAPGACPSCGGPVVATDVESERRILCLPLCLKNKRKYPCTRCFRRLVTVYKLTRPLPPGPAAPLPSTPHRPTLPLQSLGRPARGTA

SEQ ID NO: 129238 - protein, 66 aa, Triticum aestivum
  unsure (1)..(66): unsure at all Xaa locations
  Clone ID: PAT_TA_23656.pep
TICXLFLVNQNYRFLAIWLPYPYFKKDLVTIGITFLYLHPIDPLLIFSKLEYLIPMQNYASRTLYS

SEQ ID NO: 129239 - protein, 70 aa, Triticum aestivum
  Clone ID: PAT_TA_23657.pep
IRATAKHSSYMTTSISSYLMPAAAVSKEKESMKRRAPKSMGSARKKQPAIANPAAVGGKGDVGDAMDLSQ

SEQ ID NO: 129240 - protein, 143 aa, Triticum aestivum
  unsure (1)..(143): unsure at all Xaa locations
  Clone ID: PAT_TA_23658.pep
KIHTGPTAIQLYNYTRDSHFACSRPRYGHIFTSLFTLTNKMDMKTSGRHLPSTRNAICSYSSDWSPRSGSPQKASPAGRLAAVSLYTPGMALPPXGFSSGSLGFSVLAXXRMXXVKRHRQGQQGELTRSTTAXQKCSXKTXTX

SEQ ID NO: 129241 - protein, 84 aa, Triticum aestivum
  Clone ID: PAT_TA_23659.pep
KKTKQKMPFFINNSRSIYITHTHYNGIAEAGPRTTVRQAHCRHHLLLGQPKNCASSSKKREKKHLVTWRLDNQLILSKTMNFVR

SEQ ID NO: 129242 - protein, 94 aa, Triticum aestivum
  unsure (1)..(94): unsure at all Xaa locations
  Clone ID: PAT_TA_23660.pep
XXXXLXILPXVRTATSGLTARPRLRHADHGPALPAAAKGFPARAAGAGRIGVRHGPPAFMLRAHMSVAGERCHRRGRGGDASSVEPHERGRTRG

SEQ ID NO: 129243 - protein, 278 aa, Triticum aestivum
  unsure (1)..(278): unsure at all Xaa locations
  Clone ID: PAT_TA_23661.pep
EVLETLRNSNAXVCFDVDSTVCLDEGIDELADFCGAGQAVAEWTTKAMTXGAVPFVEVLVARIFLILSYLCQFNNCFXKRIHPIFLLISFFLITLKYINIHVFPVSQDXFGQKLEPVAFDFGIPIENILANRLLFGTSGGYAGFGTTEPTPRSGGKPVAXAQIKQGRGIKTLVMIGDGATDLEAWQPGGADLFICYAGVQMREAVATKADWTVFGLPVLFSGLSLVLSLSVFLTLMLFPPWFTPGWTHACAQPCLLLPYFSLFVPHFHHAVHELVLEL

SEQ ID NO: 129244 - protein, 121 aa, Triticum aestivum
  unsure (1)..(121): unsure at all Xaa locations
  Clone ID: PAT_TA_23662.pep
MSDTDEHHFESKADSGASKTYPQQAGAIRKGGHIVIKARPCKVVEVSTSKTGXKHGHAKCHFVAIDIFNGKELEDIVPSSHNXDFPMLTAKDYQLIDITDDGIQXSQLKSGYTKGDLNFHG

SEQ ID NO: 129245 - protein, 112 aa, Triticum aestivum
  unsure (1)..(112): unsure at all Xaa locations
  Clone ID: PAT_TA_23663.pep
SPSPKCILMLGAWLPQERSRLLRRLHHLSGHRYPWPNSSASDLQGENLKGPAITXPWSPRSTAWTAYGPSCWSPLYPXXIRSXVKALSPXVSQLAPXPPGNFPSCHGNPGSP

SEQ ID NO: 129246 - protein, 138 aa, Triticum aestivum
  Clone ID: PAT_TA_23664.pep
CANRLLLTTYVHINISYKAVHCMAAKRTQAEMLTISFALPRVRRREAGDSTSSSLIGSIRGVRPPAGWPRARGRAPRTGLRARRGAVHAGMGAMTWLNSSVVGRRRAVARVVGAVCRSSLLLAAQPWTESMRAATKSS

SEQ ID NO: 129247 - protein, 118 aa, Triticum aestivum
  unsure (1)..(118): unsure at all Xaa locations
  Clone ID: PAT_TA_23665.pep
RTRRRTGCRARRRPAPWRPSPSGCASAPRRRRPTCSPTSATTSSCSKLSLRRVPPRPTTKAAPPPAPAPVRXPTRPPPSASSPNDRAXPGPPPPPASSTPPSPQAALSEVVPSPPGDD

SEQ ID NO: 129248 - protein, 134 aa, Triticum aestivum
  unsure (1)..(134): unsure at all Xaa locations
  Clone ID: PAT_TA_23666.pep
MTRSRPTPTTTMGGSVPDHHHHQHDGEVDGGQLQHGGEHVETVMPGFRFHPTEEELIEFYPRRKVDGKRFNIDLIAXFDLYRYDHGISPHWASIRGTRSWFFQRASGTASYRNGDRPNRVTPSGNWXATGAARL

SEQ ID NO: 129249 - protein, 102 aa, Triticum aestivum
  Clone ID: PAT_TA_23667.pep
GRLRAAPEAAHCPILGDYVPRPRPLTAPHPPGGEEKCTTYASTVFGPTCDSRDKVVTGHQLPEMKVGDWLVFDGIGAYAASSGSNFNGFLISDIKTHLAYST

SEQ ID NO: 129250 - protein, 409 aa, Triticum aestivum
  unsure (1)..(409): unsure at all Xaa locations
  Clone ID: PAT_TA_23668.pep
MVGSSPMQAVLVAPGVKDKKVLAFRQDALKEKDAVAALMRTIAAGGVRSAFYVFDLAQVVDLXSVGCRRALPGVRACYAVKCNPEPALLGALAALGAGFDCASRREIEAVLALGVQPGSIVYANPCKPEAHLEYAAEVGVNLTTYDSEEEVVKVKRCHPGCELILRIKGPDGGEARVDLGTKYGAHEDEVLPLLRAAQREGLNVAGVSFHVGSGASNTDVYRGAIEAARGVFDAAAALGMPPMRVLDIGGGFMAGSAFDEAATVINAALERYFGELPCVEVIGEPGRYFAETAFTMAARVIGKRTRGEVREYWIDDGLYGTLSCIPMDHYVPHPRPLAVPRAGEKAYTSTVFGPTCDSLDTVVTGYQLPEMNVGDWLVFDDMGAYTTASGSNFNGFSTSDIKTYLAYSS

SEQ ID NO: 129251 - protein, 66 aa, Triticum aestivum
  Clone ID: PAT_TA_23669.pep
RTRAGGGIAASLLGSVAGAIGANLIENKFEGKHGKHKKDKKDKKHKKDKHHKRSGSKGSSSSSDSD

SEQ ID NO: 129252 - protein, 110 aa, Triticum aestivum
  Clone ID: PAT_TA_23670.pep
PTCFHRLGYLIGYPGCIRVSLVHCKALLTKQCGCTKRIFAPNCGEQVFAFVKTDKSIKAPHKAECHVCECPLEYRTKVERSLSGPRRSWVYGRVYMVKQGHPRKRRWIKD

SEQ ID NO: 129253 - protein, 65 aa, Triticum aestivum
  Clone ID: PAT_TA_23671.pep
ANSLVISSGRPGRYRRKPMETSRKVTSEVTSRKEAKEKKELACSLVPLVQKKNAVFVYKKYKPLN

SEQ ID NO: 129254 - protein, 208 aa, Triticum aestivum
  Clone ID: PAT_TA_23672.pep
SKAERTRSASVARNAKKDFSCEHLLSCSALAMEIACTDLTHVLRSERRFKYTGYSKSFHMPGRDKHIKRRWNFGGHDWEIRVYPHGGEPSAPSWVAINVVPLSECAVAVVTTIRGCLVDPEGVREPSEEICQSVAFRKPQDKSSQMLLMPWYTLNKSRYLKDDSFIVQCTLEVLKELPDIPEPEVHVPVPTSNLHQHFAELLQSQMGA

SEQ ID NO: 129255 - protein, 126 aa, Triticum aestivum
  Clone ID: PAT_TA_23673.pep
MSLVANTHLIGRELSCCYRATVDGFSATDFHRRCDFKGPCVVVGYTAGGSFRFGGFSPEGYRSTDDYYDTLDAFLFYWPPAAPEDTAAAVPVVLPKVGGNGAAPVRLLAGAGPQFRAADGAAHPGR

SEQ ID NO: 129256 - protein, 87 aa, Triticum aestivum
  unsure (1)..(87): unsure at all Xaa locations
  Clone ID: PAT_TA_23674.pep
TIFIAITLELLHRHLPGRXLRNRIPAGAMGGPGSMRTSXPKFALIGESLLQIXLGRRFXKPXXTGEKPLGXYPNLIXPCXXNPPXSA

SEQ ID NO: 129257 - protein, 98 aa, Triticum aestivum
  Clone ID: PAT_TA_23675.pep
EFTSDLSGRPGRCLEFFFFFLEHRQKGTINFLSSTSVQRAKYIWSKIITQIYILYPKIQPGYTFSAGITMYIIGCIKSYENLGISGLVWAFNLGRDHA

SEQ ID NO: 129258 - protein, 95 aa, Triticum aestivum
  Clone ID: PAT_TA_23676.pep
MADDSSSPASYIRLVQHLIEKCICYDMNKEECVEALEKHANIMPAVTSHASEELEKENREFFETYKKDRGGESPSQKGSPSDQASTSRSSDDNDD

SEQ ID NO: 129259 - protein, 60 aa, Triticum aestivum
  Clone ID: PAT_TA_23677.pep
HISTVQQYHYYISELPAVVMTVTDLQNYNELKQTTVQLETTFTFIQVFQNKNYTPRPRPR

SEQ ID NO: 129260 - protein, 198 aa, Triticum aestivum
  Clone ID: PAT_TA_23678.pep
YYHARTAPLCFFRVSGVGNSSGSERKVPGGIGEEEACQRRRHGPIHKPRACNFGGLRWRTKGSLAKYQTNAFPVSDLEAGPHRGSLLMPPTLSLLELARRSRRPCRCRSENGAFSDQNFWKMGDADPSRSSSGSALSYSESCAPYGSADASEMTGSAQSHAWESLVPSKKRSCVTRTKSSSVDMLVKDLHCIMHEEQL

SEQ ID NO: 129261 - protein, 157 aa, Triticum aestivum
  unsure (1)..(157): unsure at all Xaa locations
  Clone ID: PAT_TA_23679.pep
PLRYDLWLVSAAFFLFTGFVVWAIEHRANLEFRGPASYQVGTLLYFGFSTLVFAHRETLKSNLSRFVVLVWVFVVLILQSKLXTRSLTSMLTVPQLEPGRGRLPAKLQLGQREMVGVNEQLLRAQGHDGVGFPARERSCGTEPPTQEHCQLPNAAPL

SEQ ID NO: 129262 - protein, 158 aa, Triticum aestivum
  unsure (1)..(158): unsure at all Xaa locations
  Clone ID: PAT_TA_23680.pep
MVSRGGGAVRSLLDRLRPPPRGRRSPAMPPPPAAAAKGACFCSFSHSGAYGEGRRKGVLDLGVGRRFAPGSALSLKGCLNWQDGGRFRRADGGDGDAVEIKARVLAPQRQFVRDAEVQLSEEVGMKTVDGNGAXGRXKRLDFPEQPVPTKMVLVMWMK

SEQ ID NO: 129263 - protein, 146 aa, Triticum aestivum
  Clone ID: PAT_TA_23681.pep
MAAVTRKKKVIIDTDPGIDDAMAIFVALRSPELDVLRLPGRSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 129264 - protein, 162 aa, Triticum aestivum
  unsure (1)..(162): unsure at all Xaa locations
  Clone ID: PAT_TA_23682.pep
STNTHLCKRASYQKKSPRKRPRGPAGRGQEWQQTAALRKRRPATMAAIHGADGRGASAIADKGHCVVYPPGGERFEVPLAYLSTTVFGELLRMSEDEFGFXSEDRITVPCNAAVMAYVICLLKRKPSEEVERAVLSSVVMPRSNQSGIAMVCTGLGQSMAIF

SEQ ID NO: 129265 - protein, 196 aa, Triticum aestivum
  Clone ID: PAT_TA_23683.pep
MAANPDREVCHRAGRGGKMLLPVMAVLAAVVLASLPSAAVATNYTVGDEKGWNPKVDYTSWVKKHRPFYKGDWLLFEYQNGRSDVVQVDEVGYDNCDKESAISSHSKGTSYAFQLKEAKDYFFICSYGYCYSGMKLAVTAKKGPASSSPDSGSSSSSSPAAKSSSKSAASPLAARNAAPLAAALRPRPLRPTDLSR

SEQ ID NO: 129266 - protein, 65 aa, Triticum aestivum
  Clone ID: PAT_TA_23684.pep
PGVVISVVAAEVFSQVKEHPKEHVHLSFSSLQRSTARSSMKKISTSCLLNQQYYIRNYVVIVRYV

SEQ ID NO: 129267 - protein, 215 aa, Triticum aestivum
  Clone ID: PAT_TA_23685.pep
LAWSRPRSRTENTAEKAHISHPAHPQHQLQLVVATQKFQCNGCKQPGAGQSYRCEPCDYDLHTVCVPPKTPLKHPRFNGCELRLLLEPPGPGRWCDACGDVVLGFCVLQTANARSTSTPPCAFHPQLVEIDGTLFELHTDKDADLVCRRCEVKGARRNQLLVLSFQGTAAMTGSLRTALRVHDKRKFRKRRPTAYNMHGAPSGAYWPWYSWELNK

SEQ ID NO: 129268 - protein, 80 aa, Triticum aestivum
  unsure (1)..(80): unsure at all Xaa locations
  Clone ID: PAT_TA_23686.pep
XHXFFXPGGAIXIGXLGGLRGRGLPFRGEFGPDVRTAPPPALGGPREFRFRAAAPGRSRLLRLLIQYKRKKRKEKNRYLV

SEQ ID NO: 129269 - protein, 48 aa, Triticum aestivum
  Clone ID: PAT_TA_23687.pep
NSETEQRLDLSVLLTRGHGEEMPVLAVYVLLRRGATVVDLPGRPLEIT

SEQ ID NO: 129270 - protein, 71 aa, Triticum aestivum
  Clone ID: PAT_TA_23688.pep
MDTVKQAANYVTESIQGSGAEASKEANKSVAKDSESNLSSRVTAAKDAVVDKKDEMSHNTKANVNKESAKH

SEQ ID NO: 129271 - protein, 194 aa, Triticum aestivum
  unsure (1)..(194): unsure at all Xaa locations
  Clone ID: PAT_TA_23689.pep
EVNYLHQGCEMQILHFDIKPHNILLDSNFVPKVADFGLAKLYPRDKSFVPSRALRGTFGYIAPEMMSXRSFGVISXSKSDVYSFGHASCWEMAGGRKXTLTPNTSKLRAKRYYPSWVFDRLTAQEVCXRTPVDDMHELERXLCIVGLWGTQMNSHDRPTMREAIXIRKGVGCKSSKHLMITAFGSTLYPATNPR

SEQ ID NO: 129272 - protein, 107 aa, Triticum aestivum
  unsure (1)..(107): unsure at all Xaa locations
  Clone ID: PAT_TA_23690.pep
ITNLGRDHAKHWRLLHRHWNLNLQVNHTTWAQSRIRLFVCLTNLNQVTIXVIMQQWLXNLGNPRHHLQPQQXKKKXFXXVTKHSXSXNXXTNXGXITXLXTXWPSXP

SEQ ID NO: 129273 - protein, 138 aa, Triticum aestivum
  unsure (1)..(138): unsure at all Xaa locations
  Clone ID: PAT_TA_23691.pep
EGETDGGAGGTREIEREGASKRRGEGDSERAREDRRERERDGGRERGTNKVCVLDACDRTEDCQRERERWRERERDQQGLCVGCXDRSEDCQREREREGGRGRGTNKVCVLDACDRTEDCQRERERERGRERARERDQ

SEQ ID NO: 129274 - protein, 376 aa, Triticum aestivum
  unsure (1)..(376): unsure at all Xaa locations
  Clone ID: PAT_TA_23692.pep
MALWRRSSSWLTSCSRAPAGIGGGNEAKVSPEVAPEDAAAEHEGRRAEAGDEERWSRLLPELLTDIVRRVDAGAERWPPRRDVVACACVCPRCRNANRVVVRTPLAAGGRAFPSSPLTPAPPGGPFRSSPRXDPSHPRRVAVAQPVTRPSGKGEDLPAARRFRHGAHTEYIISYDSDDLYPGSNSGVGKLRSDFLGTKFVMYDNQKPYDGAKSLKSRSSRRFASKQISPHVSGDNLEVGQVSYRFNFLKSRGPRRMHCSIQCPVGQGTASDPSKEKPPSTSSSLSLKNKAPRWHDHLQCWCLNFHGRVTVASVKNFQLVAPAGTSDPWGVGDEETVILQFGKIEDDAFTMDFRHPLSAYQAFAICLTSFGTKLACE

SEQ ID NO: 129275 - protein, 60 aa, Triticum aestivum
  Clone ID: PAT_TA_23693.pep
FSIVFIFSLVFVYRLDKRLRHRIKIKALQKAHSSKIKIIQTGKEKRISIKSIEERILSLI

SEQ ID NO: 129276 - protein, 219 aa, Triticum aestivum
  unsure (1)..(219): unsure at all Xaa locations
  Clone ID: PAT_TA_23694.pep
NLPHGSGGFLDTDTLFGLAWVLPRSPRRYTAENSVKYGAPRDTARPELRQPLAFEVWQHIREELKPTNSLVISVVAAEVNIANIILSDTKAESVIEHIFIVGSHLAGGNGDRGNVFTVPSNKFSEFNFFLDPQAAKAVVESGLDITLIPLRAQRQVDSFKEVTRSLCTAEKTPESLFAXKLLLSMQKLQKNNQXYHHIDNVPLGELPGAGWSLGQQSAT

SEQ ID NO: 129277 - protein, 77 aa, Triticum aestivum
  unsure (1)..(77): unsure at all Xaa locations
  Clone ID: PAT_TA_23695.pep
ELVSXFFFFFFFXFEQNLELQLICKRLGSSSTYQYSEIELQSANTSCEIQFYQQRNQTSHATLDLGRRPTPNHLVNS

SEQ ID NO: 129278 - protein, 128 aa, Triticum aestivum
  Clone ID: PAT_TA_23696.pep
IEHKQTRRPPGLSMEAKAQSGFVPPMRGSSDQSNDRPYAPPDASQKAPSPSRAKASSTGTTPEPSNGNNSSRTPYKAEKTTSQKGRGLSWGAWVCVRKKNHVNKYQFVLVIYQVRYFVVQETSIPTYG

SEQ ID NO: 129279 - protein, 86 aa, Triticum aestivum
  Clone ID: PAT_TA_23697.pep
RFNRFSDGLGPSVSQRGHARSRRGSSRPLADRPGRKWGKYTRSVGRDHTLAHSLIARSLPCSHSPAPVRARRHAPSSRPVVVRRRI

SEQ ID NO: 129280 - protein, 155 aa, Triticum aestivum
  Clone ID: PAT_TA_23698.pep
CILSGQHRTGNCNCRASSRPGNPDEESGTRASISRIVMLAEALFEVLDEIHQQSAALSSRTSLPSIGSVPAPKEIVESLPVKVYRKPLKHQTDEAAQCYICLVEYEEGDCVRILPCNHEFHLTCVDKWLKEIHRVCPLCRGDVCRSDSSSIGKFS

SEQ ID NO: 129281 - protein, 145 aa, Triticum aestivum
  Clone ID: PAT_TA_23699.pep
PTSEKKTRRLPMAALRVAARRLVGGGQTPAVAVDKAQRRLFPRLSQVGRARSTTSSAAAAADTNLAATKPAPLGCEDREKLMREIHNMREELYEKVSYAERTYSIPGRAGKHINRLHDDPPHEGASPLRAAPGARGERKSALCRC

SEQ ID NO: 129282 - protein, 67 aa, Triticum aestivum
  Clone ID: PAT_TA_23700.pep
HWPSCMHAIVFLLAPCNVTGSDWEVEEGDKVVARKAGYIFKLINLNFSCKKKKKKKKKKKKKKKKKK

SEQ ID NO: 129283 - protein, 63 aa, Triticum aestivum
  Clone ID: PAT_TA_23701.pep
SFFFLFFCFFFFSHKYKMFLDIPIWTTCGLKCVYYTSDSEKKLEHVIWYKFIFLKFTPRPRPR

SEQ ID NO: 129284 - protein, 224 aa, Triticum aestivum
  Clone ID: PAT_TA_23702.pep
MPQQSATSVKLKLACRSQRPLQSSQSQRPLQSQSQRQLQSSHRERQLQSSQSQRPQQSLQRQRPQQSSQLQSSQSQRQLPQSNRPQQMLQRQRPLSSQGHYPEQRRVQANDRVKPSERQPSRQVSANGRDDRAKKKQLGKRRFDDDIEDEDDPMAMIRSMFRYDPSKYAGRDDDDSDMEADFATIEMEEKRSARIARQEDEEELRLLEEEERREQERKRRRVGR

SEQ ID NO: 129285 - protein, 91 aa, Triticum aestivum
  Clone ID: PAT_TA_23703.pep
KGALVNKLILFSFASFLDVTSLVTFLDVSIGFLRCFVLPFVFLIGFLQPRLLFLLVFLCFSLLGLFFLLRLGRGCCCRVFHGPGGRLDEAR

SEQ ID NO: 129286 - protein, 122 aa, Triticum aestivum
  unsure (1)..(122): unsure at all Xaa locations
  Clone ID: PAT_TA_23704.pep
SGXRNFWRLGFVPRAPLFDFCSEQLHSKIYLLCSLLSCGFFAISNFPGRRKLAVEKVSKAADELSRKVDEAIQKDISQSGSKLVPVRRPCQPNRTRKHASEKLTGCRVFRVSCPPLSVSSKL

SEQ ID NO: 129287 - protein, 93 aa, Triticum aestivum
  unsure (1)..(93): unsure at all Xaa locations
  Clone ID: PAT_TA_23705.pep
VPAVLDKMMKSGRDGAEAAVAVLWAVCHKYKXRRAAEAAAASEGGLTRVKLKLRLASSAEARQMALELLKIYKVNAKSCLAGYDSKTAHIMPF

SEQ ID NO: 129288 - protein, 141 aa, Triticum aestivum
  unsure (1)..(141): unsure at all Xaa locations
  Clone ID: PAT_TA_23706.pep
MYTARKKIQKDKGVXPSEFEDTVAQAFFDLENGNQELKSDLKDLYINTAIQMDVVGNRKAVVIHVPYRLRKXFRKIHVRLVRELEKKFSGKDVVFVATRRXIVRPPKKGSVVQRPRNKDLTAVHDGILXDVVYQXXXCGGK

SEQ ID NO: 129289 - protein, 66 aa, Triticum aestivum
  unsure (1)..(66): unsure at all Xaa locations
  Clone ID: PAT_TA_23707.pep
PGIRIGVGPRPRXERERERERERERENLVSRFFFFFGITTGQSGTKGTSDDSTQKQNISLNCTRVQ

SEQ ID NO: 129290 - protein, 233 aa, Triticum aestivum
  Clone ID: PAT_TA_23708.pep
MAAQPPSSSPQDGSGGGGSSENLVLQAPQAVREDYVQNAVNFLAHPKVKGSPVSYRYSFLEKKGLTKEEIDEAFRRVPDPPTSSTDAAAVGSQQASNPNQSAGVQPYASVQTPQAPNGLCRHCSQRPTNPTHQLARDSPSLCLWFPLELPRRRPCPSPRTLFSLQRTFSAQKRRLAASSADPPSPPESTIYSADERRIHLLTPLTSRLLAALAVGTMAGRGPNGENGEGPGAA

SEQ ID NO: 129291 - protein, 228 aa, Triticum aestivum
  unsure (1)..(228): unsure at all Xaa locations
  Clone ID: PAT_TA_23709.pep
ELLASKEEDKKILVKLTEALDSQAEVLKSLSETLHHTRENRFSQYNMLEEHAQPGPWNGPTTNSWRTSQQTNMYTTTPNGDFDSGRQPFMPLPAEPTSGSFPRSYVDQRVPRAGYGFQPQMGYDRLNAGTREGYYGSPPYYPGGSNAVDAPAPAPAPVAVPAPAPAPTPVAQESPFQRHWVPPQPPGVAMPEAGRHSAAKXLPRQDHSKGNSXXXKNRXXAINXXXGY

SEQ ID NO: 129292 - protein, 111 aa, Triticum aestivum
  Clone ID: PAT_TA_23710.pep
MGGRNIGVAVDFSSCSKAALRWASTNLARSGDQLVLLHVNNSYQNEQGAMHLWEESGSPLIPLVEFSDPHVTKKYGLSPHKETSERVSQVAHHIGVGPVGKVVQGGPTKKL

SEQ ID NO: 129293 - protein, 56 aa, Triticum aestivum
  Clone ID: PAT_TA_23711.pep
RGARVAPRVEQGEVAQPHSEAAGNNGRGGIAPLIGQNSSRQFSQEQEFVSSLLVPR

SEQ ID NO: 129294 - protein, 146 aa, Triticum aestivum
  unsure (1)..(146): unsure at all Xaa locations
  Clone ID: PAT_TA_23712.pep
LAWSRPRCEMQEVKRWWVDLGLSQEIPAARDQVLKWYMWSMTILEGFSFSRYRVEATKVISMVYIVDDIFDLVATHEELSLFNEAIKMWDLAAAESLPKXMISCYKALYTITNDIXADMVIKRXNGLNPIXNHLKQAWATFVLMGS

SEQ ID NO: 129295 - protein, 177 aa, Triticum aestivum
  Clone ID: PAT_TA_23713.pep
VRRTQTNTAMVEDFTCPTIPPVPCGAKKLPSPHFTSPPPWFVVPADAGAHDHHRRCFSAAEQAGNPNNDVYPGPGGRSERFAVMEEHKMDMLWEDFNEELARAPQPCPLSMEWSSEAWHAGEGDGIPSQHVDVVVASGTGSSVVRRRRLGLMMMLKLLKKLFLARKSSTTSRKTPPN

SEQ ID NO: 129296 - protein, 140 aa, Triticum aestivum
  unsure (1)..(140): unsure at all Xaa locations
  Clone ID: PAT_TA_23714.pep
RLRPSRKLLRWXXRGPRXRRRXRTTKKLCQAARGVHQGGHRRRRQCRXQASSKEIRKGLPRGTPSVLMGKEHPHPPAAIKGALRGXXPGNXGLSLSSXKPPPSVTFGPQFFNQXGWTSKEGSRRGAPNSKGWGPPSPGGG

SEQ ID NO: 129297 - protein, 163 aa, Triticum aestivum
  Clone ID: PAT_TA_23715.pep
RGRGRGVTGAMESLLPKLGELLVGEYRLQKGVKKDVESLEREMKSMHAALTKVAKVPRDQLDQQVKIWADEIRELSYDAEDVVDKFLVSIEGSNPTVNSSKLKGLMEKITSLFTKGKTRHLIANAIKDIKDRAQEVADLRDRCKVDDAVAQLSITILIPPSWV

SEQ ID NO: 129298 - protein, 227 aa, Triticum aestivum
  Clone ID: PAT_TA_23716.pep
HASEHCDISVGRISSRSLKHLSLRSCRSNSNCWVHVSTPGLVSLVLVRFGGTTPFLENMALLETARLDLSDDFDVCFDYDSDENSVPFNKDDSGDSVLLGALSGAKHLELVSAFQNFVFRRDLRQCPTFSKLKTLLLNEDWSEAPDLDALACVLKHSPVLEKLTLQLFTNKGPKQEMKMKGSYSSAERSAAISEHLKVVEVQCNVVNQGVFKVLKFLCAFNIRFSFE

SEQ ID NO: 129299 - protein, 184 aa, Triticum aestivum
  Clone ID: PAT_TA_23717.pep
GLIPYYSFDQFVRKAEKVGASSRVRRCISELKERVARGGDPTLLHQPLVEEVIPEGEPDGTTQEDPILGTEPPSTDNHEDVDPFAMESDDVDPMQEDLLNEIYEKTADEPVLRSGDGGAEQPVAPREAEKHQDGEDGGGSKPSKVELTEEQKARMEANRLKALERAAAARARASQSLPTTETTT

SEQ ID NO: 129300 - protein, 122 aa, Triticum aestivum
  Clone ID: PAT_TA_23718.pep
AHLRDRANVEKLRLLTKAEKAGLLSAAERAGLSLSAVERLGLLSKAEELGVLSAATDPGTPGSLQGLALLLLAAGPAVVFLVPEQYPWEVALQAVAALVCVAGGSAAFAASSFVSRLQGSSG

SEQ ID NO: 129301 - protein, 171 aa, Triticum aestivum
  Clone ID: PAT_TA_23719.pep
MASLLSPNTVAATTARTAGWRGRLTPSVTAMATKGPKPSSGGTKRSSGTTTVFPVGKPAGPPRPATTKGSAPVKLLTNVEKLRLLTKAEKAGLLSAAERAGLSLSAVERLGLLSKAEELGVLSAATDPGTPGSLAGPPAPGCWAPSGPSAVFRGPPTSDPWLRVAAPGSSG

SEQ ID NO: 129302 - protein, 176 aa, Triticum aestivum
  unsure (1)..(176): unsure at all Xaa locations
  Clone ID: PAT_TA_23720.pep
MAEHGEEEAGTLEFTPTWIVALVCSIIVLISLLAERCLHYLGKTFKRKNQKPLYEAILKVKEELMLLGFISLLLTVCQGKIQNICIRPSWTLHMLPCQGGXEVRAGEASPTKEHLVTAQIIGRIGRRLLSGGAAEADVCRSKGKAPLMSLEAIHQLHIFIFVLAITHVGFSVLTML

SEQ ID NO: 129303 - protein, 72 aa, Triticum aestivum
  unsure (1)..(72): unsure at all Xaa locations
  Clone ID: PAT_TA_23721.pep
VISVVAAEVFSHPKPQLVRXELLAHATGARGSXAVTSHSYSPSGTQKVLQTHIRSAYGLDCRRASTKVCSTI

SEQ ID NO: 129304 - protein, 49 aa, Triticum aestivum
  Clone ID: PAT_TA_23722.pep
EKNMMLFIIDDCYTAFAFQFFSHTHNYSSNYFRSSEGIWGNASLILQQQ

SEQ ID NO: 129305 - protein, 38 aa, Triticum aestivum
  unsure (1)..(38): unsure at all Xaa locations
  Clone ID: PAT_TA_23723.pep
CVHCHVFIMKCYFCIDRYSIENMTILTLVKKKKKXKHK

SEQ ID NO: 129306 - protein, 844 aa, Triticum aestivum
  unsure (1)..(844): unsure at all Xaa locations
  Clone ID: PAT_TA_23724.pep
MAPTAPSPAKSASPSHLDGKSEVSDLKQQLRQLAGSRAPDADDQRRDVFKRVISCMTXSTLWVAFVTQDEPRPSSKSRPRMGLLLRHFLPCFNQYCRNLGILDREHFPXSVMHLPPAFLALHNISAIHYIKLQAKPSVTSFYQKXEQVKFAVGLPVSCKYHQTIKFCREKTXLVAVLPAALWGLMLLAPYAPVVFNCLHSLLEIWTLEAANSXEAAGREIETLYSKPVVFYLLNKIKEFSEWAQCHVLELASKFIPSDNNEIFDIMNLLEDRLQHANGAVVLATIKVFLHLTMSMTDVHQQVYERIKAPLLTLVGAGSPEQSYSVLCHLHLLVMRAPMLFSSDYKSFYCQFSDPSYVKKLKLEMLTAIANESNTYEIVTELCEYAGNVDVPIARESIRAVGKIALQQYDVNAIVDRLLQFLEMDKDYVTAETLVLVKDLLRKYPQWSHDCIAVVGNISSQNIQEPKGKAALIWMLGEYSQDMHDAPYVLENLVDNWDEEQSPEVRLHLLTAVMKCFFKRPPETQKALGATLAAGLADTHQDVHDRALFYYRLLQYDPAVAERVVNPPKQAVSVFADTQSSEIKDRIFDEFNSLSVVYQKPSYMFTDKEHRGTFEYSEDLANLTVGADAPETVISAQRYQESDNDLLLSTSDKEDNGIRSSNGSYTSTYNAPSDLLSSQTPAETALINPSSSTYSTQTNFSLDDLLGLGVPDAPAPPPPPALALNSKPVLDPATFQKKWGQLALSFSQECSLSPQGAASLMNPQSLIRHMQSNYIQCIASGGQPPNYKFYFYGQKAGAAAFYLVXECIVNTASAKAQLKIKAEDGTTAEAFSTLFQSVLSQFGHS

SEQ ID NO: 129307 - protein, 203 aa, Triticum aestivum
  Clone ID: PAT_TA_23725.pep
PSKSPLDSTASSLEATAAAASGAPRAPVGSSCASGSRPRESAASAWDRDPSAGEEEPLMAPGVVLVSEFELASDGDGSTGEGIWLIAAAPSEPVLPQPSFCPWIRAAGASNLASETPGSADSSSAPEHRPAALSVPTAPLTSEPPGTSLSASAAEPSSPAAEGRAAARSGASTTSLGGEPRAPAAPGTSAMASRKGMRSGRLA

SEQ ID NO: 129308 - protein, 109 aa, Triticum aestivum
  Clone ID: PAT_TA_23726.pep
GPPSRRQLELPKVMFTRILGRFQLRNHQQHFHRTSFTGILLTYYPPWLLGLDSHGGSFHRTTQRVFSLLIDVSPVHVASAAKIASIFTHFCIVITTILLVAMASTASGK

SEQ ID NO: 129309 - protein, 347 aa, Triticum aestivum
  Clone ID: PAT_TA_23727.pep
TFSQPLSTYASTASLMMPPAGRNDQLLSARHGLKSGLGNSDTLDSWQPWKGDSSINNHLWRDDSPYQRTTSGHAYQQTWKDDAYQQTRGTETENFSRFGGLQPPRQAPVSFVMQQPQAPVAEEYQHLDIINDLLDEGQSNGSKAEPMRHDYHAYGLPFSLRGNIADSEMASVSSPGRFSRGNLADLDMASLSSSRRFSRGNLVDSEMSSVGSPGRFSRGSLADPEMLASVSSPSRFNSTDRYYDDGFSRAYDMSPLQGQGTREIQFSSLDGYSTNGGLSDMSTSKPWLYGGHSPVNPSSMNLGSLSTNGFPQHHHQMGDYSSNLASGVNGVGSAAAAYRRQANNGRW

SEQ ID NO: 129310 - protein, 63 aa, Triticum aestivum
  Clone ID: PAT_TA_23728.pep
KVLISLFLTINLIHMQYYKFLQQSVGYHIVLQTRTKNGMWSRQGTSRLGARPARAAAGIISEF

SEQ ID NO: 129311 - protein, 133 aa, Triticum aestivum
  Clone ID: PAT_TA_23729.pep
PLRPRVRKFLKAGDKVKIVVNLKGRENLYKKQAIELLRRFQTDVGELATEGSKNFAERNIYLILVPNKLAIQKEQDGVSKKDAVEGETDQSDDELDGDETVIEQLEGSSLDGDEPVIELEESKEPETEVSANV

SEQ ID NO: 129312 - protein, 123 aa, Triticum aestivum
  Clone ID: PAT_TA_23730.pep
IKHLLRLLSQVPYSPPVVLSRAQPRPNYFPPVVPSGAHPRPNYFPPVVRSQCRPHPIHPLIGDSLVRRGGACEARLVLFFFLASRHKSPNRFIISSQYNSTWSRNRPLYIGITHTYRPISSTE

SEQ ID NO: 129313 - protein, 130 aa, Triticum aestivum
  unsure (1)..(130): unsure at all Xaa locations
  Clone ID: PAT_TA_23731.pep
NSLSDFERPPGQVDGESLLGYSDSDHNAHLDSRKSTFGILFFLGSSPISWQSVRQKVVAASLCEAEYIAAAAVACQGIWLAHLLGGMLXKDTAPALIFVDNKSXAISLFKNPVLHDRSKHIDLRHHFIHR

SEQ ID NO: 129314 - protein, 40 aa, Triticum aestivum
  Clone ID: PAT_TA_23732.pep
CTTIDPFMKHTRILATPNAQVRSYCLLVDAFYKRRWRLRR

SEQ ID NO: 129315 - protein, 73 aa, Triticum aestivum
  Clone ID: PAT_TA_23733.pep
WIPRHPETRKGIYMFDSVGEPIGKAVTIGQLDDQLLVQAHRYVLRHSDELDDLRRCASMLSPISFIFHKLEKS

SEQ ID NO: 129316 - protein, 314 aa, Triticum aestivum
  unsure (1)..(314): unsure at all Xaa locations
  Clone ID: PAT_TA_23734.pep
GTSAFGTAASYVKFVEAGGARVIPLIYNEPDDRLPDERLLEKLSLVNGVLFTGGSVKRGPYFETIKVVFQYVLDKNDAGVPFPLFAQVXLDFELVGLFVCEXFIASDQASTLHFPNYPPLQGSVFERFPPVVILHPDLIXKLSTSCLVMQNHKYGISPXRLRENDALSSFFKILTTSPDENGEVYISTVEAQKYPITCTQWHPEKAIFEWGKPMIPHSEDAVQVTQNFANYFISQARKSPNRPPADKVLDNLIYNYSPTFSGKTSKSFELVYLFSWRLGADACSRGSSLTVLYITVLCTMWCIIVLMRPSGSMV

SEQ ID NO: 129317 - protein, 196 aa, Triticum aestivum
  Clone ID: PAT_TA_23735.pep
MENPDGQAGADAGLPPPPPPPLDAAGAGLGSDPAEVLPPPPPHLPGGAPHEVAAQGADGSAYPAEHASLNGTSGDAAGYQATENGAAADEMAEPMVPEQSYEDAVASAEEARLWDVVTADCLDFDAWTALIEETERIAESNILKIRKVYDAFLAEFPLCFGYWKKYADHEGRLDGVNKVFEVYERAVLCSTYSVDI

SEQ ID NO: 129318 - protein, 82 aa, Triticum aestivum
  Clone ID: PAT_TA_23736.pep
NACQDDTDARPYMAEIARELDAIRSALPEGEELMSVTSMEMSSSGTLTQSTSNSLITTTGEHFDISHASSSGVPSRMAMNPR

SEQ ID NO: 129319 - protein, 115 aa, Triticum aestivum
  Clone ID: PAT_TA_23737.pep
GLLEMMMKNKRRMGVHEKQRPCKKVIRPTLDGTSSARSDSSREPSPGALSQLSEQVVSRLCRSVVSLASFHGDTKLGECTGICIETSCPDATSFLTSRLLIPLTWPTREITENLT

SEQ ID NO: 129320 - protein, 66 aa, Triticum aestivum
  unsure (1)..(66): unsure at all Xaa locations
  Clone ID: PAT_TA_23738.pep
PNKKGKNKVERSQTLMQHHKTNTEPTLIEVNKSRTKFETSYMFSLVPLLRDYLILPQKHYLGRDHX

SEQ ID NO: 129321 - protein, 483 aa, Triticum aestivum
  unsure (1)..(483): unsure at all Xaa locations
  Clone ID: PAT_TA_23739.pep
DAWGAHTVRDPHQSAKKGPEPRLLGTRGGEGEKKGHRKVTLPTVSNYTIRDAEDGDNAKPQRSRPETENKLEMVAGKSDGSQQQDWDNAEWGSKPLCDFSNFRANVCEMRGNIRIHPNASSVMYMEPASSKRNELWKLKPYPRKGDELCLSKVTELTVKSSKVAPECTKYHNVPVVVFALTGYTGQICSTHLHPTPLVPLLTTASEFTPSSQCLITAMPWFXLRITDVVFWWPTNYPLIDFNKDTDVQRDFHADTGLHAAMQAIVDPHAAPHFSTVPAFAPLIRTTVEFPRVARSALGVPPEAVPALREIPKAKPRLLIISRQRTRMFLNLPEIIAMAEANVSSVLAQVAKVGSALALFSGVLGAGLAIWGVLPPGPTLCLFLPRGATVGVCLPWGGIQXVCRVDFGXPAEHMGLRYNQYSIAVHESSLTDQYPLDHEIFKNPLAFHKGFEFIKETFMDKQNVRLDCNRFKPVLLQTLDLLNQ

SEQ ID NO: 129322 - protein, 125 aa, Triticum aestivum
  Clone ID: PAT_TA_23740.pep
CIISFKIYVPSAAAAEDVASTPLDTASVRTFLLCNFTKRNLSPPSSPSPSPSLSSPRGCRLAALFEFRREIGFAEPSVSLSGTSPSPAILVSADRRKLAHMFNLPPKYAATTPTWHCNRPSELGT

SEQ ID NO: 129323 - protein, 87 aa, Triticum aestivum
  unsure (1)..(87): unsure at all Xaa locations
  Clone ID: PAT_TA_23741.pep
LIXXRGRRLTDRGGRAGLSREAGHRLRRAGELRMNSCFMMKNAERRIIGLNKTKCLVMDGCGTTGSQIGCTVSVSRCKFAACSIVIF

SEQ ID NO: 129324 - protein, 96 aa, Triticum aestivum
  Clone ID: PAT_TA_23742.pep
MAPSPRPYASLLLPSLVLLLLVASSRAARVGATARNQAAQDGRAEEDAGGEAAAAAEDEGCGGGAEGGDGGDDECLMRRTLVAHTDYIYTQGGNHN

SEQ ID NO: 129325 - protein, 403 aa, Triticum aestivum
  unsure (1)..(403): unsure at all Xaa locations
  Clone ID: PAT_TA_23743.pep
MSSESGASNGHAKEAALYEQQLSKIGEVRAALGQLSGKSALYCSDGSIARYLIARNWDVRKATLLRTXSLESRSGGRPPECRRDPXSGDAMTGKMYRSDYFDRGGPCLEKFTEVIKNTKKSKGQIRYLVYCMENGILNLPAGQDQMVWLIDFAGFSLPNVSLLVTKLTADVLQGHYPERLGVAILYNAPKFFESFWKMASPLLEPKTKNKVKFVYSDRPETDKIMEDLFNMDELECAFGGRSPVTFNINDYAARMREDDKKMPLFWSPENSALAAEPYRMKNHGSQQCDSGLKTEETASDMIGETEAASEKSGETDTASEKEDTEAASEEREETETSSEERGETATASGKGGETATVSVKEGVTETGSEKKEETETESSTVKSTSSRGEGIASAGKSGSSSDP

SEQ ID NO: 129326 - protein, 113 aa, Triticum aestivum
  Clone ID: PAT_TA_23744.pep
MSYPCLRRAAVPVKRVWLGLRGRLGLRRSTGLGELRREVRTCEYDDVHVMWELLSGMDGSAPRKYVHAAATAAMVDAAARKKLRGRRRTRRADAESGAWSPPPPSCSPPPARA

SEQ ID NO: 129327 - protein, 65 aa, Triticum aestivum
  Clone ID: PAT_TA_23745.pep
GTTLFYFYVKSHLAWHLHLLVRTEQRSRRAISLTGSINFQISDEINLVYRCLAASKVRLVFLVCM

SEQ ID NO: 129328 - protein, 98 aa, Triticum aestivum
  unsure (1)..(98): unsure at all Xaa locations
  Clone ID: PAT_TA_23746.pep
LGRRRVXXRRRPDRTCWNAARPWPAVLPPGFLEAPPRSFGKLPYLSPQFRRDRVLHRWLKRSLTISASKRVTVENKLLFLFSIVLRQLCCHHPAWSEC

SEQ ID NO: 129329 - protein, 88 aa, Triticum aestivum
  unsure (1)..(88): unsure at all Xaa locations
  Clone ID: PAT_TA_23747.pep
ARAGAKATGLHGQNPAVXLLLLPASWLRCARAEPAVSPCISSSCPWLWTAHAPYRTRTGVTRAVNHAFFFKKRRYSPDLCIGTMHSVV

SEQ ID NO: 129330 - protein, 107 aa, Triticum aestivum
  unsure (1)..(107): unsure at all Xaa locations
  Clone ID: PAT_TA_23748.pep
TLKRLELGMVSSFHPHSMCKKVERVTAKTRCTSCTNWTISFKSISVSDENSSVTPALHFLNLLQPQDLFCIQXCTIQSHVIKLSTISGHQXAIFHAFKRFVLXPNDP

SEQ ID NO: 129331 - protein, 71 aa, Triticum aestivum
  Clone ID: PAT_TA_23749.pep
IFSNSSAPNPLHLLIILQQNSRSARPHQIANSITAEKYVESNQGYRIFANSKLKKISGYQYETTMMCALPQ

SEQ ID NO: 129332 - protein, 130 aa, Triticum aestivum
  unsure (1)..(130): unsure at all Xaa locations
  Clone ID: PAT_TA_23750.pep
EFTSDFERPPGQVFFRAGSIFNWNYILYTSFFIYILSKAQYHLYINMVYKWHDLIFIRLYPSIWIFKYLKPLYVEIQCMHSSLTVSNYCVFHAGFFYFSDMYNGVSHTQHNSVIPILDIXLHNKPCLVAC

SEQ ID NO: 129333 - protein, 130 aa, Triticum aestivum
  Clone ID: PAT_TA_23751.pep
SCWFRGGLFNRNRRGNPLLFKKMLRVSPFYDHYTINIRAPCHNSTAPPIKLNKLSCSNTDMILLKQSRLIGQLNVPKFSFKNALTPLGCVSTGCPRVGPRPTLGILGRPRPQFPSILLRFRSLLAPSRLA

SEQ ID NO: 129334 - protein, 191 aa, Triticum aestivum
  unsure (1)..(191): unsure at all Xaa locations
  Clone ID: PAT_TA_23752.pep
MASICWALLLFLAMFSALATSDTHSDDNLTLRCHPDQAASLLLLKRSFSFFRYPSGLESWQDDTDCCLWEGVGCRNSSGYVTALELSNRGLYSQGLDPAIFNLTSLQLLDLKHEQFWAVQSPGDRGLRGSPCSHTQLSNSGFKGKIPIGIXNCNLTGSVSIKGSDDPKARTDLGVVGEDQFNQWNIGSTVA

SEQ ID NO: 129335 - protein, 82 aa, Triticum aestivum
  Clone ID: PAT_TA_23753.pep
MALSRRSAASALLLLVLLVHAEMGTTTTKLAEARDCLSQSHNFKGACLSSSNCAGVCHTESFPGGECHTQHFERKCFCKRVC

SEQ ID NO: 129336 - protein, 55 aa, Triticum aestivum
  Clone ID: PAT_TA_23754.pep
SCRMLFHLYITNTLLFIFSCRSEKHWTKFHCRFLFRHCIFGCSRKTSHHKNSTAR

SEQ ID NO: 129337 - protein, 142 aa, Triticum aestivum
  unsure (1)..(142): unsure at all Xaa locations
  Clone ID: PAT_TA_23755.pep
RVDGLNQVMTTDSQPLKXKTYSSHPEVESWTSPDLSAGGLGQSVKPSRLRSYVMSFDSDTLQTYATIRSKVAFGIIEKHTEALFGKPEIVITPEGTVDSSKDEYVRISFSGLRRLILEAVTFGSFLWDVESYVDSRYHFVTN

SEQ ID NO: 129338 - protein, 84 aa, Triticum aestivum
  Clone ID: PAT_TA_23756.pep
MASPRRMGMAAVPAVLLILLLLVATEMGTTKTAEARTCESQSHKFKGPCFSDSNCATVCRTENFPRGQCNTHHVERKCYCERDC

SEQ ID NO: 129339 - protein, 182 aa, Triticum aestivum
  Clone ID: PAT_TA_23757.pep
GRTWTHWRTEQNELTARMTYSSMHGTSRQDGASGRTSRASRRSTCARSAACGTRRGKFSVRQTAAQLLLLRQAPLKLWLCDTQSRAPATLVVVAPISACTSTKPRSAEHHHRGNKPCSRARQRDVSVATRRTSRRRAEGALRRESAIGLLWLTRDDVLDRAILLLLRGTVCCLASKTNADAW

SEQ ID NO: 129340 - protein, 180 aa, Triticum aestivum
  Clone ID: PAT_TA_23758.pep
MASVATSLAMVFIVVVAMSYGLRATHADINFIAHTCKKTNNFALCMAVLRANPKSAQASTEHDLASIALQIATNTTRKNAAAICDLDYKHQGTPEAPVWHVCVKAHVLAAADLIAGAGPSFHVGDYADVLKIVSEAKGAGDTCENAFKAIHKASPVADMDRQTTEHCGLAGDLIRLLLTK

SEQ ID NO: 129341 - protein, 82 aa, Triticum aestivum
  Clone ID: PAT_TA_23759.pep
MALSRRMAASALLLLVLLVATEMGATTVKLAEARDCLSQSHKFKGACLSSSNCAAVCRAENFPDGECHTHNFARKCFCKRAC

SEQ ID NO: 129342 - protein, 206 aa, Triticum aestivum
  unsure (1)..(206): unsure at all Xaa locations
  Clone ID: PAT_TA_23760.pep
MMAAQVQASAAPAAGAMEGGASPAAGAAAFPATSLYVGDLDVSVQDAQLFDVFSQVGSVVSVRVCRDVNTRMSLGYAYVNFSIPADAARALEMLNFTPVNGKPIRIMYSNRDPSSRKSGAANIFIKNLDKSIDNKALYDTFSAFGNILSCKVATEMSGESXGYGFVQYEQDESAQNAINELNGMLLNDKKVMLGLLVLTGKGKVFG

SEQ ID NO: 129343 - protein, 82 aa, Triticum aestivum
  Clone ID: PAT_TA_23761.pep
MALSRRMAASALLLLVLLVATEMGATTVKLAEARDCLSQSHKFKGACLSSSNCAAVCRTENFPDGECHTHNFARKCFCKRAC

SEQ ID NO: 129344 - protein, 201 aa, Triticum aestivum
  Clone ID: PAT_TA_23762.pep
IENHLNLILGQRQADGTVAAISKLRVGQVYAASVMYGYFLKRVDKRFQLEKSMKSLPWGSEDDALNQVMTTDSRLSDQTYSSHPEVESWTSPDLSAGGLGQSVKPSRLRSYVMSFDSDTLQTYATIRSKVAFGIIEKHTEALFGKPEIVITPEGTVDSSKDEYVRISFSGLRRLILEAVTFGSFLWDVESYVDSRYHFVTN

SEQ ID NO: 129345 - protein, 268 aa, Triticum aestivum
  unsure (1)..(268): unsure at all Xaa locations
  Clone ID: PAT_TA_23763.pep
VRALAQRKEERRARLXAQFSQMRPVMPPPVAPRMPMYPPGVPGMGQQLFYGQPPPAFVNPQPGFGFQQHMIPGMRPGVAPMPNFVMPMVQQGQQPQRPFGRRAGAGGMQQPMPMGHQQMVPRGGRGGYRYPSGRGMPDAAFRGVGAMVPSLYEMGRMTPGDTGAPQQVSSGALASALANSPPEQQRLMLGESLYPLVDQLEHDQAAKVTGMLLEMDQTEVLHLIESPDALKSKVAEAMEVLRSAQQQQTNVPADQLAALSLSDGFVAS

SEQ ID NO: 129346 - protein, 82 aa, Triticum aestivum
  Clone ID: PAT_TA_23764.pep
MALSRRMTASALLLLFLLVATEMGTTTTKVAEARECLSQSHKFKGACLSSSNCAAVCRTESFPEGDCHTPHFARKCFCKRPC

SEQ ID NO: 129347 - protein, 82 aa, Triticum aestivum
  Clone ID: PAT_TA_23765.pep
MALSRRMTASALLLLFLLVATEMGTTTVKVAEARNCLSQSHNFKGACLSSSNCAAVCRTENFPDGECHAPHYERKCFCKRPC

SEQ ID NO: 129348 - protein, 306 aa, Triticum aestivum
  Clone ID: PAT_TA_23766.pep
RDLYGVNKGSGFVAFKSSEDASRALVAMNGKMVGGKPLYVALAQRKEERRARLQVQFSQMRPVMPPPVAPRMPMYPPGVPGMGQQLFYGQPPPAFVNPQPGFGFQQHMIPGMRPGVAPMPNFVMPMVQQGQQPQRPSGRRAGAGGMQQPMPMGHQQMVPRGGRGGYRYASGRGMPDAAFRGVGAMGPSLYEMGRMTPGDTGAPQQVSSGALASALANSPPEQQRLMLGESLYPLVDQLEHDQAAKVTGMLLEMDQTEVLHLIESPDALKSKVAEAMEVLRSAQQQQTNVPADQLAALSLSDGFVAS

SEQ ID NO: 129349 - protein, 82 aa, Triticum aestivum
  Clone ID: PAT_TA_23767.pep
MAPTRRMAASALLLLLLLVATEMGTTRTKTAEARDCLSQSHKFKGACLSSSNCAGVCRTENFPDGECHTHNFARKCFCKRAC

SEQ ID NO: 129350 - protein, 155 aa, Triticum aestivum
  Clone ID: PAT_TA_23768.pep
MDVSATGAGAKAKKGAAGRKAGGPRKKSVSRSVKAGLQFPVGRIGRYLKKGRYAQRVGTGAPVYLAAVLEYLAAELLELAGNAAKDNKKSRIIPRHLLLAVRNDEELGKLLAGVTIAHGGVVPKINPVLLPKRTAEKVPKEGKSPKKAAKSPKKA

SEQ ID NO: 129351 - protein, 136 aa, Triticum aestivum
  unsure (1)..(136): unsure at all Xaa locations
  Clone ID: PAT_TA_23769.pep
HRGGCCKRRDTVFRSGEEGRGGPNARRPSPPPPRRPRSRGEAAPTXRPPPAVGTAPPTPPRPPPGTLGPXPREETRPKTSPPPSSAFARGCRRLPPAAARGEAEEGGWRRTGSGSPPSRPCGATRGRRGEQILETA

SEQ ID NO: 129352 - protein, 95 aa, Triticum aestivum
  Clone ID: PAT_TA_23770.pep
MMAAQVQASAAPAAGAMEGGASPAAGAAAFPATSLYVGDLDVSVQDAQLFDVFSQVGSVVSVRVCRDVNTRMSLGYAYVNFSIPAYGGVFFFFFC

SEQ ID NO: 129353 - protein, 355 aa, Triticum aestivum
  unsure (1)..(355): unsure at all Xaa locations
  Clone ID: PAT_TA_23771.pep
AVGAAAAAAPATAAAFPATSLYVGDLDVSVQDAQLFDVFSQVGSVVSVRVCRDVNTRMSLGYAYVNFSSPADAARALEMLNFTPVNGKPIRIMYSNRDPSSRKSGAANIFIKNLDKSIDNKALYDTFSAFGNILSCKVATEMSGESKGYGFVQYEQDESAQNAINELNGMLLNDKKVYVGPFVRKQERENVFGSPKFNNVYVKNLSESTTEDNLRELFGNFGPITSVIVVRGDDGKSRCFGFVNFENPDDAACAVEDLNGKKFDDKELYVGRAQKKSEREMQLKENFEKSNKETADRNQGTNLYLKNLDGXVDDDEKSTKVFAEFGTLTSCKVKRDSNAAHQRPSYGAIRSPQAD

SEQ ID NO: 129354 - protein, 434 aa, Triticum aestivum
  Clone ID: PAT_TA_23772.pep
TSINLTGSQIKPTHTSLCLPISSSLPLPPLAVGSTRQPTAWGSRHGARRRRRRRPLPRGVPSPARRRGLLRQRRRARPLPPLPPPRPPPRPRLLRGAAPARLARAGAGVEARRPPAAALGVHRARLRKAAANAQTEKVHEDLDRASCLISDGDIATILPNKAHGTFLKLLLGPVNLRARKEVQLKVKEEYNSYRDRTAIVFLGFPMILLFLRSWLWNGCFPALPVQLYQAWLLLLYTTLALRENILRVNGSDIRPWWVCHHYCAMLMALVSLTWGIKGQPDCARKQRGVELFLCWAVMQGFAMMLQNRYQRQRLYTRIALGKAKRMDVVWGETAGVEGQLLLLCPILFLLQVFEGYVGFLLLRTAHKGIIPEWQVVVCGILLIAMAIGNFANTVDTLMVKSRFKAKMKKSKSKRDLAACTSPTRSSLTNSAAGA

SEQ ID NO: 129355 - protein, 127 aa, Triticum aestivum
  Clone ID: PAT_TA_23773.pep
TSSFFFPWLSFLISLHFVTFLDVSIGFLCCFVLPFVFLLGFLHLRLLFLLGFLCFSLLGLFFLLRLGLLLLPHLPWACLKCLDEGPTNTNQGPSFSSSTLASRSLQRRRGDMSGLLQQLRIPQTTQA

SEQ ID NO: 129356 - protein, 321 aa, Triticum aestivum
  Clone ID: PAT_TA_23774.pep
NWYLQPRISSNGGQGVISVTSLKLSVLTNTVTLRRLIRKGVPPALRPKVWLSVSGAAKKRSTVPETYYDELIRATEGKTTPATRQIDHDLPRTFPCHPWLNSEEGQASLRRVLVGYSFRDSEVGYCQGLNYVAALLLLVMKTEEDAFWMLAVLLENVLVSDCYTDTLSGCHVEQRVFKDLLAKKCPRIAAHLEAMGFDVSLVATEWFLCLFSKTLPSETTIRVWDVLFNEGAKVLFHVALAIFKMREDDLLRIQHIGDVIDVLQTTAHHLYEPDELLTFAFDKIGSMTTNTITKERKRHETVVMAELDQRTRRLGSLKMDA

SEQ ID NO: 129357 - protein, 115 aa, Triticum aestivum
  Clone ID: PAT_TA_23775.pep
MGLLSNTPVHHAVPDEYVLPPEKRPEPDELVDPTVTLPVIDLAAGRRRHLVVNEIIKASKEFGFFQVVNHGVGDEVVGAFRSAAAEFFAMPAEEKAPYYSDDLTKPFRVDTSTTY

SEQ ID NO: 129358 - protein, 133 aa, Triticum aestivum
  Clone ID: PAT_TA_23776.pep
ASWRRTSATQGREVAGVVAPKNVVQQEDRASSTASTQHGRSSTAPGPTTAPPKQPQQPSSPRPRPPPRGPRSAAAPHASAGGPPPLRGTGPAATAARAGGSGGRGEADCRPAVEGFGAPGSPRRDDARELSLF

SEQ ID NO: 129359 - protein, 230 aa, Triticum aestivum
  Clone ID: PAT_TA_23777.pep
RPLARRPRPPRASGRPSLPAPPLAPAPRRPPLRAGARPGHRGVGKTSLMNQYVNKKFSQQYKATIGADFLTKEVLIEDRLVTLQIWDTAGQERFQSLGVAFYRGADCCVLVYDVNAKRTFNTLGTWHDEFINQAGPSDPKQFPFILVGNKVDLDAGSRRVVPEKKAKDWCVSKGDIPYFETSAKDDYNVDTAFLCIAKLALEHEHDQDIYFNSVAEQGPKTEEQTTGCPC

SEQ ID NO: 129360 - protein, 74 aa, Triticum aestivum
  Clone ID: PAT_TA_23778.pep
MQRRRPGFHHVEETEKNVVRSLFWTDSLCKMNYELYGDFVSFDTTFSTNIYGLPFARERERERERERDLGRDHA

SEQ ID NO: 129361 - protein, 119 aa, Triticum aestivum
  unsure (1)..(119): unsure at all Xaa locations
  Clone ID: PAT_TA_23779.pep
FFFFFFFFFXXFSYLNLLVSSLFVTVLYLGGWNLSIPYISFFDFFQMNKAVGILEMTMGIFITLTKAYLFLFISITIRWTLPRMRMDQLLNLGWKFLLPISLGNLLLTTSSQHVGRDHG

SEQ ID NO: 129362 - protein, 155 aa, Triticum aestivum
  Clone ID: PAT_TA_23780.pep
KSSPLENGNSNKGNAKIQRGKKSRSSIRQAVLAQRRSNLDANQFQITKQAANKAATMPVRGRADRWNKPSGPSTSAQRRPVSEAPQNSKGKEMQNEPPRTMDALFAQMKQQRMRVMPPQQPKAPTNGHQFNQQRRGQQQRRGRGGYGVRSGGGNR

SEQ ID NO: 129363 - protein, 80 aa, Triticum aestivum
  unsure (1)..(80): unsure at all Xaa locations
  Clone ID: PAT_TA_23781.pep
FPAPXXGAGGXXDFRXFXPGXRXLVPELFPFFFFPFXSXLFXVPFPXFPFLSSLFFFLFVFRFLIMLFLFFFLLVLISYV

SEQ ID NO: 129364 - protein, 309 aa, Triticum aestivum
  unsure (1)..(309): unsure at all Xaa locations
  Clone ID: PAT_TA_23782.pep
MAAIDEASGRRAASCFFEGLILRMNQYGKLRGHSGCVNTISFNPAGDLLVSGSDDTDIILWDWLAKTEKLTYPSGHQQNVFHARVMPFTDDSTIVTVGADGQVRVGQLKQGGGFTTKQIGEHHDRAHKMALEPGSPHILYSCGEDGLVQHFDLRSDSPTKLLTCYSFSNRRRRVRLNTIAIDPQNPNYFSIGGSDEYVRLYDFRKINLDSSSNMNLPGXDPFCPEHLLMGGKVHITGIAYSYSSELLVSYNDELIYLFENYMGLGPNPESTQPEHLDKLEQLQSYSGHRNFRTVKGVSFFGPNNEYVLS

SEQ ID NO: 129365 - protein, 130 aa, Triticum aestivum
  Clone ID: PAT_TA_23783.pep
GDQPSAQHPFAALRMLMKQRFEHSIGFSWKSKSSDSSWDTGSRPGYITGEGRNKPRFRPLRPPFLATGSVEWSNGAKEDKEKHTCAAAITCLTNVTCYSWAAEAAGRLREERGCDGGSRSPGRAAASAMS

SEQ ID NO: 129366 - protein, 32 aa, Triticum aestivum
  Clone ID: PAT_TA_23784.pep
YHPDKEARMKAVIEFYVNGKQNALDHFPDGSE

SEQ ID NO: 129367 - protein, 249 aa, Triticum aestivum
  unsure (1)..(249): unsure at all Xaa locations
  Clone ID: PAT_TA_23785.pep
GDDDGPEWMMEVGGAGATGKGKGGALDKNKKRFSEEQIKSLESMFATQTKLEPRQKLQLARELGLQPRQVAIWFQNKRARWKSKQLERQYAALRDDYDALLSSYDQLKKDKQALLNQLEKLAEMLREPGGAKCGDNAGAAARDXALGRGRHEHXFVDAGGASKLYSASEGCGGSGKLSLFGEDDDDAGLFLRPSLQLPTAHDGGFTASGPAEYQQQSPSSFPFHSSWPSSAAEQTCSSSQWWEFESPSE

SEQ ID NO: 129368 - protein, 398 aa, Triticum aestivum
  unsure (1)..(398): unsure at all Xaa locations
  Clone ID: PAT_TA_23786.pep
MLQCAIATRGSSCSRSHSLSEAEVAENTRSADIYLRIRKEAKARQYGKKLLLLGAAESGRTSICSRLHPLNLTESADAILTGYTPTSIAKGSKSMKPDNKLWPLCSDGSREFTQLETKTPKFRTSPDKAELKGNIPEIDGRLDXTINIKYEVQNVRKLWENPAIKETYSCGSVLQVHDRAHYFMENLDRLAEPDYIPTKEDVLHARVRTNGVVEIQFSPLGESKRGGEVYRLYDVGGQRNERRKWIHLFEGVDAVIFCAAISEYDQLLFEDGTQNRMMETKELFDWVLKQRCFEKTSFMLFLNKFDIFERKIQKVPLTVCEWFKDYEPIAPGKVQDVEHAYEFVKKKFEEVYFQSSKPDRVDRVFKIYGTTALDQKLVKKTFKLIDESMRRSREGTGT

SEQ ID NO: 129369 - protein, 186 aa, Triticum aestivum
  unsure (1)..(186): unsure at all Xaa locations
  Clone ID: PAT_TA_23787.pep
MSSCVSSSHHHCARRLPAPTPRAHLAAAELCASPHRRRVGSLRAVRAEPPSSVAPAGGRKAAAVQAEMVEAAAMWCAMHGLVVGDRGDLRSGTVPGVGLVHAPFSLLPTRFPASFWKQACELAPIFNELVDRVSLDGKFLQGSLSXTKQVDDFTARLLEIHAKMMAVNKKEDIRLRLHRSDYMLDS

SEQ ID NO: 129370 - protein, 196 aa, Triticum aestivum
  unsure (1)..(196): unsure at all Xaa locations
  Clone ID: PAT_TA_23788.pep
HGGIHYVISVVAAEVGFISGEEAVNWGLSGPMLRASGIQWDLRKVDPYESYNQFDWKVQWQKEGDSLARYLVRVGEMRESIKIIQQAVEKIPGGPYENLEVRRFKKEKNSEWNDFEYKFLGKKPSPNFELSRQELYVRVEAPKGELGIYXVGDDSLSPXEWKIRPPGXINLQIXPQLVKXMKXADIMXTAGRPLES

SEQ ID NO: 129371 - protein, 181 aa, Triticum aestivum
  Clone ID: PAT_TA_23789.pep
LARIPFPVLVGEEQGEQQEQHRRRGRFLFRLALLMANLRAKTEAALDSGTISSATGSEACEPPFVLGEGGDALPDSAVVSPDSAVEAPSPDIRRLDRGVGLLMSSPPGLPARASVLVAEMWRPQTPGAGLLPSSRAHPPSPAAAVALRVPARHSVLGAWSCRRRETATIRRPSSRARSCSP

SEQ ID NO: 129372 - protein, 122 aa, Triticum aestivum
  Clone ID: PAT_TA_23790.pep
GPRLPLAFAPAPAARGGSAQIRSRTGGPPSLEIVHGGPTRLQPWTETPESLATRGGPTPQPPRKGRAPAAGHLRRPPTMVARIWTSCCSYCFRWTRTSPPSWLLRLPTPSSYPLAWCGCWGK

SEQ ID NO: 129373 - protein, 65 aa, Triticum aestivum
  Clone ID: PAT_TA_23791.pep
YPEKFFDSLRILCAYRLVFLYHLNTPTDNFSYLSSIRSSPIDQYISQKSSNCHSIFRRSSTTYCF

SEQ ID NO: 129374 - protein, 157 aa, Triticum aestivum
  Clone ID: PAT_TA_23792.pep
MCCRIYAFGIIGASRCDSKARGSVYDPVLGICCHFCRQKKLCGEEGCKRCGEGDFEQQCIGKTECSSCHSSYGILCRACLKVRYGEEMEEVRKNKKWMCPHCVEEKGTKKFWICNSSICLKKRKIAPTGIAIFQAREQGYASVAHLLMDQLKSRGSF

SEQ ID NO: 129375 - protein, 280 aa, Triticum aestivum
  Clone ID: PAT_TA_23793.pep
PPHLTSSFPTSPPSRPLASKNPGGATIAAETAVASASGSGIWSRRRDEITFDRLQKFWNDLPPQARRELLKLDKQTLIEQARKNFYCSRCNGLLLENFKSLQQEVSDIDCLSSSGESKIRQQNGSQDPSVHPWGGLATTKDGILTLIDCFMKANSLRVLQNVFDNARLREREREMLYPDACGGGGRGWISQGMASYSRGYGTRETCALHTAHLSCNTLVNFWSALCDETRSSLLRMKEDDFIERLMFRFDSKRFCRDCRRNVIREFKELKELKRIRREPP

SEQ ID NO: 129376 - protein, 81 aa, Triticum aestivum
  Clone ID: PAT_TA_23794.pep
ETRKKNCMRLRAKERERDWPRHLASIKQQVLRGPANQLTPSQKKKKKKHRQPTRMSSSPEKKKKNSRLTCPGGRSKSLVNS

SEQ ID NO: 129377 - protein, 282 aa, Triticum aestivum
  Clone ID: PAT_TA_23795.pep
GLADRRGPTTHTPAGCRDCDSPGQAPPAAAPAGDAAYPPPAYPAQPQARWQNERAGGGWRLTAARASVCSILHLIRNAGISTLRGLLAADDAIVPVSSPLASPLGAAEETDKKGVVAKRKKVQAIKKDIKERPKKVNQVAKLVRGMRVEDALLQLQVTVKRAAKTLYQVIHSARANAAHNHGLDADKLIVEEAFVGKGLYLKRLSYHAKGRCGVRERPRCRLTVVVREATAEEEAKIAKLRVMNYKKLTRKEKQLMPHRLIEVSPKWARKRKEEEEEAGASA

SEQ ID NO: 129378 - protein, 41 aa, Triticum aestivum
  Clone ID: PAT_TA_23796.pep
SCQLLRVCRQIDEYTHLIASIKAQIKMVCEGIRELLQLAAE

SEQ ID NO: 129379 - protein, 85 aa, Triticum aestivum
  Clone ID: PAT_TA_23797.pep
HLPEINMHLSMCSVRRLWHDRHQSQLHMVTWHKLINKKTVQILSCDRNQIFMQTAARRRGITASKRNKGPNVSCFSKSFIAENPS

SEQ ID NO: 129380 - protein, 70 aa, Triticum aestivum
  Clone ID: PAT_TA_23798.pep
DQFAAGELQFDAAARINSDCNSAKRGGDLGPFEKGKMQKPFEKAVIALKVGDMSDVVDTESGVHIILRTG

SEQ ID NO: 129381 - protein, 220 aa, Triticum aestivum
  unsure (1)..(220): unsure at all Xaa locations
  Clone ID: PAT_TA_23799.pep
RAAARAGAVRVVAIGKTKPVSLLRQLYDAGHRCFGENYVQEFVTKAPQLPEDIRWHFVGHLQSNKVKSLLAAVPNLDMVEGVGNEKIANHLDRAVVSLGREPLKVMVQVNTSGEESKSGIDPSKCVELAKHVKLACPXNLILSGLMTIGMKDYSSTPENFKALANCKLEVCKALGIPTERFELSMGMSGDFEQAIELGSTNVRVGSTIFGPREYPNQKQN

SEQ ID NO: 129382 - protein, 153 aa, Triticum aestivum
  unsure (1)..(153): unsure at all Xaa locations
  Clone ID: PAT_TA_23800.pep
PELAATWTGRRQAGGVEAMAMGAVLSSSRAAFLASPLSSSSSSSPGKQQQQQHDTMMIKYSSTSSPHTRWPVCSQLVAGHTNGRHVARSTGKSTPHQFSAQIQQPQLNSTPMRLCXTAGLVXXXLLSXXXCXXXXXPVTXGXXXPKXXXXXXX

SEQ ID NO: 129383 - protein, 129 aa, Triticum aestivum
  Clone ID: PAT_TA_23801.pep
TDSASIVTEHSNLPLHRCMRIIPRDQNSGAFFIAVLQKLSPLNESLVVEVMKGERSTSKDKALKCSNGQGSDTVPAEEISVQQPGVDDTHVLVEQQNRDMDTEISKDKSSEEAKVVAGEAQNDQATKER

SEQ ID NO: 129384 - protein, 84 aa, Triticum aestivum
  Clone ID: PAT_TA_23802.pep
LSINRQLAVWKILQKTPNSTSQYPTSLTMYALHHLASRDARTPAKYTTAMAARIVTNLRKELSKNAVRMSSRSPKSGMCCPNPA

SEQ ID NO: 129385 - protein, 287 aa, Triticum aestivum
  Clone ID: PAT_TA_23803.pep
MVMMIRRGAMTFVIVALTMGPKTWLMGTTAAAMMASIGVATTDHRISYNGDSKNIQVPPFSIPCRVELFTVRPRFSFTGTFVVTDGFSAYYWSSQKKKLQIYHIVDSQHNLVLHSEGGALTDTFWIKIKILEDNSGADHDSGYFSFTVDPYVCNNVITHTISTKQRRKIDLTFMALHTAIQANVYVNFDFVCRNATKPGTIYYVYGEITAHHQLYDGESVMLFSRGEENKAVVTDGGELPLSRNCAAVPIYLEPLLILKLNLHVPIKCDHDDEDHTIAFRDYIIFLP

SEQ ID NO: 129386 - protein, 195 aa, Triticum aestivum
  Clone ID: PAT_TA_23804.pep
MATEGAKHTHIRFRLQVDMQCRCMGCIDKIDKAMAAIRTFTGVETSVGDVGTGVVAVAGKVDPAELCQWLKRKTRKDVKIVRPRRPSDNRNKQKRSRDTPPSAPPLPQHLSRALPTSRVHSDHKDLHMIEKKIRDLDKARDTLKMRNLKNELTAARCKLKQSREVISNGKKALLDGALIQLHAYKKLESLSRLTI

SEQ ID NO: 129387 - protein, 380 aa, Triticum aestivum
  Clone ID: PAT_TA_23805.pep
MASVAELKEKHAAATASVNSLRERLRQRRQTLLDTDVEKYSKAQGRTAVSFNPTDLVCCRTLQGHSGKVYSLDWTPEKNWIVSASQDGRLIVWNALTSQKTHAIKLHCPWVMECAFAPNGQSVACGGLDSACSIFNLSSQADRDGNMPVSRVLTGHKGYASSCQYVPDQETRLITGSGDQTCVLWDVTTGQRISIFGSEFPSGHTADVLSLSINSLNANMFISGSCDTTVRLWDLRITSRAVRTYHGHEGDINSVKFFPDGQRFGTGSDDGTCRLFDMRTGHQLQVYNREPDRNDNELPIVTSVAFSISGRLLFAGYSNGDCYVWDTLLAEMVLNLGTLQNSHEGRISCLGLSSDGSALCTGSWDKNLKIWAFSGHRKIV

SEQ ID NO: 129388 - protein, 197 aa, Triticum aestivum
  Clone ID: PAT_TA_23806.pep
MSGGGIARGRLAEERSETQTPDSATESSQQPPPPPPMSGGGIARGRLAEERKAWRKNHPHGFVAKPETVADGSVNLMIWNCTIPGKQGTDWESGYYPLTLHFSEDYPSKPPKCKFPQGFFHPNVYPSGTVCLSILNEDSGWRPAITVKQILVGIQDLLDQPNPADPAQTDGYHLFIQDPAEYKRRIRLQAKQYPALV

SEQ ID NO: 129389 - protein, 63 aa, Triticum aestivum
  Clone ID: PAT_TA_23807.pep
MDHLSHIECQKHLLQQQLAGRQLDSTRSHHTTTRHISSPSSMLNPEAYSSCQTIAKTNTARLR

SEQ ID NO: 129390 - protein, 342 aa, Triticum aestivum
  unsure (1)..(342): unsure at all Xaa locations
  Clone ID: PAT_TA_23808.pep
MGVEGCRNKEVVXETALXRKLAGLAAATGELPSVRRSPAVNALPTRGRAASQPAPSTGDVEALGPEAXEPRARLIPLCADANGPPWGCALLTAIDGPRTPLLRSTLTPLPPELQQRTSMLHAKLAARASSPASLLRPGPGPASQSSGAGRLPAQGPSRRPVRHLRHAYLEIYXVCAQRHRRQGTHDRHDADAGARMAFRTADVADVTTELAGYDVVFLAALVGMAAEEKARLVEHLGRHMAPGAALVVRSAHGXARGFLYPVGGAPREIRARAGCEVLXTVAPPGRTRVIKLPPPRACRSDNGGMPAQCAVAXSRPCLGCACELGXRAHQKMKEMAMEEMEA

SEQ ID NO: 129391 - protein, 163 aa, Triticum aestivum
  unsure (1)..(163): unsure at all Xaa locations
  Clone ID: PAT_TA_23809.pep
QRGFFGCPRGLGGFELHFGPQALLTRPQRGKRPRETPGRHLTSDTSKLGGGAAKGERECTGFFFGKKVLQQKSVWWSWVPAIPEAFNQALLAKQAWRILXYPASLCARVLKARYFKEETIMSATFPSNASYTYRSVLHGRDLLREGVIWRIGDGSKVHIPHDN

SEQ ID NO: 129392 - protein, 80 aa, Triticum aestivum
  Clone ID: PAT_TA_23810.pep
RGRGRGLEFFFLGAHFVWAFSLMFLFSGRGYWQELIESIVWAHNKLKVAPATQPRALSIIQGRAVGVTHYLLGGIATCPA

SEQ ID NO: 129393 - protein, 182 aa, Triticum aestivum
  Clone ID: PAT_TA_23811.pep
TIPIDEIIDEDLTVISGTKKFMFASVDSGCNGCIFTLMHKRDGDPGPVEIVQNMMSSAASTRKHMSRFILRVLPAEVVCYASEEEITRAIAPLVEKYFPKESPSGHKFAVLYEARSNTGIDRMKIINAVAKSIPQPHKVDLSNPDKTIIVQIAKTICMIGVVERYKELSKFNLRQLTSPPEK

SEQ ID NO: 129394 - protein, 149 aa, Triticum aestivum
  unsure (1)..(149): unsure at all Xaa locations
  Clone ID: PAT_TA_23812.pep
LAWSRPRWGAAITIALQQLKYVLGIANFTRKTDIVSVMESVWRSVHHGWNWQTIVIGVSFLGFLLFAKYIGKKNRKLFWVXAIAPIISVILATFFVYITXVPTKQGVQIVKHIEQGXINPSSVHKIYFTGPFVRKKGSRSVLFCRNNLG

SEQ ID NO: 129395 - protein, 180 aa, Triticum aestivum
  Clone ID: PAT_TA_23813.pep
TVLRGEAPWRTMRPLHLTRSDFLHGLACRGNCPGFRPATPGACALRWLVPPESMTCSMRVSKARQGEATVSRLLGARTQWRPSASPPARMAHNRDAVWKTEATTRPLAHIRAGGARGNGPRLPPRPRSGGALRAAPHSRDDGAPGFSRSSPTRRRAGFFPLLADETVAGSAGRGSGRTRG

SEQ ID NO: 129396 - protein, 98 aa, Triticum aestivum
  Clone ID: PAT_TA_23814.pep
SRWDYSEYMCENQVRYKYRYKSVNASRNMRVGPIRECGRGLGWTKLFVPPCSNWTDCRSKLTEKTKSVNSLKEAYCDGEPKESIRDLGRDHANHLVNS

SEQ ID NO: 129397 - protein, 101 aa, Triticum aestivum
  Clone ID: PAT_TA_23815.pep
LYDADHGPSVLSMAPGLERLNILPFKVAAYDTKHNKMNFFDPSRKEDFLFISGTKMRSLAKNRESPPDGFMCPGGWKVLVEYYDSLAPPEGSSKPREAVAA

SEQ ID NO: 129398 - protein, 436 aa, Triticum aestivum
  Clone ID: PAT_TA_23816.pep
GAAAAAARGVRCRAGGLIEPDGGRLVELVAPEEGGRRAALRREAAALPHRLRLGRVDTEWLHVLSEGWASPLRGFMRETEFLQALHFNAVRGADGSLVNMSVPIVLALDDAQRRAIQADGATTVALVDAHDRPVAVLSDIEIYKHNKEERIARTWGTTARGLPYVEEAITNAGDWLIGGDLEVIEPIKYNDGLDQYRLSPAQLREEFARRNADAVFAFQLRNPVHNGHALLMTDTRRRLLEMGYKNPVLLLHPLGGFTKADDVPLSVRMKQHEKVLEEGVLNPESTVVAIFPSPMHYAGPTEVQWHAKARINAGANFYIVGRDPAGMGHPTEKRDLYDADHGKKVLSMAPGLERLNILPFKVAAYDTKHNKMNFFDPSRKEDFLFISGTKMRSLAKNRESPPDGFMCPGGWKVLVEYDDSLAPPEGSSKPREAVAA

SEQ ID NO: 129399 - protein, 147 aa, Triticum aestivum
  Clone ID: PAT_TA_23817.pep
AWSRPRYPAAPLLLPRVCSKTCDVSGFEITEGSRVMVNAWAIARNPEYWHDADEFKPERFEDIIVDYNGTQFEYLPGGSGQRMCSGNTFGLATLELILARLLYFFDWSLPGGMRPDELDMDMIVGTTLRRKNQLHLVATPYNVPMEL

SEQ ID NO: 129400 - protein, 287 aa, Triticum aestivum
  Clone ID: PAT_TA_23818.pep
MAVMDEDNGSARAPAPAPRRQPSYSCSGGSVETTHDHKLSHSDSFWTPAESLRSSSASSSSPPLSSSSSCESIPALDLDRHSSLSSTSSYESLHHVEAAADHDYSSSPDEFMPATLPPAVQTMMAQGQPAGYDPKRLPSSMFRTQSTCPAQWSATSNDQLFSIQLENSGGDGPLYLVGDLYYDSAGVFHRLSSVARLPAVPGMSTGNSSRSLCVRDDCAGCSTSMNKKPVRFATTDGVAGPRSLPAALEDSEASAAETGAAAKAGWCCWPSMWWPSCACRGCDYRWS

SEQ ID NO: 129401 - protein, 101 aa, Triticum aestivum
  Clone ID: PAT_TA_23819.pep
FFKRANFPKEIKLVTFFKRVSFFRSENIFIICEHFLKFTLVFECAIFLSNRQKCHFFKLMISFSFMNFPNSNFLFHKPFYVYPKNVSWFSINNSCGFFSQE

SEQ ID NO: 129402 - protein, 421 aa, Triticum aestivum
  Clone ID: PAT_TA_23820.pep
MGNCMKSTARVDHSMNTSAAYPSKVTSKTSMSSATSASKTNSTRSTFTLPSIRDRSEPPRTEGEILSSSNLKAFLFNDLKNATKNFRPDSLLGEGGFGHVFKGWIDEHTLAPSKPGSGMVVAVKKLKPEGFQGHKEWLTEVNYLGQLHHANLVKLIGYCSDGDNRLLVYEFMPKGSLENHLFRRGADPLSWGIRLKVAIGAAKGLSFLHHAENQVIYRDFKASNILLDSEFNAKLSDFGLAKAGPTGDKTHVSTQVMGTHGYAAPEYIATGRLSAKADVYSFGVVLLELLTGRRALDKSKPGIEQNLVDWAKPHLRDKRRLYRVMDTKLGGQYPKKGAHAVANLALQCICNDAKMRPQISEVLEELEQLQDSKSNLMSPQVDIRRTSNTVPKSPMRGQPSPRRSLGAMAPPSPAFRTAQVH

SEQ ID NO: 129403 - protein, 130 aa, Triticum aestivum
  unsure (1)..(130): unsure at all Xaa locations
  Clone ID: PAT_TA_23821.pep
RGRGRGATSIALASDAAVLEGQARALFIWKDSLDYQSQQALHSWGNTSTPCNWRGINCYIGVQQHQHWPAISGISLRGMRLSGALESLNFSSLEXLGRLDLSNNLLXGSIPPSIEVLGELQCSPSARPTR

SEQ ID NO: 129404 - protein, 355 aa, Triticum aestivum
  Clone ID: PAT_TA_23822.pep
GQTYERSCIQKWLDSGHKTCPKMQLALTHTSLTPNFVLKSLIAQWCEANGIELPKNKANSHDKKAVKSSDYDNAGLVSLMNRLRGGNQDEQRAAAGEIRLLAKRNVNNRICIAEAGAIPLLVNLLSSSDPRTQEHAVTALLNLSIHENNKASIVDSNAIPKIVEVLKTGSMEARENAAATLFSLSVVDENKVTIGAAGAIPPLINLLCDGSPRGKKDAATAIFNLCIYQGNKVRAVKAGIITHLMNFLVDPTGGMIDEALTLLSILAGNQEGKSVITQSEPMPPLVEVIKTGSPRNRENAAAILWSLCSADAEQTMAAKAAGGEDALKELSETGTDRAKRKASSLLELMRQSEEA

SEQ ID NO: 129405 - protein, 311 aa, Triticum aestivum
  Clone ID: PAT_TA_23823.pep
MGAKSNKSLYFDKLKGLLEKYTSIFIVEIDNVSSQQMHEIRHALRNKGVVLMGKNTMVRRALKTFVADSPEYERLLPHVKGNVGFVFTNEDLKEVRDVILANKVAAPARAGALAPADVWVPAGNTGMEPGKTSFFQALGVPTKIARGTIEITTDLKLVEAGSKVGPSEATLLNMLNISPFTYGMGISQVYDQGQTFPPSVLDVGEEQLLKTLSQAIATIATISLALNFPTLPSVLHSLVNSYKKVLAVAVVTEVSWPEIEQLKDRIANPDAYASAAPAAAASGGDAPAAEEAKKDESEEEEDDEGFGGLFD

SEQ ID NO: 129406 - protein, 50 aa, Triticum aestivum
  Clone ID: PAT_TA_23824.pep
RERALLVSFTTLVHQSSTMFLKEICPRGNNNVIILFPYIMITSAATTLIT

SEQ ID NO: 129407 - protein, 261 aa, Triticum aestivum
  Clone ID: PAT_TA_23825.pep
MATSAITSPAAPAATLPLAGRVAIVTGASRGIGRGIATHLSSLGASLVLGYASSSQQADALAAELPRAVAVKADVSDEAGVRSLFDAAESAFGGAAHILVACAGLGIGTYPSLANTSTADFDNVFAVNTRGAFLCLREAANRLRRGGGGRIVAVSSTLAATLLPGYAAYAASKAAVEAMVRVAAKELGSARVTVNCVAPGPVATELFFDGKSQEAVERFRAGHPMGRLGEVGDIAPAVGFLCTDAAEWVNGQVIRVNGGIA

SEQ ID NO: 129408 - protein, 68 aa, Triticum aestivum
  Clone ID: PAT_TA_23826.pep
PAIPWTFNRQQAVHLPGPLSVYITISACCLSLLTGNAYTVLNFSMCGGEMCMCMMRKLSHQPLDECTL

SEQ ID NO: 129409 - protein, 466 aa, Triticum aestivum
  unsure (1)..(466): unsure at all Xaa locations
  Clone ID: PAT_TA_23827.pep
MSPCHSSTMAPARSLLLSCVALLLVLPSRAAAAGTADGSEEWGYMQVRPKAHMFWWLYRSPHRVDNGTAPWPTVLWLQGGPGASGVGYGNFMEIGPLDTDLKPRATTWLNKADLLFVDNPVGTGFSFVEGGNKSLMARTDGQAARDLTALLIKLYRHNKRLQGSPLYIVAESYGGKFAVTTALTALKAIRHGHLKAKLGGVALGDSWISPEDSVLSWGPLLYQVSRIDEKGLQQCDSLANKINAQLKAKQYAAAEKSWEDLESAVLEQSNSVNFYNILKDESSEDAAVLATAGAAVRKVGYTRYLSSKATREGGLDGLMNAEVKAKLGIIPNNFSWGEQSGDVFEALAGDFMKPRINEVDELLKLGVEVTIYSGQLDLICSTKGTLDWVQKLKWEGLKNFTGSPRKPLYCKGGEGKANRPPGLSSSRTRTMKFYXWNIGAGHMIPXSTNPCPALNMLGDITQSPAR

SEQ ID NO: 129410 - protein, 81 aa, Triticum aestivum
  Clone ID: PAT_TA_23828.pep
HSSLHLSIDKICSRGFALYNHRRLGIFVLGPRSQSTENPCCPALLPHEVWPSSRVAAKASDERQEPTCWADGAHEAELQSN

SEQ ID NO: 129411 - protein, 443 aa, Triticum aestivum
  Clone ID: PAT_TA_23829.pep
LDAMDLAYDHIAEDGYAKKTEEPKTTQPQSTLNEDLQDAYKAFSNSPWGAKIGGFFGTVAKQGESVYTQASKELAEVGEDASKGLTSLRSTILSHTRNLSLNTATAGESSKDGEKDQTTPRASQDGSEEAKQSENTLARLRAEAAKRLKDLQRAEEAADEALIKFGGNVRNFLRDAVSIAPPQESDQSGTVLFESKDAQGKRVIHTSRFNAQLHVIHTSTESFTKDPNSADYAAWSKEFDADKKTPDINNDLQKFPDLRATMEKLVPDQVPYVDFWKRYYFLRHGIETAEARRRDLLKAASAEDDVAWSDDDSDDDSDDSADTSTPATKTKVEPKTESKTELKTETKTETKATPAAAATPATASSNTTQPAAKTLLKPAEPRKSNDEKSQADSEASYDVVGAASGKTTQTPNSPKDSKDSKKKEESSDEEDSDDDSDSDEDWE

SEQ ID NO: 129412 - protein, 183 aa, Triticum aestivum
  Clone ID: PAT_TA_23830.pep
MKFIATVLSVLPVVLALPTGEDASISKRQSVNTVTDQLLFSVTLPQFTARRNARDPPTVDWTSDGCTSSPDNPFGFPFVPACNRHDFGYHNYRAQNRFTVSGKARIDSNFKTDLYFQCQSSSVSGVCRGLADVYYAAVRAFGGDDATPGKRDEDLVKEYEEKVEVYNKLVEEAQEKGDLPRLD

SEQ ID NO: 129413 - protein, 51 aa, Triticum aestivum
  Clone ID: PAT_TA_23831.pep
NSLVISVVAAEVKHLFIRNGEQSKNVSLLPLLNHPLGSEITPGSSLYFFIC

SEQ ID NO: 129414 - protein, 136 aa, Triticum aestivum
  unsure (1)..(136): unsure at all Xaa locations
  Clone ID: PAT_TA_23832.pep
RGRARGFHFHHLTVLKALTALFLFAVLVPNHVQGRHHRHDCPSFSCGPFRNVPSPFRQAGDPXGVVFKSYELVCSDTRATIRINNATYHVSRINYTVSYFWVVDAVLDLPNRCPLPQWNRPFYEHKYGPYYYPPKS

SEQ ID NO: 129415 - protein, 110 aa, Triticum aestivum
  unsure (1)..(110): unsure at all Xaa locations
  Clone ID: PAT_TA_23833.pep
RIGYEQIPFRGRQKITILHSLSLSPSPHLGAPSCHTYGHPQLSSDRSPSVHPGEPPSHKHPSAQGNRVSRTRLREARFLLLFPSHRPASSTGEPPRVGPPXDFPRGVRPX

SEQ ID NO: 129416 - protein, 172 aa, Triticum aestivum
  Clone ID: PAT_TA_23834.pep
SIVASLWKQGRPVPDPRLQFAARPVENVAMEARGAGNNRSSAAAPPRTPDPVRTPLYAAHIPQPNHRRPPPQQVVVAKRTTPQLRRSRAAGLFPCELRPRRPRICRRTARGRQPRRPRICPRIQRVSCSAHGLRWRLVAAERVFASRVVLRSDPEQPKASFCVFLFLGGVDT

SEQ ID NO: 129417 - protein, 301 aa, Triticum aestivum
  Clone ID: PAT_TA_23835.pep
IDIWSAGVILYILLCGVPPFWAKTDEGIAQAIIRSRVDFEREPWPKVSDNAKELVSRMLENNPYARLTAQQVLEHPWIQNSTAAPNIPLGEAVRSRLKQFTVMNKFKKKALLVVAEYLPAEELEAITELFHMLDTNKDGHLTIEELRKGLQMIGNNVHDTDVDMLMEAADLDGNGTLDCKEFVTVSIHLKKIRSEEHLPKVFNYFDKNMSGFIEMEELKEALSPRGDQKAIEDIIFDVDIDKDGKISYEEFELMMKAGVDWRNASRQYSRAIFNTLSRKMFKDVSLKLDPSSLLGGAGKEQ

SEQ ID NO: 129418 - protein, 78 aa, Triticum aestivum
  Clone ID: PAT_TA_23836.pep
AVAAALAAESPEESETPAKTPKKPAGGRKRKVATPAAAAEEKPAPASPDKKRRRSTKAAVVEPQEEPKKSGRKKTKSS

SEQ ID NO: 129419 - protein, 328 aa, Triticum aestivum
  unsure (1)..(328): unsure at all Xaa locations
  Clone ID: PAT_TA_23837.pep
MTLKLLMEVSPQELLESLAELQNHVLGYVKATSLKCAVDLGIPAAIHKRGGTATLADIAADAKVHPAKVADLRRMMALLSASGIFTTTTAAGAGDDDGPADDTAAXVQYGLTTTGRFLVGWRNLSPVAPFFVNPLIVSSFFDLPAWLRSEPAPAGAASLFEQAHGCSRQEMAGKDAGFGGVLRDAMTADSELFLEVIIVDKGRIFRGVSSIVDVGAGNGAGTRVVAKAFPRIKCTVLDLPQSVGQAAAAGDDNLSFVAGDMFESIPPADAVLLKNVLRDWGHDDCVKILQRCQAVGPAAAAGGGNLSFVAGDRFESIPPADAVVLAKE

SEQ ID NO: 129420 - protein, 116 aa, Triticum aestivum
  Clone ID: PAT_TA_23838.pep
EAPLNEVVRLIREGKKRLPSEFARWSRGEVGDGGDPYRITSDYRTLLVSDWSRLGFAEVDYGWGAPVHVVPLTNLDYIATCILVCPSAHKPGARLITQCVAADGVDAFHRDMMRLD

SEQ ID NO: 129421 - protein, 160 aa, Triticum aestivum
  Clone ID: PAT_TA_23839.pep
MAPVLPAPAAAAAPPTFCRVSLPARSAFPSSPAKSLRRFAARSSGGGGRPEPKAGDDESKAVLDAFFLGKALAEALTERAESVVGEVFSVVGQWQAEQQKQVQEFQEEVVQRAQKAKERAAEEVVDDKGPKTLKGPSTTIVTPAPMSPPSPNIPTQAEQL

SEQ ID NO: 129422 - protein, 572 aa, Triticum aestivum
  unsure (1)..(572): unsure at all Xaa locations
  Clone ID: PAT_TA_23840.pep
MEAAEIGGLSCSPSPRRILRRLHRAVDFSHPLAVVVQETISWFIGIFDGSSSSSSAAGGVSWRRCTSCGCGCGPGDRAAAGGRLACMVMSVMLVVEALYNCVVSLGVKGRRWRPEWRFKWEPLAGDDEEKGGXHYPMVLVQIPMYNELEVYKLSIGAAGELQWPKDRIIVQVLDDSTDPFIKNLVELECESWAVKGLNIKYATRSSRKGFKAGALKKGMECDYAKQCEYVAIFDADFQPEPDFLLRTVPFFVHNPEVALVQARWSFVNDTASLLTRVQKMFFDYHFKVEQEAGSATFSFFSFNGTAGVWRTAAIKEAGGWKDRTTVEDMDLAVRATLKGWKFVYVGDIRVKSELPSTYKAXGRQQFRWSCGGAHLFRKVAKDILTAKDVSLIKKFHMLYSFFLVRRVVAPTVACILYNIILPISVMIPELFLPVWGIAYIPTVLLVVTAIRHPKNLHILPFWILFESVMTMHRMRAALSGLFELSEFNEWVVTKKTGNNFEDSEVPLLQKPRKRLRDRVNFREIVFSAFLFFCAWYNLVFPGKISYYFNLYLQGLAFVCLGLNFTGTCSCCQ

SEQ ID NO: 129423 - protein, 161 aa, Triticum aestivum
  Clone ID: PAT_TA_23841.pep
MVIAPVATYSSSRAPPPARSTAYRARLAAAGLSSRASSFAAGSGLAVAAASVAVAARPRRTGAGGGALGCKCLFGLGVPEMVVIAGVAALLFGPKQLPEIGRSVGKTVKSFQQAAKEFETELKKEPEEGGDQPPPTTPTAVSSSDDEEKKELEASSRKEST

SEQ ID NO: 129424 - protein, 85 aa, Triticum aestivum
  unsure (1)..(85): unsure at all Xaa locations
  Clone ID: PAT_TA_23842.pep
MTVSYQAINNYFPHNFIKDCRLPXLQFPKXFLQANMSLXLQLXKAPQKQXCLIRPSSLWVQNQQPXHGGWRRPPIRNTVLICINT

SEQ ID NO: 129425 - protein, 233 aa, Triticum aestivum
  Clone ID: PAT_TA_23843.pep
MAGMGERLVIGTLLAAAFLAAPAAGTTLTLHNLCPYPVWPLVTPNRGFPSICGNDIRLEGNGHGLVSFPFPPTFWSGKLVARTGCAPPPRCETGSERPAGVVQLTVHSAEGAPRQDLAVYSVSLVDGFNVPVAVSPQAISGDGPCPALGCTADLNAGCPPAQRVVGAGGCVVACNGPPGYFKQRCPLTRTTPVDREPVEQHCYAPGELKVVFCQPAMVDADAAAQPDIVVAEN

SEQ ID NO: 129426 - protein, 88 aa, Triticum aestivum
  Clone ID: PAT_TA_23844.pep
LAWSRPRFSLSLSLSLSLSLSLSLSLSLFFFFFISQRASNPKHVRTSCWPSHMHTSIHIKLACMHQHANITHARTMPDNTHASRRQTA

SEQ ID NO: 129427 - protein, 214 aa, Triticum aestivum
  unsure (1)..(214): unsure at all Xaa locations
  Clone ID: PAT_TA_23845.pep
MQKQTGKSGGGGGSAAAKRGPKPXSSRSRRASPVEAAAAVGDPAAPAALVGPSLHVLTALSDQNNKRIVLALQSGLKSEILWALNALTVLSFKEKDDLRRDTTPLAKVPGLLDALLQVIDDWRDIAMPRDHTKPPRVRTLGVNTTISGFGLENVGKVYSDSTTPPNDQSKIESSTITKKRSAGFLFDEDGLFNIDDEGRTERQQCAVAASNIIR

SEQ ID NO: 129428 - protein, 134 aa, Triticum aestivum
  unsure (1)..(134): unsure at all Xaa locations
  Clone ID: PAT_TA_23846.pep
NHKKLIKKLNFLCETLTKFLSARKFLYYICGSGEKKSILQKMPFSKAFSCADFVFFCDFHECYFYVKIWRLLKPLLKFITKKLKNLIIFSFSFRIYWFTPISIELGEQNDTFVVWTNYLSVWLILTXDFPTIFP

SEQ ID NO: 129429 - protein, 113 aa, Triticum aestivum
  Clone ID: PAT_TA_23847.pep
DPASVLVGIIVLCGIQPVLSGVAVGCGWQALVAYINIGCYYFIGVPLGALLGFKFDYGIKGLWGGMIGGTLIQTIILLWITFRTDWNKEVEEARRRLDKWDDAKQPLLANVQR

SEQ ID NO: 129430 - protein, 159 aa, Triticum aestivum
  unsure (1)..(159): unsure at all Xaa locations
  Clone ID: PAT_TA_23848.pep
SAAFSAWVVTAMSALIAVLAGVLVFLLRHKLSYIFTGGEAVSRAVXDLCPLLVGTIXLCGIQPVLSGVAVGCGWQALVAYINIGCYYFIGVPLGALLGFKFDYGIKGLWGGMIGGTLIQTIILLWITFRTDWDKEVEEARRRLDKWDDAKQPLLANVQR

SEQ ID NO: 129431 - protein, 139 aa, Triticum aestivum
  Clone ID: PAT_TA_23849.pep
AGFHGNDVPLLQDQEDGEDSCSLKADRKKVLAHQGSCLQKRGCGVLGCDGAVEDGGAAGGDGAGGPPRLALLLPHRRQRRRTPTQEQRSLRLRPTAFGMADGEEPTLRLQIDLQEGNQMRFSKVVLVFRRRLSLRVKTH

SEQ ID NO: 129432 - protein, 117 aa, Triticum aestivum
  Clone ID: PAT_TA_23850.pep
RTEDSCPLRADRKKVLPHQEARLWCCWMQWCRGEWRRGWRPRCGRRSSAGSSSASPSPTTSHANSEAVISPSKASRVRHRRWQRTASTKCHSIWCTGGRFIYSRVTKWDFAVCSTRG

SEQ ID NO: 129433 - protein, 349 aa, Triticum aestivum
  unsure (1)..(349): unsure at all Xaa locations
  Clone ID: PAT_TA_23851.pep
MRPNALHPPPGGPGAGRAPGPPERGLARPRRAQRRRRASHSRITRPEPRPRPRPRLAPSPRPLPRRRHAAVSPHGLHPLRRPQGAGQGPERQDRGGARPRRARHHVPTADDVLVSRYPSYCRPNIWPADHLPELEIAFKALGKLMLEVGLMLARHCDLYVMQHGVGPYDGESLEQTISRSRCHKGRLLYYFPRQFSTQKEDGDSVSSWCGWHTDHGSLTGLTCGLFMKNSVEVPCPDSAAGLYIRTRDARVVKVTFGEDEVAYTIGETTEILSRGRLCATPHCVQAPSSVNASNVERSTFAMFMQPDWNGTLNFPXEIPYHQEVXPPNGALTFGVYSXRLVNKYYQGKT

SEQ ID NO: 129434 - protein, 53 aa, Triticum aestivum
  unsure (1)..(53): unsure at all Xaa locations
  Clone ID: PAT_TA_23852.pep
ILFCFXLFILLNFIFFXLYLLKVLFCLXLFILFSFLLVWTYFMNILFAFNAFH

SEQ ID NO: 129435 - protein, 431 aa, Triticum aestivum
  unsure (1)..(431): unsure at all Xaa locations
  Clone ID: PAT_TA_23853.pep
RFVALATLPVLXLXLAIAQKLXLACFSKGIQEXMHRKXSLVLEDAVXRNIYTVVAXFCAGDKIMELYKLHLGKILKQSLVHGLAIGFGFGFSQFLLFACNALLLWYIATSVDKQRLTIATGLKQYILFSFASFALVEPFGLAPYILKRRKSLTSVFEIIDREPKIDPDDNTGLKPPNVYGSIEFKNVDFSYPVRPEIFVLSNFNLKVSGGQTVAVVGVSGSGKSTIISLIERFYDPMSGQVLLDGRDLKSFNLRWLRSHMGLIQQEPVIFSTTIRENIIYARHNATEAEMKEAARIANAHHFISSLPHGYDTHVGMRGVDLTPGQKQRIAIARVVLKNAPILLLDEASSAIESESSRVVQEALDTLVMGNKTTVLIAHRAAMMKHVDNIVVLNGGRIVEQGTHDSLMDLNGLYVRLMQPHFGKGLRQHRLG

SEQ ID NO: 129436 - protein, 107 aa, Triticum aestivum
  unsure (1)..(107): unsure at all Xaa locations
  Clone ID: PAT_TA_23854.pep
PPXRFXQARPGSQWPRVGEQAAGVLKVVRGTAKIEGDGRGRILNHGCGLLLVGNQREAGIDGLDGAGGEVVGFRMDPEEDGGGGVGLMGQAAYILGLDLYIYQVGFG

SEQ ID NO: 129437 - protein, 75 aa, Triticum aestivum
  Clone ID: PAT_TA_23855.pep
RGRGRGLSLSLSLSLSLSLSLSILSILIMLPFCKTNKNKKYGLSYIFNHKQPFMLYTCCTYVHLNIKLKHMCVRF

SEQ ID NO: 129438 - protein, 290 aa, Triticum aestivum
  Clone ID: PAT_TA_23856.pep
MAGAGSSDAEAELRRGFKALAVTRPDPAAAVYEVRLSRPAQLNALSPDSFAEIPRAMALLDRIPAARAVVLSAAGPHFCAGIELGGPGNPLTAPPARGADPAAMAEELRRAILGMQAALTAVELCRKPVIAAVHGACVGGGVELVAACDIRYCSRDATFVLKEVDMAIVADLGALQRLPRIVGYGNAADLALTGRRITAAEAKEMGLVSRVFDSKQELDAGVAKIAKEISEKSANAVMGTKAVLLRSRDITVEQGLEHVATWNSGMLRSNDLMEAIKAFMEKRKPVFSKL

SEQ ID NO: 129439 - protein, 463 aa, Triticum aestivum
  unsure (1)..(463): unsure at all Xaa locations
  Clone ID: PAT_TA_23857.pep
MQIFVKTFPGKPITLXVESFDTIANVKAKIQDKEGIPPDQQRFIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLHRGGKQIFVKTFTGKTITLKVEFSDTIDNVKAKIQDKEGHPPXDSKRFIFAGKQLEDGXTLADYQHPEGSPPCHLVLRXLRGGMQIFVKTLTXGKTITLVGRVRRITIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 129440 - protein, 80 aa, Triticum aestivum
  unsure (1)..(80): unsure at all Xaa locations
  Clone ID: PAT_TA_23858.pep
DIQGFRKIHKETIRLGFRGDGCQEFFKAVVIGHKASLAGAKMPCLAYASQASPSPPGFSFSILGIPPGXRXSASSAQXHX

SEQ ID NO: 129441 - protein, 708 aa, Triticum aestivum
  Clone ID: PAT_TA_23859.pep
EIPPRLRPRVRVNAVLTAVVQGMNQTELSSEVRLAAVKALYNALDFAESNFANEMERTFIMKVICDTAVSKEVEIRQAAFECLVAIASTYYVHLDPYMQTIFNLTANAVKGDEEPVALQAVEFWSTICEEEIELQEEYEGSDDANSTVNYRFIEKALPSLVPMLLETLLKQEEDQEQDDNAWNISMSGGTCLGLIARTVGDAIVPLVMPFVEANITKPDWRCREAATFAFGSILDGPSLEKLAPLVQAGLDFLLNTMNDPNSQVKDTTAWTLGRVFELLHSPCSTNPIISNANLPRIMAVLLESSKDVPNVAEKVCGAIYFLAQGYEDAEPASSLLTPYLPNVIAALLTAADRGDMTHVRLRASAYEALNEIVRVSNIPETSSIIGQLLQEIMRRLNLTFAGQIFSSGDKEKQSDLQALLCGVLQVIIQKLSSSDAKSIIAQTADQLMLLFLRVFACHSATVHEEAMLAIGALAYATGPDFVKYMPEFFKYLEAGLQNYEEYQVCSISVGVVGDICRALEDKILPFCDGIMTVLLKDLSNSQLNRSVKPPIFSCFGDIALAIGENFEKYLPYAMPMLQGAAELLVVLDQNDEDMVDYGNQLRRGIFEAYSGILQGIKGAKAQLMIPYAGHLLQFTEAVYKDRSRDESVTKAAVAVLGDLADTLGPISKDLFKSHLFHVEFLRECLDLDDEVRETASWTQGMINQAIVS

SEQ ID NO: 129442 - protein, 127 aa, Triticum aestivum
  Clone ID: PAT_TA_23860.pep
MAAAAGGGGGAKATVAEQIGQAVQSTSNLLQLMEQSSPAQVHLAKLPKNLLAKASLTKNTEQVLQQLPNVISSLDAFMDSSLQSASQIKTVTQLLSNMESTQLKSILPASRLQKDQKNTEPGELRVD

SEQ ID NO: 129443 - protein, 125 aa, Triticum aestivum
  Clone ID: PAT_TA_23861.pep
QNCIKLDFGPEPTFQANFMRIGWLLNLEYLELTNNTLNIYFLVVELSFMENFTISRRCTILIDPCCCSSPARGQTPAPAPLPCHKHLLTVADSACSSPALGPPRKKKKKKNSNLPGRPLEITSEF

SEQ ID NO: 129444 - protein, 96 aa, Triticum aestivum
  unsure (1)..(96): unsure at all Xaa locations
  Clone ID: PAT_TA_23862.pep
RXRGRGGFXFXXFFFFFRKPIFINSKVIFSFIHRRQGKPGLLARFLNITPICEHKDKSFIQAHHISTQMFSKINIHICSFIVTSSTIAVSRIAGTT

SEQ ID NO: 129445 - protein, 291 aa, Triticum aestivum
  Clone ID: PAT_TA_23863.pep
ANSARGAALTAPGDVFTWGYGGFGALGHYVYHRELLPRKVNGPWEGKIAHIATSGAHTAAITESGELYTWGRDEGDGRLGLGSGGGPGEAGSLSVPSKVSALPVPVAAVACGGFFTLALTSDGQLWSWGANSNFELGRGSNSSDWRPQIVPSLKNVHVIQVACGGYHSLALTDEGEVLSWGHGGHGQLGHPTIQNHRIPLAIKALSEERIVYIACGGSTSAAISEKGDLYMWGNARDCQLGVPDLPEVQPLPVKVNFLADGDEDPSPPRVISVAIGASHAMCLVSRQQIQK

SEQ ID NO: 129446 - protein, 127 aa, Triticum aestivum
  unsure (1)..(127): unsure at all Xaa locations
  Clone ID: PAT_TA_23864.pep
AKAGCADAXAPCARAGCTCRGLQVLMRHFATCPKKMAPGGCARCKRMLQLFRLHASVCDRPDRACRVPLCSHFKAKAXTGKADKTWRLLVKKVTRAKVMSSLAERKVVPEVVAESWARYSRRGAKLR

SEQ ID NO: 129447 - protein, 186 aa, Triticum aestivum
  unsure (1)..(186): unsure at all Xaa locations
  Clone ID: PAT_TA_23865.pep
DSPRVYRGRGRGIVLGMFIVNESIRVGAETGERLRSWILKCIKENSSIGSNCNWEHLKVNTRTKHFVLIAVMMILLSFVWVLSIVLAIIKVRNXMMGAVLWLGCSVAPPGVWXLRWYLARLNGQGIGKQRSLIWLPIGTLVANVLAAGIMGPRPNLGDNXXSPNXSLLAGGNQRGILGTPQRVEIT

SEQ ID NO: 129448 - protein, 217 aa, Triticum aestivum
  Clone ID: PAT_TA_23866.pep
RNRAAAAAVGHAGAEAAGAAAARGGLAACARAGRAIDGAGAGPDQVRRTGPPARARHHVQETPHGEARGTALFARLVAAALCLAALAVLAADTRKGWALDSYSNYTQLRYSEAVNVIGFVYSVFQFFALALHLTRKRHLIPRPKGDYFDFAMDQVLAYLLISSSSSATARVSDWIDNWGSDTFPNMANSSIIISFLAFVVFAINSLISAYNLFRRDL

SEQ ID NO: 129449 - protein, 230 aa, Triticum aestivum
  unsure (1)..(230): unsure at all Xaa locations
  Clone ID: PAT_TA_23867.pep
MGKFVFFAVFLAALVSVSAAQGVLEQSLTDAQCRGEVREKPLLACRQILEQQLTGRAGEGAVGVPLFQAQWGARERCCRQLESVSRECRCAALRGMVRDYEQSMPPLGEGRHGSSGERQQEQGCSGESTXEPEQRQEVQGGQYGSETGGSQQQQQGGGYHGVTVGRGGQRQGQVLCHKRPQRQQGEGFSGEGAQQKPQAGRVRLTKVRLPTACRIEPQECSVFSADQYYY

SEQ ID NO: 129450 - protein, 259 aa, Triticum aestivum
  unsure (1)..(259): unsure at all Xaa locations
  Clone ID: PAT_TA_23868.pep
LIPSQSFNLNLSSISPHNKQHTISKPHPELEPVLIIGSFLCCSVFLAGLVAVPEAHSVRDXRLRDAQARAEGRXTPVLACPRIAEQQPSRSGRVGPAGGPVASCRVGGRGAAGSWQVASARAPAPRCXPAGGVMREYDTPPCRREGARGADGGALGQERRMFRGGRGGAGPERRQEVXGGQYEGETRGGQQEGAGYHGGTGGRGGQRQGQGLCQQQRQRQQGXEGCSGEGAQQKPGAGRVXRMTKAGLPAGCRIGRAGV

SEQ ID NO: 129451 - protein, 88 aa, Triticum aestivum
  unsure (1)..(88): unsure at all Xaa locations
  Clone ID: PAT_TA_23869.pep
MRKMGLDFDQEKSCEYSSTLFDDDEPSFQEVKMAFXVFDENNDGYIDALDLRRVLQNWGLGDRVGVNEAEQMIARYDTTKQEGKGWRE

SEQ ID NO: 129452 - protein, 344 aa, Triticum aestivum
  unsure (1)..(344): unsure at all Xaa locations
  Clone ID: PAT_TA_23870.pep
SSLGLHHKGAWCTPPRIFIDQDEVIPHYVPGTVPSTVDPDAAGYAERANKAKKPVKISARSLAKLDRNEVMKAAAKARASSSVLRPIDARHGHEADISSSGNASVCSCMSVDYSATPESRSEMRXDVHRTHXQQSHASQDDYETGTQTASSLSSPVHIHKLAPHAQFRAAPHPAPPPERPALGITRPPVPATHISNNPMFQSATSYVRENRRASVVWDQEAGRYVSVPMQTTRTGPGVELPARNPSFLANPSGEPGNHGRNLAPANTTSSAIPPGQPSERLTYTGQSIFFGGPILSTTGVNAERNEAGTRVRPETSRDPNSHQRDIRGEKARTGSFPLFEPRNF

SEQ ID NO: 129453 - protein, 171 aa, Triticum aestivum
  unsure (1)..(171): unsure at all Xaa locations
  Clone ID: PAT_TA_23871.pep
MLGQPKVMHAWRLNRFISXLGEKXPLYRFFGAPEHFGWXDTPRQSWSNKTILATNPILVAPNVGEPMLLYIAATHQVVSAVLVVERETDGHKFPLQKPVYYVSTVLTPCKSRYPHYQKITYAVFMASRKLRHYFQECSITVASEVPLNDIINNGDATGWIAKWAIELLRST

SEQ ID NO: 129454 - protein, 58 aa, Triticum aestivum
  unsure (1)..(58): unsure at all Xaa locations
  Clone ID: PAT_TA_23872.pep
RVTPHLLFXPPLHCWETLLLFVSRDTGKMGTSSFAGAAALPLASESPLNITRFDLQLA

SEQ ID NO: 129455 - protein, 73 aa, Triticum aestivum
  unsure (1)..(73): unsure at all Xaa locations
  Clone ID: PAT_TA_23873.pep
RDPDTTMSKLSMSLHVDPTAKLGLVRSFGLQASSYTESPKQLERGPRGGLVWMAINFREKSXYKGLGGAHAPH

SEQ ID NO: 129456 - protein, 144 aa, Triticum aestivum
  Clone ID: PAT_TA_23874.pep
GWGWGRGRGRGGAQMCSSRSLRLPSAIRAASQLLAQRHINGWDLATSAAPAKRSRRWGGKRFLMGYVCMWRMQKKKEIKTIIGREKNLQEVDGRGAHRGQDGNFTAQGPNERRGGNNGTRREKDRRRDGESTGGGGGGERKFFW

SEQ ID NO: 129457 - protein, 133 aa, Triticum aestivum
  unsure (1)..(133): unsure at all Xaa locations
  Clone ID: PAT_TA_23875.pep
VGKAMPTAPVSPVGVGLTPSNGRRRPGSRAHRYADGQHHRRRLECGAAHDSDVQGARLRVPLRKEHGQRGGEERPNAVKDEQDEGGEESPNAYKSDSGRKSGHRRAHRNHTRHLHVHGANLLLCGVHGSKLXL

SEQ ID NO: 129458 - protein, 53 aa, Triticum aestivum
  Clone ID: PAT_TA_23876.pep
RTPRPHSKFHQAKFICVAFPSSQAPVDPSSTLIEPTPSSSSRTYLTARRQLHL

SEQ ID NO: 129459 - protein, 63 aa, Triticum aestivum
  Clone ID: PAT_TA_23877.pep
IFCCNTLLLNHTGKLQKTSVCTLSFLSISYKSFLSVVHYEKQSQGKGRLMTKEMKLQTSMQYD

SEQ ID NO: 129460 - protein, 243 aa, Triticum aestivum
  unsure (1)..(243): unsure at all Xaa locations
  Clone ID: PAT_TA_23878.pep
XLLSTKKDTPAMWRAVSGMFHSRLIFYDAEVQDVSLPLLKRFGVKNVPALTGGRVGGEVQLLKDGISVKDLRSGIKELKTLLESFEKKNKKLASEQAKKHAKASEPKENKIPLLSASNFEETCGEKAPVCIIGVFKSNKAKEKLESILSEISQKTLIRGQSYSSGNAITYALLDGNKQSAFLSSFDKSGYKSSDKLLLAYKPRRGRFPVYKGEVSMEEAERFVVSVLNGDVQLSATGQKPVFR

SEQ ID NO: 129461 - protein, 145 aa, Triticum aestivum
  Clone ID: PAT_TA_23879.pep
RSLFPPSASHPPRRGCCSSPAPSPPRSATAAHPHPPLPLPEPVTAPPPPLAGAPPPLAPPPPFAAPRPFAGPPPFVFVGTPLVFAAVPPVVAPRPVAAASPTVVGSVENLRAPRPRSPSKLRRMAPERRWERARRRTAISFSSRR

SEQ ID NO: 129462 - protein, 130 aa, Triticum aestivum
  Clone ID: PAT_TA_23880.pep
QSYAGGESPALVPNSARGFNGRDRSAPSSEVSRLQRENDELRMELMQMKMRLRDPSVAAPAPAPTLAAGGTRSFPSSGKPPLPKKQGGSGGGGGGGFMKKLGRLNPFVRDPLAGGKVRTKPPKDRRHSIS

SEQ ID NO: 129463 - protein, 175 aa, Triticum aestivum
  Clone ID: PAT_TA_23881.pep
MRGGGREDEEAGQKLKSMDSGKGMDGGGGSSGDDDSPHPPRPAVKYHGWKAMPFIIGNETFEKLGTLGTSANLLVYLTQVFHMRSVDAATLLNGLNGTTSLAPIVGAFLSDAYLGRYLALAIASVASLIVSPSPSPLLSSSHQLPPDPSHPARALYVCIVASSRCHGELPAPMNR

SEQ ID NO: 129464 - protein, 73 aa, Triticum aestivum
  Clone ID: PAT_TA_23882.pep
AYYMQNYVAAALLVLMCRFSYSNITCIQFRAVMEIHMCVLQHVQNNTLQGTAARCRAVAATCSAASMTLMNLL

SEQ ID NO: 129465 - protein, 245 aa, Triticum aestivum
  unsure (1)..(245): unsure at all Xaa locations
  Clone ID: PAT_TA_23883.pep
RTSYFSSGDGWQTMGGXGKLKTFSFLFGGNPGAGGGNPFGFDLGDVFSNMFAGGSMGGSQHGGFAGSGRPSARTSSQHKNPVTIQEVTMQTFNKEIADQGITWLLLFYTQQAKGQFVLESVLEDVARSLDGAVRAGKVNCDIEKALCKKNGVSVGKSARLFIYSYSTAEKGSLHEYSGDSDAKSLKTFCQEHLPRLSRRVDINQFNFPSNAFPNLPEVLLLSTKKDTPTMGRAXGGMFHRRLTFY

SEQ ID NO: 129466 - protein, 138 aa, Triticum aestivum
  Clone ID: PAT_TA_23884.pep
SRVDLALHRLDNVVGEFRPMIFAEVPNVTSFRGVVVYVHGFYPHAGGTVVRPGRFPGHINGVYQLGDFTYLDGDFTSESGTSGGPVTMGDRVIGVNVQSVGGSRCAVSPLTLYMTFMNWCGFNGGDHTIAAMIQRLAA

SEQ ID NO: 129467 - protein, 356 aa, Triticum aestivum
  Clone ID: PAT_TA_23885.pep
MGKSEARPKGYGGGDVGGSGSPGKIFVGGLPRDTTLATFQKHFGNYGEIVDSVIMKNKQTSQPRGFGFITYSDPAIVDKVMEDTHVINGKQVEIKRTIPKDYMQSNPKDFRTKKIFVGGLPPILTEDDFKDFFEKYGAVVEHQIMRDHQTRRSRGFGFVVFESEEVVDDLLANGNMIDLAGSKVEIKKAEPKKSSNLPTSTGSDSRSAYGRDSRDHPSGDDRGGLADAYSSYNSGGFGPYRNHGGFVGGHGGVRHYHERYSHYYPGLGGYEGMSSSFGYPSRFGPYGGGFDGPYAGGNLRGYRRGGDESFGGPGSSSFDGAMYAGAYDPALGVYAPGGTPDMMNRGSFAPGRYHPY

SEQ ID NO: 129468 - protein, 121 aa, Triticum aestivum
  Clone ID: PAT_TA_23886.pep
RFRGEERRSCLVIWKVILSNPFGGGSRRSSGSFVDPVSADLAGSGSGICVECNGDLDTKLVNLEGQSSAVGISEKFQHGVAMPSIISLESDGVFLIIGGNRVIYIHDSKAVFVEMNIFSSC

SEQ ID NO: 129469 - protein, 171 aa, Triticum aestivum
  Clone ID: PAT_TA_23887.pep
ADIEAQVLVSQDDGRSNNTSTCQQNDDMKLHMALLSLAAAIFDKFITQDHNLAQLVDKISPGDSPTSFANKLNELVRRKSQPTASCLSMMKNASNMVISMMKVKHSDSYLKEHFLVIFLQSLADACKTMSSLESFMILYSANRGTLKPYRTLASLLKEAEELLVTKEPKEQ

SEQ ID NO: 129470 - protein, 376 aa, Triticum aestivum
  Clone ID: PAT_TA_23888.pep
RAGAITIRAFQEEDRFFEKNLELVDKNAGPYFYNFAATEWLIQRLEIMSAAVLSFSALVMALLPQGTFSPGFVGMALSYGLSLNMSFVFSIQNQCQLASQIISVERVNQYMDIPSEAAEIIGENRPSPDWPQDGNVELRDLKIRYRKDAPLVLHGITCRFEAGNKIGIVGRTGSGKTTLIGALFRLVEPADGKIIIDSVDISTIGLHDLRSRLGIIPQDPTLFQGTVRYNLDPLGQFSDQQIWEVLDKCQLLEAVQEKEQGLDSLVAEDGSNWSMGQRQLFCLGRTLLKRCRILVLDEATASIDNATDAVLQKTIRTEFKHCTVITVAHRIPTVMDCDMVLAMSDGKVAEYDKPSRCSETIGKGSSGGMTNSSAQT

SEQ ID NO: 129471 - protein, 152 aa, Triticum aestivum
  Clone ID: PAT_TA_23889.pep
KIASILLCSSYSTNFVCTDLHMLISRVDLRSTVEMCSVQPHGIREVEFVASSSTCLLAYSSSQPSLPSRSSVQLLAPTPVTQRAACRPPVFHLLIQLNFLHSSAFLIVAWYLYWLLDFMYYCQVLGGGIASLLLLRSLRPNLEDQENKISLF

SEQ ID NO: 129472 - protein, 154 aa, Triticum aestivum
  unsure (1)..(154): unsure at all Xaa locations
  Clone ID: PAT_TA_23890.pep
MAQGTLEVLLVGXPKGLENTDXLCNMDPYAVLKCTSAMEAERSTVASXGKRGSDPXEWESKPLCSPFSEECNRSSVIKLPRQLMVAXTDDSVGEANDPIGWSVHLKGSIPPTVYNVVKDEEYRGEIKIGLTFTPEEXRDEDQPEENYGGWNQSS

SEQ ID NO: 129473 - protein, 281 aa, Triticum aestivum
  Clone ID: PAT_TA_23891.pep
MALLLLRGCLAPVNAAGPAFRPAETTSRIGYRPSRFRAIVASAAAASPSGGDGTTAAVDSVLRGSEGHKARDYGGTNGAAVSGTARSTTIETTVERIIFDFRFLALLAVAGSLAGSLLCFLNGCVYIKEAYCVYWTSCAKGVHTGQMVLKVVEAIDVYLAGTVMLIFGMGLYGLFISNASNDLPSESDRALQGSSLFGMFALKERPKWMKITSLDELKTKVGHVIVMILLVKMFERSKMVKITTGLDLLSYSVCIFLSSASLYILHNLHRPEHEESVMPHL

SEQ ID NO: 129474 - protein, 273 aa, Triticum aestivum
  Clone ID: PAT_TA_23892.pep
MLYIVGLGLGDERDITVRGLDAVRRCAKVYMEAYTSLLSLGLDPASLANLEKMYDKEITVADREMVEERADQMLSEAAEADVAFLVVGDPFGATTHTDLVVRAKNMGVEVKVIHNASVMNAIGVCGLQLYRYGETISIPFFTETWRPDSFYEKIQNSRRLGLHTLCLLDIRVKEPTLESLCRGKKVYEPARFMTVNTAISQLLEVEELHGGSAYGPDSLCMGVARLGSDDQKIVAGPMKKLLDVDFGPPLHCLIIVGETHPVEQEMLEFYMIK

SEQ ID NO: 129475 - protein, 243 aa, Triticum aestivum
  unsure (1)..(243): unsure at all Xaa locations
  Clone ID: PAT_TA_23893.pep
SWFINLSASDYPLMPQDDLLHIFSYLPRDLNFIDHTSNIGWKEHQRARPIIVDPALQISNKTEVLTTKEKRSMPSAFKIFVGSSWVILSRSFLEFCILGWDNLPRTLLMYFTNFLSSSEGYFHTVICNSKYYQNTTINNDLRFMAWDNPPRTHPLNLTAEVLRXMANSGLPFAHSFTRDDPVLDMIDTELLRRAPDRFTPGGWCLGSPVGGKAPCASVGRALALRPGNGSRGATVVLVEAFRA

SEQ ID NO: 129476 - protein, 78 aa, Triticum aestivum
  Clone ID: PAT_TA_23894.pep
NSVEVMEAGGKKGYEEFGTRRQSWGALWCMDSKTGKPLEAPFSFRLTSSSGKVLVANNVVPAGWNAGKCYESKVNYPA

SEQ ID NO: 129477 - protein, 249 aa, Triticum aestivum
  Clone ID: PAT_TA_23895.pep
ENATRCLCRLRGQASPDLVSEQVNLILEELSYVGEEKKAGFSEIFQGKCLKAMIIGCGLVFFQQVTGQPSVLYYAATIFQSAGFSGASDATRVSILLGVLKLIMTGVAVLVVDKLGRRPLLIGGVSGIAVSLFLLSSYYTLFTGAPYGAVIALLLYVGCYQLSFGPIGWLMISEVFPLKLRGRGLSVAVLVNFASNALVTFAFSPLEDLIGTGVLFASFGVIAVASLAFIFCIVPETKGLTLEEIEAKL

SEQ ID NO: 129478 - protein, 158 aa, Triticum aestivum
  unsure (1)..(158): unsure at all Xaa locations
  Clone ID: PAT_TA_23896.pep
GVVAAEVYCLEHGIQPDGQMPGDKTVGGGDDAFNTFFSETGAGKHVPRAVFVDLEPTVIDEVRTGAYRQLFHPEQLIXSGKEDAANNFARGHYTIGXEIVDLCLDRXSGSLSXNCTGPQGIPLVFNPCLEGGNWPLGLGSSPWRRLLLFDLWEKKSKA

SEQ ID NO: 129479 - protein, 273 aa, Triticum aestivum
  Clone ID: PAT_TA_23897.pep
FLMRQQLSFSQRVREELAAKKFKGSSVVGRANGELEKGDDREDSEERQGDGSVVSIDHDDPLNWKPFVPDWMQPAWWEMLCDHWAQDEFMKVSYQKRKNRNAGGHPSAAAGSQIIAMHEHPKDTTSWDAEEARDPLLGPHPVQEQLGSSKRERYQGTPVASKKAQTDSSSKSSPDFLSRQGQEPRFTQEQVQLMINQALQGLNETWEKKFLSLEQNMRSVPSARAVPVGAKTRSAVAVARDKRCQISRQDTFDSAEGEEDPDDGEEQDDVRWS

SEQ ID NO: 129480 - protein, 107 aa, Triticum aestivum
  Clone ID: PAT_TA_23898.pep
TFVQMVTKKFFYNHGIMTWNVLLMCIPSMWIIEDYFRFIFMQKTSPGMLKFLLVLSFPGVIEISPCTEICFLLNFFEETLVLTFNYFVGMKSSREQKEQGERSAQEK

SEQ ID NO: 129481 - protein, 193 aa, Triticum aestivum
  Clone ID: PAT_TA_23899.pep
MATTPPNHRPPLLPLSSSLLLLLLLLVHPFLSAGTPSITTKAVPRLPGFAGPLPFSLETGYVALDDGVRLFYYFIQSERDPAEDPVLLWLTGGPGCSALSGLVYEIGPFYFDFHGYTGGLPTLLYKPASWTKVSNVIFVDAPAGTGFSYATGDKRTIPSDTIAIQQLHVFLETWFDEHPQFLSNPLYISGDSY

SEQ ID NO: 129482 - protein, 103 aa, Triticum aestivum
  Clone ID: PAT_TA_23900.pep
IQKTFRPSLLFHQKWAHLKHLGLQLQSMTCIFPASSLQRRPWPFPATAAESPISSNSLFSSLIVSGFRRFLARAAARRRRREATSSGWTTLWSTRTSPAKVSS

SEQ ID NO: 129483 - protein, 150 aa, Triticum aestivum
  Clone ID: PAT_TA_23901.pep
PPRRTSPPSSSTPATTLTYLPEALLDPLVKELTQRIKLPPAQPPRPRRPRRFDLSGVPDGQLAAIIPEVTLGLGGGAAVTLKAENTFVEVQEGTLCLAVAAKSEQLPASIIGNIAQQNMHVGYDLDKGTVTFAPADCASSYPAPSPSGSL

SEQ ID NO: 129484 - protein, 302 aa, Triticum aestivum
  unsure (1)..(302): unsure at all Xaa locations
  Clone ID: PAT_TA_23902.pep
GRVGGRVXKENCDLIIVDTSGRHKQEAALFEEMRQVSEATKPDLVIFVMDSSIGQAAFDQAQAFKQSVSVGAVIITKMDGHAKGGGALSAVAATKSPVIFIGTGEHIDEFEVFDVKPFVSRLLGMGDWAGFMDKIHEVVPTDQQPELLQKLSEGSFTLRLMYEQFQNILKMGPIGQVFSMLPGFSAELMPKGHEKESQAKIKRYMTMMDSMTDAELDSTNPKLMTEHGXSVARGVWAAVKDXMDMLEEYKRLLKPGQDEGSKSKRKGHXALPHMNVQQMTRPPRXXKXIGGWXIPIKMVKDT

SEQ ID NO: 129485 - protein, 295 aa, Triticum aestivum
  unsure (1)..(295): unsure at all Xaa locations
  Clone ID: PAT_TA_23903.pep
ARDHLLGQPVILLVKLAPCKIKQAVEMDRKEADLRCMEVWYINCYALFMGYLLMAVRGLGFLVITWSTVVLLGGFVSDLEKKDFWSLTIITLVLTPRVSTDVGLKGKLKYIEYSIIGVSHAIYATLNPNGTNDTWARQLLAAVVWLCHLLVGPIVVCPLAALYMCGPLFSAGISAWRLIEHDYVATKNEEAAHLQPALIVLYSLAMLQGLLFCYRFYSSFARKDLVNDVARAYKMNHIEEDVKEYLRETVIGCEKDPAFFKETNLATYAMGMIKSQKSENFLSXAGILDALLEHP

SEQ ID NO: 129486 - protein, 192 aa, Triticum aestivum
  Clone ID: PAT_TA_23904.pep
VEHHHSVPPDTNYTYITLLAGNTQQLRADDRQKSTASIDNFKRKERSCHHEESSSKSSLFTQSGHLQRQKDSLQEVKIQVSLQNGARNGLANSLAMVFKRRTGEVFMSSTCRVRAAMAVRGAAISCRSSSIVMAMATTSAALLLPPPLSMLAVAALWIPLDRRLLYAFVLLVWLCSSQCKNPHPFYMGRKRG

SEQ ID NO: 129487 - protein, 61 aa, Triticum aestivum
  Clone ID: PAT_TA_23905.pep
ADNGCTMTDALPSSLMACKLFCLRLEANKRADGFMPCPCLVRKHEHNYSRPRTKHDHMSRP

SEQ ID NO: 129488 - protein, 265 aa, Triticum aestivum
  Clone ID: PAT_TA_23906.pep
SAHASATCSCPPKKCFQGTCDCLIGIELCYSGCNCSADCQNGLSLGTINPAAAQGTTPTLASGSSAAQDTAQTQPLAPSSSTAQGIAQPHPLAPSSSTAAVPKPEAVGGRVKCNCSFTKCLNCQCTCFREGLSCMMGRCKCYDCENNPNWLADEDYVECACKTKNCKTRVCGCNKKLKGCNPNCTCIGCRHQLAGAAAPSSRPAPGRTAGAGGARRSGPSMLLGTGRSHQPPDIPEHDASHLTYLPPASRLPSPVLPLSSTARFL

SEQ ID NO: 129489 - protein, 117 aa, Triticum aestivum
  Clone ID: PAT_TA_23907.pep
RLPATAYLALSKAFAKAMSASGYKTAPAYSILDTCYDFTGLSDVSLPTVSLVFQGGTCLDVDVSGIVYAISQAQVCLAFASNGDDESVAIIGNTQQKTYGVLYDLGKKTVGFAPGSC

SEQ ID NO: 129490 - protein, 380 aa, Triticum aestivum
  unsure (1)..(380): unsure at all Xaa locations
  Clone ID: PAT_TA_23908.pep
QTPGARCPCPARDIRQAPGRSPSPAAPALPATPGRALSTGNYVVTVGLGTPASKYAVAFLTGGDTTWVHCRPRPVKCYKLAAPLFDPAKSSTCANVSCSDPACDDLDSNACTGAHGLYAVQSADGSXTVGFFAXDTLPIAHDAIKGCRVGCGGRXNSGRCGKTAGLTGSRTAGKTSLTVQAYDKYGGAFAYCLPASSSGTGYLDFGPGSAGNNARLTPMLADKGPTFYYVXMTGIRVGGQQVPIAESVFSTAGTLXDSRTVITRLPATAYTALSKAFATGMSASGYKTAPAYSILDTCYDFTGLSDVSLPTVSLVFQGGACLDVDVSGIVYAISQAQVCLAFASNGDDESRPPGQVTQQKTYGVLYDLGRKTVGFAPGSC

SEQ ID NO: 129491 - protein, 97 aa, Triticum aestivum
  unsure (1)..(97): unsure at all Xaa locations
  Clone ID: PAT_TA_23909.pep
MQVWEGGAGITDIPLIFVNFCRICIVIEHEKSFTSLYFXXVFCSKMTSTQRSESANHMLKSYMPPASPMHIFVRQYMRLQFDHGKEESYERTICQKN

SEQ ID NO: 129492 - protein, 319 aa, Triticum aestivum
  unsure (1)..(319): unsure at all Xaa locations
  Clone ID: PAT_TA_23910.pep
GRSHPLGPTSRPRSLPPSPPPVRHSSVAPIPLAPPPGPGAFHRAHRPARAPRAGAPGRSLAAHSSPSPDVVVTREQGKNAKLVAALEKHNVHSLELPLIQHVEGPDADRLSAVLRDEKFDWVTVTSPEAAAVFLEGWKAAGSPKVRIAVVGAGTARTFDEVLQSNDGPLEVAFSPSKALGKVLASELPRTSETASKVLYLASATSGHEIHNGLKACSFKVTLLNTYSTVPVHAWVKLMLNGADNWPHARVACPGAIRAWLNLXSRVDKWSNSVACIGEATASAAKKLGLASVYYPATPGLEGWVESILEALRAHKQPSK

SEQ ID NO: 129493 - protein, 172 aa, Triticum aestivum
  Clone ID: PAT_TA_23911.pep
MAASKALMLAVGVVVVAGCAVGLSGATDHIVGANRGWNPNINYSSWSANQTFYAGDLISFRYQKGTHNVFKVNETGYDNCTMDGVTGNWTSGKDFIPLPRPGRYFFICGNGFCQSGMKVAITVGIFDLGPEIYPPPAPGADNPSTSASFTAGAWPAAAAVVTALGAAAILVL

SEQ ID NO: 129494 - protein, 145 aa, Triticum aestivum
  Clone ID: PAT_TA_23912.pep
STEEPDVPTLIVHERVTIRLESESYVTLQWSSDSISDMVSDSVVATILNIGREGPKAVPIEAAAKTEEETEKVVQKVVYALMVSLFGDVKFAEEGKLVISVDGDVAHLDGRSGDVECENAALKERVSTAFRRIQGAVRPIPLSAS

SEQ ID NO: 129495 - protein, 192 aa, Triticum aestivum
  Clone ID: PAT_TA_23913.pep
LKKIEFKLRLKNSSGFCSEFYGIRVSRPPSVFSWDSVAKTLDRSNQLESPLPVEMHRAHASSSATQRPPAASRHWPWPHPPTGCTRCGSIFYEGAGRPQPWTRRTRAVLAATAPVFPPAKDTAPCGAARLKRAELACTDPILPSVKATTPRGAAGQRRAALATTAPVWPPATALSGGPHLADAWADAWADAG

SEQ ID NO: 129496 - protein, 213 aa, Triticum aestivum
  Clone ID: PAT_TA_23914.pep
GTRDLPAPPDGLDLNAVVAPPVSQVAPAPDRPSHVSVQEFRARVRTLESAFSDADWFLRDIQGEIQQMREEGHEKDRQIRSLVEDAMKKRRSSHIRIKQFDHDKELMRRFFQGCKEKLKKSSDAFREYKRMCEGSGVSSSGVMADEQNRILMMEKQSCVDNITWFRKYMLSRFGECADEIAILATRTAYLNNELQRLNDYIQIPDLNNGGPQL

SEQ ID NO: 129497 - protein, 352 aa, Triticum aestivum
  Clone ID: PAT_TA_23915.pep
MEKGDGPALQPLLCLAWLAATLPILAAALPIPAAAGGRLLHSLLAAFSSRGKTVRPSSSSSSSSSKAKFTVPQKYFLHFYVVGVAVTTSLLLAICFYAYMKMTPLLPEPSSYSTIASHLIGSNSFSFGSVLSRTMEHKYRVWRTVFVLLLMEIQVLRRLYETENVFHYSPSARMHIVGYLTGLFYYTAAPLSLASSCLPEAIDFIRGQIVEFIVKGRARMPDLVIDSPSLLKPLLKLGWCQWIGAIVFIWGSLHQIRCHAILGSLRENKDSDEYVIPCGDWFSRVSCPHYLAELVIYLGMLIASGGSDISVWFLFIFVITNLSFAAVQTHRWYLQKFEDYPRSRYAIIPFVL

SEQ ID NO: 129498 - protein, 140 aa, Triticum aestivum
  Clone ID: PAT_TA_23916.pep
RNSARGRLRLPPPATSPPSAVPPHLLRQSTSPTRPPTRPLYSASTTGLARVCPTPSSLLLPRMAVLHPTSRPCSADDELQSWSARPRWLATATYRHPAAKGGAELWCVRLLLRLGRRWPGRRRIGAWGGVPMPWWWSPCP

SEQ ID NO: 129499 - protein, 125 aa, Triticum aestivum
  Clone ID: PAT_TA_23917.pep
GKRAIFKEAEGGSPVSVVDYAQPSIVAGELGKVLDGRAPEPSPHEAEAVELVAYTAVHCVRLEGKDRPAMADIVANLETAFAHGEGSAGGSRGAGGTTTGGGFGNSSSSASLSMTSMELSGRLAE

SEQ ID NO: 129500 - protein, 162 aa, Triticum aestivum
  Clone ID: PAT_TA_23918.pep
VTPLRVGRFLRGFRWAAVGNPHLFAGPGIVDGLEIMGFPKGSGLLPLSKRLQSGSLAHGDDTAAAVKIAEQHSDFVLGLISVNPASWSVAPSSPAFIHATPGVQMVSGGDALGQQYTTPYSVINDRGSDIIIVGRGIIKASDPEQTAREYRVQGWQAYLSSL

SEQ ID NO: 129501 - protein, 68 aa, Triticum aestivum
  Clone ID: PAT_TA_23919.pep
SNKNKIVPCEIVLPNVSESQIPYTWLHKCDLVIHMQLDSLDMHTSGRGRRASKELFVRNYPYSPYIFY

SEQ ID NO: 129502 - protein, 84 aa, Triticum aestivum
  Clone ID: PAT_TA_23920.pep
VRRSRRPVGSVGSRYCVEALGLPIKSQWQPWYLNKQVAGRFVEYHGMTMVTIRGAGHLVPLNKPTEGIALIDTFLLGKQLPTQR

SEQ ID NO: 129503 - protein, 222 aa, Triticum aestivum
  Clone ID: PAT_TA_23921.pep
EIYEAARGGCGGEYRWPSNSHCAKSLQDIKECMSGLNDVHILGKICPEYPSLTLHKQPALQDHGRRRLTESAVSSVCRNATYFLSELWTNDEAVRESLGIHKETVPSWLRCDFNLPYTYEINSTVDDHLALITKGYRAMIYSGDHDSKISYVDTQAWIRRLNLPITHRWRPWHLDDQIVGYTRTYSNNLTYATVKGAGHTAPEYMPRECLAMIDRWLSGESP

SEQ ID NO: 129504 - protein, 169 aa, Triticum aestivum
  unsure (1)..(169): unsure at all Xaa locations
  Clone ID: PAT_TA_23922.pep
REEEESGLSIVYLQLYKSEVYAIGGDGTMRGAVAIFEEFKRHGWRISITWIPKTVDIGMIDRSFVFQTAVEITQHAINAEHVEAVSAVNGIGLVKLTGRSTGHITLHATLSSRDVDCCXLEIDFHVEGKGSLFEFLYERIKKKGHVVVVVAEGAGQELIPQTDDSTELT

SEQ ID NO: 129505 - protein, 83 aa, Triticum aestivum
  Clone ID: PAT_TA_23923.pep
FMKTLFGVLDHSTSMFILAEKNAFILIGMETPLRIECIIANQLLSMRAMDIEEICKQLSLEEICNNLFSREQGTYKKSPGSFA

SEQ ID NO: 129506 - protein, 78 aa, Triticum aestivum
  Clone ID: PAT_TA_23924.pep
VPQGAPFSDSMSDDLRNKRRNNPAEEFGEEEQEKNTFILIGMETPVRIECIIANQLLLESKGHIRNLQVASLRCIIFC

SEQ ID NO: 129507 - protein, 57 aa, Triticum aestivum
  Clone ID: PAT_TA_23925.pep
LCINLQFLKNEHTPCMHYSTKDAHTICISAASWELKSDELEMYETKIWQIPRETIDI

SEQ ID NO: 129508 - protein, 68 aa, Triticum aestivum
  Clone ID: PAT_TA_23926.pep
FSRKTWRIFLQVYVIGGDGTMRGAVVIFEEFKRCRLRISITGIPKNLDNDIEIIDKAFGFQTAVESAQ

SEQ ID NO: 129509 - protein, 90 aa, Triticum aestivum
  Clone ID: PAT_TA_23927.pep
DHVPQGSQNLLDNMVVQCFFEVYIGTMLKKDMAGSEDSQSSRHIPVSSIHITICLKRRALLLYIMWFAIKLSKRKNNVTLFFGEPSCRVP

SEQ ID NO: 129510 - protein, 67 aa, Triticum aestivum
  Clone ID: PAT_TA_23928.pep
KGKAIPEVIASGREKFSPVPSGGGAIAVGAPAAASGGGAAPAAESKKEEKVEEKEEFDEDMGFSLFD

SEQ ID NO: 129511 - protein, 114 aa, Triticum aestivum
  unsure (1)..(114): unsure at all Xaa locations
  Clone ID: PAT_TA_23929.pep
FWVLIQIEEGELFARSISLGLPRFFPSCKMFNFGARQFIFGYPKEYLKSSALLNLGTLDFFIEARPLFFFFFFFFFFFFFFFFFFFFFFFFFFFFFFXLIHDEHFLEIVVNYII

SEQ ID NO: 129512 - protein, 123 aa, Triticum aestivum
  Clone ID: PAT_TA_23930.pep
FAAGLRCSSRLQQARVVLLILQMHKAAIEGEIAPASSHLPTACSSRAPCPVEGGGRGGASWRRGGDDAVARQFDLPAAGMCARHHPAPSYPLGSLTQLLPRCCLPSSPASSFPYIPTPPLHGR

SEQ ID NO: 129513 - protein, 126 aa, Triticum aestivum
  Clone ID: PAT_TA_23931.pep
KMEYLEVYCRKVDDANQTRVKQQQSVATKEAEVDMLVATLGEHKLYLKRSRQHLDCCYHPPSTKPWGIFGSLLCLCSNDKLSFDSFCVWHVCLFWPLLIDANYAGHLCVPRSLWELHTNLVDVFGW

SEQ ID NO: 129514 - protein, 56 aa, Triticum aestivum
  Clone ID: PAT_TA_23932.pep
ERKGERKGFYVTALWMHAIHPHTLATNLADFARFGFLKDLPEILYRFLRDPRDERK

SEQ ID NO: 129515 - protein, 163 aa, Triticum aestivum
  unsure (1)..(163): unsure at all Xaa locations
  Clone ID: PAT_TA_23933.pep
IFCAKSSIDVIFDASKVYVIGGDGTMRGAVAIFQEFKRCGLRISITWIPKNLDNNIDIIDKAFGFQTAVESARXAIDATHVRLXNIVDGIGLVKLMGRSTGHITLHATLSSXDVDCFNPEIDFHVEGRGHAIVVVAQGAGQELIPRIDDQKREQDEYGNMLFL

SEQ ID NO: 129516 - protein, 181 aa, Triticum aestivum
  unsure (1)..(181): unsure at all Xaa locations
  Clone ID: PAT_TA_23934.pep
EGERERERKGDRKVFYVTALWMHAIHPRTLATNLAGFARFGCLKDLPEILYRFLHDPRDERKDQDDVAAAAPGARAASGAASTALPXAAAEATKARREKEAEHAQAMLALYDSDKAFRNLYDGVADLFVWLLKSDLEHLRTGDTAKIVFAAKCARRIHGSPLLHGCRWLSLIHLIVACLEP

SEQ ID NO: 129517 - protein, 115 aa, Triticum aestivum
  Clone ID: PAT_TA_23935.pep
AWSRPRYKRRPGCASFFWPMDIVIMVTLSQCIIFGSHIPQGAPSSDSMSADLRNKRRNNPAEEFGEEEQEKNTFILIGMETPVRIECIIANQLLLESKGHIRNLQAASLRCIIFC

SEQ ID NO: 129518 - protein, 121 aa, Triticum aestivum
  Clone ID: PAT_TA_23936.pep
RRSWSRTVGGSYTRGRSRTTIVSDPLDSSQLVAMSMDIVIMVTLSQCIIFGSHIPQGAPFSDSMSGDLRNKRRNNPAEEFGEEEQEKNTFILIGMETPVRIECIIANQLLCMVSGHACLFP

SEQ ID NO: 129519 - protein, 72 aa, Triticum aestivum
  Clone ID: PAT_TA_23937.pep
IGARHHTPALRRKGYEDKDISVLLRNKNILRVIMTCNLPQSLKQAYLLAFVLGSMTQSYIFTFTLFSYGLYA

SEQ ID NO: 129520 - protein, 190 aa, Triticum aestivum
  Clone ID: PAT_TA_23938.pep
GTWSSMSDQVRRWPASLEPPPTGTCCSPCTPDARDIHWRRHELLLPLAFPHRLFTSSSLPGGGWRQRWHLMMQRRRRRGGATSRPAGRRQVREASPCPLPPPACCLTSSPASSFPLSLHPTPHLHRDDPAGAAPPRRYVRSGSTATWKRTGGGKQRRRSAVDQRRRGRGEEEASGETRPAAAGEERMRES

SEQ ID NO: 129521 - protein, 74 aa, Triticum aestivum
  Clone ID: PAT_TA_23939.pep
EHELRHVSEKWSRFPDPSNMSCDYFARDSWLYITFTSNIPYVTTYLRSQSYMIYIMEKNGAFDNLHTYFSPKQS

SEQ ID NO: 129522 - protein, 469 aa, Triticum aestivum
  unsure (1)..(469): unsure at all Xaa locations
  Clone ID: PAT_TA_23940.pep
MDPTVPNSGDHAASTPTNTTVTLPPLTLRDAPRLPALPSGATTIPNPISSHPYFHPPPTFYISPGDVSLRHAFFDLSSGSPNPLVAYRRAGPRESLAVDPARARAALVTCGGLCPGLNTVLRELVVGLHELYGVLDVFGVAAGYRGFYGADDDHVRLDPASVDDWHKKGGTALKTTRGGFDLNKIVDGIVARGYTQVYAIGGDGTMRGAVAIFEEFKRRGLRISITGIPKTVDNDIGIIDRSFGFQTAWEIAQQAXXAAHVEAVSAVNGIGLVKLMGRSTGHIALHATLSSRDVDCCLIPEIDFHVEGKGGLFEFLYERIKKKGHAVVVVAEGAGQEVIPRTDDQKREQDESGNMLFLDVGPWLKSELGRWWKREHPTELFTVKYIDPTYMIRAVPANATDNLYCTLLAHSAIHGIMAGFTGFVPGPINGNYSYIPLEDIAVAKNPVDVNDHKWAWVRSVTDQPDFLKP

SEQ ID NO: 129523 - protein, 64 aa, Triticum aestivum
  Clone ID: PAT_TA_23941.pep
QEHKKTPMTNHLEGSMAESYTWLVKPSCQAGKFLTNAQISIRLHLSCSTQINFVYSEVSKARYQ

SEQ ID NO: 129524 - protein, 148 aa, Triticum aestivum
  Clone ID: PAT_TA_23942.pep
MCGSLWQLLAVVVAVSAVTRAVAALTAGRSLHRDFDDGRVVELALDRETGSRLESKDRYLFGRFDLNIRLVAGESAGTITSFYPPTMREVARPSHGPSTRRGRVGRRRRGVDDQGISRMPAVGRRSRDAAHSLPLFLADDASRKHFVG

SEQ ID NO: 129525 - protein, 70 aa, Triticum aestivum
  unsure (1)..(70): unsure at all Xaa locations
  Clone ID: PAT_TA_23943.pep
LKGKDITEVIASGREKFAAVPSGGVPIAVGAXAAASGGARSHLLAESKKEEKVEEKEESXDEDMGFSLFD

SEQ ID NO: 129526 - protein, 187 aa, Triticum aestivum
  Clone ID: PAT_TA_23944.pep
FAASLHRSSRLQQAHVASLYSRSARQHGRRDELLVPQAFPHRLFTSSYLPSGGRQRWRLSWRRGCASHGAEEVTMRWRNKSTCRPPAGARGLTLPLPHARTAHLLLPRCCLPSLPASSFPCRPHPTPPLHPHPHREDDLCPIWIDGDMEEDMRRRAEEKAGGGIDGDMIEERRRRVERRGRPAAAGE

SEQ ID NO: 129527 - protein, 113 aa, Triticum aestivum
  Clone ID: PAT_TA_23945.pep
MKLIAAYLLAYLGGNSSPSAADVKNILDSVGAEADEEELEFLLAELKGKDITEVIASGREKFAAVPSGGGAIAVGAPAAASGGAAAPAAESKKEEKVEEKEESDEDMGFSLFD

SEQ ID NO: 129528 - protein, 272 aa, Triticum aestivum
  unsure (1)..(272): unsure at all Xaa locations
  Clone ID: PAT_TA_23946.pep
KKKKKKLETSPVAPFDAAACFLAIGMAIIMSSWSENYGDQSEGKDLMSQFKVAAKAIASDEKIALLGAIQSLFEGSMYTFVFLWTPALSPNDEDIPHGFIFATFMLSSMLGSSIASRLLARKMKVEGYMQIVFAVSAFTLFLPVATSLLXVPTSSVKGSGISFGGSLQLLGFCTFESCVGIFWPSIMKMRSQYIPEEARSTIMNFFRIPLNLFVCVVLYNVNAFPITVMFGMCSIFLFMAAILQRRLMVVADLNKLSTKSQEMTAQDELLNP

SEQ ID NO: 129529 - protein, 113 aa, Triticum aestivum
  Clone ID: PAT_TA_23947.pep
MKLIAAYLLAYLGGNSSPSAADVKNILDSVGAEADEEKLEFLLAELKGKDITEVIASGREKFAAVPSGGGAIAVGAPAAASGGAAAPAAESKKEEKVEEKEESDEDMGFSLFD

SEQ ID NO: 129530 - protein, 381 aa, Triticum aestivum
  unsure (1)..(381): unsure at all Xaa locations
  Clone ID: PAT_TA_23948.pep
MEVFYYLVFGGLAAVVAALELGKSGKDRVATPTAFNSFKNNYVLVYSLMMSGDWLQGPYVYYLYSQYGFDKGDIGRLFIAGFGSSMLFGTIVGSLADKQGRKRACITYCITYILSCITKHSPQYRILMIGRVLGGIATSLLFSAFESWLVAEHNKRGFDPQWLSITFSKAIFLGNGLVAIVAGLFANLLADNLGFGPVAPFDAAACFLAIGMAIILSSWGENYGDASEGKDLMAQFKVAAKAIASDEKIALLGAIQSLFEGSMYTFVFLWTPALSPNDEDIPHGFIFATFMLSSMLGSSIASRLLARKMKVEGYMQIVFSISAFTLFLPVVTNFIVPLSXKGGSISLGGCVQLLGFCIFESSVGIFWPSIMKMRSQYIPET

SEQ ID NO: 129531 - protein, 113 aa, Triticum aestivum; identical to SEQ ID NO: 129529
  Clone ID: PAT_TA_23949.pep

SEQ ID NO: 129532 - protein, 113 aa, Triticum aestivum
  Clone ID: PAT_TA_23950.pep
MKLIAAYLLAYLGGNSSPSAADVKNILDSVGAEADEEKLEFLLAELKGKDITEVIASGREKFAAVPSGGGAIAVGAPAAASGGGAAPAAESKKEEKVEEKEESDEDMGFSLFD

SEQ ID NO: 129533 - protein, 65 aa, Triticum aestivum
  Clone ID: PAT_TA_23951.pep
MKGLKIPKKGEMSALSRNMNVQHMSKVLPPQMLKQIGGMGGLQSLMKQMGSKEMSGMFGGMGGER

SEQ ID NO: 129534 - protein, 361 aa, Triticum aestivum
  Clone ID: PAT_TA_23952.pep
GIRHEEIAGCHKFLKSSKSETMSCGKDTASQSSLKSSLVIHAKEAATDSKQPLGPKRKRSNKIPVGSDPRVDNKSRHGSQPADGSGVTSAKDPTSVKTPLDRLKQPMPYRGRKELMSFLQEAMDSPKQNIPAAPVSHRKRVAAPGARVDRKLFVLTPMPLRCDGNAVPGSGTINSKGNGKQRREGPCVGTKGFRAPEVLLRSSHQSCKVDVWSAGVTLLYFIIGKAPFGGDPEQNMKEIAKIRGNEELWEVAKLHNCESSYPQELFDVKLLQSVDLREWCMANARRPELLEQVPDSLFDLVDKCLAVNPRCRITSEDALSHEFLAPCRESLKKNALRIRSASASHPPPCLPRDAMVNANEL

SEQ ID NO: 129535 - protein, 51 aa, Triticum aestivum
  Clone ID: PAT_TA_23953.pep
HPVAILEETERKTRNKSIKFLKVKWSHHSDREATWEREDHLRSEYPVFFQS

SEQ ID NO: 129536 - protein, 175 aa, Triticum aestivum
  Clone ID: PAT_TA_23954.pep
LGCFNLSVKGHADCLRFLRSFNIPIMVLGGGGYTIRNVARCWCYETAVAVGVEPDNKLPYNDYYEYFGPDYNLHIQPRIVENLNTTKDLENIKNMILDHLSKLEHVPNAQFHERPSDPEGPEEKEEDMDKRPAQRSRLWSGGAYDSDTEDPDNMKTEANDLSANSIMKDASNDDL

SEQ ID NO: 129537 - protein, 155 aa, Triticum aestivum
  Clone ID: PAT_TA_23955.pep
SNFKSFDRAAPPALSQLSPMARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 129538 - protein, 329 aa, Triticum aestivum
  Clone ID: PAT_TA_23956.pep
RETGSSQRGREATIAVPTPLPSPAADAESLRNAVQGWGTDEKALVEILGRRTAAQRAEIRRAYASLYKESLLTRLHGELSGHFQKAMVLLATEPAERDAKLAREALGRRGDDRDAWVLIEAACAATPDHLLAVRRAYRSLHGSSLEEDVAACPAFQEPLRKLLVSLVRSYRCAEGSVDMAVAKQEPAQLAEAIRRKKQPHGGEVVRIVSTRSKPQLAATFRCYKEQHGSDIEEDMKQYSSSQFARMLKIAVWCLTSPEKHFAEVIRYSILGLGTDEDALTRAIVSRADIDTKKIKQEYRVRFKTTVTDDVVGDTSGYYMDILLALVGKE

SEQ ID NO: 129539 - protein, 260 aa, Triticum aestivum
  Clone ID: PAT_TA_23957.pep
FGRVGGRVGKFVGCFLVVILVWEIPGVFEIVWSPFTFLLGYDDPSKPDLPRLHEWHFRSGLDRYIWIVGMIYAYYHPTVEKWMEKLEEAETRTKLYIKASIVTVSLTAGYLWYEYIYKLDKITYNKYHPYTSWIPITVYICLRNFTQEFRACSLTLFAWLGKITLETYISQFHIWLRSKVPNGQPKWLLTIIPDYPLLNFMLTTALYVAVSHRLFELTNALKIAFVPRDNKRLSYNFVTGIAISVALYSVSFALVGIAGY

SEQ ID NO: 129540 - protein, 122 aa, Triticum aestivum
  Clone ID: PAT_TA_23958.pep
RPDDAHDKTAVPVVENISYQDVVATGVWKEAARMQGIQGAPFKGICMANVTAEMTKERKVSWNCADVEGVSAGVTPAPCAPLQGTHAGSCPFPTDTLAVDQITVQQCSYSVAPATTSMAGTK

SEQ ID NO: 129541 - protein, 62 aa, Triticum aestivum
  Clone ID: PAT_TA_23959.pep
QRKHTDRRNIFYCTMQYTDSSIICAQRKTKNSNTIQIIVVSHTYVRHLLMISMGTASAGSAF

SEQ ID NO: 129542 - protein, 238 aa, Triticum aestivum
  Clone ID: PAT_TA_23960.pep
MVAVDPKALPSAKAVNHQFNVVIDGAETTIHEGVLRCNGGTLTVVSPGVLEVNRLQHVVVRGGGGGDVRFARCGFAAAEACGAVSFHRCDAVRVDGAGEVAVRRCRSAAVERAGTVSIRRCKGAARVHGAGELRLGRCREADVGNCSDVALGRCREARADWCGSLGVARCRSADVSRCGAVRVDRCGDANVASCGSVMVRRGKVNMVEAHQPLQGWQEQPLCQKAEPADPVPMEIMSK

SEQ ID NO: 129543 - protein, 113 aa, Triticum aestivum
  unsure (1)..(113): unsure at all Xaa locations
  Clone ID: PAT_TA_23961.pep
LGASLQNRWVAVRAAEPALCDPSVSGVAQVRTIPEEWLPGSWQTLEPSIPHMVSSRIVRPRPGAGATPNQXRGAMRPGHHSANPYMIDKSRRXLKSDGKPXYQLSLRNPFQLV

SEQ ID NO: 129544 - protein, 142 aa, Triticum aestivum
  unsure (1)..(142): unsure at all Xaa locations
  Clone ID: PAT_TA_23962.pep
AAKQKSEGFRGSERAGRKNHQGFRVLRTSGSARTAMDASPELQQFLEQEKHKMMMSEMVTKLTNVCWDKCITSTPXGSKFSSGESTCLTNCAXRYLDMSVIIAKRFEMQIRRLLTSAGCCVIKKFPNSKLPLNMPTMASFNT

SEQ ID NO: 129545 - protein, 532 aa, Triticum aestivum
  Clone ID: PAT_TA_23963.pep
MEAMRKKEATATACSEDNRKGVHGVSMNGLYDPWNPAYPPRDPSPCDADMAAHIASVKEWMDKTQAILANSRATNIIIPDRTPQFVNDVLFDILPALVPILEKDNVRSFLRFFNENGRAMSWGFIITPETLNQIIVSNAVRCAKVVLVGDDPELHGFRANPNCMTQYGYFSLHRAADMFSVDMIELLLRHGASANLRTSGDLVPADLLPLHVAVENTSMHKYLEDSLNPSQQRVDCSQADINYILKLIHILCLPEMKIFLDTTRLLAKHTDDLLDELCKYIVDGKIVHTAVLLLAAQKQIRGLSSCNGCGSSKKDGFGTITNFVVDNITAIKMRQNRLEMEPLEVKKELLDVTLNLVHVIFKAGEALDVYIRSHPKIPCVMEVAHAEVFEHVTLILKDHGFFSIGDGIDIGNLHPYRNVLSSQELPHKLAEMARIKAGLKVPCLRNGKPKVKKDPRGWELKFARRSFFQSQRSVLTSELSVKFFAHKEKTSDKSTGKASMFMGGTLQPKFNYQPRRMFGTVALTLLKALRKA

SEQ ID NO: 129546 - protein, 272 aa, Triticum aestivum
  unsure (1)..(272): unsure at all Xaa locations
  Clone ID: PAT_TA_23964.pep
RTRGRKALEIHREHSAPASLEEASDRRLMALILDAKGDYDGALEHLVLASMTMVANGRDVEVATIDVAIGNTYLALARFDESVFSYQKALTVLKSARGDDHPSVASVFVRLADLYHRTGKLRESKSYCENALRVXAKPAPGAAPDEVAGGLMEIAAIYEALGDLDEALKLLQRALKLLEDSPGQWSTVAGIEAQMGVLYYMICENALRVYAKPAPGAAPDEVAGGLTAIAAILALGDLDEALKLLQRALKLLEDSPGQLSTVAGIEAQMGVL

SEQ ID NO: 129547 - protein, 339 aa, Triticum aestivum
  Clone ID: PAT_TA_23965.pep
VPPAGTQVRIPGVRPHDRPGHGTVYKGVLKDNRVVAVKRSKIMNVAETDEFVQEIIILSQTNHRNVVRLLGCCLEVEVPILVYEFIPNGTLFEFIHRSYGSPPPSLDTRLRVAQESAEALAYLHLSMNHPIVHGDVKSMNILLDDNYMAKVTDFGASRTLPKDAAQFMTLVQGTLGYLDPEYLQERQLTEKSDVYSFGVVLLELITGKTAIYNDGPNEGKSLVRSFLLAMKEDSLEDILDPSIVRAGTETLLGEVAELGRMCLGPMGEERPSMTQVADRLKALRSTWREELVLDRAVTENMVVHMPPAAAPVPGDLASSSSGAPSTVPDMSGMSMEAPR

SEQ ID NO: 129548 - protein, 191 aa, Triticum aestivum
  unsure (1)..(191): unsure at all Xaa locations
  Clone ID: PAT_TA_23966.pep
MGGKVLLISAVLVGLVSLSSCRSLGELHEQKTHYGGSPTPTHGSGGGYNPTPTPTYGTTPTPSYGTTPTPTYGTTPTPSYGTTPTPSYGTTPSTPSTPSHDVPASPKKHGFIGSCDYWKNHPDAIVAAIGSLGNIGKTFGAACSMIGGKKLGNMHDALSNTRTDGIGALIREGAAAYLNXIVNKKFPFTTQ

SEQ ID NO: 129549 - protein, 150 aa, Triticum aestivum
  Clone ID: PAT_TA_23967.pep
NSHLFSSVAYSVVPVHVEDADSFLSAHTESRMGGKVLLVSSVLVGLVSLSSCTSLGEMHEQTTLCGGPPTPTDGYRRRLQPGNLHQYNVTTLQQSPSSRPLHRTPTYGNQNDPHLTPLNRPHPFPTTPTAPMIIESSAYTPSTTSDELQL

SEQ ID NO: 129550 - protein, 141 aa, Triticum aestivum
  unsure (1)..(141): unsure at all Xaa locations
  Clone ID: PAT_TA_23968.pep
PTVMASSATSVAPFQGLKSTAGLPVSRRSNGASLGSVSNGGRIRCMQVWPIEGIKKFETLSYLPPLSTEALLKQVDYLIRSKWVPCLXEFKQVGFIFPXAQRTPGYYDGPGIWTCXNCLCSGCTDPTQVINEGGRRPRRIP

SEQ ID NO: 129551 - protein, 51 aa, Triticum aestivum
  Clone ID: PAT_TA_23969.pep
LYTYSLRSILLIADLVQSNMERKEYMTRTQNQGRIFCSRKDSSFQFRLSIY

SEQ ID NO: 129552 - protein, 92 aa, Triticum aestivum
  Clone ID: PAT_TA_23970.pep
MGSLGPAVSVSMAKASGGTAAVGGRRQQQERGTFSCGFRMPLHYPRYRKADYEAMPEWRVDCLLREYGLPVAGDVEDKRRFAMGAFLWPSQY

SEQ ID NO: 129553 - protein, 94 aa, Triticum aestivum
  Clone ID: PAT_TA_23971.pep
MGSLGPAVSVSMAKANGGTAAVGGQKQQQKQERGTFSCGFRIPLHYPRYRKADYEAMPEWRVDCLLREYGLPVTGDVEEKRRFAMGAFLWPGQH

SEQ ID NO: 129554 - protein, 83 aa, Triticum aestivum
  Clone ID: PAT_TA_23972.pep
AWPRPTAARRPSAARSSSKPERGTFSCGFQMPLHYPRYRKADYEAMPEWRVDCLLREYGLPVTGDVEEKRRFAMGAFLWPGQY

SEQ ID NO: 129555 - protein, 367 aa, Triticum aestivum
  Clone ID: PAT_TA_23973.pep
PRVRNQLPDHLINRVRHALATPSQRRMKRLEAKLYISIYEKDDEGDQDILELAKLDFHILQLMHRDEIKSISLWYKDLNSGSALGEYIRERPVECYFWALGVFYEPKYAKARMMFAKLIKMFSFFDDTFDSYGTLEELRQFNQAVQRWDEEDARRIGKCYGYVMSNISSILNQFVEDGASAIGIACTKEIIKHVSRCMLQEVLWREEEQVPPVQDHLRITAISTFYWALASISFTGMDAGDDVFTWATSFPKIIENAAMVSRLMDDISGHECEKERSNVATAVDCYIKEHGVTVDQAKEALGRLVEEQWRSINEEFLTNTTVPVEVLTRVVNLARVMDCMYKKLDGYTHSSETADPIDKLLNSCVNH

SEQ ID NO: 129556 - protein, 252 aa, Triticum aestivum
  Clone ID: PAT_TA_23974.pep
MEQQKPERRVIGQLEDSKWTRYFLDAVQLPCSGQSQKMIKDRRDELVQKVCCMIKRYTSSKKDISKGMRAVDAIERLGVGYHFEEEVNKFMDVLIFTSIDENDLAGVALRFRLLRQHQYDIPCEEVLKSFKDEKGEHFQDDVQSDIGTLLSLYEAAHLAKCGEESLTDAIRFTTSCLSSLSGGNQLPDHLINRVRHALATPSQRRMKRLEAKLYISIYEKDDEGDQDILELAKLDFHILQLMHRDEIKSISL

SEQ ID NO: 129557 - protein, 233 aa, Triticum aestivum
  unsure (1)..(233): unsure at all Xaa locations
  Clone ID: PAT_TA_23975.pep
MDLATGAMGSLLPKLLELLGEEYKLQKGVREGVKSLEKEMRSMHVALRKVAEVPREQLDEQIKHWAGEVRELSFDMEDIVDKFLVHVGEGSEPAANSNKLRRLTKKMAGLFTKGKARHEIADAIKDINKQVQAVAGRRARYNVDITVANLPTVTSIDPRLGAMYTEATXLVGIAGTRDQEIMKLLSEGDDMSKKNLKIVXVVRFGGXGKTLLSKRLRXXGGDNDCKXLFLSSK

SEQ ID NO: 129558 - protein, 98 aa, Triticum aestivum
  Clone ID: PAT_TA_23976.pep
GAQIVMVFCNLFCYGMHGVRRQGRCPKLRQLHLQVHDGWGGATPLGMEHLLALEHIRVGVTSSVHKNSDVESALRRAADVHPTCPSVQMYLYDDRPSL

SEQ ID NO: 129559 - protein, 234 aa, Triticum aestivum
  Clone ID: PAT_TA_23977.pep
MRCPAGGASRISTPASPNPSQAWRRLQPRRLPRRSPSRRTPSTSAAACWRHGRGGGPPAARGAPQLVTPLRSLDHIVVARPSERGLSNFYAGTSKSFTSLAEAAARAAAKEIAKPENPFNKRRRVLAAWSRRRASCSSLVTTYLPPLLSLDHTVVEGDEEEEEERSDDGDDEDNGSGNGRREKAPASPRFPPRSLHSASQKASVMSRNTINPNTSSFRSPRSFSLSDLQNAGYN

SEQ ID NO: 129560 - protein, 149 aa, Triticum aestivum
  unsure (1)..(149): unsure at all Xaa locations
  Clone ID: PAT_TA_23978.pep
MATTAMALSPSSFAGKAVKDLPSSALFXGKARVTMRKDRGQRPSGVRPGTPWYGPDRLLYLRPLSRRPPXYLTGDSPGDYGWDTAGSPADPQXFRXKPELEVIHCRGASGPLRALPRTLPRNGQFWQAFVQGVXIFKQGGSILGTNFLS

SEQ ID NO: 129561 - protein, 183 aa, Triticum aestivum
  unsure (1)..(183): unsure at all Xaa locations
  Clone ID: PAT_TA_23979.pep
RSWLVPPPPSPSLPAPPDPHLLPHSRRRPAPTSSLTPGAARPPTSLDPRASTPASQRRLMSSAPEXRSGPSSSPHSAVLLHDHAAASGGGPESLASKLRQPWDPWGPLRGGGPPHPLLSSRLAPPSLGASARAGRLGSGRAAAPSCRASARQGAGSHARLPSSPAAKGWLQVVSLAENRGEFL

SEQ ID NO: 129562 - protein, 204 aa, Triticum aestivum
  unsure (1)..(204): unsure at all Xaa locations
  Clone ID: PAT_TA_23980.pep
APTSPRLPSTTKQTKTKEAKQPCARASATPWPPTTIPSPHPTCSTWPPPTTCPPSAGPSRTTTSPSSPHPRGTALRPRQPRPGPPTIWRSTSAPPPWSPRSTAAPPSSPTSSPSPPPRPPAPPPPTAPPRSSSPKPAATSPRPTPPPSSPPPARPPAPPPLSTAPAAPPDPPPAPPRSTHVPLPPRPLAPPPGXSPPASTIRAS

SEQ ID NO: 129563 - protein, 196 aa, Triticum aestivum
  unsure (1)..(196): unsure at all Xaa locations
  Clone ID: PAT_TA_23981.pep
QKTKVPPIHPYTCMVTTYTTQYSSLLAGGVDLLQEIFLFTYSHLLVPHRRRRCSWFPAPPPNHMTEKDTRASAKPDERTSPHTLIEVIPRSSEASYLGSEMSLFILATVAVIESILSKGEPEAILPVGFHPADLGAGLVNGGLRTEAARGEVGAGWSALRMGXGGGLGWGPGAWRAXXSXGGLCTXQTKRVVKWVR

SEQ ID NO: 129564 - protein, 154 aa, Triticum aestivum
  unsure (1)..(154): unsure at all Xaa locations
  Clone ID: PAT_TA_23982.pep
LFSVNTSGQFVGXAEMLGPVDFKKTMDFXXQNKWNGFFPVVWHIVKDIPNRLFKHITLENNDNRPVTFSRDTQEIGLXXGLEVLKIFKAYRHGTSILDDFDFYEEKENTRCARKGINADSLHEARLSYFGTDDLKSMGDIEANMESLNLHEPWD

SEQ ID NO: 129565 - protein, 70 aa, Triticum aestivum
  unsure (1)..(70): unsure at all Xaa locations
  Clone ID: PAT_TA_23983.pep
SGDXSAGASPGSPLGAGEGSGRSGREGGKRXPGGTGGVAREGAWRAAGATAPPFGVGDAGHARSVDPRSV

SEQ ID NO: 129566 - protein, 97 aa, Triticum aestivum
  Clone ID: PAT_TA_23984.pep
RPRGLEPPNQPPERSGVGAPPAPAQPPAGLRSVPAGGPSARVSVGPRAIGGAPPRARLPWSWRGVSSSRPLPCSGGGFSRRRDAGRRTKRTRNLNVC

SEQ ID NO: 129567 - protein, 85 aa, Triticum aestivum
  Clone ID: PAT_TA_23985.pep
SRMHACLCMRRPRRRSNDNPLIKYFTYVARSFFLVLSRNLCQIGRPHHVRTTEYTLVESCSYVLQASVYTFHDLGLLLLLLSSFL

SEQ ID NO: 129568 - protein, 370 aa, Triticum aestivum
  Clone ID: PAT_TA_23986.pep
MASAGAAIGARAARACDGCMRRRARWHCAADDAYLCQACDASVHSANPLARRHHRVRLPSSSSPAATSSLQHADPDEPAWLHGLKRRPRTPRSKPGMVGKHGAPATAKAAAASAVPDLEAEDSGSGIVGDNDEGHGVEVDDEDLLYRVPVFDPMLAELYNPVPVDEFREPLEQKPSVCCFSSLANQPSSEYASGVAEAADGFSGFDVVPDMELASFAADMESLLMGGVEEGFDDLRFLDEEKPQLNLDFDMADFDDQSTAAPAPEQELEDRKRKRSDSGMILKLDYERVIDSWAHDGGSPWFYGERPHIDPSDDSWLDLPAGSRGFGLGAAVTAVTGGEREARVSRYREKRRTRLFAKKIRYEVRKLNAE

SEQ ID NO: 129569 - protein, 409 aa, Triticum aestivum
  Clone ID: PAT_TA_23987.pep
MSCSGKAADGAMGSKAARACDGCLRRRARWYCAADDAFLCQGCDTSVHSANPLARRHERVRLRPTSPLLPGAAPREEAARTRTWSRAWFKRKARTPRSAGQERGSSCRTRPCGDSPEEQYCDVETDEEERLYRLPIFHPAIAEPCSTQSPEPPTKRAAKSSPVPIRIYPDQLVSLGPTDAELMEFAADMEALLGRPGMDDGDEEEPFCMEALGLIEPMDVDGGRVKLEIDPMRACGLEQKPEVSGDMFDIDFDYDSPLGTPDENAASSGASADAQFTPRSLALNLNYEAIMENWGSSPWADGERPHVKLDDCWPHDYYSLQEGAWMMGGVVGHGGEGLGTPRLRMDGGREARVSRYREKRRTRLFSKKIRYEVRKLNAEKRPRMKGRFVKRANGAGGGVPVAIATACVA

SEQ ID NO: 129570 - protein, 139 aa, Triticum aestivum
  Clone ID: PAT_TA_23988.pep
NNPDLAGDRRRTVMRPPQVLREGTKKTVFVNFMDLCKTMHRQPEHVMMFLLAEMGTSGSLDGQQRLVIKGRFAPKNFEAILRRYINEYVICNGCKSPDTILSKENRLFFLRCEQCGSSRSVAPIKAGFVAQVGRRKAGT

SEQ ID NO: 129571 - protein, 112 aa, Triticum aestivum
  unsure (1)..(112): unsure at all Xaa locations
  Clone ID: PAT_TA_23989.pep
SFVASVMYGYAIVVPAAFFFLFQYFGSRPSLIRFWCMWGYSLFIFVPASILLLIPVEFLRWVIIAGAGGASSWFIFLNLKECTXGADMMALIASASVLQFALALFIKVFFFA

SEQ ID NO: 129572 - protein, 279 aa, Triticum aestivum
  unsure (1)..(279): unsure at all Xaa locations
  Clone ID: PAT_TA_23990.pep
MADEEQMERKEEATEIAPFDPTKKKKKKKVVIQDPADEVDKLAEKTEGLSVTESGEASFVGLKKKKKKLVELDPSLLIIYVDASIVVLGPGEDILDDLVAEDEHGEGIVLGGASQYPWEGTDRDYKFDELLGRVFNILRENNPDFAGDRRRTVIRPPQVLRVGTKKSFFVNFMDLCKTMHRQPEHVMMFLLAEMGTSGSRDEQHRLVIIGRFASMNFDAKLRRLINEYAICNGCKSPDNINAGXNRLFFLRCEQCGSSRSVAPIKAGFVAQVGRRKAGT

SEQ ID NO: 129573 - protein, 200 aa, Triticum aestivum
  Clone ID: PAT_TA_23991.pep
FVYGSTSGGWRSALFVVVMEVASAFSYYGVSANLITYLTGPLGHSNAAAAAAVNVWSGTATLMPLLGAFVADSWLGRYRSIILACILYVMGYAMITLSSVLSTHHPSLPDDTSSHPLSLQVAFFYASLYIIAIAQGADNPCALAFAADQFDPDRPRECAARSSLFNWWYFSLAIGITISVGVVSYIQENLGWGIGFGMLC

SEQ ID NO: 129574 - protein, 157 aa, Triticum aestivum
  unsure (1)..(157): unsure at all Xaa locations
  Clone ID: PAT_TA_23992.pep
SSSETGAFELSSTPFPPPXWGTPXFFKXASTANWTSRPPPSAASRGLSVGETSEVILACTLSHVLLSPGSKDSGGLDRGQMRRPPSCVDPACVLCFSVLECLAWTVNLCSMFLCWKKITVGEAQEMTRLKEGRRSGSFSGRREGEGQRRRPGQHPAG

SEQ ID NO: 129575 - protein, 171 aa, Triticum aestivum
  unsure (1)..(171): unsure at all Xaa locations
  Clone ID: PAT_TA_23993.pep
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFXVKHNSSPGYYDGRYWXTMWKLPMXFGCTDANTSAQTKVEGGQRKEYPAPCPRIGFXNCASCTQRKQRVQLQG

SEQ ID NO: 129576 - protein, 109 aa, Triticum aestivum
  unsure (1)..(109): unsure at all Xaa locations
  Clone ID: PAT_TA_23994.pep
GSGLSGDGFALCRRXXRXXHTAGAAHGXXDXCXDFSGPVQVSLPTVVLCSPVGXPXXSLLDGIILGSCXAFAXNSDDSSXGIIGNVQQRTLEVLYDVGGGVVGFKAGAC

SEQ ID NO: 129577 - protein, 236 aa, Triticum aestivum
  unsure (1)..(236): unsure at all Xaa locations
  Clone ID: PAT_TA_23995.pep
MPHELNPVQSPVSSVIHSLMGEATATAEAEAPVSSWVVEMEKTIGEMHIDPAAEMARWKRHSIYRVPERIKNLHNSKAYQPELVSLGPFHHGDPELLPMEEHKRRAVVHLVKRSGRPLREFVAAVAEVAQQLQDAYKDLGDEWRGAAGGGTDRFVQLMVTDGCFLVEAMRMDALRGKVHEEYAPNDPVFSKYGYLYLWNYIQSDMVVRREXKLPLLLLQRLLIVLRSSQISRTLHE

SEQ ID NO: 129578 - protein, 214 aa, Triticum aestivum
  Clone ID: PAT_TA_23996.pep
MGSSRLNLEGFEPFIGPSLEHLLPQLSREERVRLQSQLGEHERKVKRWSKKCPPLPSTHSEGTRDSSIMPHVRHAIRHYNARHPGDEFDVVKPLMESNASFRNQLWVHVNFWARSRKSNKIKRFFAEVHYDPNPIVEVCIVIEEPLDKYRRSCAFCPANWDILHPVGSRKFLCGNDKDRIEQQLKPRVLSEYLGMPFTCCPASPIQEKKGKKKF

SEQ ID NO: 129579 - protein, 201 aa, Triticum aestivum
  unsure (1)..(201): unsure at all Xaa locations
  Clone ID: PAT_TA_23997.pep
TSYGRNGGPVDREGCGIPQNGGNGPPTVETGVLLIGRGEGVPQNGPPTVETGVLFIREGCWRTAKRTKRTSYGRNRGPVPREGCWRYRKTGLRDTVHLHRRPPPTSTGLPSTSSXPPPAPVHPPPLARPPTASGSPPPPLHGXPAPPPLLGHPPPPAAXPPSTAPPGPGHPPQPRRSLFGSHVIVTNSPGCNNNWIQGSQR

SEQ ID NO: 129580 - protein, 70 aa, Triticum aestivum
  Clone ID: PAT_TA_23998.pep
MVVAAAILPELATQLVVPVAAAVGIAFAVLQWVLVSKVKVAPEPRGEGGPAGGGAGAGGKDGASEYLIGG

SEQ ID NO: 129581 - protein, 135 aa, Triticum aestivum
  Clone ID: PAT_TA_23999.pep
MSEYKNVVGGKLKLKGKPLDVKEGGVKKKNKKKHRREESSQGEHSELREGGSSELPGDPDNEFSEADKLGEEGSAQADYDHLTPAERRYIEQKQKIDVHKLAKVADKSHRDRIQDFNQYLANLSEHYDIPKVGPG

SEQ ID NO: 129582 - protein, 339 aa, Triticum aestivum
  Clone ID: PAT_TA_24000.pep
PRPPAPRAWPGMQMLALAAVLVLGGLQFLPATHFRHPADRSRTWVPFDSSRHPQDLSHEVETVDVYSSISCLDLRTLAVLTNSTLSSSSDPHHVSFNFLIPEGGNDQVPYYKIKAVLPDSNITVTSQKKIKDKLNLATPEGNFFVSFPNELSPIVIARALSRTRYVYISADSIIKGKIEDLVRIDLGSYAVGASEDCSMRLGDYISMDVLNAVQRTAPRGVVHHTETFDKDACFLDFDVLLVEPRNIKRNLIDSIAFWTMAVKLANPRDSVMLAMTLAFYNDYLKLPTNWKRADANTDILYYDGPKNVCTEDGLQHQEKGSGEIWQQYLGPKSDSVLST

SEQ ID NO: 129583 - protein, 111 aa, Triticum aestivum
  Clone ID: PAT_TA_24001.pep
SNVQTRTQTQWSLHLRGLSVGAALTTLHVWMNDLYTTLQSGEELPPLLGIHTGEGRNMYSDKGLASVFESHLKELDAPFHGAPDKAGWFLTTSVAAKHWLEAKKSSKLVPV

SEQ ID NO: 129584 - protein, 119 aa, Triticum aestivum
  unsure (1)..(119): unsure at all Xaa locations
  Clone ID: PAT_TA_24002.pep
LANLSLHHKHVHGSISISLRGIFLSRTHLPRXPTHISPHDLEGISLSQTXPLASPCVMFSMCTLDFVLGGQTLWECAXGXXPRCKXXTTTRVXXLPFYPGMMXRCSKNKIKXQLRCAXP

SEQ ID NO: 129585 - protein, 132 aa, Triticum aestivum
  Clone ID: PAT_TA_24003.pep
MDAQRALLDALMGSSRDLTEEEKKEHREVAWDDPDVCAPYMARFCPHDLFINTKSNLGVCPKIHDPALKQSFESSPRYAAALPKFEADLAHRCERLVQDLDKKIRRGRDRLAQDVVELPPPAAHAEKVEQLS

SEQ ID NO: 129586 - protein, 57 aa, Triticum aestivum
  Clone ID: PAT_TA_24004.pep
SLATTQCYLLYVRGELPPTVPLLCWLICIKCTNVLVLCIMQRLSKKSSVPSLRSRTK

SEQ ID NO: 129587 - protein, 180 aa, Triticum aestivum
  unsure (1)..(180): unsure at all Xaa locations
  Clone ID: PAT_TA_24005.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFXKVGFIFREHNASPGVLRWPGTGTMWKLPMFGCTDATQVINEVEEVKKEYLTRMSAYRIHNMRKCSASAHRKPRAARIRKAKHSSHGHI

SEQ ID NO: 129588 - protein, 161 aa, Triticum aestivum
  Clone ID: PAT_TA_24006.pep
ISQSRSIIKPRFFFEEEGEKHPVIGQIMYPSSFSITCVYIFFVRKKEESMTFSKERTRYDAQLGSRLPAPATGVVAHARVEGVVVGVPAGSGRRHAGAPRHAPIGRSTTEERLPAVQPRPERRRRRRRPPRPLAGGSGREQQQQKDHGLKGRHAVRIYVCQ

SEQ ID NO: 129589 - protein, 115 aa, Triticum aestivum
  unsure (1)..(115): unsure at all Xaa locations
  Clone ID: PAT_TA_24007.pep
FXGGTSSXIWXEDFFYLKYXEGFVXYLLLYAIYGIXTPCTRVPVAAMKPRWGGTRGSGGLDGARGEARGRGYRVALRRHEERGDCITTWSGCHYSYPNPIADSYQANLLIQWWAQ

SEQ ID NO: 129590 - protein, 203 aa, Triticum aestivum
  unsure (1)..(203): unsure at all Xaa locations
  Clone ID: PAT_TA_24008.pep
MFHSIFPLPREDTRGGARALSQLAAMAPSCGAAVPYTLLGALLSGGSYAPSWPACGGRAFLRDYAQRGTNAMLWLGVLXAVTLVLLRRIAALLRLWALGSRLPGPPALLADPGLAAVCRAGGDITGYLSKLHGSFGPIVRLWLGPPHLLVSGPDPAPIKRRLSTAEAKLPRTGRPSSLAWAGLRLFFASSPQAIVPGRPCTYS

SEQ ID NO: 129591 - protein, 261 aa, Triticum aestivum
  Clone ID: PAT_TA_24009.pep
MAAMQRLVLLLSVAIAASAQGPAVAPAAPTTPTTPAAPAPAAGTTNITGVLAKAGQFNTFIRLLKSTGVAAQIDNQLNNSFGSGMTVFAPTDNAFTSLASGTLNSLSDSQKNALIQYHVLSTAIPMSQFDTVSNPLRTQAGSSSPGQYPLNVTAEGQQVNITTGVVNATVDNTLYTGDQLVVYQVNKVLLPMAIAGTPAPAPAPLAPTKTKEKTPTSTVADAPEAEASTDTSLAAPARIVTGGGVAVVHVLALLACVWWGL

SEQ ID NO: 129592 - protein, 104 aa, Triticum aestivum
  unsure (1)..(104): unsure at all Xaa locations
  Clone ID: PAT_TA_24010.pep
LVICTYRVQQNSRVIYVLIPCLFNWFAVITCCTSNVCMFIVTQLSGLFARHRLFNLYICVGIILFTSGHCIIHLCGMVNLHMNXMMMLKXNXGRRICSHXNXCI

SEQ ID NO: 129593 - protein, 117 aa, Triticum aestivum
  Clone ID: PAT_TA_24011.pep
LVPNSARAEAETGRIMQRSSSSLALVALLICCSLATSSAAAAAQGASRGIRVPAAPPSPKPRQPNRPGEEPVDPPPPPPQETSSGRARRTGKTLQAAANFLLINSMYMMNACSIRII

SEQ ID NO: 129594 - protein, 89 aa, Triticum aestivum
  unsure (1)..(89): unsure at all Xaa locations
  Clone ID: PAT_TA_24012.pep
RGRGAVIXSFRAHGDRAPLGIKASLTPNNMPPKSKAPSNRGPMPGLETYAQGKPPAPVQKPPASNGEKKKDKALRNKPDKNGKDTSTSN

SEQ ID NO: 129595 - protein, 73 aa, Triticum aestivum
  unsure (1)..(73): unsure at all Xaa locations
  Clone ID: PAT_TA_24013.pep
HVPFVYPVFXMYXSSLSRKGRKKSASTTDKLAVLDXXVQILTEYTPFQAIHFQLXXGKGTRMSQIANECPCTX

SEQ ID NO: 129596 - protein, 113 aa, Triticum aestivum
  Clone ID: PAT_TA_24014.pep
MSWTPQYDSGQHSATVGIRSKVKSVRRLEEFILVFTDEARREIKRYRNDKKPSNLLDYILQLILVSWLRLLSFASEECSKDSHARQLSCGGELLTIVWLMNQHRELKIVAKYR

SEQ ID NO: 129597 - protein, 167 aa, Triticum aestivum
  Clone ID: PAT_TA_24015.pep
LIPPQSMNSSMYMHQAMLETFFFSFIESKSKHGRKRGANGGSDLRLGVARTLDRKPRRSPATRSPKTPPPQRRRRRRGGCPSRGLHAGGDAARRGREGWPRGAAGSDAAAARGRGSAPRAGPPHRRRFFGWPRSRVVRSSAAASRASGEAERASGADARRCLTPDAW

SEQ ID NO: 129598 - protein, 362 aa, Triticum aestivum
  Clone ID: PAT_TA_24016.pep
ASWRQGMQHKNAISTATEGLIQAQLELYHHSLGYVKSVALRAATELGIPDAIHRHGGVATLSDIATETGIHPSKYSHLRRLMHALAVTGIFSVEGSDDDAGYKLTAVSSILVEGGESMCNLSPMVHVLVELLKLTMLCSIKEWFTDERASAMTLFEVAHGCTPSEMKAKKGTVGMFQAAMVADSNLVMEVVLKEHIGIFKGVSSLVDAGGGHGAAAAAIAKALPHVKCTVLDLPHVIAGAPTSRDVQFVAGDVFEYVPQADAILLKWILSMWRDEGAVKVLRRCKEAIPAGGKVIIFDGMVDSGTSQDVILKETQVLFDIVMMGVDGVERDEQQWKKIFVEAGFGDYKITPVGHRSIIEVYP

SEQ ID NO: 129599 - protein, 175 aa, Triticum aestivum
  unsure (1)..(175): unsure at all Xaa locations
  Clone ID: PAT_TA_24017.pep
FQLRSAGPEIRRRQALAMALAAVLAAVDGAQVATAGGRHTVGVPRGLWDKRTLHAGWVVARVFHPGDKITFASSTELLDVVEVGKAGYDAXSSANNVSAFRSGNEVVALTAVGTGSALCGLTGHCVRGMSSRTVLVAASTGPAAAPPTATAGGKSVADLGALVVTQALLGSISVW

SEQ ID NO: 129600 - protein, 135 aa, Triticum aestivum
  Clone ID: PAT_TA_24018.pep
MAPKAAEKKPVEKTPAGKKPKAEKKVPASKEGGDKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 129601 - protein, 148 aa, Triticum aestivum
  unsure (1)..(148): unsure at all Xaa locations
  Clone ID: PAT_TA_24019.pep
EGGSFFLPTRRYIFSQVNPPTRPDQTRPGNKRISSLLFSLSFYNHDRQRGEGRGEEATEINRRTAPLFITKKASNSIWINNNNISLPSSCLLFLAFRLPSFFQPVRLPLLIPPVALFLAGASVKIIIRATARIRIVVVVTRASSXLVV

SEQ ID NO: 129602 - protein, 59 aa, Triticum aestivum
  unsure (1)..(59): unsure at all Xaa locations
  Clone ID: PAT_TA_24020.pep
PRRQLCLSYRLKXGRNSEIRTHTIKRLRLGSLSLQRPFQPSKGXSSTXQLPAVNTMYNK

SEQ ID NO: 129603 - protein, 168 aa, Triticum aestivum
  unsure (1)..(168): unsure at all Xaa locations
  Clone ID: PAT_TA_24021.pep
LVPTPARDPIQSSPPTISPGNLRSERSEGSLVLLLKMQIFVKTLTGKTITLEVESSDTIDNVKAKIQDKEGIPPDQQRLIFAGKQLEDGRTLADYNIQKESTLHLVLRLRGGYADLCQDLTGKTXNLEVESSDTXDNVKXKIQDKEGSPGQQRLILPGSTPGWPHLAG

SEQ ID NO: 129604 - protein, 803 aa, Triticum aestivum
  Clone ID: PAT_TA_24022.pep
PCLRALYAEATELVGIYGKRDQELMRLLSMEGDDASNKRLKKVSIVGFGGLGKTTLARAIYDKIKGDFDCRAFVPVGQNPDMKKVLRDILIDLGNPHSDLAMLDANQLIKKLQEFLENKRYLVIIDDIWDEKLWGGINFAFSNRNNLGSRLITTTRIVSVSNSCCSSADDSIYQMEPLSTDDSRRLFHKRIFPDESGCPNEFEQVSKDILKKCGGVPLAIITIASALASGQHVKPKREWDILLLSLGSGLTEDNSLEEMRRILSFSYYNLPPHLKTCLLYLCIYPEDREIDRDGLIWKWVAEGFVRHGDQGTSLFLLGLNYFNQLINRSMIQPIYDPLGQVHASRVHDMVLDLICNLSHEAKFVNLLDGTGNHSMSSQSNVRRLSLQNKMEDHQAKPLTNIMSMSRVRSITIFPPAVSIMPALSRFEVLRVLDLSDCNLGGSSSLQPNLKGVGHLIHLRYLGLAGTRIRELPAEIGTLQFLEVLDLGCNHELDEVPPTLFKLRRLIYLNVSPYMVVPTPGVLQNLTSIEVLRGILVSLNIIAQELGNLARLRELQIRFRFASELASYEGFVKSLCNLHHIESLSISCNSEETSFELMDLLGERWVPPVHLREFASYMPSQLSALQGWIKKDPSHLSNLSVLFLDSVKEVQQLDVEIIGGLLSLRRLYIRSTHQTQRLLVIRADGFRCMVWFQLNCGSAAQIKFEPGALPRAEAVEFSLGVCMAKEDGNCGFDLGLQGNLFSLRQNVRVWMYCGGARVGEAKAAAAAVRHVLEAHPSHPRIYIGMIPDIAEDAHDDDLCEDEEN

SEQ ID NO: 129605 - protein, 872 aa, Triticum aestivum
  unsure (1)..(872): unsure at all Xaa locations
  Clone ID: PAT_TA_24023.pep
MQIVIGAIGNLLPKLGDLLTEEFKLHKEYKKNFEDLDKELESMNQALIKIGEVPDEQLDDQDKLWADEVRELSYIIEDVVDKFLVDVDGIQSDDNDHKFKGLMRRTIELLKKNIKNIQEQLQKVANRRDRNKVFIPNPTPPIAIDPCLRALYAEATELVGIYGKRDQELMRLLSMEGDDASNKRLKKVSIVGFGGLGKTTLARAIYDKIKDLAMLDAXQLIKKLQEFLENKRYXVIIDDIWDEKLWGGINFAFSNRNNLGSRLITTTRIVSVSNSCCSSADDSIYKMEPLSTDDSRRLFYKRIFPDESGCPNEFEQVSKDILKKCGGVPLAIITIASALASGQKVKPKREWDILLQSLGSGLTEDNSLEEMRRILSFSYYNLPSHLKTCLLYLCIYPEDSEINRDRLIWKWVAEGFVHHGNQGTSLFLLGLNYFNQLINRSMIQPIYDDIGQVYACRVHDMVLDLICNLSHEAKFVNVLDGTGNSMSSQSNVRRLSLQNKMEDHQAKPLTNIMSMSRVRSITIFPPAVSIMPALSRFEVLCVLDMSDCNLGESSSLQPNLKGVGHLIHLRYLGLSGTRISKLPAEIGTLQFLEVLDLGYNHELDELPSTLFKLRRLIYLNVSPYKVVRTLGVLQNMTSIEVLRGIFVSLNIIAQELGKLARLRELGICFKDGSLDLYEGFVKSLCNLHQIGSLIIYCNPGETSFELMDFLGERWVPPVHLRKFESSMPSQLSAMRGXIKSHLSNLSELILLSVKEVQQEDVEIIGGLLSLRHLSIKSTHQTQRLLVIRADGFRCMVDFYLNCGSATQIMFESGALPRAESVVFSLGLRVAKEDGNSGFDLGLQGNLLSLRRGVRIWMYSGGARVGEAKEATL

SEQ ID NO: 129606 - protein, 113 aa, Triticum aestivum
  Clone ID: PAT_TA_24024.pep
TPAIYAASIVSGDRCCDRVICSGDGGLHDVPAEQWKELRGGAGGGHRLPVRVRGFGGGLHAVVGRGARRRRHLQAPARPDSTDNFQMSSLMGQLPLKDGALPGLPRLRRPRLI

SEQ ID NO: 129607 - protein, 252 aa, Triticum aestivum
  Clone ID: PAT_TA_24025.pep
LNPSRPRRRRRPPQPSTPPPRRTPYASAAMDAATDGEQRRLLSIPKEGERVIAPTRRPDGTLRKEIRIRAGYVPQDEVAIYQSKGALMKKSGPDVTPGYDPALDAKPKTKAAKRNERRKEKRHQGGSTNDKGKSLDIEEADAGEPDKVHSSKTKQRNTVDSITEQISGIAISESPATATPSTNAANNLQTESSVTEIDKKIRALKKKIRLAETQVQGDPEKLKPEQLEKTKKIEGWREELKLLESTRGHAAS

SEQ ID NO: 129608 - protein, 78 aa, Triticum aestivum
  Clone ID: PAT_TA_24026.pep
KPEAKNSRSCRCITEHRESHNHSMCMTMGDKVHWWSHKHIDVHTKDMINKLRENNVKLSGLSQPNSQSILGHRSWLCS

SEQ ID NO: 129609 - protein, 64 aa, Triticum aestivum
  Clone ID: PAT_TA_24027.pep
TPLHLAVQSRNRDIPKILLVNGADQTRRTNGGKTPLDLSLCFGRDFNSYDLAKLLKLVPANRGV

SEQ ID NO: 129610 - protein, 139 aa, Triticum aestivum
  Clone ID: PAT_TA_24028.pep
PPVLLLRHEVVRQRRRRRQPLLLAAAASPLPATAASCATPTVTAALFVGRGVGPAGGGAFPVEALHEVPGKLSDVGLDDLRRDDVDDPLSPAGSWRPWAPPRGARSPYAAAAAAPAASTGSCRRRRRCCGRTRAPPLEV

SEQ ID NO: 129611 - protein, 188 aa, Triticum aestivum
  Clone ID: PAT_TA_24029.pep
SVVAAEVQNNRLFISDSNHNRIVVTNLDGEFICQVGSSEEGLLDGQFDTASFNRPQGLAYNFKKNILYVADTENHALREVDFVNETVRTLAGNGTKGSDYEGGGRGTNQVLNSPWDVCYAPSEETVYIAMAGQHQIWKHNTLNSVTEVFSGNGSEKNLNGSSPTNTSFAQPSGISLDPELRELFVADS

SEQ ID NO: 129612 - protein, 68 aa, Triticum aestivum
  Clone ID: PAT_TA_24030.pep
ASVASHLKVCRFNMLLLQFSPGTTVNSRVAFNNLNSVTQHTSKLRTWNVAIYICRLTLGLKPIWQRSK

SEQ ID NO: 129613 - protein, 165 aa, Triticum aestivum
  unsure (1)..(165): unsure at all Xaa locations
  Clone ID: PAT_TA_24031.pep
MEVAVPVMAPSAPCSPRTAAAMGGGGGSHLPSYCYFFSSAPTSPSRASSYAADEQGDAATFDFAFGFSGQLRESTPILAAADELFEGGRIRPLNGPRSSXRRLLADEDYASLSVSPRSPRRPGPSSAPRGRGAAEPPPAAPLGASGRRXWSXSSXCXSKRGHRLV

SEQ ID NO: 129614 - protein, 178 aa, Triticum aestivum
  unsure (1)..(178): unsure at all Xaa locations
  Clone ID: PAT_TA_24032.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYXDAYSASSDSQHRQVXCVSHRKQRAARSGRLNSHHTAH

SEQ ID NO: 129615 - protein, 126 aa, Triticum aestivum
  unsure (1)..(126): unsure at all Xaa locations
  Clone ID: PAT_TA_24033.pep
MCGFQSNLERFYGLSYLAVVKLPSVRCTCGGVRSKLLHKLVDVSLMPLCIGYHLLHPPCACYEAPPAPPPARHAPDRRRPRPGRSAHPXAXSLGNLXPTSXAQFAXAFGPXPXKMXHDKXXPXRXL

SEQ ID NO: 129616 - protein, 162 aa, Triticum aestivum
  Clone ID: PAT_TA_24034.pep
MKNSRASYRYKVPLWNGAAGEVASFATAFSFRITPDKDKDSPPQQPGGRMAFFLGHHPSVDVPRSSAGGGPAIVTVGFDAFLNHVGIDISSVNSTAPAHTTATWPGKNLTTSSVMEATVKYHNDSRTLAVALLIDGALYQANATVGLSRILPEEVAVGFSAA

SEQ ID NO: 129617 - protein, 80 aa, Triticum aestivum
  Clone ID: PAT_TA_24035.pep
VAMCNTIIQKSGILTICTNPKEKKTTCSLHRSLTTGQISSRDTIFWTSQTKPSHFKTLKQSYHHPQERLAQRKVTPFNPY

SEQ ID NO: 129618 - protein, 173 aa, Triticum aestivum
  unsure (1)..(173): unsure at all Xaa locations
  Clone ID: PAT_TA_24036.pep
VAEPRPSDRDRDRWSPGAIVCRRRRCCSCSWRWRWRPSVGRCGAQLPIPVRTDXFVFGGHAGCAGVWATRWIAEAFFDTXSAXDSATPGRRCKXPPXTKGPAAXPXRQLFRPLQKXLQGXRXXHXCXPKCSACSLLEXSHYKXVLXHXTSQNXXXVVPXYNNXPPSLGAXXGK

SEQ ID NO: 129619 - protein, 78 aa, Triticum aestivum
  Clone ID: PAT_TA_24037.pep
EMQKQESDLQSRYLSRLMSSLTLSSSLRPSIGFLLASSSQNNMQLTRQRKHQMKRSAVHQYDVRIESDPIGATKDALA

SEQ ID NO: 129620 - protein, 65 aa, Triticum aestivum
  Clone ID: PAT_TA_24038.pep
LRLSAYMYDHSWHIYTHREPPEPATGRDFTGDMPEIESTPLICRNYGLYGHYLPATPSLEKRKSI

SEQ ID NO: 129621 - protein, 104 aa, Triticum aestivum
  Clone ID: PAT_TA_24039.pep
MQDDRWDVDARATADAEQTTNAAGGADASAASLAALRTTRYGCRPKFHAEFAAFAERGGGAAVDIGVLVCGPSGLQASVARECRSQNLRRGGAVFHFNSHSFDL

SEQ ID NO: 129622 - protein, 156 aa, Triticum aestivum
  unsure (1)..(156): unsure at all Xaa locations
  Clone ID: PAT_TA_24040.pep
VNYRSPLSVILALVVGLVFWTQSINALKGPKITNKVYFDILHGDKELGRIVIGXLYGGTVPITARELSELWATGEKGGDLSFGRINLHPCHQRTSMIQGGVFTKGDGTXGGXPIYGDNSPDENFQFETPSERSLLATPEKYQWSSSFITLHPGPER

SEQ ID NO: 129623 - protein, 63 aa, Triticum aestivum
  Clone ID: PAT_TA_24041.pep
LSSSGASPLVMTRLQSDEPSMDASTTTTSTTTMSMTGRSIASMDSDGLTPSAVFSQIMHPDGR

SEQ ID NO: 129624 - protein, 249 aa, Triticum aestivum
  Clone ID: PAT_TA_24042.pep
ILLGTDDGGSTGGGAIIAKVADFGLSRIGPTLGATHVSTAVKGSFGYLDPEYFQTQQLTDRSDVYSFGVVLFEVLCARPVIDQSLDRDQINIAEWADRAHGCGKQGELAQARDPGQLGDIAPPWFPKTTETAEKCVADRSVDRRSVGGDLGNRVLAQEPQDSGDATGDSRRRSPTAAAAPALVVTGLGADRRTDSAHDGRRGRDATGADRASPTARSSPGSALAARDDDPPIHHLMHQSLVQSVGTTRS

SEQ ID NO: 129625 - protein, 162 aa, Triticum aestivum
  unsure (1)..(162): unsure at all Xaa locations
  Clone ID: PAT_TA_24043.pep
SFEGAAVTGRKQGGEGATAAMAPATSTSPLSRLLLSLPKPNAQPPLCAKPPSADSGAGATSKNLVLRRREAAAPSYPPSPHTRPPRSRPRQMSARXKRPSGLRFLRRVLRNRRPRPLKAVIXATTGGSGRTNGFNTLRPGSADTWCLGVIKVGXSPPXKGSP

SEQ ID NO: 129626 - protein, 82 aa, Triticum aestivum
  unsure (1)..(82): unsure at all Xaa locations
  Clone ID: PAT_TA_24044.pep
MSCCGGSCGCGSACKCGNGCGGCNMYPEVEXAAGATLLVXAATATHKASSGGMEMAAEXNGGCGCTQCKCGTSCGCSXCCSC

SEQ ID NO: 129627 - protein, 184 aa, Triticum aestivum
  Clone ID: PAT_TA_24045.pep
MVVYTQEHVYRHPWDRVTAAAWRKFTDPASRTALSHVADVHTLQRRVDTDAGRLQAARSINVRSPPLPFILRRLLPGAAGSPSGAASRPASDTSRPHAAPATPPSRTPDRGPPAASAHGPPWGPKRVAPPRPVPGLSGFPTWDRGWVWDGVATFTNMIRLFSKARWVTFLGVRGPVLLTSQKEV

SEQ ID NO: 129628 - protein, 157 aa, Triticum aestivum
  Clone ID: PAT_TA_24046.pep
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAGKRRRAAKAQSPKRRQSQKAHNEA

SEQ ID NO: 129629 - protein, 133 aa, Triticum aestivum
  unsure (1)..(133): unsure at all Xaa locations
  Clone ID: PAT_TA_24047.pep
LYGSPGLYPIGIQAHASALPGAAAAAQAERQQHQQQDAAVLAATPARARALLGPMPFLVGGDEEVSFGWPGSFRPPPPGAGVLPLLHSGPNFGSSSGSGSVVVQADEEPRPDAQTLAAIRYAXRPSAALIRTC

SEQ ID NO: 129630 - protein, 104 aa, Triticum aestivum
  Clone ID: PAT_TA_24048.pep
NTNGTPCVHVPVIISGVVVCTSIHASIRLQHATTTQQVGFVEHHDPKSKMPNSKRPRIIHSKTRISRPVTGHRLPYPPLPRARAHPGARLEAARAHPSATGRRH

SEQ ID NO: 129631 - protein, 117 aa, Triticum aestivum
  Clone ID: PAT_TA_24049.pep
KGFVKIAMETGSPLVPVFCFGQSLVYKWWRPGGKLIVKIARAIKFTPIIFFGKYGTPIPFATPLHLVVGRPIEVQKNPQPTYDEINEVHEQFVVAMQELFEKYKTKAGYDKLELRVL

SEQ ID NO: 129632 - protein, 149 aa, Triticum aestivum
  unsure (1)..(149): unsure at all Xaa locations
  Clone ID: PAT_TA_24050.pep
CGQKTAPWYKIAAAAEKLAQCQETMLILDRQLQTMRPPAESMGASPTRQRMEDFLQDAAGTTEGXSMPKKPSGQHDRDQEMLESGNVSPLNGYKTHMTPSDVDGSPSLSTNSSKRPKHRSRSSSSSSFANQLPEKQSRGFSRFFAKGKE

SEQ ID NO: 129633 - protein, 200 aa, Triticum aestivum
  Clone ID: PAT_TA_24051.pep
NGGCTRSYVVDLMKLSLRIGLFGGERLTWWSNLNFMPRGPPSLIIAKNESTLALGAQFTHRFAGDTVYRCSSFIMHSCQGRALGGAPMPNSKNSVVKIQASTHPSKLNPLAFVSSMADFPLIPLTCISNYDLARFARPALLATIGYKGSGVGLCTGVNWGPEKVEEGCGHRDEDVLGRTCRLDETKIGVKARWERNNRRG

SEQ ID NO: 129634 - protein, 146 aa, Triticum aestivum
  unsure (1)..(146): unsure at all Xaa locations
  Clone ID: PAT_TA_24052.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRXFIKNMITGTXQADCAVLTXDSTLGGFEAGNSKDGKPVNKLSLLLSGGQK

SEQ ID NO: 129635 - protein, 122 aa, Triticum aestivum
  Clone ID: PAT_TA_24053.pep
SCRIRHEEESRDNAQGPDNLNRLEELVVHACDQINWQGSIVLPTSLRKLTLYSPGCSMDNLVSCFRDLTSLTHMEIRFGRSLTSIPLDVWSSNLPSLGGSINYGLLPPCINKRLWSKQQQRC

SEQ ID NO: 129636 - protein, 391 aa, Triticum aestivum
  Clone ID: PAT_TA_24054.pep
PRVRLFTQKRLEALRPIREDEVTAMVESVHRAAAGPGNEGKPLVVRNHLAMVSFNNITRLAFGKRFMNADGDIDEEAQEFKLIVNNGIKIGASLSVAEYIWYLRWLCPLNEELYNTHNERRDRLTKKIIEEHAQALRESGAKQHFVDALFTLREKYDLSDDTVFGLLWDMITAGMDTTVISVEWAMAELVRNPRVQKKLQEQCISPHNIELDSVVGRDRVMSETDFQNLPYLMAVVKESLRLHPPTPLMLPHKASASVKVGGYSIPKGANVMVNVWAVARDPKVWSSPLEFRPERFLEESIDIKGSDFRVLPFGAGRRVCPGAQLGINLVASMIGHMLHHFEWSLPEGARPEDISMMESPGLVTFMGTPLQAVATPRLENEELYKRVPVEI

SEQ ID NO: 129637 - protein, 81 aa, Triticum aestivum
  Clone ID: PAT_TA_24055.pep
NNLSGPSLQHHFLLAGIRVPPSIREAKTPNLVGNWLLGASFKAQVMFLIRIDPSEQEATLEYVAKCGPICEKASSMVVQSS

SEQ ID NO: 129638 - protein, 93 aa, Triticum aestivum
  Clone ID: PAT_TA_24056.pep
SRGGIEAAPTCAKKLPEIMRRLPSGHCCAFSISQDNFLQFIELRAETCVLFLNISGINPPPMRSLNFRRILHLLNYFLQITMLGFTNARNAFK

SEQ ID NO: 129639 - protein, 158 aa, Triticum aestivum
  unsure (1)..(158): unsure at all Xaa locations
  Clone ID: PAT_TA_24057.pep
PLQLRRRRWRWRILGRGTPTTVWWAAATAGWPTPASPPSPPPRARAPASPVPTPPSPCPRPSRSRPRHXRPVPLASPPARCAAXALPARPQTPPTPPELAVGLLTGRVGLVSDAFHLTFRLRPALLLPLLPWRASRTKPDSTYTYGCSACSPPHRIDT

SEQ ID NO: 129640 - protein, 171 aa, Triticum aestivum
  unsure (1)..(171): unsure at all Xaa locations
  Clone ID: PAT_TA_24058.pep
PMTVIPCWATQSWRSVSLPMYPTPTCSPPSISYTVXDDPRCTRLLPSTGELQARPFAISGWAKHILVRCWLPASRLPGQLILRPFKAGNGPSSGAKAQXNXKTNLGETLNAMVGPGCCSMDIQVNQRXQPGNSRIKGLKVKKMKPNGIYXQFTHWENRLXXEXXDCIHTXA

SEQ ID NO: 129641 - protein, 86 aa, Triticum aestivum
  Clone ID: PAT_TA_24059.pep
MASRLRSFSRPVAAAFLRSASARSPAASLPRALAPTPRASSLGRQVALARSLQPLHSAISAARLTSRLGAEVARAVSQETGLSVPR

SEQ ID NO: 129642 - protein, 129 aa, Triticum aestivum
  Clone ID: PAT_TA_24060.pep
ARPGSSAAACTPGCRRPPHPCIVKVSRPGPRRRQQRPQGRRKAAVSTPRVGGRVEVPRVAPLEGGRGGAPLRLRRRRRGAPGRPRGLAPRLLLRRLREGRHARGPPHRAAVPVPLHPAVVHLPLSLGCP

SEQ ID NO: 129643 - protein, 194 aa, Triticum aestivum
  unsure (1)..(194): unsure at all Xaa locations
  Clone ID: PAT_TA_24061.pep
MKLNISFPANGSQKLIEIEDERKLRVFMEKRMGAEVPGDSVSDEFKGYIFKITGGXNDKQGFPMKQGVMHPTRVRLLLSDGHSCYRARRXGERKRKSVRGCIVPMDLSVLGFKXLNKGDNDIPRLTDTVNLNXMGPKRATKSKVFGSQGNDAPVRFPRPSNRKEATQQKSTLSDSARINSMLRQDTHTYNRTVQ

SEQ ID NO: 129644 - protein, 261 aa, Triticum aestivum
  unsure (1)..(261): unsure at all Xaa locations
  Clone ID: PAT_TA_24062.pep
RAEFGTRCSRSACFSFFSSPSRSPSSNPGAQRLIVGPGGRAVRLPPGPRALPASGHLHHLAGALPHRALRDLGRRHGPLMMLRLGELDAVVASSPDAAREIXKTHDASFASRPLTSMQQMAYGDAEGLIFAPYGDAWRQLRKICTVEILSSRRVQSFPPPREDAPRPPLRAAAPPPAPSSPAGRPVRVAPHGAVSTVRPILGGRFKQRDTYLKMLQEGLKIVPGMTLPDIFPSSRLVRLLSSVPGRIQRHSQGMKLFMDTI

SEQ ID NO: 129645 - protein, 93 aa, Triticum aestivum
  unsure (1)..(93): unsure at all Xaa locations
  Clone ID: PAT_TA_24063.pep
RAEFXTSGNGTQYTSKKKQIGGARRRSKAMEYEYHYNSSGSGSFAKEKRPPAKRGQVKLQIARALSNLVSPGGAVDGSKQANRNSFRRETSYN

SEQ ID NO: 129646 - protein, 170 aa, Triticum aestivum
  unsure (1)..(170): unsure at all Xaa locations
  Clone ID: PAT_TA_24064.pep
IREHGDTAPLFLAGDSAGANIVHDMXMRATSNDGSPRVEGAILLHPWFGGSKPVGXEHPAAPMVTGMLWSYACPGAVGGADDPRMNPLAPGAPALERLGCVRMLVTAGLADGLAARDRAYHDAVAGSAWGGTAAWHGSDGEGHVFFPPEKPGCDNAKQLIGPRPPRIAGA

SEQ ID NO: 129647 - protein, 170 aa, Triticum aestivum
  Clone ID: PAT_TA_24065.pep
MAELPLAGGLLDLRPGGKLSPKPPPPPLPMPCRRTPPRSQVAAAVASPCRAVPELHSTTELADGSVVFHFAHPPVKDRPEPTASGPDPGHADAPASPRPELRVEEPNPHTAADAGEISLASSEAPEQAARRVVKRRRVGNGRSPATATHTTDVTCAPEISRKAVRDRSDS

SEQ ID NO: 129648 - protein, 146 aa, Triticum aestivum
  unsure (1)..(146): unsure at all Xaa locations
  Clone ID: PAT_TA_24066.pep
MAACLSPTLPRQTIHRRRCWTTKPPSSPSTATCHQRHHHHKLIGTRYGAIYARASPADPVAQGLDADDFRHPLDKQNTLLLKAIPGLNDXGKALLGPVSEQVMVLQNIGSSVLVSENQLPELQXLMTEAAKILNTEHPILHTENLS

SEQ ID NO: 129649 - protein, 111 aa, Triticum aestivum
  Clone ID: PAT_TA_24067.pep
MSTAELAVSYAALILSGRMDSRSLPDKLQTLIKAAGIVDVEPIWSNLFAKALEGKDVKELLLNVGSGGGAAAAPTSGGVSAGAAVEEDKKEEEKEEEKEESDEDMGFGLFD

SEQ ID NO: 129650 - protein, 164 aa, Triticum aestivum
  unsure (1)..(164): unsure at all Xaa locations
  Clone ID: PAT_TA_24068.pep
EIEECQDGHENKRFVKFSCDNGRTQGTSASVFGGYAANGNGSTSEICPENQVEAKDSAIRRETEGEFRLLGRREAPNXXFNGGRLFGVEEAERVPSMGRKVSFTMEDSRXVSQCLTPGETSGYAVGEEEEXMMPYTDLHDIPGGGRAPALISTLLDHVNMLGLK

SEQ ID NO: 129651 - protein, 226 aa, Triticum aestivum
  Clone ID: PAT_TA_24069.pep
MAGKRERIAIRRIENLAARQVTFSKRRRGLFKKAGELSILCDAEVGLAVFSATGKLFQFASSSMNQIIDRYNSHSKILKKADEPSQLDLHEDSNCARLRDELAEASLWLQQMRGEELQSLNVQQLQALEKSLESGLGSVLKTKSQKIMDQISELERKRVQLIEENARLKEQASKMEMQVAADSPVVYEEGQSSESVTNTSYPRPPLDTEDSSDTSLRLGLPLYNSK

SEQ ID NO: 129652 - protein, 163 aa, Triticum aestivum
  Clone ID: PAT_TA_24070.pep
MKAMSGTKLLLVRQPSSKYGNGAVSPATATSISWRRFWLVAFLALFTCASLLTVFSTARAPSGAASPGVTFVAAGVGAGSVGGASAGGGALPAYVFDALVRYAAAAGANSTVSMPEEDVRAIASVLRRRAPCNLLVFGLGAETPLWRALNHGGRTVFLDENPF

SEQ ID NO: 129653 - protein, 191 aa, Triticum aestivum
  Clone ID: PAT_TA_24071.pep
LMVQGNPCPASRYHGGLDAFRKIVASDGLCGLYRGFGMSILTYAPSNAVWWATYSLSQKIIWSGIGCYLCEYGVGVQEIDDGDGEISLQPSCKTLMVVQGTSAAIAGGAAALVTMPLGIIKTRMQVMDGQGEPITIGRTVRELIKEGGWGACYRGLGPRWASMSLSATTMITTYEFLKRLSAKKGQESGVP

SEQ ID NO: 129654 - protein, 506 aa, Triticum aestivum
  Clone ID: PAT_TA_24072.pep
MAAPPAIPRRGLFIGGGWREPTLGRRIPVINPATEDTIGDIPAATAEDVELAVAAARSAFLLDGGSRWARASGATRAKYLNAIATKIKEKISYLALLETVDSGKPKDEAVADMDDVAACFEFYAGLAEALDGKQHAPISLPMEEFKTYVLKEPIGVVGLITPWNYPLLMATWKVAPALAAGCTAVLKPSELASLTCLELGAICEEVGLPSGVLNIITGLGPDAGAPIASHPHVDKIAFTGSTATGKTIMTAAAQMVKPVSLELGGKSPLVIFDDVADIDKAVEWAMFGCFFNSGQVCSATSRLLLHEKIAERFLDRLVEWAKNIKISDPLEEGCRLGSVISKGQYEKIKKFISTARSEGATILHGGDRPKHLGKGFFIEPTIITDVSTSMQIWREEVFGPVICVKVFKTESEAVELANDTHYGLAGGVISDDLERCERIAKVIHSGIVWINCSQPTLVQAPWGGNKRSGFGRELGEWGLENYLSVKQVTRYCKDELYGWYQRPSKL

SEQ ID NO: 129655 - protein, 106 aa, Triticum aestivum
  Clone ID: PAT_TA_24073.pep
VETPSHFRTNYTSVGSSAYLRIDCSRALILDGHGVLSGGVLPRCNLFAYPGASGFTLSVDCANLVGVWAPLVSAVNTVPTPRPSDRVSRLNAGAINPRKPRQRNRI

SEQ ID NO: 129656 - protein, 374 aa, Triticum aestivum
  unsure (1)..(374): unsure at all Xaa locations
  Clone ID: PAT_TA_24074.pep
MSSPQPPAAEPATPTAAEMSPPGARLAMMELAQMIAVPMAPTAVIRLGVPAAVWXGAAANAPLSAAEVLPPGHPDPSVLERLLRLLASRGVFSEHAADPSGGPERRYALTAVGRTLVPSGPSGASYADYVLQHHQDALVLAWPRLPEAVLDPAGPEPFARAHAGVPAYAYYGQDRAANEVMLRAXMTGVSEPFMQALLERVRXGGFEGVAVLVDVGGXSGACLGDDSAPSASPPASPVYGDLPSTVAAAPPSVSVKHVGGDMFKSIPSGDAIFMKWVLTTWTNDECTAILKKCHEALPEGGKLIACEPVVPETTDASTRTRALLENDIFVMTTYRTQGRERSEEEFRQLGLTAGFAGFRALYLDPFYAVLEYVK

SEQ ID NO: 129657 - protein, 104 aa, Triticum aestivum
  Clone ID: PAT_TA_24075.pep
QCILNLYVAPPPLQPKCNCLRNSKQKKKKKSLINKTTIHSTRPPPTPKCRSLLKEQQSTEQAAATRGSRSYPSMLSSMQCSSSPAGECSNTAASIHQQAKLASI

SEQ ID NO: 129658 - protein, 278 aa, Triticum aestivum
  Clone ID: PAT_TA_24076.pep
MENKLLQSQHCKMSNEDAVKHEVSFFNLGSKREKRISVRLDDGEKQTWCSASVVFISKGPLDVALLQMEKIAIEFCAIRPEFVCPTAGSSAYVVGHGLLGPRSGLCSSLSSGVVSKVVQIPSAQHSHLPSNVQTDNMGLPVMLQTTAAVHPGSSGGVIVNSHGRMVGLITSNAKHGGGSTIPRLNFSIPCKSLEMVFKYAANGDYTILEQLDKPNELLSSVWALAQAPSSLPFLSSPPGKSGEGKVSEFSKFLANQKEGLTSISDLEAFLKHKIPSKI

SEQ ID NO: 129659 - protein, 123 aa, Triticum aestivum
  unsure (1)..(123): unsure at all Xaa locations
  Clone ID: PAT_TA_24077.pep
MAPAVMASSATSVAPFQGLKSTAGLPVSRRSSSAGLGRVSNGGRIRCMQVWPIEGIKNSETLSYLPPSPRRXLLKQVDYLIRSKWVPCLQFNKVGSSSRGAQQFPPGNTTGQYWAMWELPIFG

SEQ ID NO: 129660 - protein, 186 aa, Triticum aestivum
  unsure (1)..(186): unsure at all Xaa locations
  Clone ID: PAT_TA_24078.pep
MEKGKSVVAELAASFSGVQVTPRRKATSTPPAASFYSPMKKARPRKLVSLCIGVLGQHLEDIINDISEFTAFFPPHIKLAIMSIARRRRLLNDDVLVSLVDSSWKILDISGSEVTDVGLATVARTCSNLWAVDISRCEKITPAAVSEIICHCPSLEILRCGGCSRSEFTARGCVNLLEPXIQETNL

SEQ ID NO: 129661 - protein, 84 aa, Triticum aestivum
  Clone ID: PAT_TA_24079.pep
AQITTLVITKGHSRSSQTTYVTAGQLKDQTASYSRNITKSIDGPDQQPMANGVRYISMPRWKPTSQLNQVSHPRRKPNLSCLHD

SEQ ID NO: 129662 - protein, 167 aa, Triticum aestivum
  unsure (1)..(167): unsure at all Xaa locations
  Clone ID: PAT_TA_24080.pep
CPARRTAAPWRRSSSPGTSSAAARRPPPGDDPRHDAAARHELRHARQANRLQEAPGARRRXARGDLNLFPASGAPLAPLPPMAPAADCAANNTYHSVCTXEKSRRAGAVQRRKQGQGNTHNNNTRRRRXAGAPVLSRHXLVNXRDPXLTSTCIPSGGIXRSXALMXA

SEQ ID NO: 129663 - protein, 132 aa, Triticum aestivum
  Clone ID: PAT_TA_24081.pep
LDPLSAAGRFRSLPVVSGPAQHSLVFFSIRPIFPTNSIRRSPPPCAPVVNPSRHCGKRTAPSWTPARLRRPWCSSLTPPARSRASPRSSAWSHAPTHVGCPQAGHPGPPTPLSPPSPPPVRPRLCLWSGDNM

SEQ ID NO: 129664 - protein, 72 aa, Triticum aestivum
  Clone ID: PAT_TA_24082.pep
TETDVQIQILPKHNHELGYITHTASDLVSCKIAATFCRTYLLLPYQSHYISSLKSSKAKKRDTWYVYVCLGD

SEQ ID NO: 129665 - protein, 85 aa, Triticum aestivum
  Clone ID: PAT_TA_24083.pep
GGIADAKSQGSPTIGRVAYKDGKQFYPNESSESPYFGSSVHYGGRDFYDSSPHKQADESSRNYKEDNADGSLATRGDWWQGSLYY

SEQ ID NO: 129666 - protein, 97 aa, Triticum aestivum
  Clone ID: PAT_TA_24084.pep
QAATCAQLRALPPPPRRPPPRPPKTPNPPPYPSSSPSFGSSPTPAPIGAHRRAPRPPAPPPAPPPAPPTDSSSASSPPPPRPRKLQEARRIYTCTRY

SEQ ID NO: 129667 - protein, 165 aa, Triticum aestivum
  unsure (1)..(165): unsure at all Xaa locations
  Clone ID: PAT_TA_24085.pep
MDASQGVLLSSALVGAGANGTPAWPELLGSAHWDGLIDPLDLTLRRLVLLCGDLCQVTYDSFNSDAHSKYCGTCRFSKGHALQAAGSSRPRADVPXAANXYATXXARGLPPXAMGESLSRQAXSKGPIVCTSVLSRRPAPCPGPVSTRAGTSATVVCQADWSPRC

SEQ ID NO: 129668 - protein, 125 aa, Triticum aestivum
  Clone ID: PAT_TA_24086.pep
TRQRWPHTLSLYSPLVTDPAGSSSPGKVRRCNVHVVVLGDGPYPLPARLDQRALPFSPKHRWRGSASHPFFLAAVVWADPASRRPPSDIPATLRYNFLRNRPRSTSRAPNVAAFVSFTSSLSLSL

SEQ ID NO: 129669 - protein, 140 aa, Triticum aestivum
  unsure (1)..(140): unsure at all Xaa locations
  Clone ID: PAT_TA_24087.pep
RPSGPGGAAGINTVSDCKGVXVHSYLSMKLSSXLANSAFRVFSGSPVFVACXPEMSLPALPVSPLSGSSEGISRTGNCKFSSLXVLQQIFVTILQAITCATXMFGSMLHKAGVGNDIYGLCDIDLKDFSLHFSPSPLSRS

SEQ ID NO: 129670 - protein, 98 aa, Triticum aestivum
  Clone ID: PAT_TA_24088.pep
SCVDSNRLHMICILSKDIKDTMHIVETIMSKGSTRCYIVQQRIYFGFNKGGRLISYGIGLHQAHLRILTKNCPPAWLLNIVNICVNGGHYTSKPWNEH

SEQ ID NO: 129671 - protein, 198 aa, Triticum aestivum
  Clone ID: PAT_TA_24089.pep
LLQGQIELDSSGYILVDEGTAKTSVDGVFAAGDVQDHEWRQAVTAAGSGCIAALSVERYLVSNDLLVEFHQPVREEKKKEIEGKDVEMGFDITHTKHKGQYALRKLYHGSPRLILVLYTSPTCGPCRTLKPILNKVIDEYDEYVHFVEIDIEEDPEIAEAAGIMGTPCVQFFKNKEMIRTFFGVKMKKEYREFIESNK

SEQ ID NO: 129672 - protein, 270 aa, Triticum aestivum
  Clone ID: PAT_TA_24090.pep
ISCTCLGDFATRALGGACSSLSGARLVKTIILYDNRGGTLIYESKEGEKAQFIKRRSIWLSEDIGRKPYAFMESLVLKGPSRPMTAHDGYWIIQTDVPVESSFEPEHHPEIPGRVLYLNDDFLDKPRGNLISIRGGLVNITSVTFSNAVRSSIRFLLCSHQDGSFTKVEGELILSVENYPFGFTIFKNQVEDDAVHFVRQSGTVFELPLTRHVLALPIGSRVHVLGTLKLATLKVLVDQYLVLDKNVAWAGWTVETGLYAAICIEASSFL

SEQ ID NO: 129673 - protein, 124 aa, Triticum aestivum
  Clone ID: PAT_TA_24091.pep
LKKYGSMLFQLTPKVLLVVLWGIVGRAGHKPTLGGSARLRYGSAKTEPACKPAATKIFFTCKTFVLVHCLDFLQQLNPCFGRQTVYIAQNETSNSLLFQEMVIVMKNKLSSMNSSTKIVTTEQI

SEQ ID NO: 129674 - protein, 113 aa, Triticum aestivum
  unsure (1)..(113): unsure at all Xaa locations
  Clone ID: PAT_TA_24092.pep
MEQVTKLAGQRAVVIFSMSSCCMCHTVGAPLPGPPGRTRREVDLDEDPRGKRRWGRRWRRXSGRNPGVPAGFNGGGGAGAPAKGQSPHPRGGHAPPGRNAGGVWGRIRRERIF

SEQ ID NO: 129675 - protein, 151 aa, Triticum aestivum
  unsure (1)..(151): unsure at all Xaa locations
  Clone ID: PAT_TA_24093.pep
SPQALLLYLLLIPVLLLLRATNRRSAGERAAADNHGGRPLPSPPNKLPLIGHLXHLVGPDPHVSLAALAAKHGDGGAQXLLRLRARRAPSSISSPRAAEAVLRTHXHIFASRPPNAFADALLDGGADVAFAPYGEFWAAGQXXWVTTHLLK

SEQ ID NO: 129676 - protein, 56 aa, Triticum aestivum
  Clone ID: PAT_TA_24094.pep
IKILELVRLLIWIYIKFEVLRCASAWALKRSLTRIQNTTSSRTFGAHNPSKIYRLH

SEQ ID NO: 129677 - protein, 235 aa, Triticum aestivum
  unsure (1)..(235): unsure at all Xaa locations
  Clone ID: PAT_TA_24095.pep
MPSPAYACPRPAPRPLAHVYLSAPRLAADAVPFAPRPSGSGAASGSPRPVPLQCAQLGASPGGSFVVGPSTPVRRVVPILGVPDALVPIDPSSPQINLLPGETTAVWVSLNVPCGQEPGLYEGEICITAVRTDSDSKADSLPKSERYQLYKELKTCLDITEYRDHSXSEEMILRXSSTSTTLREDASTSSIPRTAMRIMGLGDMMDEDVMNNVAVRVKLNLTVWEFTPPXTPSLP

SEQ ID NO: 129678 - protein, 206 aa, Triticum aestivum
  unsure (1)..(206): unsure at all Xaa locations
  Clone ID: PAT_TA_24096.pep
KLRLTTPSRPPPPPRSPMAPRRPTLGRTGRSRRGNSARASNPCGRSSSAPRRSWSPCGRRPGDSTSAPSSPPRQRARIPWWTTEEGPGTVPSGGQRGSSPARACRRRPGRHPRPPRRRASRSSSPQRQDSSEGAPGVRPLEHLDDYSRMPESRHXCAVTCGKXLSSYXSXPISHTWVCLKHQGMXTXLNIHAQXSXYTFMRRSXSX

SEQ ID NO: 129679 - protein, 116 aa, Triticum aestivum
  Clone ID: PAT_TA_24097.pep
RIGGGGCEEGNAPAHRGSARRRGAAQLGLDADELLTLMHGSDPVKVELNRLENEVRDTDRELGEAQAEIKALRLSERAREKAVEELTDELEKLDEKLKLTESLLDSKNLELLVLDR

SEQ ID NO: 129680 - protein, 90 aa, Triticum aestivum
  Clone ID: PAT_TA_24098.pep
LGIIFIRFKHVKFAHVFFNPNLCSETIDGVRYPLFAIYNKIILRQRCIMFHTREVNLNRNYLTDDFLLNDACTIADPSAYGCSDLPVDGL

SEQ ID NO: 129681 - protein, 272 aa, Triticum aestivum
  unsure (1)..(272): unsure at all Xaa locations
  Clone ID: PAT_TA_24099.pep
ARGSLRGFVHSKNLNSSSSITCSSDGEIILIKGEETYFFSTLCQDDIYRHVDSINMVYRKDRPLREESSCVVKSPKEKKKGLFGMIMKDTKGSKANESYANGNGQFIATTSEELASIFSSANFTPPSARRSSSLEDDENIELDIDDIDIEDNHTKAERTALXGLSKQKFSKGLQALRPKLKPRTEEKVNTENKKPEDEPSVRLVDPSQLKYGCPASHLSTTVPIILGGQLHVHICFLQGINLRSADMAHGAQSFSSMAKELLRTTKNEKSSS

SEQ ID NO: 129682 - protein, 194 aa, Triticum aestivum
  unsure (1)..(194): unsure at all Xaa locations
  Clone ID: PAT_TA_24100.pep
GGRVRREPDVTVALVAVARAWKAPATSPSPWPRLWQAPAAHGLAPVCSTRSSASRAHRRASGLWRRRRRRPPSACRSGRLLLVDAFGFGAGSGAACGRRGQAAGKDVLLFVLPRFTVDGVIPGRAAGRAVHGVGPPVEPTAIGPGHXDGKENSSPGRKPSTRLKRXGVRTANDPPAAPXWTLXQRRGITPXGFX

SEQ ID NO: 129683 - protein, 125 aa, Triticum aestivum
  unsure (1)..(125): unsure at all Xaa locations
  Clone ID: PAT_TA_24101.pep
ANPWTMKAGHPRPSLLWKPKHTSGLRPGNISRGAHARRPIGRLLGAKLHTTPVTSHWGAIPSFHKGGGIPACVTTQAPQDPSSEHAPNSARISNLLHFLXSRTTFANGLEPANPTHQPFALPKLE

SEQ ID NO: 129684 - protein, 67 aa, Triticum aestivum
  Clone ID: PAT_TA_24102.pep
MTVNVNMAGLPALVVPCGFVEGGSAGLPVGLQMIGFPFSEGNLLRVGHIFEQTLQDLSFVPPLLADA

SEQ ID NO: 129685 - protein, 69 aa, Triticum aestivum
  Clone ID: PAT_TA_24103.pep
WIMTVNVNMAGLPALVVPCGFVQGGSAGLPVGLQMIGSPFSEGKLLEAGHIFGQKMLDLPFVPPLVPDN

SEQ ID NO: 129686 - protein, 133 aa, Triticum aestivum
  unsure (1)..(133): unsure at all Xaa locations
  Clone ID: PAT_TA_24104.pep
LDSLPPSIDRERQIAREQLEEAPTSTPTVALATSPKPAPASNGRKKLPSRFRRVCVFCGSSPGRKPAYQLAAVQLGQQLVERGIDLVYGGXSVGLMGLVXSRAVXXGGGRXTGVVPRSVSRGKLIXETPAGKK

SEQ ID NO: 129687 - protein, 148 aa, Triticum aestivum
  Clone ID: PAT_TA_24105.pep
PLTLSSKGEEGIEWGAELSPLQRELYSWPWRPPPSPPTRSRSSPSSAPGPTASTSPPSRASAPTAASPPPPGRPPSRRRPSRRRRIPPPPPPTGPPLPLPLLRSPPPPLRSPRRGRRPSSRTRGGSTGTWDLSRFGTGGADWAVIDAA

SEQ ID NO: 129688 - protein, 50 aa, Triticum aestivum
  Clone ID: PAT_TA_24106.pep
VFSLMPFPLHYHDNDAFSVNLLGGVGRCALDLESVFATLLIIPLCDSEAI

SEQ ID NO: 129689 - protein, 76 aa, Triticum aestivum
  Clone ID: PAT_TA_24107.pep
SGPLATRTYLYLFAYTYTRELHEGSVGSVQPGDCRAYLLIAVLQKCATTLGLRLGGMEFQHHACRPSCRLGFSMYI

SEQ ID NO: 129690 - protein, 55 aa, Triticum aestivum
  Clone ID: PAT_TA_24108.pep
IIPSLQVTKEIAGQLIHITDCHYYIGILPLLHQMEWKAILSRAEERAPKGLQVFE

SEQ ID NO: 129691 - protein, 146 aa, Triticum aestivum
  unsure (1)..(146): unsure at all Xaa locations
  Clone ID: PAT_TA_24109.pep
GPWCVKAELLQFGGSARRXRSTEXLDTLDAFLFYCRRQRPETPPLPXPVVLPQVGGSGVALFDYSRGXPQFGADGLLIGPPLTAVMGVFTGPDASVGVGDLRRARSRLGLSYAKREDGKESLFGDESKVELDEVLVFCSARTGRRY

SEQ ID NO: 129692 - protein, 65 aa, Triticum aestivum
  Clone ID: PAT_TA_24110.pep
TAYAEGVHRQPAQCPDSPRSTARDTIGCLQACELSCCFVGDVDVVRDARWIHPFQGSELGQARQG

SEQ ID NO: 129693 - protein, 188 aa, Triticum aestivum
  unsure (1)..(188): unsure at all Xaa locations
  Clone ID: PAT_TA_24111.pep
MAMADQQQQIEHSHLAIRGLNLHVAQAGTGELGTVLFLHGFPEIWYSWRHQXLAVAAAGYRAIAPDWRGYGLSDQPPEPEAAVYRDLEEDLLAVLDALSVPKAYLVAKDFGAMPAYDFALRHPNRTCGVMCLGIPFLHGGSSFTAMPEGFYILRWREPGRAEADFGRYDVKRVVRTIYILFSRSEIPT

SEQ ID NO: 129694 - protein, 45 aa, Triticum aestivum
  Clone ID: PAT_TA_24112.pep
PTRPPTRPVEQQQQIEHSHLAIRGLSLHVAQAGTGELGTVLFLHG

SEQ ID NO: 129695 - protein, 194 aa, Triticum aestivum
  Clone ID: PAT_TA_24113.pep
MATVEQQQQIEHSHLAIRGLSLHVAQAGTGELGTVLFLHGFPEIWYSWRHQMLAVAAAGYRAIAPDWRGYGLSDQPPEPEAAAYSDLTEDLLAVLDALSVPKAYLVAKDFGAMLAYDFALRHPSRTCGVMCLGIPFLHGGSSFTAMPEGFYILRWREPGRAEADFGRYDVKRVVRTIYILFSRSEIPIAKEDQE

SEQ ID NO: 129696 - protein, 85 aa, Triticum aestivum
  unsure (1)..(85): unsure at all Xaa locations
  Clone ID: PAT_TA_24114.pep
RTRGLAARRTLAPLPNAPRSPQPPHDLAPSSLPPXPSPCSQLPPSHLRPSSAXPRLPPPPCYRRKPQAPASPSPDPPRNLSSSPV

SEQ ID NO: 129697 - protein, 106 aa, Triticum aestivum
  Clone ID: PAT_TA_24115.pep
RRMTLDSGGAYVTAHASADVHPSASSLFPSPIPSRRAAHPSPSPHHRARLIRARFGTSRHRWPHRQRRGGRRGGRAAWWRRETHVAARLHGGGRGDGSGETVADAW

SEQ ID NO: 129698 - protein, 226 aa, Triticum aestivum
  Clone ID: PAT_TA_24116.pep
GYRAIAPDWRGYGLSDQPPEPEAAVYRDLEEDLLAVLDALSVPKAYLVAKDFGAMPAYDFALRHPNRTCGVMCLGIPFLHGGSSFTAMPEGFYILRWREPGRAEADFGRYDVKRVVRTIYILFSRSEIPTAKEDQEIMDLADLSTPLPEWFTEEDLAVYTSLYEKSGFVYPLQMPYRSLHKRHPIEDPKFEVPVFVVMGERPVLLQFSYAGHCFHFLFLTYSCAFS

SEQ ID NO: 129699 - protein, 135 aa, Triticum aestivum
  Clone ID: PAT_TA_24117.pep
MGAAKRSGGEKGLLWRLPEVTSRELGKIGPAFGLGIGCGAGAGVGFFGGAGLGYGFPGLTLGFGVGAGCGIGFGFGYGLGKGIAHDEKKRHSNVGKMFQETPNLPKDTIAGLFDELVVNTKKLATATSKQIEKWH

SEQ ID NO: 129700 - protein, 94 aa, Triticum aestivum
  Clone ID: PAT_TA_24118.pep
MAMAEQRIEHSHLDIRGLNLHVAQAGTGQLGTVLILHGFPEIWYSWRHQMLAVAAAGYRAIAPDWRRYGLYDQSTVHKVVLTYPLTIFLKLACY

SEQ ID NO: 129701 - protein, 163 aa, Triticum aestivum
  Clone ID: PAT_TA_24119.pep
LCYILLLSVCWSILISSSLFSHLVIFTPFCQLPPIMEGDGLARPSTPIGNFRQAPSRSSSPYSDAFMAKIISRSKKVKRQLWLKLCLFCVLCMIDLILLASLQIQVIWLLQCILLRVYLFALIFSPFWSPRRGEKCHCSFECSHRLNGSIGWSNSVGLLQEDT

SEQ ID NO: 129702 - protein, 173 aa, Triticum aestivum
  Clone ID: PAT_TA_24120.pep
SSLVAKYDPEAKDPYLSGALATVLWELSLLQKHYDETVSGIASNILSMANLNATQNPVQLSSSNPLEAYKDLSMGRELSKPTHKVSQTLKCKRKRRSKEFVALSPDVLEKADCTVGEDELREKLQSHFAVLRGISENERLRTELNHALSSINMYKEYKKQKKVSKKSKKAAKA

SEQ ID NO: 129703 - protein, 270 aa, Triticum aestivum
  unsure (1)..(270): unsure at all Xaa locations
  Clone ID: PAT_TA_24121.pep
MAARTSLLLLLALAAVVAHVDGATVAAPAPAVDCSDALISLAGCLSYVQEGNTVAXPGGDLAAPGAQWDVVKKEVACLCHAFQGGQDEGVTLTSTKALQLPGACKVHAPPFSKCHISAPGVTGGSPAPAHAPSSGAPFFGGSPSPSTPSAESPAAAGTGSGDSTTARAPSPSASAVVTLRHSPRVLLAPPTRGACPRLAAPAGRGMPLFLRTPVRRPGDLFPCTRPTQLRKRRPSLVAGLLHVPRCILSESFHSIFIQIYYLYTFKTSCR

SEQ ID NO: 129704 - protein, 185 aa, Triticum aestivum
  unsure (1)..(185): unsure at all Xaa locations
  Clone ID: PAT_TA_24122.pep
MAASLQAAATLMPAKIGGRASSARPSSHVARAFGVDAGARITCSLQSDIREVASKCADAAKMAGFALATSALLVSXGASAEGAPKRLTFDEIQSKTYMEVXKGTGTANQCPTIDGGVDSFPFKGRQVRDEEFCLEPTXFNVKAEGIKKNEPPASRRQLMTVNYTLTNGRPLKSRQRTSVQEKADH

SEQ ID NO: 129705 - protein, 94 aa, Triticum aestivum
  Clone ID: PAT_TA_24123.pep
FFLPQKKKASNRRRRTGPKLSRSTHTRTIKVPCAIRPGPLFSFLIHHTENKTKKISSTSAASLTQPAMAAPAADFEAPPARRHRCTGSRRIQQR

SEQ ID NO: 129706 - protein, 67 aa, Triticum aestivum
  Clone ID: PAT_TA_24124.pep
ADAWADEGNYSPSFVLYNMSAGMAYSFSCEFFFSFLDKRSPAPNFIAEIACFVSDSLHVYAWLIILT

SEQ ID NO: 129707 - protein, 154 aa, Triticum aestivum
  Clone ID: PAT_TA_24125.pep
RAAHEALDAKDQELKAVLKKWDVKERELRELEELPDPSATNELAGFSSETTEGGIVGEMELPELQIDAAEVEALAATTALRKLADMTKDFFKHGKADSGIDLVASESQKISKCDPKMEVHKKTDVILEAEKEIVRLFSLTKQIVTDDTINNLEE

SEQ ID NO: 129708 - protein, 125 aa, Triticum aestivum
  Clone ID: PAT_TA_24126.pep
NCTEGHEKPGEQNTSTDAGVIVVVLGAGRVSQHAEGVVPRLIADHWWLVLDGCKTGWMDLAAGGRPSFNLARLVRMAATVVSPRGLGYGVKTVSRRTRTVRHGRSGWGSTVLSSLDLRDGATERR

SEQ ID NO: 129709 - protein, 123 aa, Triticum aestivum
  unsure (1)..(123): unsure at all Xaa locations
  Clone ID: PAT_TA_24127.pep
LCTFATRRRNLIVCKMLVVWAKKLCHAKKKKKXKKKKKKNXGGGPXPNXPXXGXXXNSXAXVLKXXDXENXXVTQIXXLGXXSPFXRGXXPKRPXPXXLSXXXATXNGXXAXXEGLNFXXKSX

SEQ ID NO: 129710 - protein, 152 aa, Triticum aestivum
  unsure (1)..(152): unsure at all Xaa locations
  Clone ID: PAT_TA_24128.pep
MASTHSSRRLDGTLFALLLVLAAATAFVSAAAARGDALAARHERWMAKFGREYTDAAGKLRRQEVXRRANARHVEAVNPSGQTGTYTLRLNHSPDLTKRKSRRRNTPGTPPTGQTPVAPVNSPLSIRSAGQRGLGPASPNQEQNRLSRGTEG

SEQ ID NO: 129711 - protein, 228 aa, Triticum aestivum
  unsure (1)..(228): unsure at all Xaa locations
  Clone ID: PAT_TA_24129.pep
KKINNNFIIASRTYFLHEGGSPDKDARERERRRRRLAGRSRGECRQRGGPPGXRAQHRGRCGRRRPSRQHGAAGEGPETPRRPLSIQETAARPTAAGGADRSRGRPNSHPWESGRRQGRMEAAGPERGAGCGRGRRWGGPQPHRQLQRGPPRTRAEEQPEETAGNRARGAPAGRPRARPGVERSTAVGAAGDAPAANTAPPGRGPRPQGVPFDPGDGSAPDGRRWRRS

SEQ ID NO: 129712 - protein, 105 aa, Triticum aestivum
  unsure (1)..(105): unsure at all Xaa locations
  Clone ID: PAT_TA_24130.pep
SKGWNAAALNDERSTKXXLALPHLNXGIQXNFXAGQSHKKXSXTGQGGAVPIPXXXSIXPKGXVXTXTGNRVXLXPXKPLHGXYXGAHXXQFPXGRDPLGIXGVX

SEQ ID NO: 129713 - protein, 227 aa, Triticum aestivum
  Clone ID: PAT_TA_24131.pep
MAASSPSALALSPSTRVVAGPSLLLAVKRTPATRVAAAPSGQLPACSWGPLRPELAPAPGPCAARCRAPLLRPRAWMSTSQIASSAFTLGTVAVLPFYTLMIAAPNASITKRTVESTAPYVALGLLYAYLLYLSWTPDTIRAMFASKYWLPELPGIVRMFASEMTVASAWIHLLAVDLFAARQVYHDGIKNNIETRHSVSLCLLFCPIGIAAHALTKVLAGSTGRSH

SEQ ID NO: 129714 - protein, 171 aa, Triticum aestivum
  Clone ID: PAT_TA_24132.pep
TLLTVVSQLPGCHKYCVGNLLRVRVPRITKWAIELLPFDITYKPRRAIKSQVLADFVAEWTEAELPKEYGAYSNWIMHFDGSKMLAGLGAGVVLTSPTGDTVQYVLQIMYTDSNNAAEYEALLHGLRMAISMGIQRLEVRGDSNLAISQINGDFDAQDPKMAAYRNTVLNM

SEQ ID NO: 129715 - protein, 167 aa, Triticum aestivum
  Clone ID: PAT_TA_24133.pep
MTIELYFTFGADRRAPEARHFTAATAAPWHQIDNRIKIFDHTGSLQFIKEFEKLYQVDWKPESPERFVDIAELTISLNGLKIEETKKQGQGSKSAQTSGKAPVNVATKPAGAYRPPQSKHTAALQDKLFGGLAPTGGEMSKTALRNKKRREKQKEKKAGEGSSADDS

SEQ ID NO: 129716 - protein, 111 aa, Triticum aestivum
  Clone ID: PAT_TA_24134.pep
PMYKYKMNGNEMLKKERKKDDKACFPYLYMGMSKRKPSQRRSLVWRSKALYQQRVSEITEKLVKPLFFSPVRVSLSTNLHVQNLNPLSTVPSAIKLFTLMIRSGFACASRL

SEQ ID NO: 129717 - protein, 86 aa, Triticum aestivum
  Clone ID: PAT_TA_24135.pep
SVMSCNVNVTIAFGDLGSKFRFTCEDKNPAIPSSAEQVPPSHGPSSAEQGMNDCGTQNFHVKYLGNINGASADGMEDENESLDPKD

SEQ ID NO: 129718 - protein, 107 aa, Triticum aestivum
  unsure (1)..(107): unsure at all Xaa locations
  Clone ID: PAT_TA_24136.pep
MAAAAAATAAPPATPSSRPLRMPPAPSTVHPQLRCHAGPSPSLLALRHRAARAAPARALLDKATPFNFGDGEGGTTATTNPAQECGVVAXFGGDPEASSLCYLGWQT

SEQ ID NO: 129719 - protein, 100 aa, Triticum aestivum
  unsure (1)..(100): unsure at all Xaa locations
  Clone ID: PAT_TA_24137.pep
SRRVRSCRRVRRARGDAGHGYPPPESCATQGSYFINCLRRGFXERCCAMVENPRCFCQVEREAEIRCVPGRSCPSRGIAKVVKIPEMHLSCMRNLKCKRA

SEQ ID NO: 129720 - protein, 139 aa, Triticum aestivum
  unsure (1)..(139): unsure at all Xaa locations
  Clone ID: PAT_TA_24138.pep
MKSLGSPCGDPLCPTLALNHPWGSLTHWGALVPCLGIPRGXHXFXRFAPSGRRDHCGMWLPGNXHRCFWNNTAYHDXHHQLRXSGYNFSQPFFVTWDRVFGTHMPYVDRGRQGPRCAPGAAHGLTYICRKIATRKHTSS

SEQ ID NO: 129721 - protein, 113 aa, Triticum aestivum
  unsure (1)..(113): unsure at all Xaa locations
  Clone ID: PAT_TA_24139.pep
MGRVIRAQRKGAGSVFKSHTHHRKGPARFRSLDFGERNGYLKGVRHRCHPRPGRLCARLXKVTSRNPFRYKHKKXSSFPAXGXXNGXFVXWGDPNNXPVXNFSXXSVPXGRVX

SEQ ID NO: 129722 - protein, 431 aa, Triticum aestivum
  unsure (1)..(431): unsure at all Xaa locations
  Clone ID: PAT_TA_24140.pep
PPPECRWEDPDWLWKHNIGVLELGILTAQGLLPMKTKDGRGTTDPYCVAKYGQKWVRTRTIIDSFTPKWNEQYTWEVHDPCTVITIGVFDNCHLNGGEKANGARDTRIGKVRIRLSTLETDRVYTHSYPLIVLTPAGVKKMGEVQLAVRFTCSSLFNMMTLYSQPLLPKMHYIHPLSVXIQVDNLRRQATNIVSTRLSRAEPPLRKEIVEYMLDVDSHMWSMRKSKANFFRIMGVLSPLIAVARWFDQICHWRNPLTTILIHVLFVILVLYPELILPTIFLYLFLIGVWYYRWRSRQPPHMDTRLSHAETAHPDELDEEFDTFPTSRPPDIVRMRYDRLRSVAGRIQTVVGDLATQGERLQSLLSWRDPRATALFVTFCFIAAIVLYVTPFRVVVFLAGLYTLRHPRFRHKMPSVPLNFFRRLPARTDSML

SEQ ID NO: 129723 - protein, 76 aa, Triticum aestivum
  Clone ID: PAT_TA_24141.pep
RDANQVRQLYAIDFHLVSSIWSMQQQHGTHLRNQLQSRKSASAAVLSQEIQRYEESQSSSTPEISRPPSRAPKAIS

SEQ ID NO: 129724 - protein, 194 aa, Triticum aestivum
  unsure (1)..(194): unsure at all Xaa locations
  Clone ID: PAT_TA_24142.pep
QTREHALLAFTLGVKQMICCCNKMDATTPKYSKARYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVXKNVAVKDXNXGLLHQSKDNLQGGN

SEQ ID NO: 129725 - protein, 237 aa, Triticum aestivum
  unsure (1)..(237): unsure at all Xaa locations
  Clone ID: PAT_TA_24143.pep
XAANTERPSLVVNNLFIGGALAARSKYTLQHLGITHILCLCSNEIGQSDTQFPDLFQYKNFSISVRDDANISDLFEEASDFIDQVDRVGGKVLIHCFEGKSRSATVVLAYLMLRKGFTLAKAWNLLKKVHRRAQPNDGFAKALLALDKKLHGKASMDWQQKRPEMKVCPICGKNVGLSTSSLKLHLQKAHRRLSQGSVDSAMTMEIQKSIESLRISRGGSLSPSQKLAKAFADELTF

SEQ ID NO: 129726 - protein, 170 aa, Triticum aestivum
  unsure (1)..(170): unsure at all Xaa locations
  Clone ID: PAT_TA_24144.pep
VNIQVAQAAKGAGVPVILDAGGMDAPVPRELLELVDIFSPNETELARLTGMPTETFEQISQAAGACHKMGVKEVLXLNLGSQGSALFVPGKEXPIRQAIIPATEVVDTTGAGXDTFTSAFAVALVEGKPKKECMRFAAAAASLCVRVKGAIPSMPDRETVMSLLESVQAE

SEQ ID NO: 129727 - protein, 181 aa, Triticum aestivum
  Clone ID: PAT_TA_24145.pep
RHEAEAKRFKANKSSDDNGSVRKDAEADSRNASKAVDQNPPPPKQDFIHVRARRGQATDSHSLAERARREKITERMKILQDLVPGCNKVIGKASVLDEIINYVQALERQIEFLSMKLEAVNAHAHAHNGVETFPTKDFAAPAYNTAPGLTFDPQTPREYAQGSPAAEWLHMQIGGTYERVT

SEQ ID NO: 129728 - protein, 162 aa, Triticum aestivum
  Clone ID: PAT_TA_24146.pep
LSNSLYDFTYGCRKRHQPTSEERAPNSIPGLIPQRGTPRTYQKHLSLQPPEHRGGIPPGIRLVTRLTTFNVAGNLLSGPVPTLLQKFSSSNFAGNQGLCGSPLDECSTPRRRWRPIRIRLHRINDQSSIGAAVGFVVGFVVAFYFPHCFVCSERLRAYVVRI

SEQ ID NO: 129729 - protein, 161 aa, Triticum aestivum
  unsure (1)..(161): unsure at all Xaa locations
  Clone ID: PAT_TA_24147.pep
LTIKASLPAAACRLAAIPPGGQPRTFPSCAAPGRRLLPWSNQGEAIPREGNVVIYELWAITLAMGARAMKLADELASSQFQARPTSRFPPSEPTFVILFLQRSALGHHLPPIVASAPVSSVDSPRPLSAPSRHHSTSIVHTDSPGPIFNLLRAASPRPXDN

SEQ ID NO: 129730 - protein, 130 aa, Triticum aestivum
  Clone ID: PAT_TA_24148.pep
PTPSHCSSPERTPRLTLGTESGLPARPRRVLLAPHSTCYVAPRSPTAIPRNPSRRHHRLLSSNKCVAVRRCPPIGKLRPCWHRPLTPCPPLCQAALSGDYAEVQDHTVGRKKECSWLLAGDFSGVTALAL

SEQ ID NO: 129731 - protein, 105 aa, Triticum aestivum
  unsure (1)..(105): unsure at all Xaa locations
  Clone ID: PAT_TA_24149.pep
XMTVCRGXXHLMRIXXVQXSIWFLAKVMTGTHLXGSAVHQNMVPLISYVPHXHRGKVGPSLFKPRIXLKKFGRXYQAQRVMIDSCLVNGRRLTVGQRKIPSEHEE

SEQ ID NO: 129732 - protein, 102 aa, Triticum aestivum
  Clone ID: PAT_TA_24150.pep
ELVHTRRRSNTFFNDLKTIWMGDLRSKDSLDSSDSALPAECVAENWFTLAAEATPSSMTSRPLCMPSRTFESCVLSKQNHTHRSLMPPSYTRHGSVLPVLLI

SEQ ID NO: 129733 - protein, 178 aa, Triticum aestivum
  unsure (1)..(178): unsure at all Xaa locations
  Clone ID: PAT_TA_24151.pep
MANQGSKKIVERNREAHGIXLWRIILVSNVIYIVVRMAVMYSSFTWKXHWIGRVVTCAVYFLLHTQLASMTKPEYSDADNRELLSSGYDLATGGLSEYIEDVIYITAFVQLTSIISGKFWWTYLVIPAFGGYKIFFLLKGTFFGGGSEGEVEDEKSRKKREKMEKKASRGKMVKTRTR

SEQ ID NO: 129734 - protein, 121 aa, Triticum aestivum
  unsure (1)..(121): unsure at all Xaa locations
  Clone ID: PAT_TA_24152.pep
MVLYTRLGDQIRSLGSRRPARARRTPAAPGRAPRTRPCRCRPRRAACTRSGRLRGSLSRSPRRGRRGWRRRSTPCGRPPARTPPCATPPRRRRRAPXXSLRGACTCTRLRAPRSRFSGTRR

SEQ ID NO: 129735 - protein, 221 aa, Triticum aestivum
  unsure (1)..(221): unsure at all Xaa locations
  Clone ID: PAT_TA_24153.pep
ARSNRPASPQTQNGTFKKVTAPSWRRHLGFHPGAGEGGGGGGEPQCCLQEGEHRPKRHRRGGRRRRPRGYPRFRPPHTKSTQPTAGSVRIRPDQTRKTLMQANGRNXRSGEAGHRGXLRPTHRSTTDSPPMQPRGGGHSSSQRRRDGAAHTTRSPPGTLGPFPRKNRGRRPRRRXSTTAWACRRLPPAAAREDAKGRRWRRRRTEGPRGAPGGRRAGAGRR

SEQ ID NO: 129736 - protein, 267 aa, Triticum aestivum
  unsure (1)..(267): unsure at all Xaa locations
  Clone ID: PAT_TA_24154.pep
SLFPLFPSHFPHLHSQRNCCVHGRRWRRCTAGSCCEASVVRALRCCRRRHSRARLCKLRVLQGRGSLLLASTSCSKGWDNTGDTVCHNSQKPRPFFCKVTRNIGCYSLRSVAGAPSRLRAALRSYSRDAGRKSPRNDPRRLGARPAFGPPPLRRPRPPPPRSVRPAAGSTPEQPRPPPRPPVKSHLLPVLWSGGGRPRGAPIHPPHWPPWSSPCXGSPPLRRPRAPPPRSXAPSPDPPPRPPTKCRLWLVLRPGRIIKLQGPFCKNE

SEQ ID NO: 129737 - protein, 106 aa, Triticum aestivum
  unsure (1)..(106): unsure at all Xaa locations
  Clone ID: PAT_TA_24155.pep
DXTGRRTIDYSNXKESQDXLNAAWARRRARTVLDMMDPSMNASFSGGGAAGGIHIGLLCVQENPADRPLMSSVVMMLGSDTVPLSAPSRPAFYAQKASDNLGIAST

SEQ ID NO: 129738 - protein, 135 aa, Triticum aestivum
  Clone ID: PAT_TA_24156.pep
RRLPPVEQDCTAHVSKEEHAQEQHSLDQEDKAQSNTLDLVVHPENQPLLDANQLGKEALSGNVLPPVDVGALVSANIGPADHGQPCSNPEAPPPKLCGFVVSRTPRSAQLIQEMQKEGALLFAVQQVMTEPGSVV

SEQ ID NO: 129739 - protein, 92 aa, Triticum aestivum
  Clone ID: PAT_TA_24157.pep
ELYCCMYHRSCLDDNLFIFSYCRRISAEDTTRAAGYLGAYHQLICANNIRVRFRYIHKWGYLFIVDVHRCTYTTDMLICPVGWAPDSMIRVI

SEQ ID NO: 129740 - protein, 179 aa, Triticum aestivum
  unsure (1)..(179): unsure at all Xaa locations
  Clone ID: PAT_TA_24158.pep
MDALTLTSLLKAAAAAFPDRRAIAVHAKIDLTHAALDALVDAAAARLAAGPDGLRPGQTVALCFPNTVELVVVFLXAVIRARGVAXAPLNPAYTQGRFEFYLSDSXARLLVNGAAGNAPAQAAAPSSAPPGRPPRSRRRRAARTARRRNPRADHGPHIKRRRASTCLFTRTTAARRNAR

SEQ ID NO: 129741 - protein, 153 aa, Triticum aestivum
  unsure (1)..(153): unsure at all Xaa locations
  Clone ID: PAT_TA_24159.pep
SRTASMASLMAPMAGAFFLLMDPRDMLLYTSTAVIGTCTGAITSVAVSATSELFGTKNFGVNHNVLVANIPVGSLCFGYLAGFLYQREARGANRCVGPACYRDTFLLWGLTSAVXGTALCAALYARSRQEERRLQTGFSGTQGVTLSAHDSSE

SEQ ID NO: 129742 - protein, 246 aa, Triticum aestivum
  unsure (1)..(246): unsure at all Xaa locations
  Clone ID: PAT_TA_24160.pep
MDTSASPGPSSSAPEPRQWAGGRPGLGSAALELACKVLCVVATCAFAAVGSLVGAVSGSVIGLATESGVVRGAGIGAISGAVFSIEVAESSRDLWHTSDSSVWSVLFMVDIILSLLSGRLVREKVGPAVQSAVQSQISAISSPFTEPSDLFETGGARGLPAHALRRLPAIKVGADTAVDEAGEALCCSVCLQDLXVGQSARRLPGCRHVFHAPCIDRWLVRHASCPLCRRDICARPGTVGRPIPCL

SEQ ID NO: 129743 - protein, 194 aa, Triticum aestivum
  Clone ID: PAT_TA_24161.pep
MSDNSIQRALLPENPDANVLQRKPSQGAKRFRRCRSAPRSETDEKPQENGSSLPAKELFSVVRPSFRLVGFLLFLYLLAGVVVFYLVMDQLSGKRTNRVLDALYFCIVTMTSVGYGDLVPNTDTTKLLACVFVFTGMAIIALFVSKSADYLVEKQEVLFFKALHMNMKCGEAKMLRQIETNKTKYKFYTAALLL

SEQ ID NO: 129744 - protein, 137 aa, Triticum aestivum
  unsure (1)..(137): unsure at all Xaa locations
  Clone ID: PAT_TA_24162.pep
VPPNPQSGEVPXCPHPRKFWFXKGPXSXNMVQXFWXNPKRWFPKKPPKGVVPNREHFRFLSQKIPKSFQNDSGILQELLGMCRNQFDLMVYPETTFRYHRNLSDDLSLRYDSAVRNFSVSETFSVIFSQTPCLVFSR

SEQ ID NO: 129745 - protein, 324 aa, Triticum aestivum
  Clone ID: PAT_TA_24163.pep
AEIAPQNMRGALGSVNQLSVTIGILLAYTLGMFVPWRILSVLGILPCSILIPGLFFIPESPRWLAKMGKMEDFESSLQVLRGFETDISAEVNEIKRSVASSRRRTTIRFAEIKHKRYSVPLMIGIGLLILQQLSGVNGIFFYAASIFKAAGLKNSNLATCGLGAVQVVATGITTWLTDKAGRRLLLIISATGMTISLLVVSVSFFVKDNIEEASHLHFVMSMLSLAGLVAFVLAFSLGMGAIPWIIMSEILPVNIKSLAGSTATLANWMTSWLITMTASLMLNWSNGGTFAIYAAVSMGTLLFVCLCVPETKGRTLEEIAFSFR

SEQ ID NO: 129746 - protein, 134 aa, Triticum aestivum
  unsure (1)..(134): unsure at all Xaa locations
  Clone ID: PAT_TA_24164.pep
STWGTVLFIFHLDMKAGQLRRGVAIMQRHSKLCVSTSTCMFGVQDGANLPNDLLQSLFLAYAPFLTSHFVPSCRSWRVQLTYTHPNQLSTFPAPPQPTFCQVXTXSTMARTXXKNFXNKQSRLIQCXNSTXLRL

SEQ ID NO: 129747 - protein, 56 aa, Triticum aestivum
  Clone ID: PAT_TA_24165.pep
FFFFDHYVTMTFRTRQHTHSQCIIARREHNVMSHVNLHAFAPDLRHQLHLPTDRIL

SEQ ID NO: 129748 - protein, 142 aa, Triticum aestivum
  Clone ID: PAT_TA_24166.pep
MALAATPRQRSAPAVLVAAALLSLSLSLSCAQAQAPHVAVPPSAPPKAAAPGPAAGLSAACLNSLLNMTDCLPYVQAGSKARAPDKPCCPELAGMAGSNPVCLCELLSGAADSLGIAVDYARALALPGVCRVATPPAQHLRR

SEQ ID NO: 129749 - protein, 117 aa, Triticum aestivum
  unsure (1)..(117): unsure at all Xaa locations
  Clone ID: PAT_TA_24167.pep
LLXXGRSREPPGXSRFVRERERKGGCXRGVXTAVVCARPEEGEAAGXCRRCCRRESXRRPGVQISPSPRGQPEAVDRRAAPRLPLAFDSDAHCRCAITAPGGDRGIRPRAPQLGRTN

SEQ ID NO: 129750 - protein, 625 aa, Triticum aestivum
  Clone ID: PAT_TA_24168.pep
MASSPQQGQGQAQGGGGGGVCPAEQFWSLLDKADRRFARVRDLPLFGRQEPAEYGKAFRIYTQLWRMQQEHRHRLLDAGLRRWQVGEIAARIAHLCYSQYQRASDTALLSEAFVFYHAVLDRAYFLDDHLGASTKHLRFLARFLLVALILSRRAQTVPRLAGQIRSLPAVSKKTLQEADYREWKHVVQEITRFLKADSPFMNKRPLRYSYAFDPPPETLPTIPPTVKKRGLLLSDAILCSYYHNEVKFTDLTLDTFRMLQCLEWEPCGSFAQNNGYSAHDESGQNHPNLLKDLRDAALPPNPLKTVLYRPSVPHFLKVLATKCEELPLNTMMLIYLSAAGEVGSSGLGPDTSERVVNSFSQFDISNTRAITSKEDKEPCLWLGCREGEGSNCIYPCDLIPFTRRPLFLVIDSNISYAFKSIHGAEKGETAAMLLSPSSRSCAVGFSGDSTRQSGSQFTMFLTAPLQAFCFLIGNNGLDIIDKDYNKAEELLSLSLNEWAMTLVASSSLDPAWVEVLGDPLLRRLLLRFIFCRATLSLFKASNDKAECLPSCVPPLPESVGGESMLSQCCVMRVASFLGAADQFSFAEVTTWPDIDDPPAVEVPTKSYEEKIHRPYHGPISPRSRS

SEQ ID NO: 129751 - protein, 128 aa, Triticum aestivum
  Clone ID: PAT_TA_24169.pep
RAQISQMAGKPSGVKYADARRGKASGSTGRNPPPNAPTPAVPGPMSNAAILDRYKVLGAQYVRRTEAAGGLTILLEIGKAGPDGNLTFMSLARAEANLVHVLLKRGPGLRSLDQTTQGESRSPFRLCT

SEQ ID NO: 129752 - protein, 96 aa, Triticum aestivum
  unsure (1)..(96): unsure at all Xaa locations
  Clone ID: PAT_TA_24170.pep
LKPESLANGSVTWVGWSRGGAHPATFGXGEISLEESLGRAQTGRTCLYQXPKSTTCFLFAREFAXXSALQPLLVLAPHCAGLWLMCAFNRCPPCKF

SEQ ID NO: 129753 - protein, 238 aa, Triticum aestivum
  Clone ID: PAT_TA_24171.pep
QMESAVRRSTGKNQDGSEVFDWFEKYVLRSKLDVSIDHLELCSLLSHGGDARDKHITLLMNAGLLTRQLIDPNMYWFSIPSIGPILKGLSQGRKEVLSLLGRRKYKEMLLSSLEKTRLRLSPLDVRFHLRDLIGSGHVKTVQTPTGLLARRSTDPWTLLWCSAAASRCPASSAGHAAFRRGRQGVVTAYLIGSPGSRPGLLLGGAPDVLSWLVSCSCAGPDICISCCPVEFPKKKKKK

SEQ ID NO: 129754 - protein, 142 aa, Triticum aestivum
  Clone ID: PAT_TA_24172.pep
MTESPRHLRNPLLVLLFLAAAAAAASAAPAVQIAMAAEPEQAPAAQEAAVHIVYVDRPEDADPEEFHIRTLAPVLGSEEKARGAVLYHYKHAASGFSAKLTTEQVEDLKKQPGVLQVVPSQTYQLHGNEGGHASTTRTMGLM

SEQ ID NO: 129755 - protein, 139 aa, Triticum aestivum
  Clone ID: PAT_TA_24173.pep
MKTESPRHLRNPLLVLLFLAAAAAAPVAQIAMAAEPEQAPAAQEAAVHIVYVDRPEDADPEEFHIRTLAPVLGSEEKARGAVLYHYKHAASGFSAKLTTEQVEDLKKQPGVLQVVPSQTVQLHGNEGGHAKTTRTMGLM

SEQ ID NO: 129756 - protein, 108 aa, Triticum aestivum
  Clone ID: PAT_TA_24174.pep
MAAEPEQAPAAQEAAVHIVYVDRPEDADPEEFHIRTLAPVLGSEEKARGAVLYHYKHAASGFSAKLTTEQVEDLKKQPGVLQVVPSQTFQLHGNEGGHAKTTRTMGLM

SEQ ID NO: 129757 - protein, 204 aa, Triticum aestivum
  Clone ID: PAT_TA_24175.pep
LAWRRWRPRVGGCVPQTCLRLSGAASGIILWSGRLYRRCVAGVVRHDGGHGGVREKMRSRVGFVACGGGSGDSPSTPLDEGTVLGLRCMGIDPGRSSTTTMALPVMAGFFFNSESRLGDGASSAHLMVATCISLRSGGGGGTIQVFGFVCSGTSRDLTVFLFLLWESSSHIGWDFCPLSCYMYISTCGSCTPVFVANEARSNFS

SEQ ID NO: 129758 - protein, 111 aa, Triticum aestivum
  Clone ID: PAT_TA_24176.pep
RYSSHRKPSSCTHKPSACPRHPESSKMRTATLLACVGTSLVSLVSTVQASDYHCTNGAVIPASYIVSALTRAREDANNYQYGFSPNQPGAFYKATPTATSYEQLYWARNLC

SEQ ID NO: 129759 - protein, 122 aa, Triticum aestivum
  unsure (1)..(122): unsure at all Xaa locations
  Clone ID: PAT_TA_24177.pep
XRPGFSKXLPIGFLEDXQLXRGXQGVSXXLXNGXXWCHXPQVPREMLPQICSPASDRRFGSHIAMRTWVEFCRASLQVCGPSSSTVIITLSSFSTFAAFSMTEGRVWRCCYESGKCQDEETD

SEQ ID NO: 129760 - protein, 49 aa, Triticum aestivum
  Clone ID: PAT_TA_24178.pep
HASVQRQFCCSFLPAMSCRTRIVVVIVLARVLACLCGCFELNHARVCFG

SEQ ID NO: 129761 - protein, 69 aa, Triticum aestivum
  Clone ID: PAT_TA_24179.pep
MEGSSSRTPEITIVPAPRPAAGGGGGGGAISPSASKVRPGAVSLPGWKLDSLCKESSSPPAMMARFPYF

SEQ ID NO: 129762 - protein, 130 aa, Triticum aestivum
  Clone ID: PAT_TA_24180.pep
KATTKTPQNSCENDTITIRVLHDIAGRNEQQNCRCKLTYTSREILAKDDKDARGFRNRGSAPSWPSASWTPCRGSRASTRAGRRRARADGLLARRLHRLASYAVDEPGGFSCVRWKCRPRVRPRVRGRVG

SEQ ID NO: 129763 - protein, 82 aa, Triticum aestivum
  Clone ID: PAT_TA_24181.pep
MEGSSSRTPEITIVPAPRPAAAGGGGAVEAVKAASKEPISPGSPSPASKERPGAVSLPGWKLDSLCKESSSPTAMMARFPYF

SEQ ID NO: 129764 - protein, 84 aa, Triticum aestivum
  Clone ID: PAT_TA_24182.pep
MEGSSSRTPEITIVPAPRPAAGGGGGGGAVDAVKAASKEPISPGSPSPASKVRPGAVSLPGWKLDSLCKESSSPPAMMARFPYF

SEQ ID NO: 129765 - protein, 75 aa, Triticum aestivum
  Clone ID: PAT_TA_24183.pep
PFSSLFDLTREITTRIVPCCPSLPPLISRVTEPLVLALTQNEDWSLFTHHPLQSIFASTGTPWATIVDPILLPRT

SEQ ID NO: 129766 - protein, 156 aa, Triticum aestivum
  Clone ID: PAT_TA_24184.pep
MSLVTGEKSNFQFIIRLLNTNIEGKQKVMYALTNIKGVGRRYSNLVCKKADVDLNKRAGELTSEELERIVTIIQNPTQYKIPSWFLNRQRDIIDGKNYQVLANGVDSKLREDLERLKKIRAHRGLRHYWGLRVRGQHSKTTGRRGRTVGVSKKKGG

SEQ ID NO: 129767 - protein, 156 aa, Triticum aestivum
  unsure (1)..(156): unsure at all Xaa locations
  Clone ID: PAT_TA_24185.pep
RAEFATTKEYALLCLENPLLDIQAQGNEDLLKKYGLEANNAILAENELHKSIFEDLLKNYSAKLIAGGGAQNTARGAQYLLPPKSVVFLXWGWGLDKYADILKDAVKDARTXRAEYRVDAKQPTGRCGVVITGHNPSMVTDLGAANHYDLDHLKSP

SEQ ID NO: 129768 - protein, 106 aa, Triticum aestivum
  Clone ID: PAT_TA_24186.pep
MVNVPKTRRTYCKGRDCKKHTQHKVTQYKAGKASLFAQGKRRYDRKQSGYGGQTKPVFHKKAKTTKKVVLRLECTSCKTKAQLALKRCKHFELGGDKKTKGAALVF

SEQ ID NO: 129769 - protein, 363 aa, Triticum aestivum
  unsure (1)..(363): unsure at all Xaa locations
  Clone ID: PAT_TA_24187.pep
LLGTSQADCAILIIAXAGTGEFEAGISKDGQTXREHALLAFTLGGKQLIVAINKMDTAKWPEARYLEIIKETTNFIKKVGFNPKVVPFVPISGFNGDNMIDNSANCPWYKGWEKENKTGKVTGKTLLEAIDNIDPPSRPTDKPLRLPLQDVYKIGGIGTVPVGRVETGIIKAGMVVTFAPAXVTTEVKSVEMHHEQLVQGMPGDNVGFNVKNVSVKEIRRGNVAXGDSKNDPPXGAGSFNAQVIVLNHPGQDWIWIRPQSSHCHTAHIACQFSEILEKIDRRTGKXVESAPKFIKSXGDSAIVKMTPSKPMCVEAYXDYPPLXGRFAVRDMRQTVAVGVIKSVEKVDKATKVTKAAVKAGAKK

SEQ ID NO: 129770 - protein, 156 aa, Triticum aestivum
  unsure (1)..(156): unsure at all Xaa locations
  Clone ID: PAT_TA_24188.pep
MATTERTFIAVKPDGVQRGLIGHIISRFEARGFKLVGIKLVSANEQKLKEHYQDLSDKPFFSGLITYMGSGPICAMIWEGRDAVKTGRTILGATNPLASLPXGTIRGDYALDVGRNVCHGXSDSVENAQKEISIWFSEGEIQSWKSAQNDWVYEKP

SEQ ID NO: 129771 - protein, 161 aa, Triticum aestivum
  unsure (1)..(161): unsure at all Xaa locations
  Clone ID: PAT_TA_24189.pep
MPIPVPAASSLLDLLSLKGKVVVVTGASGPRGIGIEAARGCAEMGANVAITYSSRPDGAERNVIELQNQYNITAKAYKCDVGCYKSVEQLSKXVIQDFGKIDGFVANAGRTADSGVLDGTVEQWDEVIQXQDLNGVFHCAKAVGAQFKERKTGXFVIASSK

SEQ ID NO: 129772 - protein, 228 aa, Triticum aestivum
  unsure (1)..(228): unsure at all Xaa locations
  Clone ID: PAT_TA_24190.pep
YDAALRDGKLPGPRWRPQGGVRYREIAGAHRKLIARIQGLRSRAAVGEGCNIDYYALLGVRRGCTRSELERAHLLLSLKLKPDRAVVFGERLELVDEHRDLEAVRDQARMSALLLYRMLQKGYSFIMSAVIDEEAAARQRAKEAAALPKQQQHAAPIPENPPAVNSSTARTTAKPKSKAGATVATVSSQATAPVYLLVXFCSVVVYREELCRSGFDRSLPVKCEAMSC

SEQ ID NO: 129773 - protein, 153 aa, Triticum aestivum
  unsure (1)..(153): unsure at all Xaa locations
  Clone ID: PAT_TA_24191.pep
LEVXDLINAGKETVTLNVGASVFGSEESFGMIRSGRIDLSILXGAMQVSGNGDLASWMLPGKIKGFGGAMDLVSNPKRTKVIVTMEHTDKQGRPKILRQCTFPLTGKSCVSLIITDLGVFXVNFSTGLTLIEIAEGITVEEIQSKTEASFVVS

SEQ ID NO: 129774 - protein, 99 aa, Triticum aestivum
  Clone ID: PAT_TA_24192.pep
FGGGPRPRMILLYSTHKPEQGAQSAAVRHGNGPDVVEQGQFVDLGCRRVRQPAPREENYSPSRTADEKALGPRAKTSRKRKRPLLLSELDAIYPTSNYF

SEQ ID NO: 129775 - protein, 141 aa, Triticum aestivum
  unsure (1)..(141): unsure at all Xaa locations
  Clone ID: PAT_TA_24193.pep
MAEEMQQIFTEDAPYPAGPYSQAIKTANNIYCSGQIPCDTSGTILDLSTSNIGQMTEXAFKNLSAVLIAANSSLERVVKVNVFITTMDHFNEMNATYEKWXSSIDQARSCVAVAQLPKGXQVEIECIALAWRRRQAQEIMA

SEQ ID NO: 129776 - protein, 79 aa, Triticum aestivum
  Clone ID: PAT_TA_24194.pep
QKSIHVQINSRPHACLNCPQCINYLVVAATQLVNMNRPVRSRLTSDKQSKNFERNMTGQTDIGKLIKSLSNITSSRYLR

SEQ ID NO: 129777 - protein, 109 aa, Triticum aestivum
  Clone ID: PAT_TA_24195.pep
MPSESGHRLYVKGRHLSYQRGKRNTNPGTSLIQIEGVTNTQAANFYLGKKVAFVYRAQKEIRGSKIRVIWGKVTRPHGNSGVVRAQFRRNLPPKSFGASVRVMLYPSSI

SEQ ID NO: 129778 - protein, 89 aa, Triticum aestivum
  unsure (1)..(89): unsure at all Xaa locations
  Clone ID: PAT_TA_24196.pep
HXSCTXQXKKNHSPLHVGQVCLMTSHTLESSVQEGLSSMRSDSRSQAAYPKEITDFVYKVGGKYWDISYPPHSIRVTKQGEVDDDFVVL

SEQ ID NO: 129779 - protein, 61 aa, Triticum aestivum
  Clone ID: PAT_TA_24197.pep
KIDGASGMQGANKKIKSLCLYVCNQRVVFLLLSPLLGRTMCNILWALSGHTVVLRESCSPS

SEQ ID NO: 129780 - protein, 209 aa, Triticum aestivum
  unsure (1)..(209): unsure at all Xaa locations
  Clone ID: PAT_TA_24198.pep
MSASLEASKPTATIKTFGKSTREVPHHSQKAKQWYPADDEPQLKKIRKSIRASTPRPSLTPGTILILLAGRFRGKRVILLKNLPQGVLLVTGPFKVNGVPLRRVNARYVIATSYKINLAGVDQKKIDEVSGDKYFALEKGEKKKGEEAFFKQGRKXQKRRNHQAAALLPKRSVGQDTLXATINKAPFLIGYLGSTFSLRKGDRPHEMAW

SEQ ID NO: 129781 - protein, 170 aa, Triticum aestivum
  Clone ID: PAT_TA_24199.pep
ASGKTFSSGGGDVASGLATPAVISNNSVHSSARSGPADSCMPFSSGGMVLPSVLGSNGTPAFVSSCAVQSAQDSAPFFFFSIFLIMTRCLVTVVRVPWHYVHCYFPLTKKMYIFHGASDTKHHVAPTSGRLDEKVDANAGDEERVLVLPQPKVARASVLRQFQNPWFGHL

SEQ ID NO: 129782 - protein, 169 aa, Triticum aestivum
  Clone ID: PAT_TA_24200.pep
RAEFGTSSCRIRHEYSPPCPLESTFISQVINIQTRQNPWLEKMWLLHYFVLLASVSKPAAASFQKWDIEKGAVCSGIIWTGDELKEVRLRYCHRPPSPASLKNTSHHHRGRFFSNEMKFIYFLPLPQHAFLEEDIDSDYYISVGRGLYLLQRTNIEGFICSQTVYMNAY

SEQ ID NO: 129783 - protein, 178 aa, Triticum aestivum
  unsure (1)..(178): unsure at all Xaa locations
  Clone ID: PAT_TA_24201.pep
LVPNSARANSSPSSGAGVIAQYALHIWDSQEESHPNRSRKQTHVYLHLTTSQPCSTHHYLLSPQPRSKHISTRLADRQRRHPNCKQELASFITGHHSLHIYDAIYTRKEEIKSKNTKLGSWFMGDCCSNGVIHLEEEQAAEMWSERRKEDSEDRVGTDIFEEFPTLGFCVGAKNKXFG

SEQ ID NO: 129784 - protein, 239 aa, Triticum aestivum
  unsure (1)..(239): unsure at all Xaa locations
  Clone ID: PAT_TA_24202.pep
MSAPAIKYKVADLSRAAFGPREIELAENEMPGLMATRAKYAGDQPLKGARIAGCLHMTIQTAVLIETLTSLGAEVTWXSSCNIFSTQDHAAAAIAAVGIPVFAWKGETEEEYQWCLEQQLLAFKDGNTLNLILDDGGDLTALVHKKYPEMLKGCXGVSEETTTGXVHHLYKMLKNKTLLVPAVNVNDSVTKSKFDNLLGRRPSLVDXTIRATDGVXLGVVAVVAGFGDVGKGCAMAPPR

SEQ ID NO: 129785 - protein, 186 aa, Triticum aestivum
  Clone ID: PAT_TA_24203.pep
MVRYAATEISSARSARAHGNYLRVSFKNTRETAQAVNGWKLQRAVKFLQNVQEKVEAVPMRRYAGGTGRAAQGKQFGVTRARWPVKSAAFILGLLKNAEANADTKGLDTGNLIIKHIQVNQAPKQRRRTYRAHGRINPYMSNPCHIELILTEGEEVVQKSEAVVGREAHLSSRQRGARTRRAITAA

SEQ ID NO: 129786 - protein, 186 aa, Triticum aestivum
  unsure (1)..(186): unsure at all Xaa locations
  Clone ID: PAT_TA_24204.pep
MSSVVPTAPSSALFLLRYPSYASEDGAVLRNIDACRAISSTVQTSXLGPYGRNKIVINHLQKMILTSRCCHYTXVNSDVXVHPASKTYCHGQAKQQEPEMGDATNLSKSSWASEALEESGAYYWRMGLRTSDVIPGYELSTXSCALDATTGGARGPVYVRKQTKSKIQQTGNIWTGNMPRLQIIIK

SEQ ID NO: 129787 - protein, 146 aa, Triticum aestivum
  Clone ID: PAT_TA_24205.pep
MGRVRTKTVKKSAKVIIERYYPKLTLDFETNKRICDEIAIIASKRLRNKIAGYTTHLMKRIQRGPVRGISFKLQEEERERKDQYVPEVSALDFGQSEAGQLEVDTETKDLLKSLGFDSIPVSVVAVAQQQTIERGPRRFGDRPARP

SEQ ID NO: 129788 - protein, 177 aa, Triticum aestivum
  unsure (1)..(177): unsure at all Xaa locations
  Clone ID: PAT_TA_24206.pep
MLIPKADRKKVHEYLFREGVLVAKKDFSITHPDIETKNLFVVKACQSLTSRGYVKTQFSWQYYYYTLTPEGLDYLREWLHTPADIVPATHIKQQRSHAPPRGMMSGEGERERKPFAGRGRGGDRGDREGGYRKRDAGEGKXGGAPGEFAPQFRGFGXRAGKGGALLYIFFVQFCSPQ

SEQ ID NO: 129789 - protein, 103 aa, Triticum aestivum
  Clone ID: PAT_TA_24207.pep
LGKYFCTRVELLQCVYMHPLFGRCLPVEQLICYMNNPFFLARIGQTRRVLYIQTIDGSHPARKQVICSRLQARCVCTWMYHLALTLAAAAAGLFFPSLYLTIL

SEQ ID NO: 129790 - protein, 216 aa, Triticum aestivum
  unsure (1)..(216): unsure at all Xaa locations
  Clone ID: PAT_TA_24208.pep
SCRIRHEETGCSSRIRRLELRVVGASGSYASSSPWSGHAVWARAARGALIQRTSAQRVTGSPLLTCPAKSPIQSTTPIKRPPNPHVRARXIRTHCPSSLSPESKAATASSGCHEDNGYKASTTSANPVSAINFVPLGCWGKDVMAHNLLTVFQMXIASVTRXAAPQVYTAXSXTSMVNXNLSKKVNKCAXXINQCKXCGXLQNNWTXIIXNYLXYG

SEQ ID NO: 129791 - protein, 569 aa, Triticum aestivum
  unsure (1)..(569): unsure at all Xaa locations
  Clone ID: PAT_TA_24209.pep
MARRSSSSSSSGAWRYLNPAYYLKRPKRLALLFFVFVAATFAFWDRQSLVSEYESEISQLQNEINQLHGQLRKAGVQLEENPATEIPRKDLVEIDPINNERREKVKDAMLHAWNSYVKYAWGMDELQPQSKNGVNSFGGLGATLVDSLDTLYIMGLRDEFQKARDWVAESLSFDKDYDASVFETTIRVVXGGLLSAYDMSGDKVFLEKAKDIADRLLPAWDTTSGIPYNSINLAHGRAHNFGWTNGDSILADSGTEQLEFTPLSQKTGXPKYQLKAENVIRQLQKXYPSDGLLPIYINPQSGQASYSTITFGAMGDSFYEYLLKVWIQGNKTGAVKHYRQMWETSMEGLISLTRQTTPSNYTYICEKSGGSLSHKMDELACFAPGMLALGASGYGPEKAKQIMNLAEELARTCYNFYQTTPTKLAGENYYFHAGQDMNVGTSWNILRPETVESLMYXWRLTGNKTYQDWGWDIFQAFEKNSRIASGYVGLRDVNSGEKDDKMQTFFLAETLKYLYLLFSPPSVVSFDEWVFNTEAHPLRIVPTHGSNGQSIETATPVVRPFGRKQGKQG

SEQ ID NO: 129792 - protein, 134 aa, Triticum aestivum
  Clone ID: PAT_TA_24210.pep
KHKLSRLISLTYQLESLQYLKRLINCFTMKIVLPHLAIALLSVVAPALAVMYDCFGTIIDGDVVKRAEASHEYASTSKVALIKEDSKIPYTYFDIHTTGQYSERYTGFACFVDTAMTKPDVRKHHEETWWPCNP

SEQ ID NO: 129793 - protein, 142 aa, Triticum aestivum
  unsure (1)..(142): unsure at all Xaa locations
  Clone ID: PAT_TA_24211.pep
MASGVPNIVISKRRKFVADGVFYAELNEFFQRELAEEGYSGVEVRVTPTVTDIIIRATHTQEVLGEQGRRIRELTSLIQKRFKFPENSVSLYAAKVQNRGLSAXVAQCESLRYKTAKWGSLFGRSVLWGVLRFIMGKGGSDS

SEQ ID NO: 129794 - protein, 160 aa, Triticum aestivum
  unsure (1)..(160): unsure at all Xaa locations
  Clone ID: PAT_TA_24212.pep
MPTHLSKTRKHRGHVSAGHGRVGKHRKHPGGRGLAGGQHHHRTNMDKYHPGYFGKVGMRYFHKQGNHFWXKPVLNLEKLWSXLIPVEKRDAYLSSTNPDVIPVIDLLPLGYSKGLGKGRIPKXVPLAVRPRWVXKEPEREISEPGAVXWFVXWNKEFVQS

SEQ ID NO: 129795 - protein, 110 aa, Triticum aestivum
  unsure (1)..(110): unsure at all Xaa locations
  Clone ID: PAT_TA_24213.pep
MKHLAAYLLLTLGGNSSPSESDIKNVLGSIGIEADSERLTKIISELKDKDINELIAEGSAKLASVPSGGAGSAVAATGAVSGDAAPEAKEEEKEEXEKEESDXDMGFRAF

SEQ ID NO: 129796 - protein, 128 aa, Triticum aestivum
  Clone ID: PAT_TA_24214.pep
IKQFSEISSINQRILLSGPSGSEIYQETLIKALAKHFGARLLVVDSLLLPGVPSKDPETQKDVGKADKSGDKARGEKLTILHKHRSSLADTMHFRRPAAPTSSVNADIVGTSTLHSATLPKQESSTAT

SEQ ID NO: 129797 - protein, 133 aa, Triticum aestivum
  unsure (1)..(133): unsure at all Xaa locations
  Clone ID: PAT_TA_24215.pep
MASRVFSPKMASIIAQTSAKSARPAMQIGIKANQRAFSIASSSLRTAPFQAIKRQQASKIISNASLKFAGRQTTRSFNSXEIATAMVQVSQNLGMGSAAIGLGGAGIGIGARFFCSLNCSGLAIPSMRGQLFS

SEQ ID NO: 129798 - protein, 99 aa, Triticum aestivum
  Clone ID: PAT_TA_24216.pep
YKSRNRQDWHCERLRKALQLQQATMTNHWVNPVNQTGKHPRGYLVGLQGGRGRRSRTTGGWGWAGEAGRPKQSMAHQNLLILLEHKYSYSFLPRAEFGT

SEQ ID NO: 129799 - protein, 126 aa, Triticum aestivum
  unsure (1)..(126): unsure at all Xaa locations
  Clone ID: PAT_TA_24217.pep
MPSLHDTTPAMAPSYDTPEGVAIRGRYDPEFAAILTRDALAFAAGLQREFRGAVRYAMERRREAQRRYDAGELPRFDPSTRFVREGEWACAPVPPAIADRTVEXTGPADPRKMXINALNSGAKSSW

SEQ ID NO: 129800 - protein, 186 aa, Triticum aestivum
  unsure (1)..(186): unsure at all Xaa locations
  Clone ID: PAT_TA_24218.pep
STDGCGCSHPGSGHDPAGRHGRQGGARPRPRPRGWCQLRTDADRVGVQVQVQAPTLPPSLRRRPTKRRSTARRPPPKILLQAQNTRVDQPWGLWPTAGRLACCSGLGLITDVNMIITDYWMPGMTGYELLKRVKESSELREIPVVIMSSENVPNRITRCLEEGAXDFLLKPVPPLPTSPASSNRIR

SEQ ID NO: 129801 - protein, 156 aa, Triticum aestivum
  unsure (1)..(156): unsure at all Xaa locations
  Clone ID: PAT_TA_24219.pep
MGRGPKKHQKRLSAPSHWLLDKLSGAYAPRPSAGPHKLRDCMPLIVFIRNRLKYALNARETKAIVMQRLIKVDGKVRTDSTYPAGFMDIIXSIEKTGEHFRLVYDTKGRVTVQRIXAEEAEYKPGKVKRVQFGQTGLSQSVATHHARTIPYPQTSR

SEQ ID NO: 129802 - protein, 170 aa, Triticum aestivum
  Clone ID: PAT_TA_24220.pep
MGDAQIKASSWRLVEVGRVVLISRGPSEGRLATIVEIIDHKRVLIDGPSSDPNISVPRQAVSLSYLVLTPLVLQSLPRGSRSGIIKAAWEKAGIDAQWKESAWAKKRTQRERRRALTDFERFKVMRLRKQARFEVRKVVRKDQGKHDMIDVRSSAINSFDKLNLSRPREL

SEQ ID NO: 129803 - protein, 148 aa, Triticum aestivum
  Clone ID: PAT_TA_24221.pep
MSFSGVTVDPDCLEKYKELKSQKKHKFIIFKMSDDYKSILVEEASKDDNWDYFREKLLSARSVQKDGQMVKGPRYAVYDFHFQLAAGEGHRDKIVFLAWSPDDSGVKPKMVYASSKDSLKKSLDGFTHDFQLNEPEDIEYDSIVKNIS

SEQ ID NO: 129804 - protein, 219 aa, Triticum aestivum
  unsure (1)..(219): unsure at all Xaa locations
  Clone ID: PAT_TA_24222.pep
MSKITVAGVRTNVQQLLEYSHETKKRNFLETVELQIGLKNYDPQRDKRFSGTIRLPVVPRPGMSICILGDQHDIDRAKHGGVDAMSADDLKKLNKNKKLIKXKLHGKYDAFVASDTLIKQIPXRLLGPGLSKAGKFPTPVSHNEDLAGKFNEVNSTSNFQPXRVPCVGVAGGHGGLSEDQPPGSGILSTSDLLSLLLKGWQNVGSLTIKASMSPPKRLY

SEQ ID NO: 129805 - protein, 55 aa, Triticum aestivum
  Clone ID: PAT_TA_24223.pep
MPPKIGAKHTIHVPPARPLYRFAATGLGATMWFFLMYRAKQDGPVLLGWKHPWDH

SEQ ID NO: 129806 - protein, 155 aa, Triticum aestivum
  unsure (1)..(155): unsure at all Xaa locations
  Clone ID: PAT_TA_24224.pep
MQIFVKTLTGKTITLEVESSDTIDNVKTKIQDKEGIPPDQQRLIFAGKQLEDGRTLADYNIQKESTLHLVLRLRGGAKKRKKKVYTTPKKIKHKRKKTKLAVLKYYKVDGDGKIERLRRECPSTDCGAGVFMAAMXDRQYCGRCHLTYIFDDAAK

SEQ ID NO: 129807 - protein, 147 aa, Triticum aestivum
  unsure (1)..(147): unsure at all Xaa locations
  Clone ID: PAT_TA_24225.pep
RWYAWHAASVRLDVTDGDRLACFPVTPGATVYTSDQSCSLPALPGRRLGSLFRVGPAAPPASQHDDKPRDGGPAXGQAQDETREARSLVDKSAAQRAATRDMKAMKQMAPSLEIRVYLNLKTSMSSFPPLWEGHVIVTYAAISFLVL

SEQ ID NO: 129808 - protein, 122 aa, Triticum aestivum
  Clone ID: PAT_TA_24226.pep
TTRSSSLLNLRIMLFSQTISLIFLLAPSVLAEKYDKITPDFVKTVTSLKFGVDCGTHVYTDLQLKKLAFSSLRTERLVKYCTLKSGCFKEARLPQEIYELCPKLLLPYRTYYIRVRSTGRYS

SEQ ID NO: 129809 - protein, 175 aa, Triticum aestivum
  unsure (1)..(175): unsure at all Xaa locations
  Clone ID: PAT_TA_24227.pep
MAESAEKTQNPMKELRIQKLVLNISVGESGDKLTRAAKVLEQLSGQTPVYSKARYTVRTFGIRRNEKIAVHVTVRGPKAEEILERGLKVKEYELRKRNFSETGNFGFGISEHIDLGIKYDPAIGIYGMDFYACMTRPGERVAKRRRAQXHIGARHRIKREESIKWFKNRFEGIVR

SEQ ID NO: 129810 - protein, 136 aa, Triticum aestivum
  unsure (1)..(136): unsure at all Xaa locations
  Clone ID: PAT_TA_24228.pep
MRTYDDSFSGQKIYPGKGKLYVRGDSKIFRFQNGKTESLFLQRKNPRRIAWTILFRRQHKKGISEEVAKKRSRRTIKSQRAIVGASLDVIKEKRNXRDQEVRTAARAAAIKEGKDKRAAAASAKKAEKAKLAXCFS

SEQ ID NO: 129811 - protein, 99 aa, Triticum aestivum
  Clone ID: PAT_TA_24229.pep
PSCLLYFTFISQVINIQTQQNRWLDKMWWLQYLVLLTSVSKPAAASFQKWDIEKGAACSQTTWTASGLKSVQLRYCDRPPSPASLKNTKPSLQGTLLFR

SEQ ID NO: 129812 - protein, 212 aa, Triticum aestivum
  unsure (1)..(212): unsure at all Xaa locations
  Clone ID: PAT_TA_24230.pep
KPYVLPVPFMNVLNGGSHAGGRLAFQEFMIVPSSAPSFSEALRQGAEVYQILKGLAKKKYGQSAGNVGDEGGVAPDIQTAEEALDLITDAIEAAGYTGKMFIAMDVASSEFYKEDAKKYDLDFKNPESDPTKWLTYVELXDKYQTLXKTYPIGKNXDSFAEDDREPGASLQSHSAFRRGRAALACYKSLSYSDTAPGAMALPSPCARRETGG

SEQ ID NO: 129813 - protein, 189 aa, Triticum aestivum
  unsure (1)..(189): unsure at all Xaa locations
  Clone ID: PAT_TA_24231.pep
MLSLYDISVPVFIRNLEILSTLLHKASACPDVSDEVLVKSKLISDMGDLIFQIHVITDLACGMASSAGKIELTEMPRTETNMNELQDRIQATIKALKSVKQEDFVGEEEAISFTKXVIWVIPFVGKTYIQEFQIPNHYFHFVTAYNLLRKEGIDIRKEGLLGQLIGSYLCLGLGASLASFVVPTCGFPR

SEQ ID NO: 129814 - protein, 164 aa, Triticum aestivum
  unsure (1)..(164): unsure at all Xaa locations
  Clone ID: PAT_TA_24232.pep
MHLGAVTLAFLAAIASIHAAKNEVEIQIDHAVECERRSQKGDKVYVHYRGSLKDGGKEFDNSYDRGKPLDFVVGEGHVIXGWDQNLLGMCIGDKRTLTIPPEFGYGDPKIGPIPCFGATLGFTTGIRYTKGVESNRPKGSKLLQRIVDKGCVLVKENKPKFGNF

SEQ ID NO: 129815 - protein, 78 aa, Triticum aestivum
  Clone ID: PAT_TA_24233.pep
CGDVLPYASFRLGTTRSPVCQGDSHVWPRSNNHGTCSHEARRRRHPPWPGPCGLGSVVLGAAVADRRPAAFLGQQRRT

SEQ ID NO: 129816 - protein, 86 aa, Triticum aestivum
  unsure (1)..(86): unsure at all Xaa locations
  Clone ID: PAT_TA_24234.pep
LWTISLWSKXYVSMRVTLWWQLRCLMIAERPPGQAGRLLLSIVINRESNAVAHVLAEWGRANNPTVWMDAPPSYIVKLLADDDSVI

SEQ ID NO: 129817 - protein, 119 aa, Triticum aestivum
  Clone ID: PAT_TA_24235.pep
AFFKKPNFKMKLIHIVSSVALFCLPALAANDWDCGEVVIHASPLEVLMQDVADKRERTDEGSFTDFPPDHFFRVERYGDDLGLPRAQFQIEFNNLYQIRFVAMKVDNEYFKCHEKQTRN

SEQ ID NO: 129818 - protein, 101 aa, Triticum aestivum
  unsure (1)..(101): unsure at all Xaa locations
  Clone ID: PAT_TA_24236.pep
MDPSSSSVPAAAAAEGAPPAGENLAVFWHEGMLAHDAGRGVFDSGRDPGFLDVLRPPPXENADRVRNMVSILRRGPIXAPFLSWESGTPRHASEPPPSLPP

SEQ ID NO: 129819 - protein, 154 aa, Triticum aestivum
  unsure (1)..(154): unsure at all Xaa locations
  Clone ID: PAT_TA_24237.pep
MAPTTATLSASVPPPTRNTKKYDPKRPHITEEPITRDNWYKHVNWLNVTLIVGLPLYGLFRRSXTPLRLKTAVXXAIAYYFMTGLGNYCRDTNRLWAHTSYPAKPPXLKIFLAAVGGGAVQGSIRWWARDHRAXHRYTDXDKXPYSVRKXLLYS

SEQ ID NO: 129820 - protein, 77 aa, Triticum aestivum
  Clone ID: PAT_TA_24238.pep
GIWFCYGGGFGYHAYGRPHWPRRARVIYTQLKKGQRSWTGVESIQTWKLLDDENLSKIDEQVLWRDSDDDSYQSVHL

SEQ ID NO: 129821 - protein, 135 aa, Triticum aestivum
  unsure (1)..(135): unsure at all Xaa locations
  Clone ID: PAT_TA_24239.pep
MPTDGISPMLGQSTPLKLRKYEGRLSDDNFRNHVIAAIGESSGTTLFLFYGFLAAXIINSKPDILSDAPSLLQLIFVASAFGVSGAVNVWLFYRVSGRASKPAITIGLTLIGARALAPMPLHSPRPVQPVWGYQV

SEQ ID NO: 129822 - protein, 110 aa, Triticum aestivum
  Clone ID: PAT_TA_24240.pep
MAPTKKAKKTADSINSRLALVMKSGKVTLGYKSTLKTLRSGKAKLVIIAGNTPPLRKSELEYYSMLSKTNVHHFAGNNIELGTACGKLFRCSTMAILDGGDSDILSGQTA

SEQ ID NO: 129823 - protein, 132 aa, Triticum aestivum
  Clone ID: PAT_TA_24241.pep
ALAELTDFKFKMKTFQIAHFVAALSFLKPTAVDGRFFSCGITNIEDENVADVAGNLWTYKLGQFQSDSQGSFPQKVGNSEYGELREFPLLYGGNHWDHGSFMYYVISNKSAEALYPWSTGTYGGVEADMLGP

SEQ ID NO: 129824 - protein, 124 aa, Triticum aestivum
  Clone ID: PAT_TA_24242.pep
CVFSYLAMTHDRRYVYMWDDSFDVRDTHTLDFICKYHYEVCSLTQTVDPPPLVPTKGNLKTFGYPSMPSSSMHTSAARNVVVFCRIRTSDLLSQVGYVSKLSRLYLADRPRRCTTAPSNHGGVY

SEQ ID NO: 129825 - protein, 201 aa, Triticum aestivum
  unsure (1)..(201): unsure at all Xaa locations
  Clone ID: PAT_TA_24243.pep
NISKTTQKLGSILKQSRQSTFRSSFSAGKISSAHVQHTLLCINSPTNAIIRRQYHEKVLDHYSRPRNVXSMSKTDADVGTGLVGAPACGDVMKLQIRVDPATKKISDVKFKTFXCGSXAIASSSYLTELVRGMTLDEAGRVRNTEIAKELCPPPVKLHWSMLAEDYQVLQSLTTTLRIQMRPRLILVEPARNFHTSKEKTG

SEQ ID NO: 129826 - protein, 209 aa, Triticum aestivum
  unsure (1)..(209): unsure at all Xaa locations
  Clone ID: PAT_TA_24244.pep
MPFTKLVKNSAYYSRYQTKYKRRRLGKTDYYARKRLITQAKNKYNAPKYRLVVRFTNRDIVMQIVTSEXITGDRVFSSAYSHELKAXMGIKHGLTNWAAAYCTGLLIAXRRTLKKLXLDTEFVGVXEEADGEYKLTEAXEENNRRPFKANLNVGPSPLSAAARXVFGGASGAADRRARLCPTPGVRIPSRGSDLFRAPRIWTQSSNEGL

SEQ ID NO: 129827 - protein, 76 aa, Triticum aestivum
  Clone ID: PAT_TA_24245.pep
QFVESHLSREKLHINCFSLRIMFLKKQLFLLCSFSLPWYKLKKTQPLTDRFGVNALCQYAGHAGTPSNHIAMQNCR

SEQ ID NO: 129828 - protein, 104 aa, Triticum aestivum
  unsure (1)..(104): unsure at all Xaa locations
  Clone ID: PAT_TA_24246.pep
WLNLTLVKDLGRDIYILNFSTHSKDGANEDASPRQRTMYDKSWGIDASVLSSRFRNFSPLRWGLSAMQGRIWEERSVNFNRLLAQLGXVLDVLLEVVGGSHTPV

SEQ ID NO: 129829 - protein, 101 aa, Triticum aestivum
  Clone ID: PAT_TA_24247.pep
SFVPWHQSSGVPGKGGSKHIEHLPWRLPVRGCGDGAIGGSGAGSRGARRRKALADLGAPGPPPDLLRSRWISCFGRRRWWWERRQREEPSRQVRGRRRQVT

SEQ ID NO: 129830 - protein, 122 aa, Triticum aestivum
  unsure (1)..(122): unsure at all Xaa locations
  Clone ID: PAT_TA_24248.pep
YDPVTLERERAPRRITSSKDVLDFCIQWVLENPGLSKLVKPHVVLEPSKARLITITPFASVTYTRRGCPSIESLSSVRDIRLKSGYDEGQGTWWEPFPQSCILKDTSLGKRYGXSPPLSYWI

SEQ ID NO: 129831 - protein, 102 aa, Triticum aestivum
  unsure (1)..(102): unsure at all Xaa locations
  Clone ID: PAT_TA_24249.pep
SFSSAASTAALSWPPITGAYCAWSIGFQNVVGDQESXPYPXLXRLVHHRDLNKAKSGDPSRSRRQSMQXHIDGALRPAMTGSTLHLXXXLILXIYESXXGSV

SEQ ID NO: 129832 - protein, 142 aa, Triticum aestivum
  Clone ID: PAT_TA_24250.pep
MVKKGIQYVVVDAFTAQPFKGNPAAVCFLEDDAAAPAGDGRWMQSVAVEFNLSQTAFFSRDSSCAADATTPRFHLRWFTPVTEVALCGHATLATAHFLFTSVLAERHGVVEFATKSGVLTAKKVPAPEAEDQGKLFIELDFP

SEQ ID NO: 129833 - protein, 144 aa, Triticum aestivum
  Clone ID: PAT_TA_24251.pep
MSSSTQIVQCFGKKKTATAVAQCKAGKGLIKVNGKPLELVQPEILRFKVYEPILIVGLDKFADVDIRVRVTGGGHVSQVYAIRQAIAKSIVAYYQKFVDEHSKNELKRSLVQYDRTLLVADNRRCEPKKFGGPGAKARDQKSYP

SEQ ID NO: 129834 - protein, 226 aa, Triticum aestivum
  unsure (1)..(226): unsure at all Xaa locations
  Clone ID: PAT_TA_24252.pep
MGDHVVVNVDGFANTKDDGVAEKPSEAVSVAVVDMAEDGGEDEPLIQAAECRICQEEDSIKNLEKPCTCNGSLKYAHRACVQRWCNEKGDITCEICHEQYKPGYTAPPRVQPDETSIDISGDWTITGAPLDMRDPRILAVAAAQRRLLEAEYDEYGGTDANGAAFCRSAALILMALLLLRHALSISDNEGDDDSSTMFSLFLXRAAGFLLPCYIMAWDLQHFASPA

SEQ ID NO: 129835 - protein, 163 aa, Triticum aestivum
  unsure (1)..(163): unsure at all Xaa locations
  Clone ID: PAT_TA_24253.pep
ITQSSQWGLDNLRVLLWVLLDTVILVVAAEQRHLVEAEHNEXYGGTDAIDAAFWRCASLSLMALFLRRHALSISDKEGDDDSSTMFSLFLLRAAGFLLPCYIMAWIFSILHRRRQREEAASIATAEVAFILQSAQGRALQFTIAPDSPTTPQHEPQQQQQQQQ

SEQ ID NO: 129836 - protein, 154 aa, Triticum aestivum
  Clone ID: PAT_TA_24254.pep
MAKCWLMLLFLVFLLPATSATSCHADDLRALRDFARNLTGGGVILRAAWSGTWCCRWEGVGCDGGSGRVTTLRLPGRGLAGPIAGASLAGLARLEELNLANNRLIGTFPSWIGELEHLRYLDLSDNSLIGEVPKSLIRFKDITIAGRSLGKAFN

SEQ ID NO: 129837 - protein, 124 aa, Triticum aestivum
  unsure (1)..(124): unsure at all Xaa locations
  Clone ID: PAT_TA_24255.pep
MADFQDIARQFTTFYYDAFDKNRQDLKPLYRDVSMFTFEDSSILGLXAIXEKLTSLPFKXVKHGSSYDWMHSHLGENGQIIILXTGXLLVDEEQKPLSFSQAFQALPXDGARKLLIFNDIFKLV

SEQ ID NO: 129838 - protein, 215 aa, Triticum aestivum
  unsure (1)..(215): unsure at all Xaa locations
  Clone ID: PAT_TA_24256.pep
MAIKHNQQIPHNHFRKDWQRRVRVHFDQPGRKLRRRNARQAKAAVVAPRPIDKLRPIVRCPTIKYNRRVRAGRGFSIAELKEAGIPRKLAPTIGISVDPRRQNLSQESLAINVERLKTYQSRMILFPRKTSKPKKGDASQEEXTSAKNTVSNLRTSIPITTVSGGVSEIKKSEMPEPVQGGAFRKLRDARCDPRCSPQGGMPARGMAQDAAPATK

SEQ ID NO: 129839 - protein, 102 aa, Triticum aestivum
  Clone ID: PAT_TA_24257.pep
MSVPRHRLLQLLKVQCRIFNTTYNPDGLRLGNKVLRQRLRGPSVMAYYPRKVATLQDMNRCFPEWETPNEEEEERLEHLRIAKARGKAAPKKKRTFEDSKKF

SEQ ID NO: 129840 - protein, 159 aa, Triticum aestivum
  unsure (1)..(159): unsure at all Xaa locations
  Clone ID: PAT_TA_24258.pep
MPPPALCATSAARLRLLLPSAPSALFLRAAAASAALAPAKQRLLFSTTATTAGMAAAAGAKASTQPAAAGGGVSERIMPHLLNIYGSCATARDFEMYAPNATFEDPLMRAHGVKQVKSSLXTKCPKVFGESKYSGTSRKSRTATPTAGESPILSPRQIH

SEQ ID NO: 129841 - protein, 96 aa, Triticum aestivum
  Clone ID: PAT_TA_24259.pep
MAPANTGAKKQKKKWSKGKVKDKAQHVVILDKATSDKLYKDVQSYRLVTVATLVDRLKINGSLARRCLKDLEEKGQIKKVVGHSKLQIYTRAVAGC

SEQ ID NO: 129842 - protein, 89 aa, Triticum aestivum
  unsure (1)..(89): unsure at all Xaa locations
  Clone ID: PAT_TA_24260.pep
LXSLPCSISSRPSLSTISSKFRPRFPSRPRPSSQSQATRIGVSLSASDLTSLXPLPPXASRCPHKLTPPGGRPQAARPRPPPMAXRXQW

SEQ ID NO: 129843 - protein, 110 aa, Triticum aestivum
  unsure (1)..(110): unsure at all Xaa locations
  Clone ID: PAT_TA_24261.pep
PRPLRKXYISAAHVAEXIGDLXADGDEERYKSQFQGYIDSEIEAXDGLEELYEEAHRQIXREDPYKKVEGESAAKTKEEYKKESLKFKGRKLTKEEKAERVKAKIAELRD

SEQ ID NO: 129844 - protein, 174 aa, Triticum aestivum
  unsure (1)..(174): unsure at all Xaa locations
  Clone ID: PAT_TA_24262.pep
MSDSAGEIEVESDNSQQILPKEVTAEIGSIKLFNKWSYEDVEIRDISLTDYIQIRAPVYISHSAGRFAQKRFRKAQCPIIERLTNSLMMNGRNIGKKLXPVRIVSHAFEIIYIMTDQNPIQXSVDAIVNCGPREDTYSVLGPGGTGRRPGAXTLSPLXRGPPXQFXLLXIGXRE

SEQ ID NO: 129845 - protein, 78 aa, Triticum aestivum
  unsure (1)..(78): unsure at all Xaa locations
  Clone ID: PAT_TA_24263.pep
ALGYGGSTLRSVGPGWVVKGKHRGYLRWLIGDYRLRKNCSSHEKKKKEIVGGVRGPVYDTPGYYPRARRDDVXTLKFN

SEQ ID NO: 129846 - protein, 78 aa, Triticum aestivum
  unsure (1)..(78): unsure at all Xaa locations
  Clone ID: PAT_TA_24264.pep
RKHVFPTSSRVESTESAPKDPESLLQIYPVYGKLKEQTTXIMLPEVPEPPITNSDPRVVTKKKNXXLNSQGXHXGATK

SEQ ID NO: 129847 - protein, 101 aa, Triticum aestivum
  unsure (1)..(101): unsure at all Xaa locations
  Clone ID: PAT_TA_24265.pep
XTTXDQXGTXNTVPGXRSKXPCXXVYWIPCTHCTCKFFLSXXRFSXGVMXLLXSPETVXXCLESKGVVRGAGKCLRTXNCLRPGPPGVNLRPISFIPAQCL

SEQ ID NO: 129848 - protein, 183 aa, Triticum aestivum
  unsure (1)..(183): unsure at all Xaa locations
  Clone ID: PAT_TA_24266.pep
MPPKSGKKVAAAPFPQSKAGAGSKKPAKNPLIEKRSRNFGIGQNIQPRRNLSRMVKWPEYVRLQRQKKILHLRLKVPPAIAQFQNVLDRNTATKAFHLLNKYRPRDKGTRKLSASFLKLRAVRLGEQKKTSSKECLHTVKYGLEPRPLGLIRXNRKGTLVLNPNRGRPIVLGVPLPPLSGEKM

SEQ ID NO: 129849 - protein, 93 aa, Triticum aestivum
  unsure (1)..(93): unsure at all Xaa locations
  Clone ID: PAT_TA_24267.pep
MCGRKSPRSGMDSDLEAFSHYPADGSFAALPCQTAAKTNYLNQRFLSYXLNYHCGDNHQXGKTNLSHDGLKRVSRADLVLKKKKKKKKKNPRD

SEQ ID NO: 129850 - protein, 102 aa, Triticum aestivum
  unsure (1)..(102): unsure at all Xaa locations
  Clone ID: PAT_TA_24268.pep
HIILLAEGRLVNLGCATGHSSFVMSCSPPNHVLAQILLFKAEDPXIRAKKYVDSGRPQKLEXVYYVLPKXXLVETCSFYFHLAHVNAELSKLTHVQAEYPRP

SEQ ID NO: 129851 - protein, 199 aa, Triticum aestivum
  unsure (1)..(199): unsure at all Xaa locations
  Clone ID: PAT_TA_24269.pep
GGGGARGRGGGGARGGAKTIVEPHRHPGIFVARGKEDMLVTKNLSPGESVYGEKRISVENSGPTNEDGTPSTTKTEYRVWNPFRSKLAAGVLGGLDEIFIKPGXKVLYLGFCLRVPPVSHVADIVGXTGTVFAVEFSHRXPGRDLIXMATHRTNVIPIIEXDARHPXRYRMLAPMVDVIPASSSPTPLWFNPIFIGGDH

SEQ ID NO: 129852 - protein, 103 aa, Triticum aestivum
  unsure (1)..(103): unsure at all Xaa locations
  Clone ID: PAT_TA_24270.pep
XWISRRXYRYHSSIFAPYTRLKHNIVIKPGCRKPNSRKKHANKMKIKTRTVRIQLHAMQLPIRRRKLQFRCNTHPYASSNSSAELVVIFHGLYSQCSIREIEI

SEQ ID NO: 129853 - protein, 141 aa, Triticum aestivum
  unsure (1)..(141): unsure at all Xaa locations
  Clone ID: PAT_TA_24271.pep
QGPVITAVGAPGRPASLVVAAAGGEQHVAQALQVHRHGGLLLGGTHWQAAYIHTQAIEEPREGDGDELVRCGRSSGRRGHGRIARRWMDGQRGRGGEERNSERNKEVRPVRRRMAGNRVFMVRDRAGWVLVGVHLXPNSAR

SEQ ID NO: 129854 - protein, 102 aa, Triticum aestivum
  unsure (1)..(102): unsure at all Xaa locations
  Clone ID: PAT_TA_24272.pep
TKQLHEESSFISNPSPSVVVQTMLGPVFKQYRVPACRVRHVVAMTETGDVKQSIPVIDQXSDLWGRLSKAFKAGSGSVRVLVISDSGRELAVDMKVIHSSRL

SEQ ID NO: 129855 - protein, 51 aa, Triticum aestivum
  Clone ID: PAT_TA_24273.pep
MPSHKSFRTKQKLARAQKQNRPIPQWIRLRTGNTIRYNSKRRHWRKTRIGI

SEQ ID NO: 129856 - protein, 160 aa, Triticum aestivum
  unsure (1)..(160): unsure at all Xaa locations
  Clone ID: PAT_TA_24274.pep
MPAGHGLRSRTRDLFARPFRKKGYIPLTTYLRTYKVGEHVDVKVNGAVHKGMPHKFYHGRTGRVWNVTKRAIGVEINKXVGNRIIKKRIHVRVEHVQPSKCNEEFLQRKLNNDKLKAEXKARGXVISTRGSSRPKPGHGGGHTSRRHPSVHSQHKVVQLS

SEQ ID NO: 129857 - protein, 198 aa, Triticum aestivum
  unsure (1)..(198): unsure at all Xaa locations
  Clone ID: PAT_TA_24275.pep
MPGVNLDPAFCDDIRVCGEDPLIPPQLLLSEIPPTHKSMDTVIQGRREAIEIINGMSDRLLVVVGPCSLHDPITALDYCRKLKKISDELSDDLSIIMRAYLEKPRTTVGWKGLINDPXDINDTFMINKGLRIKSXKLFCDLTTMGMPNCXQEMLDTISPQFLADLISXGARAARPTPSPLLRRLPPVGLPGRGSNMRV

SEQ ID NO: 129858 - protein, 161 aa, Triticum aestivum
  unsure (1)..(161): unsure at all Xaa locations
  Clone ID: PAT_TA_24276.pep
MGRVIRNQRKGRGSIFTANTRLNKAPAQFRTLDYAEAHGYLRGVVKEIIHDPGRGAPLARVQFRDPYRFKLHTETFIANEGMYTGQFIYAGKNAALTIGNILPLKSVPEGTVLTNVEEKAGDRGALGRTSGNYVTVIGHNPDEGKTRXVKLPSSAKKNFQE

SEQ ID NO: 129859 - protein, 111 aa, Triticum aestivum
  Clone ID: PAT_TA_24277.pep
STMKINSRAFIIYLMSHIKVIDALNSYLCRDGFTLTPQMISDALRRDWDSKYTRPYFGYGREHRHFLIEHCKGGCNFKQPVFYAVAADRHRRIIRVFMTSYTFYNDCTGDN

SEQ ID NO: 129860 - protein, 109 aa, Triticum aestivum
  unsure (1)..(109): unsure at all Xaa locations
  Clone ID: PAT_TA_24278.pep
MADQLTDDQIAEFKXEAFSLFDKDGXDGCITTKELGTVMRSXWGKNPTGGLSSKDMINEVXDADGNGTIDSQDSSTWMARKXMXDTDSRGGLKEASRCSDKDQNVHLCC

SEQ ID NO: 129861 - protein, 130 aa, Triticum aestivum
  unsure (1)..(130): unsure at all Xaa locations
  Clone ID: PAT_TA_24279.pep
MSWQAYVDDSMIGSGHADKGAIFGFDDLGMWASSTGFNITPRRXKVIHDALNSSQSKKNYNLRGYLLLGVKYVFSKXGVRSLYARKGTEGVVIVNTAKTILIAHHNDTMIAGNCSTVIEGLEVYRGSSGY

SEQ ID NO: 129862 - protein, 178 aa, Triticum aestivum
  unsure (1)..(178): unsure at all Xaa locations
  Clone ID: PAT_TA_24280.pep
MSALNKIAANSTSRQNPSELETSIAGALYDLEVNTADLKAALRPLQFVSAKEIEINNGKKAIVIFVPVPSLLGFHRVQQRLTRELEKKXFSERHVLILASRRILPRPKRXNRSRTSLTQKKTRFKNLTSXHDAILNDLVYPVXNLSGKRLRSKEDGSKXMKXILDEKEKXALPIGNIR

SEQ ID NO: 129863 - protein, 113 aa, Triticum aestivum
  Clone ID: PAT_TA_24281.pep
MPSNRLTYRRRNPYNTRSNKVRVTKTPGGSLRYLHIKKAGTAPKCGDCGTKLPGIPALRPREYAQISRPKKKVQRAYGGSRCANCVRDRIVRAFLIEEQKIVKKVLKESQQKK

SEQ ID NO: 129864 - protein, 145 aa, Triticum aestivum
  unsure (1)..(145): unsure at all Xaa locations
  Clone ID: PAT_TA_24282.pep
MWLIDWFWDTLASLGLLNKHAKLLFLGLDNAGKTTLLHMLKNDRVAILQPTLHPTSEELSIGNVKFMTFDLGGHQQARRLWXKDYFPEVXGIVFLSXDAKDIERLSESKAELDALLSNGKELSXXPFVVLXGNKFDNQDXINEDD

SEQ ID NO: 129865 - protein, 56 aa, Triticum aestivum
  Clone ID: PAT_TA_24283.pep
MSHENVWNSRPRTYGKGSRSCRVCTHKAGLIRKYGLDICRQCFREKASDIGFVKHR

SEQ ID NO: 129866 - protein, 73 aa, Triticum aestivum
  unsure (1)..(73): unsure at all Xaa locations
  Clone ID: PAT_TA_24284.pep
MYHQVYAXRPGYSQXQXLPYYPEFVXEXTSKNELKRPLPTSARGTLLVADNRRCEPKKFGGPGARARYQKSYR

SEQ ID NO: 129867 - protein, 204 aa, Triticum aestivum
  unsure (1)..(204): unsure at all Xaa locations
  Clone ID: PAT_TA_24285.pep
MSTFEPVITIDGKGHLLGRLASTVAKQLLEGQKIVVVRCEALNISGEFFRAKLKYHAYLRKMTRYNPTRGGPFHFRAPSRIFYKTVRGMIPHKTARGAAAMERLKVFEGVPPPYDKVKRVVVPXQALRVLRLKPGRXKYCTVGRLSHEVGGKYQDVVARLEERRKVKGAPKGHSNIAPRRQRSDPLKGAAVDKSTLQQLSELGY

SEQ ID NO: 129868 - protein, 140 aa, Triticum aestivum
  unsure (1)..(140): unsure at all Xaa locations
  Clone ID: PAT_TA_24286.pep
NIIYLSLYSPSTQASKYHQRCCIMAAATTNVSYTTNLLKYMGLGPRREAQWLSIYGFDAVGGVPFKVKRPFTSIPTKVGEVYKLDDLPRWASVGRLLSGPXGSRRCPPSPPAPSRLLLPAHILLPPRHPGPPWFPTVYLA

SEQ ID NO: 129869 - protein, 131 aa, Triticum aestivum
  unsure (1)..(131): unsure at all Xaa locations
  Clone ID: PAT_TA_24287.pep
MVLEAVMVVVDNSESSRNGDYTPTRFEAQSDAVSMIFTVITEANPESSVGLMSMXGKGPEVLVTLTTDYGKILEGLHRTKSKIRGEGHLATXIQVAGLTLKHRQNNXQRQLSSFYCNSIPEDEKTLQXGKK

SEQ ID NO: 129870 - protein, 203 aa, Triticum aestivum
  Clone ID: PAT_TA_24288.pep
MGALKYVEELQKKKQSDVLRFLLRVRCWELRQLNVVHRASRPSRPDKARRLGYKAKQGYVIYRVRVRRGGRKRPVPKGATYGKPTNQGVNQLKYQRSLKSTAEERVGRRCANLRVLNSYWINQDSTYKYYEVILVDPQHKAIRRDPRINWIVNPVHKHRECRGLTATGKRSRGLGKGHGYNKTTAGRRKTWKRHNTLNLQRYR

SEQ ID NO: 129871 - protein, 128 aa, Triticum aestivum
  Clone ID: PAT_TA_24289.pep
MDMEKLKKMQQSVRIGGKGTPRRKVKKVHKSAGMDDKKLQTALKKLNVQPIQAIEEVNMFKADGNVIHFAAPKVHAAVPSNTFAIYGNGEDKELTELVPGNSKSSLGPDSLGATDGIWNYCLSKHTGN

SEQ ID NO: 129872 - protein, 120 aa, Triticum aestivum
  Clone ID: PAT_TA_24290.pep
SNSSNTMNFFHKAITAVILLLTTPAMSMMPMRDGSTGYPVPVQDHRLWFSCRGVNYENEYLFRVLNHAYGLMSSYATYPVPTERVIYERRGPYYLFPLLQNKQIYDLGTTSGHYLIFNID

SEQ ID NO: 129873 - protein, 141 aa, Triticum aestivum
  Clone ID: PAT_TA_24291.pep
MAPSNSSTSSTVSTATPTQVTFAKRADEVNSCKSDLNDIILDYLTIEGYPCAAEKFSKEANIKPRQVEEEIRSRHEIQNLIHRGMIQEAIEALNNTDPEVLDRNPPLHFDLLRLQLIELIRAHNSNPIGDITPGSPRCKTN

SEQ ID NO: 129874 - protein, 203 aa, Triticum aestivum
  unsure (1)..(203): unsure at all Xaa locations
  Clone ID: PAT_TA_24292.pep
MSSQGNDQEQDVLPEQTEGFRVGEKKTMNEYQQLDAEDEAMQRYKRSLGIGGDGKYLTDPNDPRQCIILSLTMESQDRPPVTIDLSEEDSLSTLKDKPFKIKEGASYSMTAQXFKVQHEILSGLHYVQIIKRKGIRVXKDQEMIGSYAPNTEANPVYTKRFAVNTAPSGIMARGNYTVISNFIDDDKKVHLIFEWSIMIGKDW

SEQ ID NO: 129875 - protein, 132 aa, Triticum aestivum
  unsure (1)..(132): unsure at all Xaa locations
  Clone ID: PAT_TA_24293.pep
MASSSFPSIFNATSQDIEMLLAAQCHLGSKNLQVHMDSYLWKTRPDGINIINIGKTWEKVVLAARIIAAIDNPADICVISARPYGQRAVLKFAAHTGAXAIAGRFTPGNFTNYITRXGSKEPRLIIVTDPPY

SEQ ID NO: 129876 - protein, 128 aa, Triticum aestivum
  Clone ID: PAT_TA_24294.pep
HKFAFTMNRILPYAWRKDEGIHSKRHRLGFSPRWTKTPAPAASSPAAPPDHTSALSPAATNGALRRHVAARHSDRAASCTARSGRVWASQARDGAFQRPAAAASGTARSSLSFLWLALEAARDGGRKI

SEQ ID NO: 129877 - protein, 96 aa, Triticum aestivum
  unsure (1)..(96): unsure at all Xaa locations
  Clone ID: PAT_TA_24295.pep
DQGSPINGNDTMPHQVQGDIEPGARWILPGGGDNYXKPNLWXLTXAQXARTLQFVINQLPIYIANKWXRYPKRXKLHFXXKDGHMAXSIIINPXSM

SEQ ID NO: 129878 - protein, 80 aa, Triticum aestivum
  Clone ID: PAT_TA_24296.pep
IQVEPVLYQPRRSQFTRPQDPYLYNLHPILIEDVYRTQFNREEHVIFDREGFIMGGMTYEAVNSVPKYVACRFSSSTRFM

SEQ ID NO: 129879 - protein, 121 aa, Triticum aestivum
  unsure (1)..(121): unsure at all Xaa locations
  Clone ID: PAT_TA_24297.pep
RAEVGPGEWRPERFLDPRFDSADMYKTMSFGSGKRICAGSMQATVISCTAMARMVQEFSFRLKEGDEDKVDTVQLTXYKLHPLYVHLSPRGSKLNGSIVFDNNNNEKHYSPANFGPGLTLT

SEQ ID NO: 129880 - protein, 96 aa, Triticum aestivum
  Clone ID: PAT_TA_24298.pep
MKYLGQVVVALLAFSTVVLMVAPAGAEAATCNALQLTPCAGAIIGSAAPTASCCSKMKEQQPCMCQYARDPNLKQYVDSPNGKKVMAACKVPVPSC

SEQ ID NO: 129881 - protein, 96 aa, Triticum aestivum
  Clone ID: PAT_TA_24299.pep
MKYLAQLLVALLAFWAVVLMMAPAGAEAATCDALQLSPCAGAIVGNAAPTAVCCSRMKAQRPCMCQYARDPNLKQYVNTPHGKKVLAACKVPVPSC

SEQ ID NO: 129882 - protein, 96 aa, Triticum aestivum
  Clone ID: PAT_TA_24300.pep
MKYMGQLVVALLAFSAVVLMMAPADAEAATCDALQLSPCAGAIVGNAAPTAVCCSRMKAQRPCMCQYARDPNLKQYVNSPNGKKVLAACKVPVPSC

SEQ ID NO: 129883 - protein, 154 aa, Triticum aestivum
  Clone ID: PAT_TA_24301.pep
YHNRLRLIFTGFDGHYNGEPATIIKGKKKVRHDTVSQGRQGSLIADVMYRAGLGWAKQLTPPPTTEGGNETKVFFLMVDDGIGNSFRRPIPVVVGVAAAVVVPRLGIRLPSPVPLLPDVLRIHHLYSPLLLCVIEFLVPFLKLSLCHLYFGVSL

SEQ ID NO: 129884 - protein, 71 aa, Triticum aestivum
  Clone ID: PAT_TA_24302.pep
HGSRVRNERCVDTIRSWVTTAEMGSSEVRVIVRESSLSSYLSNVTWRILIARELGYVVSQVSPTFLKKKKK

SEQ ID NO: 129885 - protein, 88 aa, Triticum aestivum
  Clone ID: PAT_TA_24303.pep
DSGKVGKIKLASVQLAKKYMERVTSELDALQGTEKEPNREFLLLQGVRFAFRVHQFAGGFDADSMKVFEELRSKMSSTQAPAPPASDT

SEQ ID NO: 129886 - protein, 186 aa, Triticum aestivum
  unsure (1)..(186): unsure at all Xaa locations
  Clone ID: PAT_TA_24304.pep
CLLVKVQKRGAVVSKELHSALILDVPAILVNHRLYWLLWPKARGLLXEFDLDRQSLTVIKWPTGMIAPGSYGIIKTDKGAAGLFRFSFPNMELREMKVDCKGFTSWLDPKIIDMHNVLGIPPQIGRRVWHCKLRGYEEDNNVIVLYVDDSAYMLDLNSMKSTKLDGSRSMNHCHPFTSFYPPDMAI

SEQ ID NO: 129887 - protein, 164 aa, Triticum aestivum
  Clone ID: PAT_TA_24305.pep
CDVPATLVGNVLYWMLSWDNVCAAMLEFDLDTQSLAVIKGPSDMNYSGSHRIIKIEQGTVSWLRFKFPILEIWLGLQFRPGLAAWGQHKAVVLPRGRGIPPRVCMTCLRSLLGYEEDSNVIILYVDDSAYMLDLNSMKSTKLDESRLMNSCHPFTSFYPPDMAI

SEQ ID NO: 129888 - protein, 65 aa, Triticum aestivum
  Clone ID: PAT_TA_24306.pep
MAKSKNSSQHNQSKKAHRNGIKKPKTSRYPSLKGTDPKFRRNHRHALHGTMKALKEQKDKKGEDA

SEQ ID NO: 129889 - protein, 129 aa, Triticum aestivum
  unsure (1)..(129): unsure at all Xaa locations
  Clone ID: PAT_TA_24307.pep
MAPRAAEKAPVSPPTGLGLGVGGGVGVVAGGAHYRGVRKRPWGRYAAEIRDPAKKSRVWLGTYDTAEEAARAYDXAAREFRGAKAKTNFPFPSSSSSVPCPPRPGRRPPPQATATSVPRRAPGDPARPN

SEQ ID NO: 129890 - protein, 152 aa, Triticum aestivum
  Clone ID: PAT_TA_24308.pep
MADEYDPIQAAELKKKRAFKKFSYRGIDLEQLLDLSSDQLRDVVHARARRRFNRGLKRKPMGLVKKLRKAKHEAKPNEKPSLVKTHLRDMIVVPEMIGSVIGVYSGKEFNQVDIKPEMVGHYLGEFSISYRPVKHGRPGIGATHSSRFIPLK

SEQ ID NO: 129891 - protein, 116 aa, Triticum aestivum
  unsure (1)..(116): unsure at all Xaa locations
  Clone ID: PAT_TA_24309.pep
SCRIRHEDTLPSPPAATAPPGSDRIARVSSPPHPRPWPSPPSSAPPRATAPPSPPPSCAPPPXLPRXPPPPPTPAPPSSVRAACSPVPPGRKSTPRSAGWKAAVAARYDSAIEESP

SEQ ID NO: 129892 - protein, 193 aa, Triticum aestivum
  unsure (1)..(193): unsure at all Xaa locations
  Clone ID: PAT_TA_24310.pep
MKYIHSEETLNIPQGVKVLIKSRLVTVEGPRGKLTKNLNHLAVNFSSPKKDIIKIELHHGARKNVATLRTVRTLINNLIIGVTKGFKYKMRYVYAHFPINVNIDKNNETGLYEVEIRNFIGEKIVRRVVMHPGVEVVTSTNQKDELQITGNSLENVSQSAADIQQVXRVRNKDIRKFLDGLYVSEKGNIEEAA

SEQ ID NO: 129893 - protein, 171 aa, Triticum aestivum
  unsure (1)..(171): unsure at all Xaa locations
  Clone ID: PAT_TA_24311.pep
SKRPGRDVEIWPAYTGNIDGILXLLQARVPRLWGGSRYPVVTLPMPLPTALLRLASPLPVGPPTLCSSGGCPAIGPLVDRWELGLPGFWPEPPSLRSVXSLXXARXRLXMTQKRKSGGXVNQWIXDVLXRHDNDVXWMYVVQAPVREXVTGPLGFHLKHXFWPQGXLXSTG

SEQ ID NO: 129894 - protein, 144 aa, Triticum aestivum
  Clone ID: PAT_TA_24312.pep
SEAEKSSVPPDPLALRRLKLKLRETLIAHKNREANRVPLGRLDQTLNSAHKNREPTRVPLLGRLDENSASHLQKREPNRVPLGRLDDNSASKMQHREPNSASKMQNREPYSASKMQKREPNSASKMLSREPIRMRLGRLDENAC

SEQ ID NO: 129895 - protein, 270 aa, Triticum aestivum
  Clone ID: PAT_TA_24313.pep
MGGGDLYALDFDGVFCDSCGESSLSAVKAAKVRWPWVFEQVDAALEEWIVEQMHTLRPVIETGYENLLLVRLLVEIKIPSVRKSSVADGLSIQDILENWSKLLPTLMDEWQEDRESLVDLFGRVRDDWLENDLSGWIGANRFYPGTADALKLSSSELYIVTTKQSRFTGALLKELAGVDFPSERIYGLGTGPKVKVLQQLQEMPQHQGLTLHFIEDRLATLKNVMKEPALDKWNLYLVKWGYNTQKEREEAGDIPRIQLIDLPDFSKQLK

SEQ ID NO: 129896 - protein, 170 aa, Triticum aestivum
  unsure (1)..(170): unsure at all Xaa locations
  Clone ID: PAT_TA_24314.pep
MAPKRSAREAASALGTAAVKPTKASSGGPKGSKITAEPTTLTSLLGKLGQDYQRDTQQRIKLIDCFLTFLLLVGALQFLYCVLXAGNYPFNAFLSGFSATXVGQFVLTSXVCAYKTNPENKGRSLSAFPQKGHFADYVFGKLDFTFFLRELYQLKNYMWAPKHPGNLTDI

SEQ ID NO: 129897 - protein, 121 aa, Triticum aestivum
  unsure (1)..(121): unsure at all Xaa locations
  Clone ID: PAT_TA_24315.pep
HCYSDWSLLLAATASXRRTHILYSTNSFTLTAQRXRGDGDLVFAMPKRPNQLPLIPPQACRTLLWYADXDGTNGVQRVCKILKGTPRFEYHTFPNRSQEXSSNFSKKTCAVIHEGFPQLLR

SEQ ID NO: 129898 - protein, 235 aa, Triticum aestivum
  unsure (1)..(235): unsure at all Xaa locations
  Clone ID: PAT_TA_24316.pep
MASRPTVSILSAEGKPCGSTHPLPKVFNAPIRPDIVQTVHTGMAKNKRQPYAVSEKAGHQTSAESWGTGRAVARIPRVSGGGTHRAGQAAFGNMCRSGRMFAPTKVWXRKWHXKINLGQKRYATVSXALAASSVPALLMARGHQISTVPGVPLVINSSVFEGAGITRTAAAISLLKSVGASSELEKVEGSRKLRSGKGKLRGRRYRQRRGPLXVVYDPSVDGTKLXRAFRNKXXG

SEQ ID NO: 129899 - protein, 110 aa, Triticum aestivum
  Clone ID: PAT_TA_24317.pep
LKTRYISSPSVSTELNHSLATALEDLITGIPIVYGDVKSFLQTSKNTLDNLCDDLPNFLGAVAQQLSFPVRKFLPAELIKVASTVPKLNSKDGIKLKIIDTLAKILKSSL

SEQ ID NO: 129900 - protein, 119 aa, Triticum aestivum
  Clone ID: PAT_TA_24318.pep
MSAQNSAGIQTLLDAERDAQRIVQKAREYRTKRVKEARDEAKKEVDAYKAKKDLEFKRFESEHASNNKKAEEDAISEADSKMKQILEFGKKGEGEVIRNLLGGVFEVTPVVPKRVEVIK

SEQ ID NO: 129901 - protein, 130 aa, Triticum aestivum
  unsure (1)..(130): unsure at all Xaa locations
  Clone ID: PAT_TA_24319.pep
ARWEGYFALVAGVAXAGTLGIQMMVPAARXPKVWGVPLXVPGLPSLSIATNLFLMGSLGSDAFVRFGACTAIMLIYYVLVGLHATYDVAHDVCSEDRPPGHGDAADDAADEKATAKTADVERASAGDGGR

SEQ ID NO: 129902 - protein, 211 aa, Triticum aestivum
  unsure (1)..(211): unsure at all Xaa locations
  Clone ID: PAT_TA_24320.pep
VRQAGLVNGSKLMQPIKXKYPSITYADLFQLASATAIEEAGGPKIPMKYGRVDVTGPEQCPPEGKLPDAGPSAPADHLRLVFYRMGLDDKEIVALSGAHTLGRSRPERSGWGKPETKYTKNGPGAPGGQSWTAEWLKFDNSYFKEIKEKRDQDLLVLPTDAALFEDPAFKVYAEKYAADEEAFFNDYAEAHAKLSSLGAKFDPAEGFSLDD

SEQ ID NO: 129903 - protein, 260 aa, Triticum aestivum
  unsure (1)..(260): unsure at all Xaa locations
  Clone ID: PAT_TA_24321.pep
MSAGRGPSERYVGAASVAELMKAASEDIRELFKTTHSHPILVRLGCQDSGIHDKNSXDWPERXGGAKGPIXFDVELKHEVNAGFGKVILRLVQPXKDKSPQYXTYADLFXLASATAIDQGXLAPEISMEYGRVEGRGWGKSATKGTNTGAGPPGAAEWMAVGLNFVNNXNKEIDEXSGVYPLDAAIFEDPGWEVPAKKYAENDAADDEEYSEAHAKLNSQGAKFGCRRGICIGDLSVARKQENPFKNQTHFEKAQRDATN

SEQ ID NO: 129904 - protein, 216 aa, Triticum aestivum
  Clone ID: PAT_TA_24322.pep
MGRLSSRRICGQVVGPARHQLSKNLPVGVRGFGSFDRLPIGQVKDWSLGTVMSLGSLPVFAGGIWYLKTNPEEPGAQKPTVEDPEEKAMKKRFEEWMVVHKRRYKNEEEKARRYELFKGCVKRVNELNAASRPGEARYKPSRYADFTKEERSKIHGIVVEPSMFDEWNEEKRRKTQGGHDGGANGDDWEEEMRLIQRCLRTAALNGKAQCKAQQSS

SEQ ID NO: 129905 - protein, 334 aa, Triticum aestivum
  unsure (1)..(334): unsure at all Xaa locations
  Clone ID: PAT_TA_24323.pep
QEQYFGNVALKFNLKAGGINHILEPTKLGIVSEGKTMVVGAGRTRPAPGSREGAPSVAGIVASVDKYLXGQWPSQFSIQAKSXRTEMVSDLESLFVSPSKYVGKKRTKNQLPENILIYRDGVPEGQYRPVLTEELPQIRNACRLKYPATDTKRGLPRITIVVCGKRHHTRFYPKNSGDADKSSNLMAGTVVDRGVTETRNWDFYLQAHACLQGTARACHYYVIIDEIFRSNKVKGGHKNHADALEELTNNMSHLFGRATKAVXSLCPPAYYADLLCTRVRCYLSEVFDPSEGQSVMSGXTNQTIEDIXIPPSMXDSKYYIQAQCMRMINPKSVG

SEQ ID NO: 129906 - protein, 71 aa, Triticum aestivum
  Clone ID: PAT_TA_24324.pep
YNHFIFIDFLPIPLALKFMISSSAVCYLILLYFCSPDLNRASTASEPVTGAVAVPCCISDGSYCARPLSNV

SEQ ID NO: 129907 - protein, 75 aa, Triticum aestivum
  unsure (1)..(75): unsure at all Xaa locations
  Clone ID: PAT_TA_24325.pep
MGNGAKAASKRDRKDKDVKVAKSQLKVNEQARDIXCNICKSTFLKDXLRAPALSEHATNKHSKTLGICFPGFSAK

SEQ ID NO: 129908 - protein, 136 aa, Triticum aestivum; identical to SEQ ID NO: 116005
  Clone ID: PAT_TA_24326.pep

SEQ ID NO: 129909 - protein, 70 aa, Triticum aestivum
  unsure (1)..(70): unsure at all Xaa locations
  Clone ID: PAT_TA_24327.pep
IVLXPITGPKRSXVXVXIVSTFPVSGLVICALAAFLGCGSRFSGFPLRNRTLIPRYPLNPMVVPYTTIES

SEQ ID NO: 129910 - protein, 157 aa, Triticum aestivum
  Clone ID: PAT_TA_24328.pep
MGHPAGLRAGTRYAFSRNFREKGMIKLSTYLRQYKVGDIVDIKANGAVQKGMPHKVYHGKTGVIYNVTKNAVGVIIYKKVKHRYIEKRVNLRIEHVSLSRSREEFVRRVKANAELKKKSKAEGTHVFLKRQPLQPREARTISMKGQCTKKQSLPIAY

SEQ ID NO: 129911 - protein, 154 aa, Triticum aestivum
  Clone ID: PAT_TA_24329.pep
LLQSTHPAAPTRARRRRSSPAQLHRAAPLLSRASSSAAWEAYATAPSCLAQLPCPLACLPNLPSFTPKVVSSSSRCVSCLRAAATPPPRCPRRQRRHGASSSVSRCACATSGARGTMHRSPLRPCASPKGGRKGVPFAAKGMGISRVPLLSPSH

SEQ ID NO: 129912 - protein, 124 aa, Triticum aestivum
  Clone ID: PAT_TA_24330.pep
MSSKTKKPSGKTQRSAISDVVAREYTIHLHKRLHGVTFKKRAPKAIKEIKAFATKSMGTSDVRLDPQLNKKVWEAGIKGVPYRLRVRISRKRNDEEGAKEKLYSYVQAVNVKDAKGLQTVLVEA

SEQ ID NO: 129913 - protein, 178 aa, Triticum aestivum
  unsure (1)..(178): unsure at all Xaa locations
  Clone ID: PAT_TA_24331.pep
SHQDYLHDFIQVNIGPLPLSARHRITQIVEVVSEFEKRDRMTKHLEKIMEDKDNKILIFTGTKRVADDITRFLRQDGWPALSIHGDKQQNERDWVLNEFKTGKSPIMVATDVASRGIDVRNITHVLNYDYPNNSEGYIHRXIGRTRXARTKRDKRITFFTTGNSKQGTRFRSGLRQTF

SEQ ID NO: 129914 - protein, 151 aa, Triticum aestivum
  Clone ID: PAT_TA_24332.pep
FKGPAEKDDVLLTSPKKPCIAVRKDLNPPPLLVEIYGSRPGGQPRDMPVRLNGGQPRDMPVRLNGGQPRDMPVRLNSGQPRDMPVRLSGPETILRAVTSGANTRSALTDSSSTAGTRPVKLQSGAKHILQPCASASLDPGGFLACAVGHTA

SEQ ID NO: 129915 - protein, 137 aa, Triticum aestivum
  unsure (1)..(137): unsure at all Xaa locations
  Clone ID: PAT_TA_24333.pep
MARHRLLAVLLIGIVAASAFNQAAAAGRGLAVVEKLXELEPKPESKPEPMPKPMPHTEPEPCKPEPTPKPKPKPGQKPEPEPKPKTMPKPKPEPCSKPKPGPKPEPMPKPEPKSEPKPKPEPKPKPPPKCKPPTTHN

SEQ ID NO: 129916 - protein, 92 aa, Triticum aestivum
  unsure (1)..(92): unsure at all Xaa locations
  Clone ID: PAT_TA_24334.pep
PKPQSHKTPRSQEPSKPATXETPNPNQKPEPKPRNTKPRTKNPSPKPMPKPKAQPXAPNPKPGPKPRANARNPETKPDPQPKPXEPKPKPSP

SEQ ID NO: 129917 - protein, 213 aa, Triticum aestivum
  Clone ID: PAT_TA_24335.pep
NCRRLFRIGRDNSLNLRITYARAEYRNPSMYRRYHNVHFRSPDGHGDDNEYDNGGLVIDLKEKVVGMVNLPKRFGSFITSSILLNCLDSWKKYRYIARPHLGMMFEAIKHLEPAHVDMLWHMYNIDHGLIVQEVSKGSNAEILGIQKGDVIESINGKPVSTTIELENTLMITCKGPSGAEVHISVGVFHTLKKQRSTVQWTAELSELGEVLTS

SEQ ID NO: 129918 - protein, 164 aa, Triticum aestivum
  unsure (1)..(164): unsure at all Xaa locations
  Clone ID: PAT_TA_24336.pep
MAVGKNKRLSKGKKGLKKKTQDPFTRKDWYQVKAPSSFQIRDVGKTLVNRTTGLKHANDALKGRIFEVSLADLQKDEDHAFRKVKLRVDEVQGKNCLTNFHGLDFTSDKLRSLVRKWQTLIEANLTVKTTXDDYLIRLFAIAFTKAGGGTQIQEKTPLGPLPSP

SEQ ID NO: 129919 - protein, 326 aa, Triticum aestivum
  Clone ID: PAT_TA_24337.pep
MAQPHRRVLRVAPPGSAGGSGDGEAFPTVQAAVDAVPLGNRERTVIRLAPGVYREPVYVPKTKNFITLAGASAEATVISWDNTATRIKHAQTSRVIGTGTFGCGTVIVEGEDFIAENITFQNSAPQGSGQAVAVRVTADKCAFYGCRFLGWQDTLYLHYGKQYLRDCYIEGNCDFIFGNSIALLEHCHIHCKSAGFITAHSRKSSSESTGYVFLRCIITGNGEAGYIFLGRPWGPFGRVVFAHTFMDRCVKATGWHNWDKSENERTACFYEYRCSGPGSRSSSRVSWCRELLDLEAEQFLTHSFVDPDLDRSWLVQMMAIKIPASA

SEQ ID NO: 129920 - protein, 92 aa, Triticum aestivum
  Clone ID: PAT_TA_24338.pep
SCRIRRVLYLIFIYFRIPEFPSLRFGINTPTEHSTMKFFTIGSVSALFCILGPVTAMSNKSKQQPLPSAQAEPRIHHVLPKWGTVTKNLNSS

SEQ ID NO: 129921 - protein, 82 aa, Triticum aestivum
  Clone ID: PAT_TA_24339.pep
MPRETSDIKQFIEICRRKDASSARIKRNKKSAQTKFKVRCQRHLYTLVLKDSEKVEKLKQSLPPNLIIADTPKKNAKGKRIA

SEQ ID NO: 129922 - protein, 170 aa, Triticum aestivum
  unsure (1)..(170): unsure at all Xaa locations
  Clone ID: PAT_TA_24340.pep
TFTVAIISSTSTTMTDYKIPISDSESHPLYVSEKQELPAPALAQQYNDPASRCQRYRARRCILNFVAVMALLVWTGYYFLSSIQCMSSTIGGGFSYSPENSKILIRTRKIQAFRPRVMIMDIPEKYLPEIGPDRTQRRATRDRRHSRHEGINAKIFSKKPNLIMSKATWX

SEQ ID NO: 129923 - protein, 170 aa, Triticum aestivum
  Clone ID: PAT_TA_24341.pep
MAPTQGKQSSQDLLEAQVDLWHHSLGFVKSMALKCAMELQIPNTIQHHGGAMTLSELATKTGIHPSKLPPLGRLMRVLTVSGIFVVHDSASGDNKEAVYGLTPSTCLLVSDEVKSNLFPILSLFLDSTAITPFFGMHSWFLDEHSTSLFKKAHGLNVWEMGPEQCLQRAK

SEQ ID NO: 129924 - protein, 138 aa, Triticum aestivum
  unsure (1)..(138): unsure at all Xaa locations
  Clone ID: PAT_TA_24342.pep
IKFSQSCCHSVSQAIFSSSQGRNSATNVRLRSHQANLIAQPPYPPTITNSRKIIFSETSLKYFKCSRGSLLPNRCILVSIHFFTSLPVTSLEDRHFIIIKXGFHVVRNRKLGSILFRTFKRVKYLSYRILTFQESSLI

SEQ ID NO: 129925 - protein, 153 aa, Triticum aestivum
  unsure (1)..(153): unsure at all Xaa locations
  Clone ID: PAT_TA_24343.pep
MASARIQEITDEEPPKKVTAEDEATESSDSEPEAGEGGVSSGSMVVHSRNEKKARKSIAKLGLIKVPGITRVTLRRPKNILFVINQPEVYKSPSSNTYIVFGEAKIEDLNSQAQASAAQQLAANEGHEHSGHEHSGPGXSHDNGXGKVAESDD

SEQ ID NO: 129926 - protein, 235 aa, Triticum aestivum
  Clone ID: PAT_TA_24344.pep
MSLVVYPLLRLPCRCALAAAPRAAAASVVSLSASASASAADGGDGELTARERRERRREARELKARDWKEEVEERLIHEPARRRKKPPKRTWREELNLDFLAEHGPQWWLVRVSMAPGTDYVDLITKAVARRFSEVSFKIYNPAIQVKKRLKSGLISTKSKPLHPGLVFLYCTLNKELHDFIRDTEGCYGFIGATRGSIKRQIKKPKPIPVEDVESIINENLVRIIHALAYTALLD

SEQ ID NO: 129927 - protein, 392 aa, Triticum aestivum
  Clone ID: PAT_TA_24345.pep
MDFAVDAALWVVGKALAPVTDGLLESCAASTELGRNIDALKMQLLYAQGMLDNAQGRDIRSPALKELLHKLRELAYCADDALDELDYFRIQDALDGTYHAANLDSQSCVDRIAINAHHTAKAAANNLKCSSSSTRADPDDQEDGGKRGCLSVVGSCGEHEISSSRPPPTTQGVQEVDGGCMPNVVSCARTAAQTIGKHFPCYSFPSVCDDDADTVMVKSSNMTGSGHQYVLQGDHAMQTRKLKFDRVVISTKILEIIEQLKLLCAMVSTILNLELLGSTRIPPAQDITMNRPKTTPNIIEPELYGRNDQKKEIIDDITNGKYCTNELTVVPLVGPGGIGKTTLTQHIFAELEGSFQVSVWICVSLDFNADRLTQEIVKKIPEVNDEKANATN

SEQ ID NO: 129928 - protein, 218 aa, Triticum aestivum
  unsure (1)..(218): unsure at all Xaa locations
  Clone ID: PAT_TA_24346.pep
LVPNSARVNAQTHQENXAHAQTRGRGRGSRVSGRFRQRXNTTTRPPAASGAPASRIRPDRLLEPEWVKDNVLKDKVFVLWLGSGQTGTQQWTFHHPIGHTDMDDTEWVATPSRDIDYLLQRRESESLASWKRKAELAKRQKVLRSRTGRGLDASGQEVWTFENAPEIHPVIHTCITAAKAAGAKESAWLDYARLSCPNCKNSSSRRPLRKQEIPESMG

SEQ ID NO: 129929 - protein, 159 aa, Triticum aestivum
  Clone ID: PAT_TA_24347.pep
LKMKFSCLAIITTACLSAAQPHNHRHRHMARHGSRIEARDTATSVQVEAAMVTVYELNGQKISSNDVDSCLKENKCVVLGAGSSSTESQEDLNTFPAPDQDNSSPEDSPSTEDNASPRRAFQPRTSSPNPVYSRATKTKSPQSQSRLLQEPPKPRAPYN

SEQ ID NO: 129930 - protein, 209 aa, Triticum aestivum
  unsure (1)..(209): unsure at all Xaa locations
  Clone ID: PAT_TA_24348.pep
MAEPLKTNGNGAAEAGSAFASVKVPPSPPRRLQRFDSLHMEAGKIPGGHSYAAKVGWATTLHLAFQSLGVVYGDMGTSPLYVFSXSTFTGGIKDTDDLLGVMSLIIYTVLLLPLMKYCFIVLRANDNGDGGTFALYSLISRYARIXLIPNQQAEDATVSYYKLESXTIVSSGSLVKEKWKQPEFKYFSRTIQHGGTGATFVRGISIKSY

SEQ ID NO: 129931 - protein, 155 aa, Triticum aestivum
  unsure (1)..(155): unsure at all Xaa locations
  Clone ID: PAT_TA_24349.pep
HLKRCWELHYWDGGSSSPRADSGTSHGLPSSTPNTPIPTDYTLHWCSTLYSHICFGLTRSTIHMLPCHSCYVPSXVLXQXGMGWKXTKIXPILTRRELNKXGTPRVTPHTXIIXGHXGTXSTXXXIAHNHTTNDIQKXHPAXQQQXXTKCNKSHC

SEQ ID NO: 129932 - protein, 309 aa, Triticum aestivum
  unsure (1)..(309): unsure at all Xaa locations
  Clone ID: PAT_TA_24350.pep
MRPTLLQGHERALTQIKYNRDGDIIFSTAKDQHICAWFSHNGERLGTYHGHQGAIWTVDVDPTSTIIASGAADNTVRLWDIKSGKCLKVWDFNTAVKRVEFNEDGSQLLAVTEQRMGFLGTIVVLDIKIDVNAEQSDEEXMTITCEESKATVAGWSYLSKYIIAGHEDGSVSQYHPGDGRRILNEKVHETIITDLQWSTDRTYFITASKDKTSKLINVSNLEVLKVYVADTPLNSASITPKKDFVILGGGQXAAMDVNTTSTXVXGKFEAEXFXTKIFEKKSGKYGQFRVHLTVGFLKRQVGGKLGTRV

SEQ ID NO: 129933 - protein, 122 aa, Triticum aestivum
  Clone ID: PAT_TA_24351.pep
MVKKRASNGRNKNGRGHVKPIRCSNCSRCTPKDKAIKRFTIRNMVESAAIRDISDASVFPEYTVPKMYLKLQYCVSCAIHGKIVRVRSRQGRRNRSPPPRVRYNKDGKKVNPNQAAAKTTQA

SEQ ID NO: 129934 - protein, 108 aa, Triticum aestivum
  unsure (1)..(108): unsure at all Xaa locations
  Clone ID: PAT_TA_24352.pep
RAEFGTRRNTLSDSKVDEKIDAAXDKEKLKAEIDKTVAWLDDSQAATKEEYEEHQKELEAVANPIMMKFYGAGGEGAAGGFPGAGGFPGAGAAPGATHDDGPTVEEVD

SEQ ID NO: 129935 - protein, 157 aa, Triticum aestivum
  unsure (1)..(157): unsure at all Xaa locations
  Clone ID: PAT_TA_24353.pep
SKAPASIMPTNMISKVLEKAVLPLDVAPPVKKGPASRTERASQSKHGEASRTATLFPGIKHETLKAQREEYPRPDARLGAARPATRPSPYSHSAWAASPAYPPGGHLPQPTRATXLRGSPTVSQRGATKRGHSDGPCXXRLQMMSGKLTRXKTTSGY

SEQ ID NO: 129936 - protein, 117 aa, Triticum aestivum
  Clone ID: PAT_TA_24354.pep
KLFKIFCKKEGRALMIPEVPMGKNTGHIESARHQKVESKLLTWFRKSMNIPSSKSTREMQSVGNRGWASETHQRGTIGHEERAPARRGASSSRGRPAASKLNPGQNLERRQNNRPRD

SEQ ID NO: 129937 - protein, 88 aa, Triticum aestivum
  Clone ID: PAT_TA_24355.pep
MENDKGELVDLYVPRKCSATNRIIKAKDHASVQISVAKVDENGRITGESQVYALSGFVRAMGESDDSLNRLAQRDGLLKNVWSGSSQR

SEQ ID NO: 129938 - protein, 209 aa, Triticum aestivum
  Clone ID: PAT_TA_24356.pep
RGGHQGSTSSNPSTDWCWTSVPSPLPFTKDDMINSYAMHPDGHTIFMSSSSRRYLHCTFSFDTRYQEWRCLGEWSLPFQGQGYFDSELDAWVGLHKDGYICSCQVASCTDKGTMQPDWKMGKEKLFLKHSDATLTYMGSTRFCLVESLVREELEFDDAFGDCNGFMLCITIFGVKYNREGELQTTIRRTTKSYQVSKHVLSFSPVAFWF

SEQ ID NO: 129939 - protein, 186 aa, Triticum aestivum
  unsure (1)..(186): unsure at all Xaa locations
  Clone ID: PAT_TA_24357.pep
MGIDLNAHHVRNTHRKAPKSDNVYIKLLVKLYRFLARRTDASFNKVVLRRLFMSRINRPPVSISRIVANTSEHTNNKTIVVVGTVTDDNRLLTVPKLSVAALRFTSTARARILAAGGENTYIGIKLALKSAYXGSNPLLIRGPKNSREAVKHFGFGPHKHKKPYVESKGRKFEKARGRRRSRGFKV

SEQ ID NO: 129940 - protein, 142 aa, Triticum aestivum
  unsure (1)..(142): unsure at all Xaa locations
  Clone ID: PAT_TA_24358.pep
MQIFVKTLTGKTITLEVESSDTIENVKSKIQDKEGIPPDQQRLIFAGKQLEDGRTLLDYNIQKESTLHLVLRLRGGMIEPSLRALASKFNCEKMICRKCYAXRYPLEATNCRKKKCGHTXKLRPKNKDKVLVFLNQLLLRFH

SEQ ID NO: 129941 - protein, 165 aa, Triticum aestivum
  unsure (1)..(165): unsure at all Xaa locations
  Clone ID: PAT_TA_24359.pep
MVQQHRIYVVQFDKGEPDQEELSCKASPPKGGGRRIMYYYHDYGTGGAAGKNGKPAKSRALSLSGFFGLLLICLFGLATLLAAPGAFFSFARTGGAAAAAXRSSSKSGRCSGIGNDTLCCDRSSRRADMCFARGDLRMHSASASFXLVSSAGGPPAGMFRSFHSI

SEQ ID NO: 129942 - protein, 174 aa, Triticum aestivum
  unsure (1)..(174): unsure at all Xaa locations
  Clone ID: PAT_TA_24360.pep
MPAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLNNDKLKGGGXKARGEVIKHQRGKPAGPKPGFMVEGXTXETVTPIPYXVVNDXXGXVLTLVVLSK

SEQ ID NO: 129943 - protein, 166 aa, Triticum aestivum
  Clone ID: PAT_TA_24361.pep
MGRLHSNGKGISASAIPYSRNPPAWLKATPEQVVEQICKLAKKGATPSQIGVVLRDSHGVAQVKVVTGNKILRILKSNGLAPEIPEDLYMLIKKAVAVRKHLERNRKDKDGKFRLILIESRIHRLSRYYKTVGVLPPTWRYESATAKYFSFIGDIYKITNVARDSG

SEQ ID NO: 129944 - protein, 149 aa, Triticum aestivum
  Clone ID: PAT_TA_24362.pep
MAATGKTSSTVVALSTLALAASLLLLAVSTEAACPSKNKPTPSASTATSGSGGGKCSVDALKLGLCADVLGLGDGLTNLMAGSWSTASSGKKPCCELIDGVADLDAAVCLCTAIKANVLGVVDVGLPLQLGLLVNHCGKKLPAGFQCPN

SEQ ID NO: 129945 - protein, 234 aa, Triticum aestivum
  unsure (1)..(234): unsure at all Xaa locations
  Clone ID: PAT_TA_24363.pep
MSHRKFEAPRHGSLAFLPRKRAARHRGKVKSFPKDDPKKPVHLTATLGYKAGMTTIVXRDLDRPGAKTHKKEVVEAVTVIETPPXIVVGIVGYIETPRGLRSLTTVWXAEHLSDEVKRRFYKNWYKXSKKKAFTKYAKXKHSENSGSSINRELERVSKYCTVVRVLAHSQISKTPLKQKKAHLMEIQVNGGSVPDKVTFARNLFEKPVEXIGSIFEQDELIDVIAVTKGHGFSG

SEQ ID NO: 129946 - protein, 173 aa, Triticum aestivum
  unsure (1)..(173): unsure at all Xaa locations
  Clone ID: PAT_TA_24364.pep
IKLAQALPPRLKRFIARYQPISITLPASGQVSAIKRPNPFKSTRDPITKRWHDPVFSLRRQADLVKLARNHGVESLLPPSRMRPEERIRKRLRHGRQMKGTGEGQTVKGKQSERTMKARLEKRRQAMLDMPXMIQTWKERGHGPWMEEMAKVRRVNGGTLRYHTIIDGRVQGQ

SEQ ID NO: 129947 - protein, 183 aa, Triticum aestivum
  unsure (1)..(183): unsure at all Xaa locations
  Clone ID: PAT_TA_24365.pep
SLSRRGTAPGRAHQGGLPPPPAGPRGLPRIQAFPNTKSTQPTARIRPESRPDPVGGGXLMQATGXPSSDLAQQVAGVLXARRPGPPPPSPPTQPRGGGHISSERRRPPGRRRPHHQAAAWNPRPVPEKEPRPKTSPPPSSTPCGLAGGCLRRRQGKMRRGGGGGGRDLSPPESPRAAGGPSGT

SEQ ID NO: 129948 - protein, 132 aa, Triticum aestivum
  Clone ID: PAT_TA_24366.pep
LIVSFIILAAMKFLTGVALELIQIIAILSSVSEGRDFQCKSTTISDEDLESIRVLACNSLQTTMETSKIDIKSKGKEGLSYDWDLSEPLVLAQMKDESISQVQLNSNCEITSIKSVQVKRMMTKFAQKKSLS

SEQ ID NO: 129949 - protein, 164 aa, Triticum aestivum
  Clone ID: PAT_TA_24367.pep
MPLRLLSSAAAHSPPPRHTTRERAMAMSLSLARLALPPVLQALPGRRQAHSALAFPANSFFGAPLAVAAAGAAALSPAAPLPRPLAVVAAGKGYKMKTHKASAKRFRVTGTGKIVRRCAGEQHLLSKKNAKRRTRVSKMVQVNKSDYSNVMGALPYLKVNKKAG

SEQ ID NO: 129950 - protein, 89 aa, Triticum aestivum
  unsure (1)..(89): unsure at all Xaa locations
  Clone ID: PAT_TA_24368.pep
MARVYADVNQTMPRSYWDYDSVNITWGVXENHEVVRKIGRGKYSEVFEGINIVNYQKCVIKVLKPXVKKKKIKREIKILQEPIWEGRIL

SEQ ID NO: 129951 - protein, 192 aa, Triticum aestivum
  Clone ID: PAT_TA_24369.pep
MAPRCYSKTSRVPRRPFESARLDAELKLVGEYGLRNKREVWRVQLTLSKIRRAARQLLTLDEKDPKRLFEGNALIRRLVRVGVLDESRMKLDYVLALKTEDFMERRLQTCVYKLGLAKSIHHARVLIRQRHIRVGKQIVNVPSFVVRLDSQKHIDFALSSPFGGGRPGRVRRKKAAAASKKDGGDAEEEDEE

SEQ ID NO: 129952 - protein, 196 aa, Triticum aestivum
  Clone ID: PAT_TA_24370.pep
ALAQIKPPGVEVHFIVAACENMISGTGMRPGDILTASNGKTIEVNNTDAEGRLTLADALVYACNQGVDKIIDLATLTGACVVALGPSIAGIFTPSDELAQEVTAASELSGEKFWRLPMEESYWEQMKSGVADMVNTGGRQGGSITAALFLKQFVDEKVQWMHIDMAGPVWNDKKRAATGFGVSTLVEWVLKNSSSS

SEQ ID NO: 129953 - protein, 244 aa, Triticum aestivum
  Clone ID: PAT_TA_24371.pep
PTRPAGQSVVLRLSGQGFKRVALVGLGQSAPSTAAACRGIGESVASVAKSAQASSVAIVLASPAGIQEGFKLNAAAAIASGTVLGLHEDSRFKAESKKVHLKQVDLIGLGSGSELDQKLKYVNDLSSGVIFGKELVNAPANVLTPAVLAEEASKIASEYSDVFTATILDVEKCQELKMGSYLGVAAAFANPSHFIHLVYKPVGGNVKRKLAIVGKGLTFDSGGYNIKTGPGCHIELMKFDMGGS

SEQ ID NO: 129954 - protein, 153 aa, Triticum aestivum
  unsure (1)..(153): unsure at all Xaa locations
  Clone ID: PAT_TA_24372.pep
ASRSYWTGFRLTVGEETYVCERSFLKQDFGERACKGTCVFAHGPSIAGIFTQSDVRVQEVXAASELSGEKFWRLPMEESYWEQMKSGVADMVNTGGRQGGSITAALFLKQFVDEKVQWMHIDMAGPVWNDKKRAATGFGVSTLVEWVLKNSSS

SEQ ID NO: 129955 - protein, 67 aa, Triticum aestivum
  unsure (1)..(67): unsure at all Xaa locations
  Clone ID: PAT_TA_24373.pep
PPLXFFFFFFFFFFFFFFFFFFFFFFYWKDCTACESSTSTQVLEFNSTSWHNLRTGTCSSVKIKTMS

SEQ ID NO: 129956 - protein, 108 aa, Triticum aestivum
  unsure (1)..(108): unsure at all Xaa locations
  Clone ID: PAT_TA_24374.pep
DPDTGEFAPVDPVPGTFIVNLGDVATRXAWSNGALHNVRHRVQCVAAVPRVSIALFLLAPKDDVVRAPDAFVGAGSHRLFRTFGYDDYRRLRQSTGEHAGEALARLAA

SEQ ID NO: 129957 - protein, 109 aa, Triticum aestivum
  Clone ID: PAT_TA_24375.pep
LNLSSIIMKFLNTLATLAISTIAAAHCMKKDQQLSTSPNSDPFDGLLPGSNLLYFCSDEDKDSSISISNLDINPFLPTSYNPIDITISGILRRPLDPASYVIIRRCSVW

SEQ ID NO: 129958 - protein, 171 aa, Triticum aestivum
  unsure (1)..(171): unsure at all Xaa locations
  Clone ID: PAT_TA_24376.pep
MAFRGRGRGTGANFSGGGSRGGGGFGARGGRGGFGRDNGPPSEVLEMGSFLHSCEGEMVCESINTKIPYFNAPIFLQNKTSIGKVDEILGPINSLYFTIKXSEGIQPTSFKSGDKFYIGNDKLLPXEKFLPKPKPPPGAPKPKRXPGGGGRPAPSLGGQVGXXGAPXGXGX

SEQ ID NO: 129959 - protein, 173 aa, Triticum aestivum
  unsure (1)..(173): unsure at all Xaa locations
  Clone ID: PAT_TA_24377.pep
MGSFLLPREALYAAAVAAMAWCAVWVLEWAWWRPRRLGRALRSQGLRGTAYRPVAGDSPLMQRLNREARARAMPLGVGCHGVVPRAMPLFHRAMHEHGKMSITWFGPVPRVTITKPELXVREVLSNKFGHFEKLKFGPTPGGCCNNGVGQRRGKKIGKKETNPGLQGESSKVA

SEQ ID NO: 129960 - protein, 148 aa, Triticum aestivum
  unsure (1)..(148): unsure at all Xaa locations
  Clone ID: PAT_TA_24378.pep
MTTHNVVVFGGDHCGPEVVAEALKVLRVIETRRPSAGKFNFQLHLLGGCSIDATGEPLTSVALDAAKAADAILLGAIGGPEWGTGSIRPEQGILTLRKELGTYANLRPCNFISPALVDISPLRPEICRXTDLHIVRELTGGTYFGKKE

SEQ ID NO: 129961 - protein, 139 aa, Triticum aestivum
  unsure (1)..(139): unsure at all Xaa locations
  Clone ID: PAT_TA_24379.pep
MENIKETSIEPAASELQKLKDKYTAAEQEQVFTFYDTLDVTEKASLFXKLSKFDPDYINQITKRALDSVKTTNDREKLEPLPSSATASILDSDSKDIDXWHEQGLNLIAXNKGGVVLMAXGQGTRLGSSEPXGCFNIGL

SEQ ID NO: 129962 - protein, 103 aa, Triticum aestivum
  Clone ID: PAT_TA_24380.pep
RGFHRAKLVIINPGLYVDVFWIPQHRSFPTSFMLFTGNKQALDDDDHGQHFVDSCAVDGALLADHLLSSSEDDDDAEDLSCCLIIYCCWILSTLLVWKSLAVQ

SEQ ID NO: 129963 - protein, 170 aa, Triticum aestivum
  unsure (1)..(170): unsure at all Xaa locations
  Clone ID: PAT_TA_24381.pep
AGRIRLAIHSYTATQKTXVDGPSXAKDWRGGRTAAQNIIPSSTGAAKAVGKVIPELNGKLTGMAMRVPTANVSVVDLTCRIEKSATYDEIKKAVKIAAGNELQGILSYTEDEIVSTDLIGNNHSSIFDAKAGISLNDNFVKLVAWYDNEWAYSRRVLDLITYIAKIDDSN

SEQ ID NO: 129964 - protein, 62 aa, Triticum aestivum
  Clone ID: PAT_TA_24382.pep
MGKVHGSLARAGKVKSQTPKVEPQEKKKTPKGRAKKRITYTRRFVNVTLTGGKRKMNPNPTS

SEQ ID NO: 129965 - protein, 191 aa, Triticum aestivum
  Clone ID: PAT_TA_24383.pep
KHRDKEPTEVILRGFRSSQQYAAIREYERIAGRICEDYPRDPPVDQRRYKADLRDPASLRKKPLTIEEKLKSNKFAGGEHWIKVTFECAEFAETAIECSPQKILGHWVFAEIYRGVPPNLDEMIPVDNSKATDPNKYEMSLRLGAAPGLDVVSSNLHTSLIEPSQELRKRLNSEDEDISPFVPQDVEFICR

SEQ ID NO: 129966 - protein, 151 aa, Triticum aestivum
  unsure (1)..(151): unsure at all Xaa locations
  Clone ID: PAT_TA_24384.pep
MATLDVXFPNXIRAAXMTXRNVSTVSIPSLAIVDGSLGFYGNYMPSVSAPNITSVGSKADGQGSLAFVANGKLANVSMPLLKTVGGAVPRADNGASSSRSRPALTYVGGAIDFSGNFSTPDLPALGNVKGGFNLQSTASILFKLRLRTWCR

SEQ ID NO: 129967 - protein, 161 aa, Triticum aestivum
  unsure (1)..(161): unsure at all Xaa locations
  Clone ID: PAT_TA_24385.pep
MLRNTVARAAVATHYQIASRRLQTLSRNLSTMSSEIETSIVKKCEYLVIGGGSGGLASARRASSLYGVKTILVEKKRLGGTCVNVGCVPKKVTSNAAFIAETLREAKAYGFSISTTQPFDWGYFKQKRGAYIKRLNGXIYERNLEKXSIEYXHGAPRSKDD

SEQ ID NO: 129968 - protein, 123 aa, Triticum aestivum
  Clone ID: PAT_TA_24386.pep
SQTMFISSPLSLAALLSGSYIAHASIINQFDPLKHLSGVSPPFDHEEASSPLDPVPPLGCNVTRAAYLVRHAAIHSNSYDYVAFIEPFLEKLSRTTVRWAEIPSLSFLSYLEKPNSKGRRRKN

SEQ ID NO: 129969 - protein, 99 aa, Triticum aestivum
  Clone ID: PAT_TA_24387.pep
ANISLKIVKDFDKYKNSSKRPHRSYRTLKCRLKGERTSLDHDFQWVQIFLGFACGLYIRTKFGQFGLDQHIVNLITGVFYPSSRGFGIFASSTAFTFSI

SEQ ID NO: 129970 - protein, 183 aa, Triticum aestivum
  unsure (1)..(183): unsure at all Xaa locations
  Clone ID: PAT_TA_24388.pep
RAEFGTSETDTLKIIFTATSDGIAKRPHQAFLLLRDQDTGVETAFVSSFKGNGRGKVEFSQKDIPSPLLQSSQPLRATFLLGSFGESQAFRNHVFNLIVLTDQGSSTKYEKPLRYGRRDEINHTFRPDPKSGPIFLSXFFTLAIVATVHILFXSWIYFGANLSHLXKFLKIAPLSHTLXYGRF

SEQ ID NO: 129971 - protein, 144 aa, Triticum aestivum
  unsure (1)..(144): unsure at all Xaa locations
  Clone ID: PAT_TA_24389.pep
MPKSKRAKVVNLSKVGKKGKELSQKLFRNVRECLDQYAYCWAYSVEAMRNTYLKDVRNELSDSRLFFGKTKVMAKALGLTPEEAYQRNTEKLAVHLNGDMGLLFTNREPQSIIDYFXELAKTDFARAGNKQQEDFSISWELSWS

SEQ ID NO: 129972 - protein, 82 aa, Triticum aestivum
  Clone ID: PAT_TA_24390.pep
MVLAVDLLNPTPAAEARKHKLKNLVPAPRSFFMDVKCPGCFTITTVFSHAQTVVICAGCSTVLCQPTGGKARLTEGCSFRRK

SEQ ID NO: 129973 - protein, 155 aa, Triticum aestivum
  Clone ID: PAT_TA_24391.pep
MNPHQKSKIDVSKLSPDEQRLFRLYGKIPSKANHLAKIMKDRKYFDSGDYALSKAGKADSVDTGSVGSQHPVPENIPHLSSPSIGSGGQIGSSSIHHITGTSGLQCSSPIKESSNLNREMNFDQAEDTETKEATPAKDENTPLPVPSVESLPSQG

SEQ ID NO: 129974 - protein, 248 aa, Triticum aestivum
  unsure (1)..(248): unsure at all Xaa locations
  Clone ID: PAT_TA_24392.pep
SCRIRHEAISRTTQLAGQFTSPTLNHNRFKTMASKYSVRKIGQPNTLEHRIYIEKDGNIVSPFHDIPLYANPEGTILNMVVEIPRWTNAKLEISKEQTINPIKQDIKKGKLRYVRNCFPHKGYLWNYGAFPQTWEDPNVIHPETKAKGDNDPLDVCEIGRXLLGTPGKIKQVKVLGVMALLDEEETDWXVSVIDGNRPLAAKLHDVEDVERHLPGLLRATNEWFRIYKIPXDXKPENQFAFNGECKNK

SEQ ID NO: 129975 - protein, 130 aa, Triticum aestivum
  Clone ID: PAT_TA_24393.pep
GGRPPGQRRQGPQRLCRRRRARAPRRFRAGTPRHEHLCPLATSVELHLLRLMPNMATSCLGRVSPAGFSFSAQLPPSPERYVALQECPSSVGSAPPAAAASPVAYFCVFLQVNLSRFVTTTTSATMYAVA

SEQ ID NO: 129976 - protein, 115 aa, Triticum aestivum
  Clone ID: PAT_TA_24394.pep
TLTPSTCTNSHEALAELTDFKFKMKFFQLASIIAGLSFLQPTVADQYISCGMGSISRNSILSVAKDMWNMSLGSCPSYHETFPAEYRQSSEGMTRRFPIIYNSQEMDLWGLLLHC

SEQ ID NO: 129977 - protein, 91 aa, Triticum aestivum
  unsure (1)..(91): unsure at all Xaa locations
  Clone ID: PAT_TA_24395.pep
PAPTPAPAAPRPPPPLPSSPPXPPPSPPAPPPAPRPPRPPPRPPPPAPPAPPFPCRPSPPRHGCPPVATGRRTSLSAPGPVLPLRAARRVS

SEQ ID NO: 129978 - protein, 235 aa, Triticum aestivum
  Clone ID: PAT_TA_24396.pep
PNQALSHAFLQGLIQPITLLSQTVSNPTNRQFHPRLPRTPTPTPRRPPHLPLPWTNPWPYSAFQCRAASSHPTTDPVSAASHLEEKNPYWDPSSPAANSTADPALLAHAGASTPLSSAHRSAASAATAAAGKASIRHIIPRLISSDRSRPSPNGDWPCRPPARHSWPVLATDVVAVASVVASTLPELADGRKVAALARRSGAVGWSRQETVAREGRRSNSMAACLECCGLWECGL

SEQ ID NO: 129979 - protein, 61 aa, Triticum aestivum
  Clone ID: PAT_TA_24397.pep
MALPASSSGLFRFISPRSRLQSTDIVAAASWGVFAGTAGLYLVQPFDWIKKTFFEKPQPEA

SEQ ID NO: 129980 - protein, 130 aa, Triticum aestivum
  unsure (1)..(130): unsure at all Xaa locations
  Clone ID: PAT_TA_24398.pep
MTKLFVGGLSWSTEEDSLRNKFEEFGAVEEAVVVRDRETGRSRGFGFVRYTSDQDAETAITAMNNIEFNGRTIRVDKATERGSGGRQXGGGGYGGGGGGGGGGYRNSGNDGYGGGGGYNGGGGDGNYNGG

SEQ ID NO: 129981 - protein, 334 aa, Triticum aestivum
  Clone ID: PAT_TA_24399.pep
MESSTSRTSLNCISLVDPDIQRSVALLKQACLDSGFFYVLDHGISQEFMDEVFAESKKFFELPNSEKMKLLRNEKNRGYTPMLDEILDPENQVNGDHKEGYYIGVEVPADDPQSNRPFYGPNQWPSEEILPKWREVMEQYHREALRVAKSVARIIALALNLDEDFFDRPEMLGDSIATLRLLHYEGGQKTGQVSNPSKGVYGAGAHSDYGLITLLATDDVVGLQICKDRNAQPQVWEYVAPVKGGFIVNLGDMLERWSNSIFRSTLHRVVLDGQERYSIAFFVEPSHDCVVECLPTCKSETNPPKFPPITCSVYLSQRYKDTHADLSTYSDGKA

SEQ ID NO: 129982 - protein, 371 aa, Triticum aestivum
  unsure (1)..(371): unsure at all Xaa locations
  Clone ID: PAT_TA_24400.pep
HKAPFKKNYICSKTNPELYHKKVDFNRAVSFFLVTAQSTLAAAPRRRGPPRASADHAAAGERAGGGETAAPPGGLASRPSLTCISLADPDTQRSVALLKQACLDSGFFYVLDHGISQEFMDEVFAESKKFFELPNSERMKLLRNEKNRGCTPMLDEILDPENQVNAVLPKWSEVVEQYHREALRVANLVARVVALASILDGNIEGGPDMLEDPFACFKPRRGXFDRPDQGRFDCRILAAGLCSGYGLSTRLATDDGVVGLQICKDRNAQPQVWEYVAPVKGGFIVNLGDMLERWSNSIFRSTLHRVVLDGQERYSIAFFVEPSHDCVVECLPTCKSETNPPKFPPITCSAYLSQRYKDTHADLSTYSDGKA

SEQ ID NO: 129983 - protein, 111 aa, Triticum aestivum
  Clone ID: PAT_TA_24401.pep
CPDHYSSSSIHMRVLKCMCESGIHRFGALPPGLAGFPFLLLSVGGGAVLGALALDAVEDASCCTGTCFPFFAAPEFISPGRSFVCIALACEAMLFGVGEALIRNRPSPASR

SEQ ID NO: 129984 - protein, 258 aa, Triticum aestivum
  unsure (1)..(258): unsure at all Xaa locations
  Clone ID: PAT_TA_24402.pep
MAASLPRLSLPPTAALPAVASSRYRPDLAPVPSRRRRLGLRLHRSPLAPAAAASSPSIPSSSPEPGSGIGDALGGVAIFSAATGEPVLIRDLWDQNEGMAVVALLRHFGCPCCWELALTLKDAKERFDSAGVKLIAVGVGTPDKARILAERLPFPLDYLYADPERKAYDLLGLYFGVGRTFFNPPSVKVFSRFDSLKEATKNYTIEATPDDRPSVLQQGGMXVFKGKELLYARXKDEGTGDHAPLDDVLNICCKVPVA

SEQ ID NO: 129985 - protein, 244 aa, Triticum aestivum
  unsure (1)..(244): unsure at all Xaa locations
  Clone ID: PAT_TA_24403.pep
LVPDSAPEQQTTPPPLIGAHPHASASFLSSHVSVILVSLLSRKLVPRSDXRRPPGPMAASPWIGNLHQILTTKAXVGLRDLAKKHGPGHVPSAGVMXTPMADLLAGGRARSSAAGAQKILTFTSRPSVRPSGLSPCAERGILFTPYGTYCRSXARGARWELLXERKVRQFSPVRDSETMCLVRNVGDASRGGKPFNISRLLVSCSNSITGRTVFGEMCSPELQKEFMSALDKARNLAAXLCIGD

SEQ ID NO: 129986 - protein, 193 aa, Triticum aestivum
  unsure (1)..(193): unsure at all Xaa locations
  Clone ID: PAT_TA_24404.pep
AATXLIRRLXPLFRTLKSYANDVASFSPLGPNPMEADGTVQECKYMPGSFRDPWSVEEEDAPWAICAMEGHSLLIEDDDVRAAELMQAYKMGGVSCFRWHSRMSTVTLRSDLSVLNKPGGRDVVVIADSTFRSGYTLPVGTIIDSGFVRRCVVDERGRAIIRSRDIFEIEAIQTRSRGGRIASRRSRHGRPNK

SEQ ID NO: 129987 - protein, 224 aa, Triticum aestivum
  unsure (1)..(224): unsure at all Xaa locations
  Clone ID: PAT_TA_24405.pep
MADTRFKLNTGAKIPALGLGTWRSGPXLVQKAVTHALSXGYRHIDCAYVYENESEVGEALGEAFSKGLKREDVFITTTLWSTYXSRAGGPRAKSLKSLGLEYVDLYLMHWPFAMNPHGNHDLSPRAPDGTREIVRDWSHVKTWKSMENLLATGKVKAIGVSNCSVPYLEELIAEAKVIPAVNQIENHPSLPQQEIVDYCHSKGIHITAYSPFGSAXCPMFTEPT

SEQ ID NO: 129988 - protein, 346 aa, Triticum aestivum
  unsure (1)..(346): unsure at all Xaa locations
  Clone ID: PAT_TA_24406.pep
MLSYVLPTWIPRYDHNTQRPRRFGSITYDSEDAVDHALHKNFHELNGKMVEVKRAVPKEQSPGPVARSPAGGQNLAISRVHNFLNGFNQGYSPNPIGGYGMRVDGRFGLLSGARNGFSSFGPSYGMGMNVETGMNANFGANSSFLNNSNGRQMGSYYNGGSNRLGSPIGYVGLNDDSGSILSSMGRNVWGNGNVNYQNSPTNMSSFVPSGSGSQVGITGDGINWGGPTSAHGMGSISSLGSNIGRGAGDNFGLPSGGYGRSNPTGTIGEPFSASPNAYEMTNIDTYGHNSIYGDSTWWFTSPGVDTPPLDTALGIFDXDRNSEHASTVTWGNYTVNNNQTSRGITS

SEQ ID NO: 129989 - protein, 154 aa, Triticum aestivum
  Clone ID: PAT_TA_24407.pep
LVPNSARVKAPPNNSISINVEEGHWITSKLSASSSTTTKLIEKFLADAFSTSSDGSWSTSYSTTFSFEVPAGKYGAIVSNPLTTVHEGHVDVGCIGQAERTEFVSHTYQSRDYFNLKWVEGVIGLCVGDTLPLARCYGPGSLGGVEKRVKMSPR

SEQ ID NO: 129990 - protein, 90 aa, Triticum aestivum
  unsure (1)..(90): unsure at all Xaa locations
  Clone ID: PAT_TA_24408.pep
GXPADDTHHPLLVTNFPIIHPQLEVMNLLVTQPPPAPGNTQVQLGDTSPPPPRATGHWELNGLAPTSARQNLGLGLPRLLQYSHNAFLRY

SEQ ID NO: 129991 - protein, 127 aa, Triticum aestivum
  Clone ID: PAT_TA_24409.pep
RAEFGTRLFLSYFSQQASLGFFDQAVVKFSLYSFNLAIVLRLRYTRSSDLDPYEHITTQTFESTDYYLTSLSLTLPPLQWLIQLLMRLTSPSSESLPSILLLYTTHLCYRKCANVTIPRMQPWTKFV

SEQ ID NO: 129992 - protein, 121 aa, Triticum aestivum
  Clone ID: PAT_TA_24410.pep
MVQAVRGEEEQPLRQLTDRPYSLGPNVSDYDARRAAWLAAHPGFPAMVAPGRPRVLMVTGSSPRRCTEAEGDHVLLRAFKNKADYCRVHGLDIFYSNAVLDGEMTGFWTKLPLLRALMVAH

SEQ ID NO: 129993 - protein, 181 aa, Triticum aestivum
  Clone ID: PAT_TA_24411.pep
SCRIRHEVTVYLHLYSPLYIPLRVSALFKQKMRSYLIFPAWAMLAAAHFTLEYPESRGFDEDTLDKFPCGGQNDISEIRTPYPLSNGVIALKMGHIKSRVQVTIALDSDPTTAFNTRLASHISGDRPRKVLHDGKFSIPTSLNVQGGGMASRPVPTSATIAGADSTAPVSCLTPRRLSRQR

SEQ ID NO: 129994 - protein, 67 aa, Triticum aestivum
  Clone ID: PAT_TA_24412.pep
MESKVSVKFVKVIRVLGRTGSRGGVTQVRVEFMDDTSRSIIRNVKGPVREDDILCLLESEREARRLR

SEQ ID NO: 129995 - protein, 165 aa, Triticum aestivum
  unsure (1)..(165): unsure at all Xaa locations
  Clone ID: PAT_TA_24413.pep
MEGPSTNLIEFIDLSQKSFAIAAGSILFNPTFWNIVARKEYHDKVXLLNLSGGNARLXLVIILAVTIPCCGGCRDFLYERALRDQPTMPLLLTTPFQLXALVLVISGNILVISSMWALGITGTYLGDYFGILMDEMVTGFPFNVTDAPXYYXSTMSFPRTALILG

SEQ ID NO: 129996 - protein, 160 aa, Triticum aestivum
  unsure (1)..(160): unsure at all Xaa locations
  Clone ID: PAT_TA_24414.pep
MDPAAGEKPHAVCLPFPVQGHITPMMKLAKVLPXRGFHVTFVSTEYNHRRLIRSRGPSAAAGLPGFVFATIPDGLPSSDADVTQDPPSLCYSIMTTCLPXFKESNPLGLKRQHVPGRRRSTLHRGGTGSRSFRRGRREGELVAVALSGTAALKWANGNFP

SEQ ID NO: 129997 - protein, 220 aa, Triticum aestivum
  unsure (1)..(220): unsure at all Xaa locations
  Clone ID: PAT_TA_24415.pep
MARRPARCYRYCKNKPYPKSRFNRGVPDPKIRIFDLGRKRANVDEFPLCIHLVSNEYEQLSSEALEAARICANKYLVKIAGKEGFHLRVRAHPYHVVRINKMLSCAGADRLQTGMRGAWGKPNGTVARVNIGQIIXSVRTRDSHRATALEALRRSQYKXFPGRQKIIVSKNWGFTPLRREEYMEKKASGKVLVDGAYVQFLSNHGKLADNVRRFPAAFEG

SEQ ID NO: 129998 - protein, 274 aa, Triticum aestivum
  unsure (1)..(274): unsure at all Xaa locations
  Clone ID: PAT_TA_24416.pep
AWHASGTYDKETGTGGSNGATMRFSPEKDHGANAGLEAARNFLEPVKEKFPWISYSDLWILAGVVAIQEMQGPIIPWRPGRSDKDLSACTPDGRLPVPTPAREHLRDIFGRMGFNDQEIVXALSGAHALGRCHTTRSXGFDGPWTFSPXTFLPTXYYRLLLNEKWSWRKWDGPKQXKDKTTKTLMMLPTGYSLIGDKDFKSWVKKYADDNQLFFQDFSNVILKLFRXLGVPIPXGSKRFQFKTNSKSLGLPVVINTGINNFNGGKNSIPLEPKS

SEQ ID NO: 129999 - protein, 184 aa, Triticum aestivum
  unsure (1)..(184): unsure at all Xaa locations
  Clone ID: PAT_TA_24417.pep
LFRKRWEAHLAVRRRQDEILLPLIEARRSVSVPRGADDPPCYADSLLALRVADEGGRPLTDSELVSLCSEFLSGGTDSTVTSLEWIMGELVNHPDMQAKVYEXEVRSKPELSEGDXMGMPLPERAVVLEGLRFHPPAQFLLPHGVQXDTEIGGYRVPKGAEANLLAARARRTCGRGQFDGVLTG

SEQ ID NO: 130000 - protein, 120 aa, Triticum aestivum
  unsure (1)..(120): unsure at all Xaa locations
  Clone ID: PAT_TA_24418.pep
FXPLSDAPRTXMSFVNXPLXIXNXLXAFRRNDSYXXXWILXLGXRXIXISHRSXMNXIPXLLSXQLSXDAXXXLVPSPAPALGRPMCLVVSTTLQSPHLRYISIIEDSKQNMTTLLFSSA

SEQ ID NO: 130001 - protein, 157 aa, Triticum aestivum
  Clone ID: PAT_TA_24419.pep
RPYPEPDWTRSSLPTEAARPPPAAPPRPAGPLAARRSVRSIRIRLSRPAASQIRRPPPLRSCFVAASVLLQSDKVEGLEGEASFMSEQASVYLGSVGLLGEYSRSTRKRHKFVLPCMHQEPIRISGSENSLATASAQSQLSFLQGPAATLTSGIFYI

SEQ ID NO: 130002 - protein, 50 aa, Triticum aestivum
  Clone ID: PAT_TA_24420.pep
RTPRVRPRVREEETIVQWYNEAVAAGKDSQVVKNAKPVVEWLESAESDEE

SEQ ID NO: 130003 - protein, 459 aa, Triticum aestivum
  unsure (1)..(459): unsure at all Xaa locations
  Clone ID: PAT_TA_24421.pep
MALQNIGASNXDDAFYRYKLATMIXTKIEGRSNGIKTNIVNMVDIAKAXLARPASYTTKYFGCELGAQSKFDEKTGISLVNGAHDTSKLAGLLENFIKKYVQCYGCGNPETEVLISKKEMITLKCAACGFLSDVDMRDKLTTFILKNPPEAKKGGKDKKAMRRAEKERLKEGEAADEEMKKLKKEWEGRKVLRPRRGTAKGVATKKKXAGGSEXRNMSHQPRDADFAAAADDDDDDDDDVQWATDTSAEAARKRMEEQLSAATAEMVMLATEETERKKKQAQHKDDGGANGTAKAEETSNGXPGVGPRTTTPYDALVEEIKASLANAATAAQLKGLLSSSPLPLKDVMDALFEALFHGAAKGFAKDVVKNRKYLAAAVPDEAAQMLLLQSIEAFCGKCSAEALKELPVVLKALYDGDVLEEETIVQWYNEAVAAGKDSQVVKNAKPVVEWLQSAESDEE

SEQ ID NO: 130004 - protein, 93 aa, Triticum aestivum
  Clone ID: PAT_TA_24422.pep
KANNRFIGCMQGFDHWYASKRPNPHVVTGAIVGGPNCPDEFRDDRAKYVQTQGCTNNTGPMVAVFARLPNLSAAEEEEGCRPGAALGLSAKCR

SEQ ID NO: 130005 - protein, 137 aa, Triticum aestivum
  unsure (1)..(137): unsure at all Xaa locations
  Clone ID: PAT_TA_24423.pep
MASLAVLGVGVATAAFLGRAGLLAFRRSRGEAVGAFGKAYYKGGFEPKMNLREAALILQLNERNLTKEAIRKNHRMLMMLNHPXDRGGSPYLATKVNEAKEFLNKNKPSLRVLTTLEIEILTCHYQWCLTKLLLGKL

SEQ ID NO: 130006 - protein, 225 aa, Triticum aestivum
  Clone ID: PAT_TA_24424.pep
LVPNSAREKIRGFCHLSTGQEAVAVGIKHALSNEDDIITAYRCHGFALMRGPGPKSARGELLGRRDGIAYGKGGSMHMFAKGFYGGNGIVGAQVPVGAGLAFAHKYNDKKNCTVALYGDGASNQGQVFEAFNMAKLWNLPVLFGCENNKYGMGTSINRSSATTDFYKRGQYIPGLKVNGMDVLAVKAAVAYGKAWAAAGNGPLVYEYVTYRYGGHSMSGSGTTYR

SEQ ID NO: 130007 - protein, 102 aa, Triticum aestivum
  Clone ID: PAT_TA_24425.pep
MSTAKAKVEQIINDHAVAVFSKSYCPHCDHTKNLLESMGAKYTAIELDQIDDGSTIQAALKEINGQSTVPNIYINKVHIGGNSDLQSKKSTLPSLLKDAGAL

SEQ ID NO: 130008 - protein, 143 aa, Triticum aestivum
  Clone ID: PAT_TA_24426.pep
AKIDGSMRNAMRPVGPLARLLDGAGAEPAAAQDLSRRLLRVLRDLRRRGDVRPPPLLDPPGRHLAPALLDGGFSLPLLPIVVARGRGGTSSPARRAPPTGSASRRCCRSPPPWLPVVLYRFLLSSPLGLELTRAAAVWTGGAG

SEQ ID NO: 130009 - protein, 144 aa, Triticum aestivum
  unsure (1)..(144): unsure at all Xaa locations
  Clone ID: PAT_TA_24427.pep
EHKSSQTTIFSIPFPFIYAKIDGSMRNAMRLAGPLARLLDGAGAEPAAAQDLSRRLLRVLRDLRRRGDVRPPPLLDPPGRHLASALLDGGLSLPLLSICVARRREEGVAVVRAFVGVEEPQVAVVAEPAVAVWTGGVGWDPRXR

SEQ ID NO: 130010 - protein, 99 aa, Triticum aestivum
  Clone ID: PAT_TA_24428.pep
LEVPRRGPYSGGLGGISFDGDMLIALALRTIVFSTAPSHNTMYSYKSSDRRREWVAHLQAGAGIVADSIPDDEQKECENKAAALARAIDLAESAFVDKE

SEQ ID NO: 130011 - protein, 205 aa, Triticum aestivum
  Clone ID: PAT_TA_24429.pep
AGPRSIPIPIPSHSGELETERGRGGNDTDLKPPMEVVTASKGGRLNPWAEPLFPGSWCRPAPVQAAGGEVEDFSPEWWALCRPPPPLPRQLAPPARRPGAPGRRRRPITTATPSSFRRATTMGRRGEETRPPRRAEGRWRPWGHRERGGGQHVASPAGGPEVCGEGACQGPGRRQVQPPHNPAASLRGPTTHVIRRVDPSIFGSK

SEQ ID NO: 130012 - protein, 185 aa, Triticum aestivum
  unsure (1)..(185): unsure at all Xaa locations
  Clone ID: PAT_TA_24430.pep
DEPVALRPVRPAHGRWCLLRLGARPKHWVTVNEPNRLSIGGYDNGSQPPRRCSYPFGADCAEGNSSTEPYIAAHHLLLAHASAVSLYREKYKAAQGGQIGITLLGWWHEPASDTPQDAAAAVRMNDFHIGWQVXHPLVYGDYPPVMRSRVGRRLPALPAPESAKVRGSFDFIGFNHYLIMRARSI

SEQ ID NO: 130013 - protein, 218 aa, Triticum aestivum
  Clone ID: PAT_TA_24431.pep
MHPLVYGDYPPVMRSRVGRPGGMSLLPTHPQDAAAAVRMNDFHIGWFMHPLVYGDYPPVMRSRVGRRLPALPAPEPAKGEVETAPWSLRKLLEHLKLNYGNPTVWIHENGYADGPGTRSKAEEEEDDDEDRAEFLQDYMETLYLSIRNGSNARGYFVWSFLDVFEFLFGYRLRFGLCGVDMGDAARRRYKRSSARWYSGFLAGGELRPAAWPQKSYVQ

SEQ ID NO: 130014 - protein, 135 aa, Triticum aestivum
  Clone ID: PAT_TA_24432.pep
MKFLKVSRVAIITRGRYAGKKVVIVQPQDNGNKSHPYPHALVVGIERYPSQVTRRMSKARQTKRSKVKPFIKVINYNHLMPTRYTLELEGLKNLISADTFKEVSQREEAKKTAKKALEDRYLTGKNRWVFTPLHF

SEQ ID NO: 130015 - protein, 117 aa, Triticum aestivum
  Clone ID: PAT_TA_24433.pep
PFRRLSNFALQVKNNLIFNTINYFTLFNMVSPSTCCGKDGQRCVCASMAKCSCGEKSALHCNCSKSAVENAITGPRCSCRARPARACTCDRAAVENASPTGTFMLLADQDLADSCSV

SEQ ID NO: 130016 - protein, 151 aa, Triticum aestivum
  unsure (1)..(151): unsure at all Xaa locations
  Clone ID: PAT_TA_24434.pep
MAPIKVGINGFGRIGRIVFRNAAQSCDIEVVAVNDPFIEPEYAAYMLKYDSTHGQFNGDIQAVEDGLVVNSKNVKFYNKRNPEEIPWADTGAQYIVESTGXVFTTTEKAKATLEKEVLKRVVISAPSADAXPMFGLGGSHKSYTTDLXVIQ

SEQ ID NO: 130017 - protein, 138 aa, Triticum aestivum
  Clone ID: PAT_TA_24435.pep
MSGQSQRLNVVPTVTMLGVVKARLIGATRGHALLKKKSDALTVQFRAVLKKIVATKESMGEAMRASSFSLAEAKYVAGDGVRHVVLQSVRSASLRVRSHQENVAGVKLPKFTHFVDPAGASSGGPCGAYNRLTGLFRH

SEQ ID NO: 130018 - protein, 271 aa, Triticum aestivum
  unsure (1)..(271): unsure at all Xaa locations
  Clone ID: PAT_TA_24436.pep
MSGQSQRLNVVPTVTMLGVVKARLIGATRGHALLKKKSDALTVQFRAILKKIVATKESMGEAMRASSFSLXEAKYVAGDGVRHVVLQSVRSASLPXVAPTRENGAGVKLPKCTHFFAPAGASSGGPSGASPSLTGLARGGQPVPASCATHVKAIKALIRRASLHAYFLTLDEAIKTTNRRVNALENVVKPRLENTITYIKGELDELEREDFFRLKKIQGYKRREVERQMAAAKLFAEEQLAEDLALKRGVSIGGATNILVGGGDKDEDIIF

SEQ ID NO: 130019 - protein, 204 aa, Triticum aestivum
  Clone ID: PAT_TA_24437.pep
SKALPDEPVSRLNEEPTRMSTLIDLTCDSDGKIDKFIGNAETLPLHPLDPERGGCYYLAVLLSGAYQEALSNKHNLFGGPSIVRVEKSTAAATGFQIATADLGPTTEELISTMRYNVRQDIVGVIQRRAIEIGVWGMVGEAVHTGLTTMPYLIMEDHAASSWKHQGGLDGKDESIVKMVFRQVSRLLCLPFMWSIPSKRIGSAA

SEQ ID NO: 130020 - protein, 160 aa, Triticum aestivum
  unsure (1)..(160): unsure at all Xaa locations
  Clone ID: PAT_TA_24438.pep
MREIVHLQTGQCGNQIGAAFWQTISGEHGLDGSGVYNGTSDLQLERMNVYFNEASGNKYVPRAVLVDLEPGTMDAVRAGPFGQLFRPDNFVFGQSGAGNNWAKGHYTEGAELVDQXVLDVVRREAXGCDCLQXGFQITHSLGGGTXGAXMGXLXNSKSXE

SEQ ID NO: 130021 - protein, 97 aa, Triticum aestivum
  unsure (1)..(97): unsure at all Xaa locations
  Clone ID: PAT_TA_24439.pep
IHLSTANTVGLCLHPTQRGLGCARYAQSSSTKDQITNQITPLPICDIQANLVLVSRPGSNISSFNHHATAIPQPAFEPLAKTVSSIKRCNRTDXCRK

SEQ ID NO: 130022 - protein, 215 aa, Triticum aestivum
  Clone ID: PAT_TA_24440.pep
MAEDTETRPASAGAEEREEGEIADDGDGSSAAAAGRITAHPLENAWTFWFDNPQGKSRQVAWGSTIHPIHTFSTVEDFWGLYNNIHNPSKLNVGADFHCFKNKIEPKWEDPICANGGKWTISCGRGKSDTFWLHTLLAMIGEQFDFGDEICGAVVSVRQKQERVAIWTKNAANEAAQISIGKQWKEFLDYKDSIGFIVHEDAKRSDKGPKNRYTV

SEQ ID NO: 130023 - protein, 221 aa, Triticum aestivum
  Clone ID: PAT_TA_24441.pep
GEALSLFETYNEPWVTNTIYFWVGPGEQLWPDQKMKLKLKAVYMYAAGFYTYSIFALLFWETRRKDFGVSMSHHVATVVLIVMSYICRLSRAGSVILAVHDASDIFLEIGKMAKYSSCEGLAVVAFLLFVASWILLRLIIFPFWILRSTSYEVAVILDKEKKEFYSSVYYYLFNSLLFSLLVLHIYWWVLIYRMLVKQIQSRGRVGDDVRSDSEGEEDHED

SEQ ID NO: 130024 - protein, 98 aa, Triticum aestivum
  unsure (1)..(98): unsure at all Xaa locations
  Clone ID: PAT_TA_24442.pep
PAPHPARAPRLPPPRPAPPGPPAPPAHLQSPQSCRSRPTNPSNPSXASSPPSRWTAGTPRRTCRSGSSSSPPRPPPRRRALTPPARRRWRTTPPGPST

SEQ ID NO: 130025 - protein, 141 aa, Triticum aestivum
  Clone ID: PAT_TA_24443.pep
MSSRAGDRALPASSPTEPDPEAPSAVSGGDFPADLLRAVLHRLPPADVARAACVCRLWRAVASDRAVLEAAFRAPCGVRRVLGDPATRAFWRAASLARFALSHAVRRGDTVPGVALKYPVQVTDIKRFNNMMTGPGIKFYQ

SEQ ID NO: 130026 - protein, 69 aa, Triticum aestivum
  unsure (1)..(69): unsure at all Xaa locations
  Clone ID: PAT_TA_24444.pep
VAKLSQDSAIRAVKESLKVLFSRRARSLDKYSIAVITKAGVELKENEQXLENQSWKFAEQIRGYGTQKN

SEQ ID NO: 130027 - protein, 145 aa, Triticum aestivum
  Clone ID: PAT_TA_24445.pep
RRVVVVDLGEAATTAAPWRARVGSGAGWCATEYVAGRGRTGLAFLPDPLLVPFRSFTNLHPHHGPLYSTRVNSTSSSRLLGDSSQESFWPDLMELRGQRKKSNLKKCREEITAACVRLVQGMCRAAVAMRVSRQAISRMDAMLRG

SEQ ID NO: 130028 - protein, 109 aa, Triticum aestivum
  unsure (1)..(109): unsure at all Xaa locations
  Clone ID: PAT_TA_24446.pep
MSLLLARHALRHSAKIRGLVAKSKARWESTASKANTSTTSQATEGLSRVASAAGPVLNGAVNGLTEALIKVGGRTGRVVAFIQRTNPXTLYYARVGLELSKLGLPWARR

SEQ ID NO: 130029 - protein, 127 aa, Triticum aestivum
  Clone ID: PAT_TA_24447.pep
SPGRAPHELGPLSARARIPRYASYPNMRTSTLLSCLITWLVSVVSMVKCHDNYKCDHGAIISAEHITHTLTPPGIKTNNLGSVVIDDERRPVYWREISVAPEYLAINGATLSYRAVFYDAGIFLDIL

SEQ ID NO: 130030 - protein, 142 aa, Triticum aestivum
  Clone ID: PAT_TA_24448.pep
GRRGPPQGDLATITTAVPAWLEDVQGGYQEDAEAQRLLTKLTTSPEGFDGFVLQDGIIRHRGRVWLGANVALQRQVLEALHTGAIGGHSGFNATYRRVRHLFTWPSLKHHVKLFLEACQTCKQAKPERIRYPGLIEPLPVPC

SEQ ID NO: 130031 - protein, 95 aa, Triticum aestivum
  Clone ID: PAT_TA_24449.pep
AALFSFESLYSSLLVVMDQSLLSEWKNAVGNSFVPFIGKENHFTVGFSLLVAGIILSGLFGLNRSSFEHTIDNVFQASLGDFLWLNLYDVAQVGV

SEQ ID NO: 130032 - protein, 180 aa, Triticum aestivum
  unsure (1)..(180): unsure at all Xaa locations
  Clone ID: PAT_TA_24450.pep
LVLAGFLGFXILPEXGLKSXIXCHRTLRSFRXVIXQVWGHSRSGKLILVQRKGLALVSNAKLXIADIIRDEAETHFESRESIPGHVQQGGVPSPMDRTRXVRLAIKCMEHLEKYEGCSREKILNDPLGSSVIGIKGXXSVVFSSMKDVEEKETDXWPNRRPRNEHWLGLTKIVDTLSWKI

SEQ ID NO: 130033 - protein, 82 aa, Triticum aestivum
  unsure (1)..(82): unsure at all Xaa locations
  Clone ID: PAT_TA_24451.pep
KLCHQLIVKEILTSGYLLEMGSKSIQRIVNWHGIAQXQGLKAVTSSKCKCWXNEKFSWDLKFEICNTSWHYSYTKEDKNCQG

SEQ ID NO: 130034 - protein, 142 aa, Triticum aestivum
  Clone ID: PAT_TA_24452.pep
FVSTFAAFITGHIWEGHKGFNCDGRKIYYNEYNQAEKSELSGPVNYLGWKMINVYHSRLSDQEDNRTVAFQGSYDGVNRFFELIRLTQRQDIYDGYFLNSYILVTNVNNQANAMIKRSIYYRNNHPTEPRPEGLYTMCEITT

SEQ ID NO: 130035 - protein, 324 aa, Triticum aestivum
  Clone ID: PAT_TA_24453.pep
HLLSYLIERRAIRKLLDKITGTDAKKEQVLKFLLHLVTKYGKNVKPDTGERNENLQSESKSLSPSLSLASDASTPEKCDKPTYFQGYEYQSSMSGETTPPTEFCCPISTKLMHDPVIITSGQTYEREYIEKWFSEGYNTCPKTQKKLENFAMIPNTCMRDLICNWCREHGFTISDFLPSKDSYSYLPEQLHGHSMSSLHNVSVPLIAGNARNFVIDHSSSSVAFSDASYVSDSSHVKDMEEPKDSFSQFSWSADYQKHLSFHNFNQGMFLRFFCELSKLPLEIQGSSIKDLKNILHDDDDVSWAIGVHGFVEAFLRFLRNDDSS

SEQ ID NO: 130036 - protein, 189 aa, Triticum aestivum
  unsure (1)..(189): unsure at all Xaa locations
  Clone ID: PAT_TA_24454.pep
IFGPSKFFLAYLVVPIFIISTQLSIMPNPSPQSNQQLLRKAQCLTGLDNQLGEDTALLGSEGPDTQPVVADVTVPRSVDEEITKEERKNRISGVWGALHGKTSKQQIISPWFILITIFTAIQMTRXINYFVATIRSQYEIHFRLLRRKQVTTSKFLRRKQLPTRWESLLPFIVLANYVQRLALALIQWE

SEQ ID NO: 130037 - protein, 55 aa, Triticum aestivum
  Clone ID: PAT_TA_24455.pep
LSTYFISSVSRRQVVTISNRVVWIRSIYRPRASRALYGTHRVPGPPSSPQAENSS

SEQ ID NO: 130038 - protein, 100 aa, Triticum aestivum
  Clone ID: PAT_TA_24456.pep
RSTGRPGLGDHRWPLVTHFVGCKPCGEPGATYDAVVCREGMERALNFADDQILGLYGFQHQSLGTTAVRRVRNDTGRPLDADDEEIGRLLHPEFRAAMPL

SEQ ID NO: 130039 - protein, 163 aa, Triticum aestivum
  unsure (1)..(163): unsure at all Xaa locations
  Clone ID: PAT_TA_24457.pep
MPPKKAARPAQENISLGPQLREGESNVFATARIFASFNDTFVHITDLSGRETITRVTGGMKVKADRDESSPYAAMLAAQDVATRCKELGINALHIKIRATGGNGTKTPWAQALSRLYVALARSXGMKIGRIEDVTPTPSDSTRRKRGAVVVVYDFTALRMGMG

SEQ ID NO: 130040 - protein, 100 aa, Triticum aestivum
  Clone ID: PAT_TA_24458.pep
CHSCTAVCHTCGRSDSAAGGCCLQRHQSHSSLPPGCTRGTPCPPCCWSVSSINRRCSLVPNSARVSSSSSSSSSSKASSSSSSSSSSSSSSSSLVPNSAR

SEQ ID NO: 130041 - protein, 175 aa, Triticum aestivum
  unsure (1)..(175): unsure at all Xaa locations
  Clone ID: PAT_TA_24459.pep
MXTELTVQSERAFQKQPHIFLNSKVKTKSTKVGKGGRRWYKDVGLGFRTPKTAIEGNYIDXKCPFTGLVSIRGRILTGTVVSTKMHRTLIIRREYLHFIPKYARYEKRHKNLAAHVSPAFRVEEGRSKLRXGTXGRPLKQGXVRFNGPRXVLPRAGKAVKQFNKFWANIPKATSL

SEQ ID NO: 130042 - protein, 127 aa, Triticum aestivum
  unsure (1)..(127): unsure at all Xaa locations
  Clone ID: PAT_TA_24460.pep
MPTSEHDESAAPETSENSDHVKHLNIKVTDNNNEVFFKIKSTTPLKKLMDAFCERQGKSPASVRFLHEGSRVQPTRLPXSINIEDGDTLESTSGKSGGASSSDGYELHGYHSRVLDKDGVFKRKWIQ

SEQ ID NO: 130043 - protein, 80 aa, Triticum aestivum
  unsure (1)..(80): unsure at all Xaa locations
  Clone ID: PAT_TA_24461.pep
VACIMLPSGVERYTIQPXSSIFNLGMFRLKHLYLSFVAQDQLLMPFIGEVSGHFDTXGFLLFLFLVMGAHGSMAFTWTGK

SEQ ID NO: 130044 - protein, 146 aa, Triticum aestivum
  Clone ID: PAT_TA_24462.pep
MGKGKPRGLLAARKLQTHRRDQRWADLSYKKRALGTAFKSSPFGGSSHAKGIVLEKVGVEAKQPNSAIRKCVRVQLIKNGKKVTAFVPNDGCLNFVDENDEVLLAGFGRKGKGKGDIPGVRFKVVKVSSVGLSALWERERREKPRL

SEQ ID NO: 130045 - protein, 188 aa, Triticum aestivum
  unsure (1)..(188): unsure at all Xaa locations
  Clone ID: PAT_TA_24463.pep
MNISHWRRPTQNRFSWFLEKVALQSQLQYCTIQSYSHCGRGRVNNLCPTXVVADKSKDAVIIDPPSPIEVAPILKERIQSIQICLKSIINTHXVGVSPHADHAGGNRRMLGYPEFKGVTIIGGKKCEGVQWTPDDREVFKVGKISVTALYTPCHTQDSICWFMEDEGQRAVFSGDTLFHGGCAREFGT

SEQ ID NO: 130046 - protein, 94 aa, Triticum aestivum
  Clone ID: PAT_TA_24464.pep
MTKGTSSFGKRHNKTHTLCRRCGRRSLHIQKHTCSSCGYPSAKIRKYNWGEKAKRRKTTGTGRMRYLKCVARKFKNGFQTGEPKDARGPNKISA

SEQ ID NO: 130047 - protein, 136 aa, Triticum aestivum
  Clone ID: PAT_TA_24465.pep
MEGADRGGEDEMHLGDGNRAGEAAHQRPWTDTSSSPARLREAPHQLRPWWPAARAPGASPPGPPGALRPGPPPRMPSPPRYVEPPDPLPPPSSVSSACRRTPLAAAKGKGRGEGGVRRRRFRVSPESPRLVPNSAR

SEQ ID NO: 130048 - protein, 114 aa, Triticum aestivum
  unsure (1)..(114): unsure at all Xaa locations
  Clone ID: PAT_TA_24466.pep
TCPVRGDELVKARNGVDPPTLSMAMXGARFADSLLKACPRTKRNRXAGNVERALARERGGAPPGGAVDTGPSGIGHERDIGKISPEEQKLLAVALEELAKNISKGVKLIVPTPN

SEQ ID NO: 130049 - protein, 291 aa, Triticum aestivum
  unsure (1)..(291): unsure at all Xaa locations
  Clone ID: PAT_TA_24467.pep
MKFSVSPVVQXRSVEVKNAQDLPKLVEGLKRLSKSDPCVLTFISDSGQHIVAGAGELHLEICLKDLEDDHAGVPLRISDPVVSFRETVRSTSRMTALSKSPNKHNRLYMVAEPLAEEVSLAIEAGKITPRDDVKTRARLLAXDDFGWDVTDARKIWVXSGPDTNGPNLLVDQTKAVQYLNEIKDSVASGFQWAMKEGPVTEEPMRSCRFNIMDVTLHADAIHRGGGQIIPTARRVLYASVLLXAEPALQEPXVFLAEIQVPENALGSVYSTLNIKNEGKVVPEEQRPGEPP

SEQ ID NO: 130050 - protein, 134 aa, Triticum aestivum
  unsure (1)..(134): unsure at all Xaa locations
  Clone ID: PAT_TA_24468.pep
MEEEVAALVIDNGSGMCKAGFAGDDAPRAVFPSIVGRPRHHGIMIGMGQKDSYVGDEAQSKRGILTLRFPIGHGVVTNWDDMGENMXTTHSXNELRVAPEXEHPGLLTXSPIXPSRXREXXTXIGFXXFKXPAX

SEQ ID NO: 130051 - protein, 164 aa, Triticum aestivum
  unsure (1)..(164): unsure at all Xaa locations
  Clone ID: PAT_TA_24469.pep
FFPLRXTNYKNPFLRTLVPAVGAAYALQATVAIPSILAKSEKFYDASGSITYLSVTALSLCLPMLRARISGNFVNEMRPVTLSFSALNWRQVALSMAVTIWATRLGSYLFQRILADGKDSRFDEDKXSPLKFLGAFTAQATWVSICLLPVLALNSIPTKLLSLQ

SEQ ID NO: 130052 - protein, 176 aa, Triticum aestivum
  Clone ID: PAT_TA_24470.pep
RVPEQEKEQLKVDHDNETPAQAFARRHEELAEQESKNHEIFLSQERTKKNRAPKQESVKFEPKSRPSNHRFPSRDIWEDTPDSLLLQTTVAGPQVEKDISNALEEQQNPELTNTEAYRLPQFRDENIDLAKSSQTVKPSVPFRSTVPNLQDRQEQSQAAILGKSLQKPTSGPVRLH

SEQ ID NO: 130053 - protein, 118 aa, Triticum aestivum
  unsure (1)..(118): unsure at all Xaa locations
  Clone ID: PAT_TA_24471.pep
TTHLSSVHRGTVSTSFRGIPFAQPPVGPTPPPAPAAHYTELGQLVDANGILPASCPQQVNSNKPNVSWXLKDLLQRHYSTVGXGQKVRNYYEGGPGRVXCXKXAMXLXPXKXXGGVSG

SEQ ID NO: 130054 - protein, 172 aa, Triticum aestivum
  unsure (1)..(172): unsure at all Xaa locations
  Clone ID: PAT_TA_24472.pep
MSTTNTSVPTVDQILVPETLLKKRKSQEKAREERAAEIETKKKAQKEKRGVIFKRAEKYVKEYRDMEREKIRLSRLSKQDGTYFIPAEEKLVFVVRIKGINKIAPKPRKILQLLRLLQINNGVFVRMTKATLEMLKVVEPWIAYGYPNLKXIRELIYKRGYGKVDKQRIALT

SEQ ID NO: 130055 - protein, 141 aa, Triticum aestivum
  unsure (1)..(141): unsure at all Xaa locations
  Clone ID: PAT_TA_24473.pep
DSPVIDNGKFKFNILPGQRVSLDLHAIYRDPKIFSDPQEVNLNRPLESYFDHGFGPQQYVGHDLNLVARVAMTAMFKTIFSLKGLQRLRGGGVARSRSPGARVKXMLKKAQISPVRFAYMTPDQSSFCPFPTTMKIQWNIE

SEQ ID NO: 130056 - protein, 70 aa, Triticum aestivum
  unsure (1)..(70): unsure at all Xaa locations
  Clone ID: PAT_TA_24474.pep
FTFLMQVSRIFYSWPNSSRVKSRNCRTLGHRITSICYRTITSTLLVVPVKRFGKSKRQDTRGGAGPXSAX

SEQ ID NO: 130057 - protein, 106 aa, Triticum aestivum
  Clone ID: PAT_TA_24475.pep
MAAERKERSGIAVGLNKGHKTEARVPKPRVSRTKGHLSKRTAFVREIVKEVSGLAPYERRVIELLRNSKDKRARKLAKKRLGTFGRAKAKVDELQRVIAESRRAGH

SEQ ID NO: 130058 - protein, 98 aa, Triticum aestivum
  unsure (1)..(98): unsure at all Xaa locations
  Clone ID: PAT_TA_24476.pep
MEGLFFNVNNGYIEGXVRGYRNXLLTGQNYTXNLTQCETIDDLKLQLGPXYGDFLASLPPNPSTSSLAAKASDKLXSEFRYVRANASGGHXQKFMGLH

SEQ ID NO: 130059 - protein, 119 aa, Triticum aestivum
  unsure (1)..(119): unsure at all Xaa locations
  Clone ID: PAT_TA_24477.pep
MSYNKIDKEGYGEAPKTHKIRITLSSRKVQSLEKVCQELIDRAKTKGLRVKGPVRLPTKTLKVTTRKTPWGEGSKTWDTFVMRIHKXRLIDLNAPTEXVKQIIINIEGWWLKSRVTIAA

SEQ ID NO: 130060 - protein, 101 aa, Triticum aestivum
  unsure (1)..(101): unsure at all Xaa locations
  Clone ID: PAT_TA_24478.pep
NVCKNSLKAKIDFEGQKLNESLATSLLVVAGVVSFLYGYFRQGYXYKPLYIGLXGTALTFFLGVPPWPFYRSHPVKWLPVEGSDKHVRDFLPRWVWLSISK

SEQ ID NO: 130061 - protein, 70 aa, Triticum aestivum
  unsure (1)..(70): unsure at all Xaa locations
  Clone ID: PAT_TA_24479.pep
QARYXLFAILFGSIXIALIPRIAGNAYLNPSYIRWKLLKKLFILASDIRDSSDVTRLLYSPYLGVYGLKY

SEQ ID NO: 130062 - protein, 84 aa, Triticum aestivum
  unsure (1)..(84): unsure at all Xaa locations
  Clone ID: PAT_TA_24480.pep
VIQTCLRHPSTFLRAKCNLRCLLPKWSRCPGYSNYTRRTSPGGGSQHLPSWACFYSVKLHSRKRSLGRAQSPIPKNSLAKFXIP

SEQ ID NO: 130063 - protein, 88 aa, Triticum aestivum
  unsure (1)..(88): unsure at all Xaa locations
  Clone ID: PAT_TA_24481.pep
NSGFSNPQHPEECRRETNITPQEHLNGATTSSPSPTPATAQVPMATPNIGPYQSREXGGGNPEPQPXSPAQANNSNLPPWMLSTISNR

SEQ ID NO: 130064 - protein, 182 aa, Triticum aestivum
  Clone ID: PAT_TA_24482.pep
MASTPPPVIGKAGNLTVFITPPATPPPVDTPTSRSAESPGSEFSTPNSTPRSVASPASPPPEHIATSPPPAKMVSPPPPVKTVSPPLPPAKLFQASPVQVPPPQFEKAEARTDGSAFGFFWDAVLRVQEAHASLDEYISNWIGLDQSKYQWALNDNYESTGKEMDSGKAAKTTELSGKIQKV

SEQ ID NO: 130065 - protein, 171 aa, Triticum aestivum
  unsure (1)..(171): unsure at all Xaa locations
  Clone ID: PAT_TA_24483.pep
MAAGSVGVSKSNDGGGGGRVTMFVVLSCITAGMGGAIFGYDIGIAGGVSSMEPFLRKFFPEVYRRMKGDSHVXSNYCKFDSQXLLTAFTSSXLYVAGLLTTFLASGGQRPVLGRRPSMLLXGGAAFLAGXAVGGAPLNAYMAILGARAPPGSGWASRTKAVALHLSEMAXP

SEQ ID NO: 130066 - protein, 126 aa, Triticum aestivum
  Clone ID: PAT_TA_24484.pep
PSLLFLSPALSRLFRFPASLTWSGDMRHKAWSHLPFIFSKVLGNQRYQSLANAIDFSVKKSHTAESRFRMRCKEAAECSRRINNAGVSPSKFTAFKYQGMTTLNEWAFAMDPQLPNIFPGQKTSYL

SEQ ID NO: 130067 - protein, 160 aa, Triticum aestivum
  Clone ID: PAT_TA_24485.pep
RRHLSLSPPALDLDSPPTGALTSRRPYPPSHHPPTLSVSPSLPSSPQRGEGDRPTMAAAMVAARSGMVAGTSPSSQRLRDLPVWDRSTVSSRCFCSAAREEIPWTPMSSSAALTPIQVCPLLCSPLRSALLPIPSPRHAFSLGFLPHTGTCTSNSMQGEE

SEQ ID NO: 130068 - protein, 126 aa, Triticum aestivum
  Clone ID: PAT_TA_24486.pep
MGEQPQQQEPLLEVEQCVTSIPEDHEATCWGCGLRLVFSSYSPVYKCGWCGAVTQGNQTSRKPDSVCFSHWRRFRDGFFVIVLVLFLLAPFRGRVRRPGSLPRPRGRLLGLSLSQQSLNQNLQIEV

SEQ ID NO: 130069 - protein, 52 aa, Triticum aestivum
  unsure (1)..(52): unsure at all Xaa locations
  Clone ID: PAT_TA_24487.pep
KLTYLDFRSTTKVRPDIKKSNLRXKPWTTHSTARGCPQRQICGIHXLIFNPQ

SEQ ID NO: 130070 - protein, 135 aa, Triticum aestivum; identical to SEQ ID NO: 129600
  Clone ID: PAT_TA_24488.pep

SEQ ID NO: 130071 - protein, 135 aa, Triticum aestivum
  Clone ID: PAT_TA_24489.pep
MAPKAAEKKPVEKTPAGKKPKAEKKVPASKEGGEKKGKKKSKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 130072 - protein, 262 aa, Triticum aestivum
  Clone ID: PAT_TA_24490.pep
RREPETDPPPHPHPHAPPPSTPTPTPRPPLPAAPSPTPWAAQGGPKRKAVKKTPGGKEAQGGEEGAGVQGGRREEEEEEGHQEHSDEEEDPRPRGDGAGPPGHAHLSPNHLPHILSHSRHVREAGAGDPASRPHYTRKPPIPPRGSPPPARPVLPGELAQPPPPARTTPRHHVHLRLLRSRSRVCFFGGLVGCRSVVFWSYFLVLLVCVVCCVVCEASHFIFRKNSNSLYHSFAKKKKMLLCLGSICGASSLFSVNLCGRRL

SEQ ID NO: 130073 - protein, 116 aa, Triticum aestivum
  unsure (1)..(116): unsure at all Xaa locations
  Clone ID: PAT_TA_24491.pep
XFLVTSLLPSALSCLFLLGACCALGENVFLLSKILDCMSVEVAASFASQAVPDQIYQSDPVSRGDVVLEAYHFSRTNANNEPGYYLIQVVNEHRVLVLWKYLQKKWSPCPLLINEP

SEQ ID NO: 130074 - protein, 244 aa, Triticum aestivum
  Clone ID: PAT_TA_24492.pep
TGPEFPGRPTRPDSLREVIGAVLKQLGSSYNTIDMETEVNGGREAVLSSFTQLQKQVQLFDSMNYLKSFGVGDVWVTVGWSSDVIPAAKRMSNVAVVVPKSGSSLWADLWAVPCATRFQTDRIGGRTRGPSPLIHQWFDFCLQSARSLPFRQEIIPGASPLFLENPAPEVLQDRNKKKPKLESNLLRGVPPPEILEKCEFLEPLSDKAVGDYQWLMSRVHRPRGGLLGTMLQKISTMLDLKSRF

SEQ ID NO: 130075 - protein, 199 aa, Triticum aestivum
  unsure (1)..(199): unsure at all Xaa locations
  Clone ID: PAT_TA_24493.pep
MSRTLEDEDRRELGALHGRLMNFSSRALSAPGRPAPPQELFTMAHHSSQVSADLIWEIVRPQNSFLVKRASSGGIQFSRDPLNLKNVHSRKYAGFVNDKAVGILPAEGDKGGVTLVTKKPKHSQKPASALSKTTFGGHKSTRKTYKGVVNTTVKFGYRSDLKVEAIARASALRQAQKPKKNAPXQKLRGAKGFGSKVIG

SEQ ID NO: 130076 - protein, 604 aa, Triticum aestivum
  Clone ID: PAT_TA_24494.pep
NSARLLSPDCPATAAPLPPLCPRASPWIAAQRSAAGLLPSAASPLVLRARERTSQMDFFTEYGEGNRYKIEEVIGKGSYGVVCSALDTHTGEKVAIKKINDIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAISDTPTAIFWTDYIATRWYRAPELCGSFFSKYTPAIDIWSIGCIFAELLTGKPLFPGKNVVRQLDIITDLLGTPAPETIATIPNEKARRYLSSMRRKKPVPFTHKFPNADPLALNLLERMLAFDPKDRPSAEEALADLYFKNIASVDREPSAQPITKLEFEFERRRITKDDIRELIYREILEYHPNMLREFLEGAEPTNFMYPSAVDHFKKQFTFLEEHYAKGSTAAPPERQHNSLPRPSVIYSDNRPQGSDSRPQGAANITDDLSRCIIRDNAQKPRRDPASVGANRVPQGAAVARPGKVVGSALRYGNCSTSGTEQYEQRRVITSQGIVPNGVPSGSSYPRRNNTCKSETGEAERIDVSQAGPPKPYTGNKLPATVDGRNGHW

SEQ ID NO: 130077 - protein, 77 aa, Triticum aestivum
  Clone ID: PAT_TA_24495.pep
FQTYDTFEMKFLSSATTAAMAGLLLLVSAANGEGFYECYNKEKFYLSEVIVKASICYCWEIRNHRTSCSFECDSYFT

SEQ ID NO: 130078 - protein, 203 aa, Triticum aestivum
  unsure (1)..(203): unsure at all Xaa locations
  Clone ID: PAT_TA_24496.pep
PRPSSAPPPPLLPPPPPPPLPRRPSPPRPRPPPPPSPXPSPPPPCPPGRPGAPRRAPPPAPAPAARPAGRPPPPRRRPPPPPSRPPRPGAPPPPRRLGRPGPALRPPPARPAPAGGSLPGARPVGACGWGGWRGEGSVSSRRLESGSSPWRVVPMWRSAWGVLGAVPVIGAPNVGDASKLLGVSLHTIADMRDAAESIYKFGP

SEQ ID NO: 130079 - protein, 474 aa, Triticum aestivum
  unsure (1)..(474): unsure at all Xaa locations
  Clone ID: PAT_TA_24497.pep
MSASKGASTGKVTTKDTGLHKLVFKVLLDGTEVTYFVDGKKIIDGYIKDQRIYCNHCNKVVSPSAFEAHAGEGSRRKPYDNIYTSNGVSLHELSMSISKDMQLSERETDDLCRECGLGGDIFPCKMCPRSFHPACVGLPGVPSEEWFCDNCTILVQKEXALAANKNAKAAGRQAGVDSIEQILKRAIRIVPICDDLGGCALCKKKDFNNSVFDERTVILCDQCEKEYHVGCLRSEWQVDLKELPEGEWFCCDSCSEIRSSLDKMISEGAQPLSESDLDIIRKKHESKGLIMDTNTEIRWQLVXGRSATEDGNSLLSSAVPVIHQSFDPIIEAHTGRDLIPEMVHGRRPXKECQGQDYSGMYCAVLTVGSTVVSAALLPVMGGDVAELPLVATSMVPRARGSFQVLFSCIERLLVSLKVKHFMLPAAHEAEAIWMKKFGFSKIPQDQMEAYLVGPLLTVFHGTLNLYKAVPLPES

SEQ ID NO: 130080 - protein, 226 aa, Triticum aestivum
  Clone ID: PAT_TA_24498.pep
MDISEEQQQDFGVLLKQGAEGRVFVSTFVGRKCVIKERFSKKYRHPLLDSKLTLKRLNAEARCMTKARRLGVPTPVLYAVDPLPHTLTFEFVDGLCVKDILLGFGSNGINEERLNDIATQIGNAVGKLHDGGLVHGDLTTSNMMIKNSTNQLVLIDFGLSFTSTIPEDKAVDLYVLERALISMHSSCGDVMEKILAAYRKASRQWCATTNKLAQVRQRGRKRTMVG

SEQ ID NO: 130081 - protein, 161 aa, Triticum aestivum
  unsure (1)..(161): unsure at all Xaa locations
  Clone ID: PAT_TA_24499.pep
YFTNEGQIIRSPILNHAVTKISRWGYEDSVYLAKLAEQAERYEEMVENMKQVASEXDQELSVEERNLLSVAYKNVIGARRXXSWRIVTSIGQKXRDPKGNSSSRVVWIKDYRQEIEGKLAKICEDILQVLNKHLIPSAKSXXESXGFYHKMKGXXQRYPCK

SEQ ID NO: 130082 - protein, 88 aa, Triticum aestivum
  Clone ID: PAT_TA_24500.pep
GTESELVPTLPAVGSCRKFSRGEGGARPRTTGRPRIIPRHLQLAIRNDEELNKLLGHVTIAQGGVLPNIHQNLLPKKTKPNKQASQEY

SEQ ID NO: 130083 - protein, 89 aa, Triticum aestivum
  Clone ID: PAT_TA_24501.pep
MKGTKLAAILILQAVLVMGLLSHVNADFFPKCCNNCRSFSGVDVCDDAHPKCPQGCSACRVVSTSPEMWRCADMKSTVDGTCGGPCKKY

SEQ ID NO: 130084 - protein, 92 aa, Triticum aestivum
  Clone ID: PAT_TA_24502.pep
LQARDWNAVADHVLLSTFRREHACGGSNKGVQEEVVLVALLHGTIWFSVNLVSSLFALITIVKNQLSYRCCVCTQALCVYQLNFDVPCIQLS

SEQ ID NO: 130085 - protein, 139 aa, Triticum aestivum
  Clone ID: PAT_TA_24503.pep
AVAAFLLDSATSERYGYMCRPDTQQFIMFDQESAQQTLTEYCPSCRSPPDRELNDNTRNNRSPAYFDQVVKLGYSEYSIVVRVPGPHGLGTGFIITDRNCAFRTMLYMFTRGLRRCYYGALDNFLYQDGKGTGIRSCGD

SEQ ID NO: 130086 - protein, 84 aa, Triticum aestivum
  unsure (1)..(84): unsure at all Xaa locations
  Clone ID: PAT_TA_24504.pep
LKSSPTKRQINDFEVRFGYPLRTLDLLQFDSSLPLLQLSVELDGEQANYQALEXSTRSDENIHRPIIPTPRESTAPXEQGRKDH

SEQ ID NO: 130087 - protein, 149 aa, Triticum aestivum
  unsure (1)..(149): unsure at all Xaa locations
  Clone ID: PAT_TA_24505.pep
MALKRILKELQDLGKDPPSSCSAGPSGEDMFRWTATIMGPSESPYSGGVFFLSIHFPTDYPFKPPKVNFTTRIYHPNINSNGSICLDILRDQWSPALTISKVLLSICSMLTDPNPDDPPVPEIXAHVYKPDRSRXYKSTAREWTXEYAV

SEQ ID NO: 130088 - protein, 187 aa, Triticum aestivum
  Clone ID: PAT_TA_24506.pep
PKMTIYYLRNKYSRYPSPAFPTIKFTLSLFRSTVGKIALCLIALLSTYSFPSPYLFLDPTTKKSRSLFFNPAMYLVDTQILLILCEYLCGNNLPPWRFCLSLLRYLFPVDLTSSSLKFCSPSHTNVRESTKAGSQEDSKRQSLTENKQISFRDFFLGGVVFVTFEREKVASMPRSFASMASSLAGDE

SEQ ID NO: 130089 - protein, 91 aa, Triticum aestivum
  unsure (1)..(91): unsure at all Xaa locations
  Clone ID: PAT_TA_24507.pep
MVSVRQSPMVRSEEDLGPPWLRPLLGTSFFVPCPAHPDLSKNECNFFCLGCNHAAGALCSYCVPRXRDQHVVQIRRSSXHNVIRVGVGTVQ

SEQ ID NO: 130090 - protein, 313 aa, Triticum aestivum
  unsure (1)..(313): unsure at all Xaa locations
  Clone ID: PAT_TA_24508.pep
PRPRIANRAVGEHVSSIYISEQEKHFNVVNFVVLNEYVEMNLASSRSHCVYIFSVQHGSTADDKVRAGKIVLVDLAGSEKVEKTGAEGRVLDEAKTINKSLSALGNVINALTTAKPNHVPYRDSKLTRILQDALGGSSXKTLPKLIPNEVDSVKKPTCYSHDQDDPRGRAPSKAGSSQSEVSDPSLDSYDHDDLRDRILSKLRLSLKEEDVDLLEELFVQEGIIFDPNAAVPDIDLAFQDVASRQIVSLVQTVEELTETVQELTDENEKLRHQLEFAQEIAARAQCATADRSRGALFGFVPAAVLRPFGFVPD

SEQ ID NO: 130091 - protein, 128 aa, Triticum aestivum
  Clone ID: PAT_TA_24509.pep
VVVWLEVEGDQGDPAVSAIVVQCIILPLLGGARDQAVVDENVAKLKKVLEVYEARLSASRSRAGDDISLADLSHFPFTRYLMETEYAPLVAELPHVNAWWEGLKARPAARKVTELMPPDLGLGKKAEE

SEQ ID NO: 130092 - protein, 155 aa, Triticum aestivum
  Clone ID: PAT_TA_24510.pep
RAIARHVLRKYKPELLVGDGSPESASTVDMWLEVEAHQHHPVLVAITMQCLVAPLLGNAPDQAVLDENLGKLGKVLEVYEARLSASKYLAGESVSIADLSHFPMMRYFMETEYAALVEESPHVKAWWEELKARPAARRVTEFMPPDFGLGKKAEK

SEQ ID NO: 130093 - protein, 224 aa, Triticum aestivum
  Clone ID: PAT_TA_24511.pep
MAPALKVYGWAVSPFVARPLLCLEEAGVDYELIPMKREAGDHLLPDFLAKNPFGQVPVLEDGDLTLFESRAIARHVLRKYKPELLVGDGSPESAAMVDVWLEVEAHQHHPVAGAISIQCLLVPLLGGTRDQAIVDENVVKLRKVLEVYEARLSASKYLAGESVSLADLSHFPLMHYFMETEYASLVEERPHVKAWWEELKARPAARKVKEFMSPDFGLGNKAEQ

SEQ ID NO: 130094 - protein, 224 aa, Triticum aestivum
  Clone ID: PAT_TA_24512.pep
MAAPAVKVHGWAMSPFVARALLCLEEAGVEYELVPMSREAGDHRQPDFLARNPFGQVPVLEDGDLTIFESRAVARHVLRKHKPELLGSGSPESAAKVDVWLEVEAHQHQTPAGTIVMQCILTPFLGCERDQAAIDENAAKLTKLFDVYEARLSASRYLAGESVSLADLSHFPLMRYFMDTEYASLVVERPHVKVWWEELKASPAAKRVTEFMPPNFGFGKKAQE

SEQ ID NO: 130095 - protein, 225 aa, Triticum aestivum
  unsure (1)..(225): unsure at all Xaa locations
  Clone ID: PAT_TA_24513.pep
MAPAVKVYGWAVSPFVARPLLCLEEAGVEYELVPMSRAAGDHRQPDFLARNPFGQVPVLEDGDLTLFESRAIARHVLRKHKPELLGCGSPEAEAMVDVWLEVEAHQYXNPAASAIVVQCIILPLXLGGARDQAVVDENVAKLKKVLEVYEARLSASRYLAGDDISLADLSHFPFTRYFMETEYAPLVAELPHVNAWWEGLKARPAARKVTELMPPDXLGLGKKAE

SEQ ID NO: 130096 - protein, 50 aa, Triticum aestivum
  Clone ID: PAT_TA_24514.pep
NSIRRPGIAGLVVTYGLNLNIMQVTLVTSMCNLENKIISVERILQYLSLP

SEQ ID NO: 130097 - protein, 115 aa, Triticum aestivum
  unsure (1)..(115): unsure at all Xaa locations
  Clone ID: PAT_TA_24515.pep
MSSSDTAGSVADRPISPDTTRIGWVGTGVMGQXPWAHHLLAAGYALTVNRPTPAFGPRPRPGRPPPRGLARAPPAAVADVIFLXMVGFPPXVRXSTXLEPXHXAXSAXPPPQAVL

SEQ ID NO: 130098 - protein, 141 aa, Triticum aestivum
  Clone ID: PAT_TA_24516.pep
PSTPRLVSRSKSSKSRSPTHRRSIHGAGGAVAGEVPAGRGDHDGRRRAPARLHDLPQQALLLLRRGLRLLHRLRRPLLLLLQADVGTRASSDGPRARVPSGAVLAASATSIHSRSTRKERRSHLYPRSVSDAVAQVVNSVV

SEQ ID NO: 130099 - protein, 239 aa, Triticum aestivum
  Clone ID: PAT_TA_24517.pep
GFMFALALLMMTIYPIMIAPLFNKFTPLPEGSLREKIEKLADSLKFPLKKLFVVDGSTRSSHSNAYMYGFFKNKRIVLYDTLIQQCSNDNEIVSVLAHELGHWKLNHTAYSFVAVQVLTFMQFGGYTLVRNSKDLFESFGFEDQPVIIGLIIFMHTIIPVQHLLSFCLNLVSRAFEFQADAFAKNLGYAPELRGALVKLQEENLSAMNTDPWYSAYHYSHPPLVERLSALEDLDSKKEN

SEQ ID NO: 130100 - protein, 77 aa, Triticum aestivum
  unsure (1)..(77): unsure at all Xaa locations
  Clone ID: PAT_TA_24518.pep
AXYLILVXLPARIPMHMHMGGQPRXHNLTXPPQYNVVLPRAXXYHVSPPEXPMWCWYLISGTTRXXHPRYXGXAXGX

SEQ ID NO: 130101 - protein, 138 aa, Triticum aestivum
  Clone ID: PAT_TA_24519.pep
MGIFESLSDLLEAAIPWTEAHAEAPPVEAEEQEVNQTETKAAEPQETSEEQEQPTEQAEDAEEVEEEEEETVDPKEVLEEECKNSASCSPAKHHFEDCVERVTGAQEGTADEDCVEEFFHLIHCASSCAAPKLWSTLK

SEQ ID NO: 130102 - protein, 169 aa, Triticum aestivum
  unsure (1)..(169): unsure at all Xaa locations
  Clone ID: PAT_TA_24520.pep
XXNVXXKXXWNGHLQKPXSKNWTRFXGFPKGPMFPSINLPSNSRCXVKRVFLLQRGNYPIHRKLGLTAGSSMEGSESDPPQRNQGTKGANLNPRCFSEALKFSPHKVPQPPFQTSRSAQTSTTLRPDPRKNQRNFFQGFWPVNSKVDPLTLTLRQKTEQYQLLRVNSWA

SEQ ID NO: 130103 - protein, 81 aa, Triticum aestivum
  Clone ID: PAT_TA_24521.pep
RASTSSSMMITTHPRSMSRIGLARRASEDKTVACWCLIVSHCLGGSVMIHSARPRPRQIVGNVRCLTRTVPETVSGQLRLL

SEQ ID NO: 130104 - protein, 108 aa, Triticum aestivum
  Clone ID: PAT_TA_24522.pep
MVETELTPFEKAAKESKQLTIPLSNDKLLYMYGLFKVASGEDIEKAPAPGTFDLKGKAKRKAWREVSQYSQKEAEEKYIKFIEELKESNGFDPNKVPEVVGGTKAQEV

SEQ ID NO: 130105 - protein, 220 aa, Triticum aestivum
  unsure (1)..(220): unsure at all Xaa locations
  Clone ID: PAT_TA_24523.pep
MATARIAAGTCSAIAGHRLRPAAVSPLVSNLSHSHHHRRNQPLGLASARAAEHGLTGAHRPEFFPHDHCRAPPYSMSARRTRTMATSALAKKSLVGENAGLRNKEREARIRKQLQNPELTPSPLXDQQWVAMVALAGNFPSAPQLPPVALNGIIAKANKDYGSRGGSERDLAPDNSTLLSTLACVIALKKWNVGPEHIRRGLHFIGKKFSFSMDEQIATP

SEQ ID NO: 130106 - protein, 217 aa, Triticum aestivum
  unsure (1)..(217): unsure at all Xaa locations
  Clone ID: PAT_TA_24524.pep
LPVASTFQLALIQGGRRSSDGRAGAAMAEMGRDFLRQMRRCGVLAEELLRPRAGTGMAAWWNRQGGVLPRWSRDAGTGMATCWNWQEGVLPRWACDAGTNRPICWNRRPICCVRWSTPVPLQPTTMADMTKAGTSRPICWNRLSVLLHTTEHACTTEAGTNDRHVATARRRSTIAGTINFFAGSSDLFCYYPVTMIHDFAGNGKYFCWKHGILLKXK

SEQ ID NO: 130107 - protein, 76 aa, Triticum aestivum
  unsure (1)..(76): unsure at all Xaa locations
  Clone ID: PAT_TA_24525.pep
FGDIAKHSRSNLCSFEPVILNWSPECWNLKPFFALQIRSPIVLFEQTELGVETRNPKLXSVYSLISVVHFLGYGVV

SEQ ID NO: 130108 - protein, 84 aa, Triticum aestivum
  Clone ID: PAT_TA_24526.pep
RTGRKIGPVRRRLALAFLFCFLFFFFDFVLFSTFLLLTLCLFTNLFFFFLVYVFYFTFFYCVIYVFYIFCNVQNIGRFVALTSD

SEQ ID NO: 130109 - protein, 94 aa, Triticum aestivum
  Clone ID: PAT_TA_24527.pep
PPYNCMGEVIPGIKLESMINGEYNSLIPRGESGASFNSDERFGKIQIELVARNPPYEGWDVVFEATFNMHKIITKAEASSRGHTVPCYPVTRVD

SEQ ID NO: 130110 - protein, 133 aa, Triticum aestivum
  unsure (1)..(133): unsure at all Xaa locations
  Clone ID: PAT_TA_24528.pep
SCRIRHELAVPMLNLIYPDVEDAHCYGNIILRGLYSLGLHPRERIPLFTGVKDADLXVSVFNRVISNPIGTSAGVDKLAEIPDILXFALGPXAVVEVGGVTPFAQEGNPRPRVFKLPKYNALINRCGLARKGS

SEQ ID NO: 130111 - protein, 125 aa, Triticum aestivum
  Clone ID: PAT_TA_24529.pep
MPQTKSSKVKQAKVTHKFIINASQPASDKIFDISAFEKFLQDKIKVDGLVGNLGDTVQISQIGDGKIEVIAHTQFSGRYLKYLTKKFLKKQQLRDWLRVVSTSKGVYELRFFNVHNDAEDDDDDE

SEQ ID NO: 130112 - protein, 144 aa, Triticum aestivum
  Clone ID: PAT_TA_24530.pep
GTSGQGRDRGSVVVSAVGATPKAPLPPGPEGQPSAVASGAAGSDASRGRGVASVFRAAPRLGAAFAGAEAVVCGMRSGRASRHARVRRASPRSRFRRPRASARAATSWLVRRAALPFRRGPRSASALRGQGHAVVPRVRRRPAP

SEQ ID NO: 130113 - protein, 171 aa, Triticum aestivum
  Clone ID: PAT_TA_24531.pep
MAASEPSSAIDMAELDPVLHGVGFEMQEVSPSLLSGRLPVTERCCQPFKVLHGGVSALVAEGLASMGAHMASGYRRVAGVHLAINHFRSAALGDVVLARAVPVHLGRSTQVWEVKLWKMDPSEEGKKGPQISESRVTLLCNLPVPDNLHHAGDALKKYAAAATTPTPTSKL

SEQ ID NO: 130114 - protein, 243 aa, Triticum aestivum
  Clone ID: PAT_TA_24532.pep
MEGAISSGPNPRIAVVTGGNKGIGFEVCRQLASHGVAVVLTARDEPRGAEAVEKLRALGLAQVIFHQLDVTDTSSIATLFVFLKTRFGKLDILVNNAAIGGVEYLQELHANEEKFAGMDFDQMLEWMVKNVREPVDSAKKGVQTNYYGTKHVTEAVLPLLQSSSEGRIVNVSSLFGLLRLISNEEVRQELNDIDNLTEERLDELLDRFLRDFEADALEARGWPWGALRTRWQRHERLKVAVQG

SEQ ID NO: 130115 - protein, 123 aa, Triticum aestivum
  Clone ID: PAT_TA_24533.pep
QCVSLSLQLPLYAPLRLHSPSLTNGLKHPPTLLPSWQHLPLCHMVLVSKLHPHHQLGIFNNGTSTTSEASSATTSSTHKTTASPISSTKLFYCRWPPQPVSGANEYAKGSRRWCKLGINGVWL

SEQ ID NO: 130116 - protein, 142 aa, Triticum aestivum
  Clone ID: PAT_TA_24534.pep
MAPKAEKKPAAAEKTPAAEKTTAGKKPKAEKRPPKSKEGGADKKKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 130117 - protein, 142 aa, Triticum aestivum; identical to SEQ ID NO: 130116
  Clone ID: PAT_TA_24535.pep

SEQ ID NO: 130118 - protein, 110 aa, Triticum aestivum
  unsure (1)..(110): unsure at all Xaa locations
  Clone ID: PAT_TA_24536.pep
RGTIKGGIFGNIGNMQNLYETVKKAQMVVQVEAVRVQKELAATEIEGYCEGELIKVTLSGNQQPINVEITEAAMELGAEKVSELVNEAYKDXADLAQSIGMPAGLGDGLK

SEQ ID NO: 130119 - protein, 210 aa, Triticum aestivum
  Clone ID: PAT_TA_24537.pep
MASSTALSPVAFKSSFSPLPSRPARTSINVQGAFCLPCSTWKRANNRSFRVYSLFGGKKEKDENGDEAPSKGGIFGNIGNMQNLYETVKKAQMVVQVEAVRVQKELAATEIEGYCEGELIKVTLSGNQQPINVEITEAAMELGAEKVSELVNEAYKDAHQRSVQAMKERMADLAQSIGMPAGLGRRSQVIKGLVLECFPIMKEASLNFVF

SEQ ID NO: 130120 - protein, 150 aa, Triticum aestivum
  unsure (1)..(150): unsure at all Xaa locations
  Clone ID: PAT_TA_24538.pep
ITARAEPGTRLTALNICLLAHFTSLVSATALTYMLGANERACFYANVEKKGLKVAFYFAVQSGDSFEIDYEVVGPDRKEILDGIKERQGDFVFTANAAGPHEFCFXNKVSASTQKLFDFEITVENEXQASIPFKQDKSPXQASNLXGIHI

SEQ ID NO: 130121 - protein, 99 aa, Triticum aestivum
  Clone ID: PAT_TA_24539.pep
PCFLPAFPQGPPSSASAAAPDFSPEGTDPAAIPRRLSSFANSDSGASSSLPRAPPPSSPSMRHLTRRRSMRRPRGRSEGDGVRAGRARWITASSMGMVC

SEQ ID NO: 130122 - protein, 115 aa, Triticum aestivum
  Clone ID: PAT_TA_24540.pep
MARAAVARLVLVALVATMLLIATDAAISCGQVNSALSPCISYARGNGANPSAACCSGVRRLAGAVRSTTDKKTTCNCIKSAAGGLNAGKAADIPSKCSISIPYAISPSLECSTIR

SEQ ID NO: 130123 - protein, 142 aa, Triticum aestivum
  unsure (1)..(142): unsure at all Xaa locations
  Clone ID: PAT_TA_24541.pep
MLAAGSIKSQGLEPGITDTDPRQTETENSKLVVAYTDGSSRGNGTSNAKAGIGVYFGKNDPRNISEPLLGKPQTNQRSPSSMLFGAPFKSALKSKNXPTLYKTVXYSIXNXLTTGYKGWLXNXWRXASGSPVXXRDLIQAVR

SEQ ID NO: 130124 - protein, 80 aa, Triticum aestivum
  Clone ID: PAT_TA_24542.pep
HISSSHTINTYEVQTHTISHTRTHTHTHTHTHTKRAAGEGKELLQGSGKIEARLGGEEVQRSSSKLEMQKGYCKTGTDAW

SEQ ID NO: 130125 - protein, 103 aa, Triticum aestivum; identical to SEQ ID NO: 123558
  Clone ID: PAT_TA_24543.pep

SEQ ID NO: 130126 - protein, 155 aa, Triticum aestivum
  unsure (1)..(155): unsure at all Xaa locations
  Clone ID: PAT_TA_24544.pep
MSDIDFTPKFAPFFGMAGITFAMTFGCIGAAYGTAKSGIGISGVGTFRPDLIMKSLIPVVMSGIIAVYSLXVVAVLIAGDMGPPPGQNYSLFNGFMHXLACGLSVGLTGLAAGIXALGIVGDMGVRSYMLQSRIFVGMVLILIFGEVLGLYGLIV

SEQ ID NO: 130127 - protein, 319 aa, Triticum aestivum
  unsure (1)..(319): unsure at all Xaa locations
  Clone ID: PAT_TA_24545.pep
METAVLAPQQVNPAQAAVPQTRNAAAMAAMRKLGATSARRKTLCDITNLRRPLEAAADEGHQDGSRCADGVDAVARLVKENSDLVKLLEERDKFIELSGAELQNLRLANWQLAQANSQMLAELNLGKNRLKSLQHELTCSRAALKVKSSELEEAXKALKSSRLQQQKSANETARHLAADRAAAAAQLKDGNAEPASDASRAAXPXKSTCNASRKRLLNPMSXPAVAPTKLVAASKERESAQRRKSMRTPQPSGRREDLFEIEDVQLTAGSGDDRKETSWELDSSVQFPRRSSLGRPLRRATEKVTSYKEMPVNIKLRRP

SEQ ID NO: 130128 - protein, 70 aa, Triticum aestivum
  unsure (1)..(70): unsure at all Xaa locations
  Clone ID: PAT_TA_24546.pep
VIKFSKNIEKVSKTKKKSGINLXRKVLHQGSXPNDLTSLARGFSPPTLVSPLPLLPRGRVPDHGITLPLS

SEQ ID NO: 130129 - protein, 114 aa, Triticum aestivum
  unsure (1)..(114): unsure at all Xaa locations
  Clone ID: PAT_TA_24547.pep
MTVEKTIIKAGHGVSPKPGDTVTMEYTGFLKDTGXQDNKGKQFDSSVGRGDFEVVIGRKCVIKGWDEAIPTMKVGEKATLDIKQAINAYGKKWLWKYHSRQMLSPNLPMSSSRV

SEQ ID NO: 130130 - protein, 60 aa, Triticum aestivum
  Clone ID: PAT_TA_24548.pep
SRPLSPRTCAGTARATPPLNAVHPSGDVQVVLTRVDSPLAGLNTCNVDMVPARSALCEKC

SEQ ID NO: 130131 - protein, 72 aa, Triticum aestivum
  Clone ID: PAT_TA_24549.pep
MESPHEHQQNLLMSRIITNVEKLNEAISLLNMNLQHINIQNMNVELVAQMFKNYQTNVLFHLEATDSLKDPS

SEQ ID NO: 130132 - protein, 164 aa, Triticum aestivum
  unsure (1)..(164): unsure at all Xaa locations
  Clone ID: PAT_TA_24550.pep
TINHVCTKHFQDIAKSSNDLLNKDFYHLSAAALEVKSNTPNDVVFKVNGKSTHEGATSGLLEARYSDKPTGVTLTQSWNTINALDTKIEITDSIAKGLKAEILGSFLPATQAKGAKLNLHFKQAXFHGRAFFDLLKGPTALVDAVIGQGWVSSPGASPGYNVXK

SEQ ID NO: 130133 - protein, 170 aa, Triticum aestivum
  unsure (1)..(170): unsure at all Xaa locations
  Clone ID: PAT_TA_24551.pep
RAELGPSSPPPPTDGDDELPSSPTSPLLHLHLHLLRPPTSLSFPPPLQSTSSSSRRGFYFRLGPWLQFLAQPPLPKRCRTLAALLRATASISSRLAREVVKITGYVTDILCSSVLDVTVFLGQVLGVESNNSGGKKGQRFRNKSKVNMPLGVVTGPPLLGIIYKLSXCFV

SEQ ID NO: 130134 - protein, 110 aa, Triticum aestivum
  Clone ID: PAT_TA_24552.pep
SCRIRHELLHSALSPCSLDIRSHSFSFFFTVTHELSDLQRRNHNLKSSQLYTLPPTSTIKMRSSILTSFSLLISSYASASSIHGASSLERRHGHAQVQPINIVILNDKEE

SEQ ID NO: 130135 - protein, 206 aa, Triticum aestivum
  unsure (1)..(206): unsure at all Xaa locations
  Clone ID: PAT_TA_24553.pep
HLVRLNYKLPLRRSLLKPAPISPFSNTSLRLFHACKSDMSVKAFFDVSWKGPVLDAKNKATGEIKEQSGRINFNLYNDVVPKTAENFRCLCTGEKGFGFKGSSFHRIIPGFMLQGGDFNKHNGXPGGKSIYGEKFADENXPLKHTKPGILSMANAGPKHETASQFFYHYKSLRNWLDKKHVRNLAKVXRDEESMRVVKAIEXTRNG

SEQ ID NO: 130136 - protein, 122 aa, Triticum aestivum
  Clone ID: PAT_TA_24554.pep
AGRFALLGKETRWVLNTHPAMYPIYEKAQLLQHILLPQEKDTMCPFTPEEIGGDGGFTSDIDFFKKVIDLKSRDPEEVYHRIGDLFHHREGMVLIRSESLNQVVKQVQGLASDGECLKGISP

SEQ ID NO: 130137 - protein, 88 aa, Triticum aestivum
  Clone ID: PAT_TA_24555.pep
MFATRRAFAFAAKNRTFSTSVKDLSKVAVLGSSGGIGQPLSLLLKLNPRISELALYDINAAPGVAADLAHINTKSKVTGHDKTERCII

SEQ ID NO: 130138 - protein, 125 aa, Triticum aestivum
  unsure (1)..(125): unsure at all Xaa locations
  Clone ID: PAT_TA_24556.pep
XGAPFXGGGXVXYPEAGGLTGKRFXPXPGAIAXSNLXQISNSFXKRNPEGTHGGIGSGSGGDLIPRKFFPVXSXTSRAHPNFLWPFKLVKSYLVASDRESSDTLWKEEILGNREEHINALIRQMN

SEQ ID NO: 130139 - protein, 388 aa, Triticum aestivum
  Clone ID: PAT_TA_24557.pep
SVANTVIRQLNQVCPLENLRHVKRVRRRIQCEKSELSIILCLSTESESGKNGFPEAVQKVVKAYQLSPFIAKVASYPAMSKEEWEEQCKLWPTSYHPLHDTGGSSGFKEDELPSIFDCMRTAIQLSEVGNTAIIVDPSSMQIISKATDQTHQHDAFQKRNRCVNVEADGGRSLAETAGANDGRLLLSSSHVRNGLNMEVSCMDPWGWTKQRSSEQKTLSSEGGFLWHPLRHAAIVAIENAAERDRMMFHTSTSPTTELDLNGDMDNCSDNEPAKRPKIVTKDKEQAEHQECGSDLSGTNRPYLCTGFDIYLVWEPCTMCAMALLHQRFKRVFYAFPNPITGALGSVYRLHGEKSLNHHYSVFRVKMPEPDLNVSSDFPEKGCSDFVPS

SEQ ID NO: 130140 - protein, 92 aa, Triticum aestivum
  Clone ID: PAT_TA_24558.pep
PWTWSALFEESTNKYVTLMCRVNSQNDEKLAYYAFSLANACAVARSTRRNFCLQAVDVQQFIWCQIARSTTVVPSLLFDFRKRRRAKRKVTY

SEQ ID NO: 130141 - protein, 124 aa, Triticum aestivum
  unsure (1)..(124): unsure at all Xaa locations
  Clone ID: PAT_TA_24559.pep
PRFLFAFHPGGGPDPSKENPYAIFRQIRRXSRKRMLEIIQREASXCTXTQLXTAKLIPEVIGREIEKATQGIYPLQNVHIRKVKLLKAPKFDLGALLNLHGESSTDDAGQRVERDFKEQVLDSV

SEQ ID NO: 130142 - protein, 101 aa, Triticum aestivum
  Clone ID: PAT_TA_24560.pep
MQFNFFAIIAFLATSALATETVTVTVCSTTSAYPSTGYSMPTSPASPSSGYGSNPGYGSNPGYGSNPGSGSGSGSGSSGTGAYSYPGTKQPSYAIHRSCQR

SEQ ID NO: 130143 - protein, 180 aa, Triticum aestivum
  unsure (1)..(180): unsure at all Xaa locations
  Clone ID: PAT_TA_24561.pep
YTATKDELAHIKPLAKFLSFKSIVFLTWWQGVVIAIMYSLGLLRSPLAQSLQLKSSIQDFIICIERXMGIASAVHLYVFPAKPYELLGNQSPGNISVLGDYASSNPIDPEEVKESNRPSKMKLPQFEPDERSATNIKESVRDFVVGSGEYVIQDFKFTVNQAVRPVEKRFDKLLKKKGQV

SEQ ID NO: 130144 - protein, 103 aa, Triticum aestivum
  Clone ID: PAT_TA_24562.pep
GLDKAVIQPGKGFRGALGLSEGGPLFGFTKSNELFVGRLAQLGVAFSIIGEIITGKGALAQLNIETGVPINEIEPLVIFNVLFFFVAAINPGNGRFIIGEDEE

SEQ ID NO: 130145 - protein, 90 aa, Triticum aestivum
  Clone ID: PAT_TA_24563.pep
MASKVELVVEVADDEKKVVSYSVVDGELVSFYKNFRVTVQVTDKGADGAGAVVNWTMDFDKASDEVPEPDVIKETAAKTFHDLDDYLLKN

SEQ ID NO: 130146 - protein, 153 aa, Triticum aestivum
  Clone ID: PAT_TA_24564.pep
MASKVELVVEVKSPAEKLWTAMRESTELFPKIFPEQYKSIETVEGDGKSAGTVRLIKYTEGVPMVTFAKEKVEVADDEKKVVSYSVVDGELVSFYKNFRVTVQVTDKGADGGGAVVNWTMDFDKASDEVPEPDVIKETVAKTLHDLDDYLLKN

SEQ ID NO: 130147 - protein, 141 aa, Triticum aestivum
  Clone ID: PAT_TA_24565.pep
MSWQAYVDDHLCCEIDGQHLTSAAILGHDGSVWAESPNFPKFKPEEIAGIVKDFEEPGHLAPTGLFLGGTKYMVIQGEPGVVIRGKKGTGGITIKKTGMALILGIYDEPMTPGQCNLVVERLGDYLIDQGYYVGSHHHHHH

SEQ ID NO: 130148 - protein, 110 aa, Triticum aestivum
  Clone ID: PAT_TA_24566.pep
FVDEEVTGLDKAVIQPGKGFRGALGLSEGGPLFGFTKSNELFVGRMAQLGVAFSIIGEIITGKGALAQLNIETGVPINEIEPLVIFNVLFFFIAAINPGNGRFIIGEEEE

SEQ ID NO: 130149 - protein, 225 aa, Triticum aestivum
  unsure (1)..(225): unsure at all Xaa locations
  Clone ID: PAT_TA_24567.pep
MAAVAMDIAKPSALPASVDDPSAASAKGRAGGGEGLRQYYLQHIHDLQLQIRTKTHNLNRLEAQRNDLXSRVRMLREELRLLQEPGSYVGEVVKVMGKPKVLVKVHPEGKYVVDLDKSIDITKITPSTRVALRNDSYMLHLILPXKVDPLVNLMKVEKVPDSTYDMIGGLDQQIKEIKEVIELPXKHPELFESLGIAQPKGVLLYGPPGTLLSERAAEFDTTDAK

SEQ ID NO: 130150 - protein, 95 aa, Triticum aestivum
  Clone ID: PAT_TA_24568.pep
MAMMRKEAVVALMLALVLLAEVPGWARAECQVTQLAVCASAILGGTKPSGECCGNLRAQQGCFCQYVKDPNYGHYVNSPHARETLQTCGIALPHC

SEQ ID NO: 130151 - protein, 81 aa, Triticum aestivum
  Clone ID: PAT_TA_24569.pep
MASKVELVVEVKSPAEKLWTAMRESTELFPKIFPEQYKSIETVEGDGKSAGTVRLIKYTEGVPMVTFAKTFHDLDDYLLKN

SEQ ID NO: 130152 - protein, 181 aa, Triticum aestivum
  unsure (1)..(181): unsure at all Xaa locations
  Clone ID: PAT_TA_24570.pep
MASKVELVVEVKSPAEKLWTAMRESTELFPKIFPEQYKSIETVEGDGKVXGTVRLIKYTEGTCAVKRSTYPELVSVYICNVSIGCVPSGVPMVTFAKEKVEVADDEKKVVSYSVVDGELVSFYKNFRVTVQVTDKGADGAGAVVNWTMDFDKASDEVPEPDVIKETPPKTFHDLDDYLLKN

SEQ ID NO: 130153 - protein, 96 aa, Triticum aestivum
  Clone ID: PAT_TA_24571.pep
MASMGKKQVVAALMLVLVVLAAAPGGAHAACQASQLAVCASAILSGAKPSGECCGNLRAQQPCFCQYAKDPTYGQYIRSPHARDTLQSCGLAVPHC

SEQ ID NO: 130154 - protein, 156 aa, Triticum aestivum
  unsure (1)..(156): unsure at all Xaa locations
  Clone ID: PAT_TA_24572.pep
MSWQTYVDDHLCCEIDGQHLTSAAILGHDGSVWAQSPNFPQFKPEEIAXGIIKDFEEPGXHLAPTGLFLXGGTKYMVIQXGNLGFVIRGKKGTXGGITIKKTAWPDLGIYMSHDSWQCNWSWRRRHWSTGSSRLIYVFGRRTSCHVGIISGYDIYQ

SEQ ID NO: 130155 - protein, 182 aa, Triticum aestivum
  unsure (1)..(182): unsure at all Xaa locations
  Clone ID: PAT_TA_24573.pep
KENIVKSFFSLRHVPSSSYLTMSSFAYQKLKKLPPPPPPASDQEDAHYAVAAAQDHYYRHAAAAIIASRRTWRSRRSSSGTGPRRRGRPLRISSLXRGALRRRAAAVGGRVRASVTXVVTRLKEGGPCVADLFAGNYMFLQVTPSMAAPAAAGVGKGAFLPYYLAVKGKPAGAGAVHGLIRA

SEQ ID NO: 130156 - protein, 171 aa, Triticum aestivum
  unsure (1)..(171): unsure at all Xaa locations
  Clone ID: PAT_TA_24574.pep
EHAPSIIFMDEIDSIGSARMESGSGNGDXSEVQRTMLELLNQLDGFEAXSNKIKVLMATNRXDILDQALLRPGRIDRKIEFPNPNADSRGDILKIHSRKMNLMRGIDLKKIAEKMNGASGAELKAVCTEAGMFALXRERRVHVTQEDFEMAVAKVMKKDTEKNMSLRKLWK

SEQ ID NO: 130157 - protein, 237 aa, Triticum aestivum
  Clone ID: PAT_TA_24575.pep
HPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNADSRGDILKIHSRKMNLMRGIDLKKIAEKMNGASGAELKAVCTEAGMFALRERRVHVTQEDFEMAVAKVMKKDTEKNMSLRKLWK

SEQ ID NO: 130158 - protein, 345 aa, Triticum aestivum
  unsure (1)..(345): unsure at all Xaa locations
  Clone ID: PAT_TA_24576.pep
QLLQEPGSYVGEVVKVMGKSKVLVKVHPEGKYVVDLDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGXRIDRKIEFPNPNADSRGDILKIHSRKMNLMRGIDLKKIAEKMNGASGAELKAVCTEAGMFALRERRVHVTQEDFEMAVAKVMKKDTEKNMSLRKLWK

SEQ ID NO: 130159 - protein, 132 aa, Triticum aestivum
  unsure (1)..(132): unsure at all Xaa locations
  Clone ID: PAT_TA_24577.pep
MSWQTYVDDHLCCEIDGQHLTSAAILXGHDGSVWAESPNFPKFKPEEIAGIXKTLEEPGHLAQTGLFLGGTKYMVIQGEPGVVIRGKKGTGGITIKKTGMALILGIYDEPMTPGQCNLVVERLGDYLVEQGF

SEQ ID NO: 130160 - protein, 98 aa, Triticum aestivum
  Clone ID: PAT_TA_24578.pep
MASMGKKQKQVAATLMLALVVLAAAPGGARAACQASQLAVCASAILSGAKPSGECCGNLRAQQGCFCQYAKDPNYGQYIRSPHARDTLHSCGLAVPHC

SEQ ID NO: 130161 - protein, 358 aa, Triticum aestivum
  unsure (1)..(358): unsure at all Xaa locations
  Clone ID: PAT_TA_24579.pep
MVTEAASLPYAPGACRRLAVGDGEAAGGEGVAGVGAADVLPVGGVLGVLAEAPLLRPQVAAALAARLGPAQDRRRAHRQLRCLARRVRPARRRRQHHQRQHQRRHHLLLPHARHGSRSRSCRCVRVCDGSGVPRAESGTRPGTGKTLLXARAVAHHTDCTFIXRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRGDILKIHSRRMNLMRGIDLKKIAGKMNGASGAELKAVCTEAGMFALRERRVHVTQEDFEMAVAKVMKKDNEKNMSLRKLWK

SEQ ID NO: 130162 - protein, 96 aa, Triticum aestivum
  Clone ID: PAT_TA_24580.pep
MAGMRKQQVVAALVLALMVLAAAPGGARAACQASQLAVCASAILSGAKPSGECCGNLRAQQPCFCQYAKDPTYGQYIRSPHARDTLTSCGLAVPHC

SEQ ID NO: 130163 - protein, 96 aa, Triticum aestivum
  Clone ID: PAT_TA_24581.pep
MAGMGKQQVVAALMLALVVLAAAPGGAHAACQASQLAVCASAILSGAKPSGECCGNLRAQQGCFCQYAKDPTYGQYIRSPHARDTLQSCGLAVPHC

SEQ ID NO: 130164 - protein, 273 aa, Triticum aestivum
  Clone ID: PAT_TA_24582.pep
MAQSMLMSGVNGVASGRSLLQAARPSSASTPFSRLALSSSSSAAAYYKHMPSLSVRTMALFGKKTKAAPAKKVVAPKPKTEDGIFGTSGGIGFTKENELFVGRVAMIGFAASILGEAITGKGILSQLNLETGIPIYEAEPLLLFFILFTLLGAIGALGDRGRFVDEQPTTGLDKAVIAPGKGFRSALGLSEGGPLFGFTKSNELFVGRLAQLGIAFSIIGEIITGKGALAQLNIETGVPISEIEPLVLFNVVFFFIAAINPGTGKFISGEEDD

SEQ ID NO: 130165 - protein, 272 aa, Triticum aestivum
  Clone ID: PAT_TA_24583.pep
MAQSMLMSGVNGVASGRSLLQAARPSTASTPFSRLALSSSSAAYYKHMPSLSVRTMALFGKSKTKAAPAKKVAAPKPKTEDGIFGTSGGIGFTKENELFVGRVAMIGFAASILGEAITGKGILSQLNLETGIPIYEAEPLLLFFILFTLLGAIGALGDRGRFVDEQPTTGLDKAVIAPGKGFRSALGLSEGGPLFGFTKSNELFVGRLAQLGIAFSIIGEIITGKGALAQLNIETGVPISEIEPLVLFNVVFFFIAAINPGTGKFISGEEDD

SEQ ID NO: 130166 - protein, 96 aa, Triticum aestivum; identical to SEQ ID NO: 130153
  Clone ID: PAT_TA_24584.pep

SEQ ID NO: 130167 - protein, 96 aa, Triticum aestivum
  Clone ID: PAT_TA_24585.pep
MAGMMKKQVVTALMLALVVLAAAPGGARAACQASQLAVCASAILSGAKPSGECCGNLRAQQGCFCQYAKDPTYGQYIRSPHARDTLTSCGLAVPHC

SEQ ID NO: 130168 - protein, 153 aa, Triticum aestivum
  Clone ID: PAT_TA_24586.pep
MASKVELVVEVKSPAEKLWTAMRESTELFPKIFPEQYKSIETVEGDGKSAGTVRLIKYTEGVPMVTFAKEKVEVADDEKKVVSYSVVDGELVSFYKNFRVTVQVTDKGADGAGAVVNWTMDFDKASDEVPEPDVIKETAAKTFHDLDDYLLKN

SEQ ID NO: 130169 - protein, 477 aa, Triticum aestivum
  Clone ID: PAT_TA_24587.pep
MAAASAGGEPVEPQSLKKLSLKSLRRSLDLFAPTHSLPFAPDAESKRIRVSCKVNAEYGAVKNLPTDQDRAQGKGAAAPSNALALLGTQDTKDAPREGTSNAIIPAPLMLPKAPESAVPGKNTTVLSIPGSSDRFSTSALMERLPSRWPKPVWHAPWKNYRVISGHLGWVRSIAFDPGNEWFCTGSADRTIKIWDLASGTLKLTLTGHIEQVRGLAVSQRHTYLFSAGDDKQVKCWDLEQNKVIRSYHGHLSGVYCLAPHPTIDVLLTGGRDSVCRVWDIRTKAHVSALTGHDNTVCSVFARPTDPQVVTGSHDTTIKFWDLVAGKTMCTLTHHKKSVRAMALHPKEKSFASASADNIKKWSLPKGEFLHNMLSQQKTILNAMAVNEDGVLATAGDNGSMWFWDWKSGHNFQQEQTIVQPGSLESEACIYALSYDNSGSRLVTCEADKTIKMWKEDLTATPETHPVNFKPPKDIRRY

SEQ ID NO: 130170 - protein, 153 aa, Triticum aestivum
  Clone ID: PAT_TA_24588.pep
MASKVELVVEVKSPAEKLWTAMRESTELFPKIFPEQYKSIETVEGDGKSAGTVRLIKYTEGVPMVTFAKEKVEVADDEKKVVSYSVVDGELVSFYKNFRVTVQVTDKGADGGGAVVNWTMDFDKASDEVPEPDVIKETAAKTLHDLDDYLLKN

SEQ ID NO: 130171 - protein, 131 aa, Triticum aestivum
  Clone ID: PAT_TA_24589.pep
MSWQTYVDDHLCCEIDGQHLTSAAILGHDGSVWAQSPNFPQFKPEEIAGIIKDFEEPGHLAPTGLFLGGTKYMVIQGEPGVVIRGKKGTGGITIKKTGMALILGIYDEPMTPGQCNLVVERLGDYLVEQGF

SEQ ID NO: 130172 - protein, 131 aa, Triticum aestivum
  Clone ID: PAT_TA_24590.pep
MSWQTYVDDHLCCEIDGQHLTSAAILGHDGSVWAQSPNFPQFKPEEIAGIIKDFDEPGHLAPTGLFLGGTKYMVIQGEPGVVIRGKKGTGGITIKKTGMALILGIYDEPMTPGQCNLVVERLGDYLVEQGF

SEQ ID NO: 130173 - protein, 182 aa, Triticum aestivum
  Clone ID: PAT_TA_24591.pep
MIIKSQLYDHVKTKKNPGPSKASPAQPRPRALHAASAAAAAQRSRRRRRGRMSWQTYVDDHLCCEIDGQHLTSAAILGHDGSVWAESPNFPKFKPEEIAGIVKDFEEPGHLAPTGLFLGGTKYMVIQGEPGVVIRGKKGTGGITIKKTGMALILGIYDEPMTPGQCNLVVERLGDYLVEQGF

SEQ ID NO: 130174 - protein, 423 aa, Triticum aestivum
  Clone ID: PAT_TA_24592.pep
MAAVAMDIAKPSALPASVDDPSAASAKGARGGGEGLRQYYLQHIHDLQLQIRTKTHNLNRLEAQRNDLNSRVRMLREELQLLQEPGSYVGEVVKVMGKSKVLVKVHPEGKYVVDLDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRGDILKIHSRRMNLMRGIDLKKIAGKMNGASGAELKAVCTEAGMFALRERRVHVTQEDFEMAVAKVMKKDNEKNMSLRKLWK

SEQ ID NO: 130175 - protein, 206 aa, Triticum aestivum
  Clone ID: PAT_TA_24593.pep
MGTAAKPPPFVCFKWPWGPSLNASPSASPSPCGDLERPWLFKSISTVAQGLVIAGDIPSASTGSGGHGARLWKRHPGTAPVEADRGDAEQRALAAALVSARATTVLEFYSPRCRLCSSLQGLVRELEDGGNASASFVLADAEDDRWLPELLHYDVRYVPCFVLLDKNGRALAKTGVPTSRQHVIAGLHHLLNMKQPSGQDGKKSRS

SEQ ID NO: 130176 - protein, 124 aa, Triticum aestivum
  unsure (1)..(124): unsure at all Xaa locations
  Clone ID: PAT_TA_24594.pep
MSAPHFANFIIKRPWLLRVFDPFAKWYTNAAGYRKLGLRADDLIPEESEVVLHALKRLPPKDAYDRVFRIRRAVQXSLSHQLLPKEEQTKPEEDVEYLGPLIREIEAEARERADLESLAIEKRK

SEQ ID NO: 130177 - protein, 149 aa, Triticum aestivum
  unsure (1)..(149): unsure at all Xaa locations
  Clone ID: PAT_TA_24595.pep
MSFPAPIIIPAVXKHTATXVIVAHGLGDSGDGWVWLAENWRRRHKFEGVRFIFPHAPKIPISMNMGLSMPGWVDFRSSRTGNPPLMDRASYAHWPSRFGPLTPRARAGNERLLVGGADAHCGAWDLPPAYLPGKLGGVLGFLVPLARFN

SEQ ID NO: 130178 - protein, 113 aa, Triticum aestivum
  Clone ID: PAT_TA_24596.pep
IEKERARYCKPIQAGVNLWQVTSGEQTHAVNLEVETCGCRKWDLSGIPCNHAISAINKAKRFPEDFVSKFFKKPYYLAAYEPMIYPVPGEHDWTKTPGPDIEPPAFKVKKGRR

SEQ ID NO: 130179 - protein, 167 aa, Triticum aestivum
  Clone ID: PAT_TA_24597.pep
MCPGGRYAGLDLPAGAGAGDLRPAFDVLDADHDGRISRDDLKTFYANAGATDERFDDDDIEAMIAAADADLDGFVQYHEFEGLLGRAAKAGADSGCRSAMEDAFRLMDRDGDGKVGFEDLKAYLGWAGMPVADDEIRAMISMAADDDGGVGLEALARILAVDFDAIV

SEQ ID NO: 130180 - protein, 314 aa, Triticum aestivum
  unsure (1)..(314): unsure at all Xaa locations
  Clone ID: PAT_TA_24598.pep
MALQPLLRLLLRPAPTPPPPTRRTPHLPAPFSTRRGTAAALLLLAVAAPPPRPARAEPDGEDDVDEPHVVRLFEEATPSVVFIKDLLVAPPPRTRGRDGGGAQPVDDEEGGATVEGTGSGFVWDSLGHIVTNYHVVAKLAGDGSESHRCKVFLEDSTGTSYSKEGRLIGYDPTYDLAVLKVDVDGDRLRPALLGTSQGLRVGQSCFAIGNPLGYEHTLTTGYPXVVSGLGREIPSPNGRVIRGAIQTDAAINAGNSGGPLIDSYGHVIGVNTATFTRKGSGISSGVNFAIPIDTVVRSVPNLIVYGTDVSNRFY

SEQ ID NO: 130181 - protein, 129 aa, Triticum aestivum
  Clone ID: PAT_TA_24599.pep
SIVWSPTMISLFAGYGIAGFMFYTITPFVLEMSGATLLNLSLLTSDMWAVAIRVFFYQQQINWLYYLAFAVVAIGLIIYSLNESSSADATATSTEAAAHYEQLPGEDNSTGSGSILDRKERKQQEAHIC

SEQ ID NO: 130182 - protein, 99 aa, Triticum aestivum
  unsure (1)..(99): unsure at all Xaa locations
  Clone ID: PAT_TA_24600.pep
MITNTRRLIGLKPAKQLMRYSSYKSPHXPKYAVQPNIGXFTLKQAKTLGITLGGFGGVAGFFALFFLGDVPRVREDILEKVPFIGSHFKKGIPXSDNPF

SEQ ID NO: 130183 - protein, 105 aa, Triticum aestivum
  unsure (1)..(105): unsure at all Xaa locations
  Clone ID: PAT_TA_24601.pep
XPTRFLLFFGXYIVTCLTPLRNIQGPRDSPCVLPSSWGLFNLPACRQYRILNRQAFTIVRRVGPSLFQVDFHRQGRGCCNYNSPASITLVMYFLVFVFVSVIRII

SEQ ID NO: 130184 - protein, 182 aa, Triticum aestivum
  unsure (1)..(182): unsure at all Xaa locations
  Clone ID: PAT_TA_24602.pep
RAEFGTSLDSEKCIECGNNYEMQSPETRARPENPNPKWPXVPKDLIELQPSYKQDDWDPXDWXSTTSSKVAYLIDKLRSLREARMRHVHSTNITIGAGPATTSSSQDDDNLQTRLPQTXPDKVIIFSQFLEHIHVIGQQXLTIAGITYAGMYSPLPFGTKRSALTKFKEDPTCMALLMDGTA

SEQ ID NO: 130185 - protein, 83 aa, Triticum aestivum
  Clone ID: PAT_TA_24603.pep
ISQKSEQNRQSCGCSARQRSWNFSTKTRAITAQSGGCCIFVQNKFVVMEQELDYLVNCLRTAAATPLINERMLLTSPRNKKKK

SEQ ID NO: 130186 - protein, 128 aa, Triticum aestivum
  Clone ID: PAT_TA_24604.pep
QLKLRSAGVGHDDEDSDARSEAGSARMQAKADAALARENEALRSELARMRAHMSSGVQQSKGSGSRTAATAPVAGKKASFFGSMSRTLSRLNPFRAGGGWSKDTSSIRESRGGAMNVVKPKRRRSSIS

SEQ ID NO: 130187 - protein, 214 aa, Triticum aestivum
  unsure (1)..(214): unsure at all Xaa locations
  Clone ID: PAT_TA_24605.pep
MAQAPVTPSFKLVLVGDGGTGKTTFVKRHTTGEFEKKYIATLGVEVHPLKFNTNLGEIQFDVWDTAGQEKFGGLRDGYYINGKCGIIMFDVTSRITYKNVPNWHRDLVRVCENIPIVLTGXTKVDVKERKVKAKTITXFHPKENLQYYDISAKSNYNFEKPFLWLARKLVGNPALEFVAAPALAPPTATVDHALLAQYEKEMHEAAQMPPPGER

SEQ ID NO: 130188 - protein, 171 aa, Triticum aestivum
  unsure (1)..(171): unsure at all Xaa locations
  Clone ID: PAT_TA_24606.pep
ADEKXSEEKREAAKXLKSSKDIEKIEILKRSTTGDPAGGDGVNEANPDNVVKTKEPGRENKPKPSDSGAWRRASHTVPSSRDDIPRGPRGARGGPVGGSRGRGDGPKQYDDRVNRKIMNGESSPVAIVLEGKPEAVAQVAEEDGWSTVSKAKKNNRSGKXSARGCNVLDVX

SEQ ID NO: 130189 - protein, 142 aa, Triticum aestivum
  unsure (1)..(142): unsure at all Xaa locations
  Clone ID: PAT_TA_24607.pep
MAAPLRRVFPSLGRALLSPTPARMLSAEASDALVEIKPGEIGMVSGIPEEHLRRKVLIYSPARTASQQGSGKVGRWKINFVSTQKWENPLMGWTSTGDPYANVGEAGLTFDSADSAKAXFAEKHGWEYVVRKRHTPLLKPKT

SEQ ID NO: 130190 - protein, 170 aa, Triticum aestivum
  Clone ID: PAT_TA_24608.pep
MLASPALAGATHSFPAFVSGSRGVHLPSVSAPSHSPARRAALVVLAKAKVSTPNADRIARHDRLRKKVSGTTERPRLSVFRSNKHLYAQVIDDTKSCTLASASTMHKALSKELEYSAGPTTEVAQKIGEVIAKSCLEKGITKVVFDRGGFLYHGRIKALADAARENGLEF

SEQ ID NO: 130191 - protein, 148 aa, Triticum aestivum
  unsure (1)..(148): unsure at all Xaa locations
  Clone ID: PAT_TA_24609.pep
MADAQRAGAGAARGGGFGSRGDRGGDRGRGRGRRGPRRGANKNEEKEWXPVTKLGRLVKEGKIKSMXEEIYLHSLPIKEYQXIVDYFLPKLKDEVMKIKPVQKANSCWVNRTPIQXAXVINXGGLPNAMSGLGIKTSKGSSHCVSGKL

SEQ ID NO: 130192 - protein, 105 aa, Triticum aestivum
  Clone ID: PAT_TA_24610.pep
LEKHLVIWQNRICILPEMKIQNLEWLVALLGISKLACADIVFYCDGVAITEDHIKTAYGNSQSAPISGYPMGMEIPYYGEPCLLYFLSHFTGTGETIKTKSSVGH

SEQ ID NO: 130193 - protein, 93 aa, Triticum aestivum
  unsure (1)..(93): unsure at all Xaa locations
  Clone ID: PAT_TA_24611.pep
TQQITPFLFLHLPERCPKFPKKSNNSTAPTPQNTPANNAPISSHAQQPGVGTIKEERIRSXASASIFAHNPKLVXLIQGKTTFTRLGRSSGYV

SEQ ID NO: 130194 - protein, 157 aa, Triticum aestivum
  unsure (1)..(157): unsure at all Xaa locations
  Clone ID: PAT_TA_24612.pep
MTEQLILKGTLEGHSGWVTSLATSLENPDMLLSASRDKTLIIWDLTRNETAYGLPKRSLHGHSHIVSXDCVISSDGAYALSASWDKTLRLWELATGTTTKRFVGHTNDVLSVSFSXADNKQIRLGLSRTGTIKLWDTLGDWQFSNLQEKGQKRLGHV

SEQ ID NO: 130195 - protein, 115 aa, Triticum aestivum
  Clone ID: PAT_TA_24613.pep
ERKRKPGRPTNSRDKLPYDDRGAKSKRMKQRTAAEDVDRCGTSKRTRFCSICREPGHKSTTCPQRGGPPPKERNEAKCSICGVGGHRRNTCNKPKVVLYVAGTTNVDTNALTSLI

SEQ ID NO: 130196 - protein, 101 aa, Triticum aestivum
  unsure (1)..(101): unsure at all Xaa locations
  Clone ID: PAT_TA_24614.pep
PPGARRPAGGXGQLPXXXPLPNSAVESNRRGXCFPARSPRRQMTLGRADYGTGRRRRPRGAAGGAPAPPPGSFDRPRGPVVASHESEVNKLARVINFLLGS

SEQ ID NO: 130197 - protein, 175 aa, Triticum aestivum
  unsure (1)..(175): unsure at all Xaa locations
  Clone ID: PAT_TA_24615.pep
SLXILIXSSXSLXDQYXGDMLKAMIHDVDLPTVVRERLNLFVESDSIITGADTGTRKKRTIPNLVMLISRDLKLGAEIYRILVSHYEREDFEVICLRPCFYLFGRVEEATALSAAAQGSMLNIEPHVIEDQGAMMFEDMVLFNEGDAPEWIWDPLQKFPTRFTGVWVVRSDRNGN

SEQ ID NO: 130198 - protein, 99 aa, Triticum aestivum
  Clone ID: PAT_TA_24616.pep
SCRIRHELEFFYSEAPESMKSMCTSFALLTVALGSYASSLIYAVVNALTATGGRPGWISDDLNEGHLDYFFWTMAALCTLNFVVYSAFARNYQVKTVVS

SEQ ID NO: 130199 - protein, 245 aa, Triticum aestivum
  unsure (1)..(245): unsure at all Xaa locations
  Clone ID: PAT_TA_24617.pep
AASCRIRHEGGSSSFSLPVPSGANAAPGPVSAQVQVQPRVQQXPPQAAPSKVSNASIKSRNSSKKQTAQANPTNAPSSIQAAAIAAGGRIATSKHRHQFIXAAQSPQAVHIRSRGKGSSKTSTSSKASTMAGEPGTQTGSAQHPELLNCSAPTPSPTVLITQSTEQVNVVPEVAGVNPPEQSASAHLLEPDRTLSTTPVPGPCDNMEIDDDSTFCVVTMEDLFPEDVKQPETVSQPEMVRQPETV

SEQ ID NO: 130200 - protein, 161 aa, Triticum aestivum
  unsure (1)..(161): unsure at all Xaa locations
  Clone ID: PAT_TA_24618.pep
MLHTFASPAPHLGNIAPVAMAPAQHFSLSAGGGDSQTEMPHFSFSHDHYMPVHAAPASAPAVDYSLNFSMSSGLVGVNNTRGTLQSNSQPHLSGHHHHHHQQLQRLSTPLDAPHIPFLFKPKPSAGXPPPTQAGEATSARRAALQLWEGFXHSDMKEKGKN

SEQ ID NO: 130201 - protein, 98 aa, Triticum aestivum
  Clone ID: PAT_TA_24619.pep
RVHPLSLPPSAACGYGSGAHLKIQHVHPPHAPAVGASCLGSTNLGFFLGLSPLPVIGRIVFWPGCPWSGPRPREWFLLRESCLFSVRAQWRTTASCRR

SEQ ID NO: 130202 - protein, 230 aa, Triticum aestivum
  unsure (1)..(230): unsure at all Xaa locations
  Clone ID: PAT_TA_24620.pep
QITNLVIILGMMQVSKKIPMEDPNVLNMIRVGYVISNLVIISIYAYVHFQITKKKDLTTLKYIDTPPMGSAEEPKLITTPPHAXYDVTQXRLLYKAQLMGVGMMAVMHLYFKYXTNPLIIXQSIIPLKGALEGSXVAIHLFGKPAXGELKRPFKAPPRALXSLQGGAGQVQXDRKAMEAAGKSGRGGAKEEYTIRWNVRAENAFNFIKKSYISLNKIYLSIKLAIGFIRA

SEQ ID NO: 130203 - protein, 108 aa, Triticum aestivum
  Clone ID: PAT_TA_24621.pep
MAIQKVTSLDEYRKIAKDNQSIIIMFTAEWCGPCKVAYPRFQKKSDEFKNTTFISADVDHAQDLSTEFGIKAMPTFIAIENGEKKETLIGGDLRNVIPFLGDTQHSRL

SEQ ID NO: 130204 - protein, 139 aa, Triticum aestivum
  unsure (1)..(139): unsure at all Xaa locations
  Clone ID: PAT_TA_24622.pep
FXXXXEAXXWXRARGSFWAXCSAGVPAEGRCGPGRSRGPPPAPGPGGAATMRSPCSSPLARPWSSLGGTIGLRELHCNQERVRSIDAWNSWIARRLFFLQADCTGCSFHRVIISEIQINKLIRLALVLLIISCGIFTCC

SEQ ID NO: 130205 - protein, 181 aa, Triticum aestivum
  unsure (1)..(181): unsure at all Xaa locations
  Clone ID: PAT_TA_24623.pep
MSSPQEIWRQLQMKAAEAGRSGGRMPKGVGGAGTAAVLIGGAAWVLSHSIFNVDGGHRAIKYTRIGGVAKDIYSEGTHIKIPWXFETPIDYDVTSKXRRNVASLTGTKDLQMGNITCRVLSRPRIXALPQIYRNLGTGYDERILPSIVNEVLKXSVVAQFNASQLITQRXRMLQXLXREET

SEQ ID NO: 130206 - protein, 81 aa, Triticum aestivum
  Clone ID: PAT_TA_24624.pep
NAKSCPDEHLLPQLLVHKYYSFPFKFNFNPKGGFFWTENSTANWTLPEVVINEEIYLWKIHDGARIHGRTLAGKIGNVFSI

SEQ ID NO: 130207 - protein, 183 aa, Triticum aestivum
  unsure (1)..(183): unsure at all Xaa locations
  Clone ID: PAT_TA_24625.pep
PPPPTXGDGSGGGVADGGDGLVRRPGAPRGERGVRHDAAGGAAPAGRPPPPPARARGRARRPPPPARAPPPPPPATSPPPAGAPRGSRPPASGTAPSCSPSSSSTRPTPGAAPHAGRAPRPAPPAPGXPGPPSPARPGARGSVATTPASTRVRLLRKDPAENVPVGGGAGGSARVAELVWGEE

SEQ ID NO: 130208 - protein, 81 aa, Triticum aestivum
  Clone ID: PAT_TA_24626.pep
AFRSSGVGIAIDATTQGDVADWVFAVSMGLATGIFIYVSVNHLLSKGYKPQRPVKADTPLGRWLAVVLGVGVIAVVMIWDT

SEQ ID NO: 130209 - protein, 173 aa, Triticum aestivum
  unsure (1)..(173): unsure at all Xaa locations
  Clone ID: PAT_TA_24627.pep
IWYCSSXRIEVIHTYAHLQNSLLVTHCSLSFHRRLAGHRXXVVSIAEXRGIXXLXGGYELLQETSLPSXATTVXKKHPGLPXIKPAICLMGASPXKIAGGIEASSRKAVXWKQXPDRAAPNVXAXSKPEPPLXQRNSXRCXRXPPPRGGXNQXIRRXXLLMGQGLXLPPLNQP

SEQ ID NO: 130210 - protein, 142 aa, Triticum aestivum
  unsure (1)..(142): unsure at all Xaa locations
  Clone ID: PAT_TA_24628.pep
KLXPNRHXLVPNSARGTMKTFVSHDFINGRYRPPHLLLVETIKDLIREEKQFRSPTRGLLMEVLVEDYELSHEELVEEYLVQKGTMVPLLEVIYSGHRINEHAHAARLAAAKAFLAGLDAQGRGRKGREALRLKTGTERSNP

SEQ ID NO: 130211 - protein, 142 aa, Triticum aestivum; identical to SEQ ID NO: 130116
  Clone ID: PAT_TA_24629.pep

SEQ ID NO: 130212 - protein, 171 aa, Triticum aestivum
  unsure (1)..(171): unsure at all Xaa locations
  Clone ID: PAT_TA_24630.pep
PCRRCRWRRPASGSRPTHPHPSNPLGPSVAWWTRSTPGTLPPPHPAPTPPSSWSHTSPPPSPPPPWRRGSPPPSPAAPRTXXAPPPPPXEGPQLHLGLXPPLTWPRPPAWPPSPWPPLPWPPLPWPRPPAWPPSPWPSSPWPXPPAWPSPPWPWPPXPPAWPWPSSPPPST

SEQ ID NO: 130213 - protein, 142 aa, Triticum aestivum; identical to SEQ ID NO: 130116
  Clone ID: PAT_TA_24631.pep

SEQ ID NO: 130214 - protein, 94 aa, Triticum aestivum
  unsure (1)..(94): unsure at all Xaa locations
  Clone ID: PAT_TA_24632.pep
XPIPLLAKAFTHRISVSNVPPPLDYELYSFSIFPMLVFVSCYSKKFTGFVSTSGSLKSRTCGPHHERFVCDSQEYALDHNHNPERQVQASDDLK

SEQ ID NO: 130215 - protein, 83 aa, Triticum aestivum
  unsure (1)..(83): unsure at all Xaa locations
  Clone ID: PAT_TA_24633.pep
TVCCWNSRIALESACCSSCPADSCHELRLPCRHFPCNPHGPSRIRRAHTHFPVRGVPXRSGYSETTNLGTVKFQTAMYEDTFK

SEQ ID NO: 130216 - protein, 132 aa, Triticum aestivum
  Clone ID: PAT_TA_24634.pep
TRKSESDKEGTYYEPEHWKFGDKYFRHATGQLYAISKDLATYISLNKHVLHKLWGEDVSLGAWFIGIDVEHIDDRRLCCGTPPDCEWKAQAGNTCAASFDWRCSGICNTVENIQGVHNKCGESEKAKWTASF

SEQ ID NO: 130217 - protein, 151 aa, Triticum aestivum
  unsure (1)..(151): unsure at all Xaa locations
  Clone ID: PAT_TA_24635.pep
MSDVEEPTSPVAEAEEVEVSADATPKGQMTVLDALKGALPTALMHDGLARGLREASKALDRREAHMCVLNEACEEEAYKKLIXVALCSEHKIPLIKGTPMEKQLGEXWAGLCVLGXRRGNAPQGVNCSSVVXVRXGGRESSERMMLLKLIP

SEQ ID NO: 130218 - protein, 109 aa, Triticum aestivum
  Clone ID: PAT_TA_24636.pep
KLSYIKASTQKVQCFQAHQQYGRCALYEYEKIYRLAGRCLIRSQNLVLLFQSTSDLIGWKTAHWMNDGLKWHDPEPGNSTSEGARGASRAAHATQAWARRKYAHFGKEK

SEQ ID NO: 130219 - protein, 223 aa, Triticum aestivum
  unsure (1)..(223): unsure at all Xaa locations
  Clone ID: PAT_TA_24637.pep
MAPMKVYGWAVSPWMARVLVCLEEAGAEYELVPMSRNGGDHRRPEHLARNPFGEIPVLEXGDLTLYQSRAIARHILRKCKPEFLGAGSLKESAMVXDVWVDVDAHQLEPVLKPIVFNCIINPFVGRDVDQGLVDESVEKLKKLLEVYEARLSSNKYLAGDFVSFADLTHFSFMRYFMATEHAVVLDAYPHVKAWWEALLARPSVKKVIAGMPPDFGFGSGNIP

SEQ ID NO: 130220 - protein, 182 aa, Triticum aestivum
  Clone ID: PAT_TA_24638.pep
MGSSEADDDQLLKSFLAEVSEAERDNEVLRILGCFKLNPFEHLKLSFDSSVDEVKKQYRKLSLLVHPDKCKHPQAQEAFGALAKAQQLLLDPQERGYILDQVTSAKEELRAKRKKELRKDSASKIKSQVDEGKYEEQFERSDEFQKQLIIKVREILTDKEWRRRKMQMRISEEEGRLKKDEE

SEQ ID NO: 130221 - protein, 260 aa, Triticum aestivum
  Clone ID: PAT_TA_24639.pep
TTAYLLLPKCCIGLPDKLVHKHSAAIANTAHVRRELQGVAPMKVYGWAVSPWMARVLVCLEEAGAEYEIVPMSRSGGDHRQPDHLARNPFGEIPVLEDGDLTLYQSRGVARYILRKCKPELLRAGNLAESAMVDVWLDVEALQLEPIVRPIVANCILYPLEGRDCDQKIIDEKIEKLKKLLEVYESRLSCSKYLAGDFISLADLSHFSFMRYFMATEHADQLNTYPHVKAWWAVLLARPSVKKVMAGMPPDFGFGSGNIP

SEQ ID NO: 130222 - protein, 210 aa, Triticum aestivum
  Clone ID: PAT_TA_24640.pep
MAPMKVYGWAVSPWMARVLVSLEEAGAEYELVPMSRNGGDHRRPEHLARNPFGEIPVLEDGGLTLYQSRAIARHILRKHKPGLLGAGSLEESAMVDVWVDVDAHQLEPVLKPIVWNCIINPFVGRDVDQGLVDESVEKLKKLLEVYEARLSSNKYLAGDFVSFADLTHFSFMRYFMATEHAVVLDAYPHVKAWRCCNRQKIAAAGFRSGP

SEQ ID NO: 130223 - protein, 222 aa, Triticum aestivum
  Clone ID: PAT_TA_24641.pep
MEPMKVYGWAVSPWMARVLVSLEEAGAEYELVPMSRNGGDHRRPEHLARNPFGEIPVLEDGGLTLYQSRAIARHILRKHKPGLLGAGSLEESAMVDVWVDVDAHQLEPVLKPIVWNCIINPFVGRDVDQGLVDESVEKLKKLLEVYEARLSSNKYLAGDFVSFADLTHFSFMRYFMATEHAVVLDAYPHVKAWWEALLARPSVKKVIAGMPPDFGFGSGRIP

SEQ ID NO: 130224 - protein, 102 aa, Triticum aestivum
  unsure (1)..(102): unsure at all Xaa locations
  Clone ID: PAT_TA_24642.pep
HHIDDEDLQQQRLQEGSDTQAPPSPDPTKKARIKVFTLKKQSERIRGQAPTRSXXKKNIAIARDDHSGXDLGFRPGSSKPXAXSTTIKVTHXLSPRFPNPXX

SEQ ID NO: 130225 - protein, 151 aa, Triticum aestivum
  unsure (1)..(151): unsure at all Xaa locations
  Clone ID: PAT_TA_24643.pep
PSYRAYLVALWLVGFVLVFLWQNTSMGRLRLYNRPPMPKRAPSAAASMGQWVASPPVYDLREFGGVGDGRTVNTAAFQAAVAAISERGGGRLTVPAGRWLTAPFNLTKXTMTLFLAAGAEILGVXYWPLMSPLPSIWITGEEHKGPRYWEA

SEQ ID NO: 130226 - protein, 183 aa, Triticum aestivum
  unsure (1)..(183): unsure at all Xaa locations
  Clone ID: PAT_TA_24644.pep
WPKAQAEVRXRTFDDKNPQDHEEHVAELHYTKMVIKEAMRLYPXVVPMLIPHVCRETCDLGGFEVTKGTRVMVNTWAFGRNPEYWHEAXEEFKPERFEDGTASCRGPRVGYLPFRSGRRKLPXXDNFGLAVLHLMVARLLYYFDWSLPAGVKPXELDMEMRGGMTXRGKNQLHLVATPYKACS

SEQ ID NO: 130227 - protein, 78 aa, Triticum aestivum
  unsure (1)..(78): unsure at all Xaa locations
  Clone ID: PAT_TA_24645.pep
ISARNGIXRINYHLGQNHEYSAQSFTTLDTYHLGSWELTCWGSTLLDYGFSLHTVLARPMESMACKVQSVATLRGVIM

SEQ ID NO: 130228 - protein, 112 aa, Triticum aestivum
  Clone ID: PAT_TA_24646.pep
MKIFSSLIGFCAGAAAISVSFDSGYDERDRGLDTVSCSDGSHGLLTRGYTTQSSLPSFPAYRRALPFQRGGTSCAGGLPAWPYFTRGLHQYVAGSTPTGRFNNCARRPPGNL

SEQ ID NO: 130229 - protein, 143 aa, Triticum aestivum
  unsure (1)..(143): unsure at all Xaa locations
  Clone ID: PAT_TA_24647.pep
MATAQGRNAPQQSVYPRSHVGFDSITSQIERKLLKRGFQXFNIICVGQTGLGKSTLINTIFASHLIDSKGRLTPDEPXVRSTTXEIQTVSHIIEENGVPLTAQQLWDTPRLRRTKVNKWIRCXDPMVKYIKGPPWQYKETQRS

SEQ ID NO: 130230 - protein, 128 aa, Triticum aestivum
  Clone ID: PAT_TA_24648.pep
CQDSWKLWWLTYTSTLTPDKTRLLLAKINPGGRPIQSQQTRDVSRTRVGTKYRRYARAMSYVVVELLSANTSQFEEILQRRALELNLSSSYEAIRHFDGADALIYVDRDSARRAAEAKKLALTYRENW

SEQ ID NO: 130231 - protein, 108 aa, Triticum aestivum
  unsure (1)..(108): unsure at all Xaa locations
  Clone ID: PAT_TA_24649.pep
MAATHRVSAVIFDLDGTLLDTERATRDVLKEFLGTYGKVPDAAKEEKRLGHXMTGKSTTGIIADYGXLPITVEEYSRGNIPACYIKRGRSAAPLPGVNRLLKAPPQGG

SEQ ID NO: 130232 - protein, 54 aa, Triticum aestivum
  Clone ID: PAT_TA_24650.pep
CQSVIELAISMICIKPRFGADTLPLLFSDGIEMSTPSGTFPDNNTLLYRFKVLI

SEQ ID NO: 130233 - protein, 159 aa, Triticum aestivum
  unsure (1)..(159): unsure at all Xaa locations
  Clone ID: PAT_TA_24651.pep
RKGILPKDKTTVLTKAAGYLKTLEAQVSELEEKNNKLEKHIPTXTARRTCRTSRGGKRAKVQITKAASDEVVNLTVMVMVECDVVELVLRILECLRWMEQVSVMSVDADTYSPQVLLKAIASIKLRIVDHDWNEALFHEAMAKAVNDATVFRPPLVLTA

SEQ ID NO: 130234 - protein, 226 aa, Triticum aestivum
  unsure (1)..(226): unsure at all Xaa locations
  Clone ID: PAT_TA_24652.pep
HPSVKRETTNAQSRNQEQASPNGQHGGRRPQPPPPPAPPRPEPPHYPRRNGALRPSHRAGADGSVRPPARSPPRKPPGGTSSTPTAPSELFLDDGLRRSKAGGLPRPVRHQVPAPGAPGRPRGRGPRGPVRAAPPGPGAGSPRGPPVPXPVRKRPAPGRAAAVTPQAVGSPVKRKSFPCPVGLQRAKVRLCKLTGPPAGSLGMLALSFVPNRSKLSFVCKFLKGPN

SEQ ID NO: 130235 - protein, 138 aa, Triticum aestivum
  Clone ID: PAT_TA_24653.pep
MKDEQLPKRLQTLVPLQRNSLESLRPSSSLKMAAAAEGLAAYRAVLRAARRTFSGDQLMLTESAVEIRRRFEDHRGLAPGSEDAVRALSEAREAADFIANMIVQAKRSPSGSFVVKPEKAHAGATLEIPSEEILSTLK

SEQ ID NO: 130236 - protein, 147 aa, Triticum aestivum
  unsure (1)..(147): unsure at all Xaa locations
  Clone ID: PAT_TA_24654.pep
MMLSKAVRPALKASSAAYTRSIPKAATYATLREIEDRLKSIRNIEKITNTMKIVASTKLTRAQRAMTESRQYGQTSNAVFDQAGTKPLEKDNQKYLIVVXSSDKGLCGGXHSGLSKRXLGRCLLKNPNAGIVVLGEKAXXQLSRSSG

SEQ ID NO: 130237 - protein, 115 aa, Triticum aestivum
  unsure (1)..(115): unsure at all Xaa locations
  Clone ID: PAT_TA_24655.pep
AKLISQGXSQESHVFHTAQENXSXSEGGGGXGYPKFGPNKWRSLLTPPAQXGPXVFTNRSVDXGXKXPGAVNPKXLNXAFCXAXIPPLFRPRPGXGXLAQRKGXXNPDLAPFPQT

SEQ ID NO: 130238 - protein, 223 aa, Triticum aestivum
  unsure (1)..(223): unsure at all Xaa locations
  Clone ID: PAT_TA_24656.pep
MARRSGMLLLLAAAALLAVGAGAAVPPSCERIECPAYDVVDSANGFEIRRYKDAMWVSTAPIADXSLRPNATRSGFLPLFMYIQGXKNAYNDTIEMTAPVLTRVAPSDGPFCVSSFVVSFYVPAKNQADPPPAEGLRVQRWAGARYAAVRRFGGFVADADVGKQAALLEASLQGTRWAAPVSDGRKADPASEYTVAQYNSPFEFSGRVNEIWMLFDTMAASDM

SEQ ID NO: 130239 - protein, 122 aa, Triticum aestivum
  Clone ID: PAT_TA_24657.pep
RRKEEERRLAAEKEAARAKAKTLKMEDYMLFEQMIREILEEGNEGDKGINDNRMMVAASSRVAELRIGIKHWWKKSTYAYLNEPAVTASMDDKGRNRRAVTYIPQDRCLKARSSIPASFVIF

SEQ ID NO: 130240 - protein, 136 aa, Triticum aestivum
  Clone ID: PAT_TA_24658.pep
MAFSITRKEIEGFWRRKEEERRLAAEKEAARAKAKTLKMEDYMLFEQMIREILEEGNEGDKGITKNRMTVTPSSRVAELRIGIKHWWKKSTYAYLNEPAVTASMDDKGRSGRAVTYIPQDRCLKVRSSIPASFVIF

SEQ ID NO: 130241 - protein, 124 aa, Triticum aestivum
  unsure (1)..(124): unsure at all Xaa locations
  Clone ID: PAT_TA_24659.pep
ATCFKRRVKLALIQLXVAPIRLKTLQNAWDKAVQAAKKGANIIXLPECFNSPYGCDFFPKYAESLPPLPSDQRRFKVRAGCPRKKYYNTXRIISPSGQLLATHRKVHLFDIDIPSCRIRHERHE

SEQ ID NO: 130242 - protein, 98 aa, Triticum aestivum
  Clone ID: PAT_TA_24660.pep
NTTITAQHANQYLSGKELAVNVCCITATRCQAKKYQNAAHSNSEHLHVFVVVYSQNLSSKCKGRTSIYHLCQHIKTPLAIYYEQLASLPDLQIVLTDI

SEQ ID NO: 130243 - protein, 153 aa, Triticum aestivum
  unsure (1)..(153): unsure at all Xaa locations
  Clone ID: PAT_TA_24661.pep
AIALDPQYSRSNNRFATGGLAGQVLVLTKKSWVSGYNXRVLREGEGPIHSMKWRTDLLFAWGXWMQGVXVHGPLTDRASAAFRIPMAVPRAGLLPPLLGGLRPAAALAGWGSGLAPAPIRVPSSPWARGCPRELSRSLCGGGPPRVLNEICCL

SEQ ID NO: 130244 - protein, 113 aa, Triticum aestivum
  Clone ID: PAT_TA_24662.pep
EICEKKGSLVGIWNVLLSYYTSNSSCQLIFGATLTMALDNYCLPFAISSKFSVYDNAFFSLKIGYRATELTMTERVDSSSSSYVIADACPNNSYWKCQPRRQHMDQNVLTDAG

SEQ ID NO: 130245 - protein, 85 aa, Triticum aestivum
  Clone ID: PAT_TA_24663.pep
RAPGQVLRRTPPTSRSPTPFGTAKYLFDKIPNDASSKVRINRDLDTPERVLGAPPPLPDFSLALPPEDYDLPPLDPLWNKEDGHQ

SEQ ID NO: 130246 - protein, 149 aa, Triticum aestivum
  Clone ID: PAT_TA_24664.pep
FCQVTATGHSTMKLFTTSGIATLFNVLAPVIAMSIANARTRISVPAPGSNFSFLCENGRRYQKNYLQGAVQEARSIMSNQFSHIGYPLSLNHLDYDIPGNVWYHPLNLHNADDFVVFSPRLSNSGPSPTCGTHPDGQLTFKPLFNHLGL

SEQ ID NO: 130247 - protein, 153 aa, Triticum aestivum
  Clone ID: PAT_TA_24665.pep
MATTAAAMAPPSTSASSVLLLRRLPSPTSAAPGCCRLGPPPRLEGPGHHRQLPLQGRVSCSPAEQDPEHAPNFGRRVRVTAPLRVYHVVKAPDLDIQGMEGVIKQYVGVWKGKRITANFPFKVEFQLTVDTQPKPVKLFVHLREDEFEYIGDE

SEQ ID NO: 130248 - protein, 87 aa, Triticum aestivum
  unsure (1)..(87): unsure at all Xaa locations
  Clone ID: PAT_TA_24666.pep
IDHAKDKMKDGAGAAKAKASITQAKVAEKAEAATARSHDERELAHERGAAXVAAAEAQLHQDKAAHREDAMSHHIHKHGGHKHGHSH

SEQ ID NO: 130249 - protein, 154 aa, Triticum aestivum
  unsure (1)..(154): unsure at all Xaa locations
  Clone ID: PAT_TA_24667.pep
SCRIRHEPQAAAASSCAKGRQTLTLVXASLXLPSSRSSXSHXADQGRGAXHRHRPRXHLLVRRXVAARPRRDXRQRPGEXHHALVRRLXPTRSGLIGDARQETRSAMXPIKQRLPMAKRLIGKGLLDCPCPVIFKDVGRFKGLFPWAPPGKLMG

SEQ ID NO: 130250 - protein, 100 aa, Triticum aestivum
  unsure (1)..(100): unsure at all Xaa locations
  Clone ID: PAT_TA_24668.pep
MLLPTQISTIILRVDLDCHQCYKKVRKILCSLQDQERIRTISFDTNNNXYIIDGPFDPHKLSCRIRCKGGKVIKGVQIMGDGKPEEMAGPPPSNSRKKKS

SEQ ID NO: 130251 - protein, 223 aa, Triticum aestivum
  unsure (1)..(223): unsure at all Xaa locations
  Clone ID: PAT_TA_24669.pep
KGNPEXGXMVXRMLRVLXXHXXLXCVVKEGKDGNLSRRYGAAPVCKWLTPNEEXVSMXAWAIIAQDLVPMAARGYLKDAVLEGGSPFKKALGMSWFDYAGTDMRFNHLYNEAMKHHSGIITKKLLXLYTGFDGLGTLMDVGGGIGTTIHAITSKYPSIKGINYDLPHVISEAPPYPGVQVQHVGGDMFEXRCPPATDAILMKXWXLNWFKRPTXXPTXLKKCX

SEQ ID NO: 130252 - protein, 140 aa, Triticum aestivum
  Clone ID: PAT_TA_24670.pep
MTKINSSLHSSRRKSRHAYFNAPSSVRRTMMSAPLSKELREKYNVRSIPIRKDDEVLIVKGSNKGREGKITSVYRLKYVVHIERVVKEKSSSQSVPLGIHPSKVVITKLKIDKDREQILERIKGGRENKKEAKKKQLLKA

SEQ ID NO: 130253 - protein, 166 aa, Triticum aestivum
  Clone ID: PAT_TA_24671.pep
PTPKPTPPTYTPSPKPPATKPPTPKPTPPTYTPSPKPPTPKPTPPTYTPSPKPPTPKPTPPTYTPSPKPPTHPTPKPTPPTYTPSPKPPTPKPTPPTYTPSPKPPTPKPTPPTYTPSPKPPATKPPTPKPTPPTYTPTPKPPATKPPTYTPTPPVSHTPSPPPPYY

SEQ ID NO: 130254 - protein, 69 aa, Triticum aestivum
  unsure (1)..(69): unsure at all Xaa locations
  Clone ID: PAT_TA_24672.pep
MQRKKIXVIIGGGVAGYVAAIKAGQXEGLXVTCIEENVATLGGTCLKTXGCIPSERLLLNNSHPFIIKI

SEQ ID NO: 130255 - protein, 194 aa, Triticum aestivum
  unsure (1)..(194): unsure at all Xaa locations
  Clone ID: PAT_TA_24673.pep
MAPIKLYGMMLSPNVTRVATLLNELGLDFDFVDVDLRTGAHKQPDFLKLNPFGQIPALQDGDEVVFESRAINRYIATKYGAALLPTPSAKLEAWLEVESHHFYPPARTLVYELLIKPMLGAPTDAAEVDKNAADLAKLLDVYEAHLAAGNKYLAGDAFTLADANHMSYLFMLTKXPKADLVASRPHVKAWWDEI

SEQ ID NO: 130256 - protein, 213 aa, Triticum aestivum
  Clone ID: PAT_TA_24674.pep
MAPIKLYGMMLSPNVTRVATLLNELGLDFDFVDVDLRTGAHKHPDFLKLNPFGQIPALQDGDEVVFESRAINRYIATKYGAALLPTPSAKLEAWLEVESHHFYPPARALVYELVIKPILGAPTDAAEVDKNAADLAKLLDVYEAHLAAGNKYLAGDAFTLADANHMSYLFMLTKSPKAGLVASRPHVKAWWEEISARPAWAKTVASIPLPPGV

SEQ ID NO: 130257 - protein, 258 aa, Triticum aestivum
  unsure (1)..(258): unsure at all Xaa locations
  Clone ID: PAT_TA_24675.pep
AEAEAGAEQKQKQATGEQEGSKRGGDGAHQRLYGMMLSXNVTRVTTLLNDGLGLRGFASRFDSPPPGPAAHKPPAFLTSSPLGXTPALQDGDEVVFESXATNGYIATKVGGALAPXPSAKSGQAWLGRWESHPFLPRPGVRDARIVPSLVTPTPTAGGAPTDXTEVGHWNAADLAQRCSNVYEAHLAAXGNKYLXAGDAFXCADANHMSYLFMLXTKSPKADLVASRPHVKAWWGRKISARPXAWAKTVASIPLPPDV

SEQ ID NO: 130258 - protein, 153 aa, Triticum aestivum
  unsure (1)..(153): unsure at all Xaa locations
  Clone ID: PAT_TA_24676.pep
MLLATRLYGQKASIGASLNIPHLARRASTWANVPQGPADAILGITECIXDRTIQKRKINLGXVGAYRDGSXEXPFVLXFRTXQQKNLIVSSGPSKESSGLTGLPGVSHASAPLPSGALSAVPVPTVSSLPIARTGAPSTGAESPARTKPPEIG

SEQ ID NO: 130259 - protein, 195 aa, Triticum aestivum
  unsure (1)..(195): unsure at all Xaa locations
  Clone ID: PAT_TA_24677.pep
METPAGGSADRRVTGSGASAGAAASGLSRYGLNFSASSLLQAPLAALLEYSGVVPSGPVPQTVQQAVPSSSSSSEADGLLSAAAAGDGEVSIRIQGGPGDPDTASATAAGASPAXTQXEVAASSNFDQASVARRGGGADAEASGGGSGGATXNGAGDRPYQRYDVHHVARWIEQILPFSLLLLVVFIRQHXVIAV

SEQ ID NO: 130260 - protein, 86 aa, Triticum aestivum
  Clone ID: PAT_TA_24678.pep
EGSWKQQEEEGQYMFGEKVTCGHEHGRWTTGEMWCAAVDGTKRRQGFRLGAASLSLLLVSTKRTSRTGACGGGRQAWLARTGKTAG

SEQ ID NO: 130261 - protein, 224 aa, Triticum aestivum
  unsure (1)..(224): unsure at all Xaa locations
  Clone ID: PAT_TA_24679.pep
PVTESEIFWLTKECLLRYLRASKWDTAKSAKRIQGTLTWRRDFGVEEITGDGISSENAPAELGPRGYDLFTRPCGYMYAGRQXNSEAGPRQVQFVVFMLERMIDFTEAXKDTLTPIINPENKSNCXPSPGQAKGILXIIQNXHYPERLGKGIFRLXWMXDGFFRLLTPFIDPXTREKLXFNXDXKKXCQVEQLCXXFQGXLEFXYXQKIYWAALLKLLRXKKKI

SEQ ID NO: 130262 - protein, 195 aa, Triticum aestivum
  unsure (1)..(195): unsure at all Xaa locations
  Clone ID: PAT_TA_24680.pep
ESYVSKVNWIMNRALFGVHFYLSWGFVCPYVMALVHIATTLRAPYSAIVKEAAGSSCGLXLVSFLLICTLTELVSMWNLTRVEIQLCNMLSPEGPQDSLRSYNWGLVFVAVLVDNFLYPISAIRSHFSQSINWSGIRYYLRDGKISKIERENSSKYTDLGGKHLYGKKTYPAGKSLLGYLSISLAQWHQPKKYDV

SEQ ID NO: 130263 - protein, 133 aa, Triticum aestivum
  unsure (1)..(133): unsure at all Xaa locations
  Clone ID: PAT_TA_24681.pep
MKISSIMRAGGDVEVGKHGKYIGNWGNFGLQKQKGVASYALSANRQRPFAGALHAAIFNTWXRFSGQVLYVAPPLIAAYCTMQWAIERNEYLNSKEGRKEFAQKECREGQSLFNLFVPHENLEIYLSGVSLNL

SEQ ID NO: 130264 - protein, 159 aa, Triticum aestivum
  unsure (1)..(159): unsure at all Xaa locations
  Clone ID: PAT_TA_24682.pep
MPGGISVRDVNAQKFIDSYSAFLKRQGKLAIPGWVDTVKTGPAKELPPQSIDWFYIRAASIARHVYMRKTVGVGRXLRKVHGSTRNRGSXRPSHHVDPTWEVSNPKXVMQSFNRKIWCPGKQRLKEKGRVRSHNHKSGPACVFPGPRNLPSSVWSEGKN

SEQ ID NO: 130265 - protein, 487 aa, Triticum aestivum
  Clone ID: PAT_TA_24683.pep
MGKDGGGGDGLEVPLLKRTYYHGNCPGCRLEKRNETRRGVPYTEFACMWLVTVCSTLPIQSLFPFLYFMIRDLHIAKQVEDIGFYAGFVGASYMLGRALTSTLWGIVADKHGRKPVLVVTLIAVITLNTLFGLSSSYWMALTTRGLLGLLSGMLGPIKAYATEVCRKEHSHLALSLISSSRAIGLIVGPAIGGYLAQPADKYPGMFSQESIFGRFPYFLPCLCISILAVAALISCIWLPETLHKHNEATYSNNSIEAMEESLSGSNAEESSGGYWSLFTNWPLMSAITVYCLFSLQDVAYAEVFSLWAVSDRKYGGLSFTSTDVGSVLALSGLFLLIYQILIYPSVAKAIEPITLVRATAILTLPLLASYPFMTTLSGFNLQLVVNCASSLKNSFQVTTITVCNILMNDAVSQDLRASANGLSVTLMSIFKAVAPAVAGVIFSWAQRRQTASFLPGDHLVFFMLNAATVIGLMCTFGPHFARGSTKH

SEQ ID NO: 130266 - protein, 399 aa, Triticum aestivum
  unsure (1)..(399): unsure at all Xaa locations
  Clone ID: PAT_TA_24684.pep
MELSAATLLVLSFVSLMILVSLLSRKTTASSKGRKPPGPRCLPFIGSLLHLLTATPQIALRDLAKKHGPVMYLRLGQVDAVVISSPAAAQVVLRDSSLTFASRPNPRPARLVGYGSVDIAFAPYGAYWEXLRKLCMVELLSARKVRQFAPIRNSVSMSLVRDVRAAAGEXGNLGKLLMSCTNTITAKATFGDEFDAELQERFLAGMDVLLKIVGAFSFGDLFPSLWGPGXXVTGLRRSVWRARRPADAIPVLFSAGCAPRRAEAEPATAGDDDLLGVMLRIKDEAQHEFPIGITNIKAIIVDLFTAGTETTSSLLEWIMSELIRNPEVMAKVQEEVRQTLYNKNPGDHEVHMDKLRYMKMVIKEGLRLYPAVPLLLPRVCSKTCYDSGFEITKVFKDMF

SEQ ID NO: 130267 - protein, 137 aa, Triticum aestivum
  Clone ID: PAT_TA_24685.pep
VARPGLGRGRRWRGSRRSTRGPGAARWRPSSGPRRPPSPPPRPPPSAPAPPAAARRPSITATPSPAPWSPSCRPRRAAAAGTRRGGSKQGGGNGYRTPEASSPKVSCIGQIKRGKVNDQQRQERREKNSPPTAGGGP

SEQ ID NO: 130268 - protein, 173 aa, Triticum aestivum
  Clone ID: PAT_TA_24686.pep
EQIPPTKPLPARSTYATRASVLKPKVEQGMVKAAHMVGTNYRLAPAQKEKLNQKVNPQEPTKKEPVKIIIGSDNDSKWCTTRAILNMEPADLMKEVGSESGPPLVWGARKRRTRSETLPIDAATLLPGEGEKRMRGPGPDAQEDEAVQAVEAAPAKRAHRFNPKYDATLWITC

SEQ ID NO: 130269 - protein, 146 aa, Triticum aestivum
  unsure (1)..(146): unsure at all Xaa locations
  Clone ID: PAT_TA_24687.pep
MGAGGSWRWAVGAVCGGLVYYHCAVRRASAVSLAAGVLLVLLCSLSILGLLFRHLHISVPVDPLEWXISQEMANSIVASLANTIGAAESVLRVAATGHDKKLLFKVVLTLYFLAALGRVVIXGAAIAYAALCIFSLLHVRAKHRPV

SEQ ID NO: 130270 - protein, 249 aa, Triticum aestivum
  unsure (1)..(249): unsure at all Xaa locations
  Clone ID: PAT_TA_24688.pep
LVPNSARARAEFGTRSAMSGNTXATGSTLPSNLCRHFIFAELQTATKNFDQAFLLGKGGFGNVYLGEIDSGTKVAIKRXNPMSEQGVHEFQTEIEMLSKLRHRHLVSLIGYCEDKSEMILXYDYMAHGTLREAPLQHQVTPPLSVGSKRPPSGGPAAPGLSLLLTGVKHTIIHRDSXHKHLLDDKWVXKVSDFXLSXRAQHGRHHXTRRQGXFGTQPEXFAGVSNPSSFGSASVSRRPSKITCGLLKQS

SEQ ID NO: 130271 - protein, 85 aa, Triticum aestivum
  unsure (1)..(85): unsure at all Xaa locations
  Clone ID: PAT_TA_24689.pep
GXGFKVLETXFYXNFREGXXXIDPKXSXPSRTXGXRELHXPGCPFFYFLXGXXPYSDCVPCKANGLEGNRRQIHPSLYKICNTSY

SEQ ID NO: 130272 - protein, 141 aa, Triticum aestivum
  Clone ID: PAT_TA_24690.pep
KQKKVAPPDPSQIQSWSNPVAGAPISCAPPCTRAGRRSAALTALASTTLPRSSRTNLYTWTRSLQAVDVGGELTTHPSCCTAPRHRVMAEACNGSRGCRFSCSSRRNGGQSCCCRCFLASPPPVRCCCCCSSPRGGDEERY

SEQ ID NO: 130273 - protein, 295 aa, Triticum aestivum
  unsure (1)..(295): unsure at all Xaa locations
  Clone ID: PAT_TA_24691.pep
ARGPHTHPPAAIHPSLAAPAAMPAGQQPPAREPDGGDSNHHPHPPPPTPALPSEVVPAYPPPESEDDESWVWTQIKAEARRDADAEPALASFLYATVLSHPSLPRSLSFHLANKLCSSTLLSTLLYDLFLASLTAHPSLRAAVVADLLAARARDPACVGFSHCLLNYKGFLAIQAHRVAHVLWAQNRRPLALALQSRVADVFAVDIHPAAVVGKAILLDHATGVVIGETAVVGDNVSILHHVTLGGTGKAVGDRHPKIGDGVLIGAGATILGNVMIGARAKXGAGFAVLIKGPAR

SEQ ID NO: 130274 - protein, 172 aa, Triticum aestivum
  unsure (1)..(172): unsure at all Xaa locations
  Clone ID: PAT_TA_24692.pep
LGLAKQFQQWRGREQHYCAPRWARRWRRSRRCCSRWRPWRPARSPCTSTRRRGACAGSRAPSPTALGRATCXLPGTKHGSQGLRRPRXRKIRGPLQLGLGPAAPGRARPAPWLRPGPAGLXARGGHASLGKVRCRVSFRPAEPLPASTRPPPPPPRPXXQXKPSLFQPKGAL

SEQ ID NO: 130275 - protein, 267 aa, Triticum aestivum
  unsure (1)..(267): unsure at all Xaa locations
  Clone ID: PAT_TA_24693.pep
APPGRRLLLLPAPAPATAPSSSSAPPATTRRALLLSTSALTLAAVVPAVAQAAANPFSTPYSQSRTLQLGLDTNGKIRTCPSTNPGCVCTNPTAAPPPPAPPPPSSPAPPPPAPPLHMLRQAILKTQKNVSFNVDQRTPHXHALRFKLVATFLTGQLAGTKLHSTEFHYRRLSSRMKMRFXMHLRECTYVCVYAGQYIQAEVDGGFGRDVMEFLVRAVAQDVAYRCPATRSTFVYPFTTAIGDSRGQELXVAAVAQTVGWYAPGICM

SEQ ID NO: 130276 - protein, 310 aa, Triticum aestivum
  unsure (1)..(310): unsure at all Xaa locations
  Clone ID: PAT_TA_24694.pep
SPPAVELAAEGCRVDHPVQSEAWVAALFLTARERWPGDGYPPSLRRRSGALYLAHFLGDNVVWAXDCLDARKLTPLEPLLPGTXLDRFQSVYPRPAVDYLLSQFKDLGFPSLLADMDATYVLLPVDQRAVDSNSAFEGRTRNVMVLLVLSTLKWRMQAVTACSFIDYFLRKFNDHDAPSMLAFSRSTDLILSTAKGADFLVFRPSEIAASVALAAFGERNTSVVERATTTCKYINKERVLRCYELIQDKIAMGTIVLKSAGSSMFSVPQSPIGVLDAAACLSQQSDDTAVGSPATCYQASSASKRRRIGR

SEQ ID NO: 130277 - protein, 174 aa, Triticum aestivum
  unsure (1)..(174): unsure at all Xaa locations
  Clone ID: PAT_TA_24695.pep
MGRLTEYQVIGRHLPTETAPTPKLYRMRIFAPNSVVAKSRFWYFLKKLRKVKKANGEIVSLNVINEKRPLKVKNFGIWIRYDSRSGTHNMYKEYREMSRTDAVEALYQDMAARHRSRFRSIHILKVVEIEKTDDVKRPYIKQLLTKDLKFPLPHRIAKSSXSKIFANKRPSTFY

SEQ ID NO: 130278 - protein, 82 aa, Triticum aestivum
  unsure (1)..(82): unsure at all Xaa locations
  Clone ID: PAT_TA_24696.pep
MGGVDRAGGKAKPLKAPKKXPKQELDDEDKAFLQKQKDDAKAKADMAAVAKKSKGPLNTGAQGIKXERKKIELLHTYRSVNM

SEQ ID NO: 130279 - protein, 116 aa, Triticum aestivum
  Clone ID: PAT_TA_24697.pep
VQVKRVQKYVETLDAVMAKNAAIARKPASAKKQPQQAAPQPTPARQRQERQPQPQSQRQRQQQPPQPPAQTTRWEMFDLLSSLPTTSSSSSTTTDSSTASSAGAPPPPTNRLDWML

SEQ ID NO: 130280 - protein, 168 aa, Triticum aestivum
  unsure (1)..(168): unsure at all Xaa locations
  Clone ID: PAT_TA_24698.pep
MARTKQTARKSTGGKAPRKQLASKAARKSAPSTGGVKKPHRYKPGTVALREIRRYQKXSTELLIRKLPFQRLGREIAQDFKSXDLRFQSVCKSGAFTRESVGGALPPPPLLPDVCATLARRALRSSRRFLCLARRLLGGAPGRPFGGVTVKISCKESKLKLRDMGISW

SEQ ID NO: 130281 - protein, 191 aa, Triticum aestivum
  unsure (1)..(191): unsure at all Xaa locations
  Clone ID: PAT_TA_24699.pep
LSSVESTGICASDQLVIGVCRECFPNWSGGLEDPRVHLHVGDSVSFLRNDPEGTFHGIIVDCSGPIGPAPELGERPFSESNARALRPGSWLCXNAVSKWVHAHLIQDMLWICSTNLKSSVLFAWACVQTYPSGAIGFLLGAQKGXQSSTWHPLNPIEKIKGAMTAGRDIRFYNTEMHRAAFVLPTFAKEDK

SEQ ID NO: 130282 - protein, 177 aa, Triticum aestivum
  unsure (1)..(177): unsure at all Xaa locations
  Clone ID: PAT_TA_24700.pep
MDTFFLSHXSPAICIDERIPAHGFFKSWLPAAVAGAQAPRAVLVVSAHWETDAPAVNVVRGTNDTVHDLPGLPDELYKLRYPAPGAPGLARRTKELLEGAGFGPVSEEHGRGLDHRAWVPLMLMFPEADVPXCQLSLQAGRDGAYHPPRSGRWRPSRGRRAPALRSRPAKNSKRLGL

SEQ ID NO: 130283 - protein, 106 aa, Triticum aestivum
  unsure (1)..(106): unsure at all Xaa locations
  Clone ID: PAT_TA_24701.pep
MLDRPQNIGIKAIEIYFPXQCVEQSELEIFDGVSQGKYTIGLGQTKMSFCDDXREDIYSFALTACSNLLEXYNINTHSIGSVWRGGTRDAPWGKSSKVRLWQPILG

SEQ ID NO: 130284 - protein, 422 aa, Triticum aestivum
  Clone ID: PAT_TA_24702.pep
PAAAASGQARSTASQHRGPPAVFGGKWALGPLIASARPSLRRRGRGGARGRSAPLGTWFHHGTTVFGARHPSPGFKCYSHVCDDVFCFYVRRGILPPEPVSGPSRRFLPWLMLGISIGVIFNVIFPDWLVTVLLIILFLGTSTKAFLKGVETWKKETIIKREAEKRLEQTSEEPEYAPLSTGPGAAADVKPHSDEAPSLMKNIYWKEFGLLTFVWLAFLAIQITKNYAPTCSTWYWVLNFLQIPVSVGVTMYEALGLMNGKRVLSSKGNEQTTLKFHQLCIYCFFGVTAGLVGGLLGLGGGFIMGPLFLELGIPPQVSSATATFAMMFSASMSVVEYYLLNRFPVPYAAYFVAVAFVAAIIGQHVVRRLISWLGRASLIIFILAFMIFISAISLGGVGISNMIHKMEQHEYMGFENLCKYDA

SEQ ID NO: 130285 - protein, 164 aa, Triticum aestivum
  unsure (1)..(164): unsure at all Xaa locations
  Clone ID: PAT_TA_24703.pep
ERTKNNIKPRARRGSSTDDATDLIPEWLSFVKGVVDSEDLPLNLSRETLQQNKIMKVIKKNIVKKVLQLFQEISEDKEQFDKFYSAFXSKNIKLGIHEDSQNRXALAKLLRFNSTKSADDQTSLTDYITRMPRAPRRMWFYITGGGSLEGSAKSSRLRPQLGRK

SEQ ID NO: 130286 - protein, 66 aa, Triticum aestivum
  Clone ID: PAT_TA_24704.pep
RPLFFFCPFFFFFLGVDRRKPKKNPYCLVFSCLLNAYRFQLSPMHVHYYYYPHRSVMQVKGNFNDI

SEQ ID NO: 130287 - protein, 46 aa, Triticum aestivum
  Clone ID: PAT_TA_24705.pep
VMLFEQQYVNAHSYNTWLTFGLCAIGATGHLVKLQLAMSRPSRNVR

SEQ ID NO: 130288 - protein, 157 aa, Triticum aestivum
  Clone ID: PAT_TA_24706.pep
EARKRARGDRRAWRGEQARGGEEGRRGEARVRGGGGGMMDDGGVEHAQIPNSFGHELRACLRCRLVKTYDQFRENGCENCPFLDMDKDRDNVVSCTTANFTGIISLMDPNRSWAARWLRIGRFIPGCYTLAVSEELPEEYQGMCQDNNVQYFPPKRP

SEQ ID NO: 130289 - protein, 104 aa, Triticum aestivum
  unsure (1)..(104): unsure at all Xaa locations
  Clone ID: PAT_TA_24707.pep
HHRCEPSKFMNFISSSIKVRSKYFCANYPSNASQVRRTTRKQVAGAESGTSREKFIXMLCLPLFCSLANSRXLCALRSSXIGXLPLGNGSMPFQXXHPTSFVTX

SEQ ID NO: 130290 - protein, 73 aa, Triticum aestivum
  Clone ID: PAT_TA_24708.pep
MICSQKWFASSSRGTFSIQWCTYICLKYARNSPWEKISQKKMYSFYWVCSLQVCVHACKYCQDISMLFVLVAR

SEQ ID NO: 130291 - protein, 97 aa, Triticum aestivum
  Clone ID: PAT_TA_24709.pep
RAEFGTSPHRILYPQSIISILLRIHLLPHRTNTFITLIMGKTKSSKADGKSKSESKSKALSVKNASIAKPSQTTVAKSKENSEGCRVQGQQQDKQKE

SEQ ID NO: 130292 - protein, 134 aa, Triticum aestivum
  Clone ID: PAT_TA_24710.pep
AIIASQNNCNMKILSLISIAAVLNNLTPVHAADTWNYQCGPAVIHGSYVQDCVNSYHKYIMPSVTRDYGPNEYFKTATFPGKYFHNGAYMGGQGSSKILQFLRELLKVKASGLSGKRIECHPTKEGAWNLGTPT

SEQ ID NO: 130293 - protein, 60 aa, Triticum aestivum
  Clone ID: PAT_TA_24711.pep
GAKIGAGSVVLIDVPARSTAVGNPARLIGGRKGESDKDEDMPGESMDHTSFIRQWSDYTI

SEQ ID NO: 130294 - protein, 117 aa, Triticum aestivum
  unsure (1)..(117): unsure at all Xaa locations
  Clone ID: PAT_TA_24712.pep
SNLRSGLRTHKVIVYTIRRRFAFQQASLPSGSRFKLGMGPNPEGGSTPVAFVXLQVTLGNQQKSPKGLAFATNGQSPTFWGAPTCXTSKEXRVRWXRLXXRMXSQXYFXNPXXRDLA

SEQ ID NO: 130295 - protein, 78 aa, Triticum aestivum
  Clone ID: PAT_TA_24713.pep
ASSRIQRQMVYHPFRRGFLCILEHDKVVRSTIRYMPRHSFHLSSPGQVNCLVAAEVPQIRDTNPCPPPAHQFQCHLIG

SEQ ID NO: 130296 - protein, 270 aa, Triticum aestivum
  unsure (1)..(270): unsure at all Xaa locations
  Clone ID: PAT_TA_24714.pep
VRSELISSKXAFASSRRQIEDQAVQLQEQVQELEDQRVLLMSYTHDLEAAQLEIQGKTQELNYAQSRCHELESQLLKEMEKVESLEAELTKEKQSLEHRTEEVGFLQKELVQKENECTKSQELVKVKEFELLEARQEVQDMKLKVESIQLAVQEKDSELSDTQSRLTEVSSEIVELQQLLNSKKDQLVQARTELHDKEQHIETLESELDSIRLRCSQAESMVQRMAELTGDLASSVKAGEMGHLYITGVMKFQAQVHPRSNLHKHNQLGG

SEQ ID NO: 130297 - protein, 74 aa, Triticum aestivum
  unsure (1)..(74): unsure at all Xaa locations
  Clone ID: PAT_TA_24715.pep
FFRKEDXLDKSLHRASXDQQKPIPAVRIGDTQVSSLEDIITSMKDSSSSKWDDAVFIPPGFDIAIGSEPSHLNK

SEQ ID NO: 130298 - protein, 120 aa, Triticum aestivum
  unsure (1)..(120): unsure at all Xaa locations
  Clone ID: PAT_TA_24716.pep
EXARTICAEXLDMVRLTXDXVRRLMSXWATQVRHAGGECVARRRGGGAGGRAAGVAASRDAAVRDAGHARHAVAVAEGARGVCRERATAAWGARRELMAPEPTVPKGAELVALLRLFTTD

SEQ ID NO: 130299 - protein, 119 aa, Triticum aestivum
  unsure (1)..(119): unsure at all Xaa locations
  Clone ID: PAT_TA_24717.pep
HGAFSSAGSVLNGYPLQPRRFTHRRQLALKXPRLLFRIFNSLLVXPHPRPFSAFAAVKLSXSRGPSLLCGCLIXTVAYGLSMXTLDAAPCSGGAFKSAXRVGGGYRAQRDPRYTLPQRP

SEQ ID NO: 130300 - protein, 91 aa, Triticum aestivum
  Clone ID: PAT_TA_24718.pep
LYPTGAVGDGRHVEDPRRGRGARGHRAPMSSRKEKWLGGLGYALVHSGPKCTVLLFFWFFPLLSIFSYCLLFISLIVYSFTKSKPTPKIEL

SEQ ID NO: 130301 - protein, 125 aa, Triticum aestivum
  Clone ID: PAT_TA_24719.pep
MGISRDSRHKRSASGAKRSYYRKKRAFEAGRQESNTRIGNKRIHLVRTRGGNRKFRALRLDSGNFSWASEGVARKVRVIVVVFHPLQQTNFVPNKPSTKICNCSKFDASNLSGGGAPLAPVGQGN

SEQ ID NO: 130302 - protein, 316 aa, Triticum aestivum
  Clone ID: PAT_TA_24720.pep
ALASEGTDVRALFELTLVDQSGKGQHEVHTHFGRSLEGGPYTLKYRGSMWGYKRFFKRSGLETSDYLKDDCLLVNCTVGVVQSHTEGPKIYRIPVPQSDMSQHIGHLLTSGKRTDITFEVDEEMFPAHKVVLAARSPVFRAQLFGPMKDKNMKCIKIEDMEAPVFKALLHFMYWDELPNIEELTGLNTTWVSTLMAQHLLAAADRYALERLKLLSELKLCEDVAINTVANTLALAEQHHCHQLKTVCLKFVASPENLKAVMQTEGFDYLQQSCPSLLTELLEYVAKVGDHAVPPCLYSNEVLDGGDANGRRVKPRL

SEQ ID NO: 130303 - protein, 209 aa, Triticum aestivum
  Clone ID: PAT_TA_24721.pep
PTCFRSGRAPGAILKDGSVVEADTDIVGIGAKPSVSPFEAVGVNIEVGGIEVDSMFRTSIPSIFAIGDVAAFPLKMYDRIARVEHVDHARKSAQHCIETLLTSQAKAYDYLPYFYSRVFEYEGSSRKIWWQFYGDNVGETIEVGNFDPKIATFWIDSDSRLKGVFLESGTPEEFSLLPKLARSQPIVDKAKLKSATSVEDALEIARSSL

SEQ ID NO: 130304 - protein, 504 aa, Triticum aestivum
  unsure (1)..(504): unsure at all Xaa locations
  Clone ID: PAT_TA_24722.pep
MEVALALRQKAAHIASPAAAAAAAMGSYSRSTWALRLLSHGGCPVAPAALRRLNCSVAAAVADNLCRCCVFGGVRTAVAFTPPTFVVHAGAVGRLGAPSPPAAPPAEPPAPPLRGRGTYDGMTARPPGFHTCVGSGGQRQTAEWYKENGIEVLYEDPVEAFDGKTQTLKTSSGKILKYGSLIISTGCAAARLPEKIGGDLPGVHYIRDVADADSLVSSLGKAKKIVVIGGGYIGMEVAAAACGWNLDTTIIFPEDHIMPRLFTPSLAKKYEELYEQNGVKFVKGALIDKLDAGSDGRVSSAILKDGSVVEADTVIVGIGAKPSVSPFEAVXGVNIQVWGDRRLISMFXRTSIPNTFAIWRMWQAFSPLXDGLXRIPPRGRARVPKFSPHQCGRPRFSSPACLVSPHPSPWLGVLPHKGSXCKFVVNSTXDHVGEPIEVGNFDPKIATFWIDSDSRLKGVFLESGTPEEFSLLPKLARSQPIVDKAKLKSATSVEDALEIARSSL

SEQ ID NO: 130305 - protein, 202 aa, Triticum aestivum
  Clone ID: PAT_TA_24723.pep
EGKAQVPAPAQLVVSPCNIELSSLVPPVGLPRATFLFPNGEVSVKEKKLDEGEKILSVNGIVKSHVLNGVCTALYNDNMMNIKYRYKDDELSFIPSLTLPSNSLSFAFKRQLTPSDKFSYRYHFDTNYWSAVYKQKASKHVKWKAGYGSDERLGWASVWVGDAGGKTKEAPLKTKVQLMIKVPQNNIQNSTLVFRVKKRWDF

SEQ ID NO: 130306 - protein, 105 aa, Triticum aestivum
  Clone ID: PAT_TA_24724.pep
VCCPCPPSRHWPGGHPPILLAPTSTRLAHQGLPRTVRDAATKSTCLSQDASHSCSLRSRRADRHIWSKNCAAAVMHVCRGYQRCRRYRVWSNLQDHFASLVLGKP

SEQ ID NO: 130307 - protein, 242 aa, Triticum aestivum
  Clone ID: PAT_TA_24725.pep
MGEERTEAWWGRRAWALLSAVRARAPLVQCITNLVSMDIAANALTAAGASPAMLHCIREIPDFTPRCHAVYINVGTLSEDWLPSMRAAASAGRPWVLDPVAAAASQFRMEACLELLALPPAVVRGNASEILALAARSDSSPTFKGVDSSHDSGEALQAAKALAWSSGAVIAVSGAVDFITDGEQVLSASNGVAMMQKITATGCAVTALIAAFVGADPSDALAAAACALAIDEMHPERGRSLR

SEQ ID NO: 130308 - protein, 108 aa, Triticum aestivum
  Clone ID: PAT_TA_24726.pep
SLGTNITSGRKITGYFFGGCYKSSDLFPVKISRVCIRPICPVKPLDGSTHNRFLLFHIQQNANIMHTSRRSTVVPSQQPARHRPICCSCLHHHPAAQHRQTRHRRVLR

SEQ ID NO: 130309 - protein, 160 aa, Triticum aestivum
  unsure (1)..(160): unsure at all Xaa locations
  Clone ID: PAT_TA_24727.pep
TMEGSKPPFLAIRPSKDPGGNLTCASQPARLTSILTLLSLLLLSCGVGSIRCSSSTTAIHDNSTGHDVAAKIFKAGHHHTSRLQSPGPWWPPRPSPRRRREPPVPPGASHXAEPXEPIXXRHDLXSLGNLSFLRRXDCQLMGXPARXSSNGXKRLGDFLG

SEQ ID NO: 130310 - protein, 139 aa, Triticum aestivum
  unsure (1)..(139): unsure at all Xaa locations
  Clone ID: PAT_TA_24728.pep
MADREAPVTLRTRKFIRNPLLGRKQMVVDILHPNRANISKDELRGKLAEMYKANKDQVNVFGLQTQFGGGKTTGFALVYDSPEAFEEXSKPRHRLVRVGFATKIEKPSRQQRKQXRKNKAKGLSRGTGKGQWCKERKXG

SEQ ID NO: 130311 - protein, 109 aa, Triticum aestivum
  Clone ID: PAT_TA_24729.pep
RRAEGEADGDRAPVRWEWRSRRGAAARQAKESLELAFQMSQILDTGLDRHTLSLLMALCDRGANPEALAALLRQLPSAPPPSAAATAPGSNTRAAPPTPSLFPSGFRHL

SEQ ID NO: 130312 - protein, 147 aa, Triticum aestivum
  unsure (1)..(147): unsure at all Xaa locations
  Clone ID: PAT_TA_24730.pep
RMEVATISSTHHLNLVRLIGFCSEGRHRLLVYEFMKNGSLDSFLFGAGSSSDSGKAMSWATRFAVAVGTARGITYLHEECRDTIVHCDIKPENILLDEXHNAKVSDFGLAKLINPKDXNRHRTLTSVRGTRGYLSRRSGSPNLANHR

SEQ ID NO: 130313 - protein, 105 aa, Triticum aestivum
  Clone ID: PAT_TA_24731.pep
GTGAQSVIHYICSTLYKMEPQRLFARVCTLHTLTALHTQEASGSRRTGKGRRCSVHSIAFGKGGNPLPAPLFSSTQRLCGRATDPFFHAAVRSVGRSGLPPHACH

SEQ ID NO: 130314 - protein, 67 aa, Triticum aestivum
  Clone ID: PAT_TA_24732.pep
FRVDGIRKLKTKADLLEVLRSDVSCKSMTEAQFFKKDQCSDWHKNLDLVRTSRFYLSFLAFRAYGTF

SEQ ID NO: 130315 - protein, 216 aa, Triticum aestivum
  unsure (1)..(216): unsure at all Xaa locations
  Clone ID: PAT_TA_24733.pep
LQIKSLHLGDIKSFLLKAVEPPKEEAISSAIDLLFKVGAFEGHEELSPLGYHLAKLPVDVLVGKMMLYGAIFGCLSPVLSCCCFXLSYKSPFISPKDENQNVEKAKAALLNENLDGSTSXNRLQNNQDHLLIGYLQYXKWARHTCKEHGARSARHFCRSAFLYSTVMYMIRDMRLQYGSLLADIGLVDLPKDNLNQMNGNRKSNLESWFANISLPX

SEQ ID NO: 130316 - protein, 130 aa, Triticum aestivum
  Clone ID: PAT_TA_24734.pep
RAARAACAARKLHFSKLITLIFCLIGPSAAVWRYECRRHWFSERAVEGLVDKYTRNGGYMEPVSNLRGQLRYRIFLNLIHDDSGSRAYAIITPNNYKVTQVQVFDEDNELDICGYGWTFATGLSPKLGGA

SEQ ID NO: 130317 - protein, 50 aa, Triticum aestivum
  Clone ID: PAT_TA_24735.pep
GPSLPSPRINCLMCSMVRLNWIQACYKSNSYLIRHLMSSCNSNLLPTFYS

SEQ ID NO: 130318 - protein, 84 aa, Triticum aestivum
  Clone ID: PAT_TA_24736.pep
MSPPSSLAIATGALQRLIKEEASYHDELKAQEARLQKLTNSSDEDGNHDWNIRQERTAIEQTRAVFPSLKQENFRSAGKCKSAS

SEQ ID NO: 130319 - protein, 160 aa, Triticum aestivum
  unsure (1)..(160): unsure at all Xaa locations
  Clone ID: PAT_TA_24737.pep
IHEFLLHKGSQADQIVQETRLWDESSQKTFTMRKXEGLADYRYFPEPDLPEVVLTSEYIDEIRNLMPELPEAKRRRYENMGLSMQDVIFLANDDKVAHFFDSTLEHGADAKLAANWIMGDITAYLKDEKLSIDESKLTPLELSEMIAYIKNGTISGXNCQ

SEQ ID NO: 130320 - protein, 406 aa, Triticum aestivum
  unsure (1)..(406): unsure at all Xaa locations
  Clone ID: PAT_TA_24738.pep
EDAGKLLHSESGSYSQVDLNRAGVPLLEIVSEPDMRSGIEAAEYGAEIQRLVRYLGVGNGNMDEGSLRCDVNVSVRPIGQSEFGTKVEIKNMNSFSAISRAIDYEISRQILLHKGSQADQIVQETRLWDESSQKTFTMRKKEGLADYRYFPEPDLLEVVLTSEYIDEIRNLMPELPEAKRRRYENMGLSMQDVIFLANDDKVAHFFDSTLEHGADAKLAANWIMGDITAYLKDEKLSIDERQIGPREPSGLIGSMKSGPMXGKLTPLELSELIAYIKNGTISGKIXQGDQIADPAAIGAMVDQVLADNPKQLEQYRAGKTKLQGYFAGQVMKASKGKASPVLMNKILGEKRRGRRRGVKQAQQVVLDDWSIGRKQNPAAGTTFWGAKISPILVFEGVVLAMNLGWI

SEQ ID NO: 130321 - protein, 105 aa, Triticum aestivum
  unsure (1)..(105): unsure at all Xaa locations
  Clone ID: PAT_TA_24739.pep
RMGPSTHLQDRFYHRLRAKLGKFLRMGLQPSNLKDKINTLSENTXLPGEGQTNSCSIQQQPXIDTSKTLMNSTSNNFGQTGNREPGQXKLPPGXELLHLKGFSXX

SEQ ID NO: 130322 - protein, 105 aa, Triticum aestivum
  unsure (1)..(105): unsure at all Xaa locations
  Clone ID: PAT_TA_24740.pep
MTGRGKGGKGLGKGGAKRHRKILRDNIQGITKPAIRRLARRGGVKRISAMIYEETRGVLKTFLEGVIRDAVTYTEHAKRKDSHKFKMLSXALKRQXGRTLYGFGG

SEQ ID NO: 130323 - protein, 517 aa, Triticum aestivum
  Clone ID: PAT_TA_24741.pep
RHNDTELHLAAQRGDLDAVRQIIVEIDAQMTGTGEEFDSEVAEIRAAVLNEPNEVGETALLIAAEKGFIDVVLELLNHSDKESLARKNKSGFDALHVAAKEDDRDIVKVLLDHDPSLGKTFGQSNVTPLITAAIRGHLEVVNLLLERVSGLVELSKANGKNALHFAARQGHVEIVKSLLVSEAQLARKTDKKGQTALHMAVKGTSAAVVRALVNADPAIVMLPDKNGNLALHVATRKKRSELVNELLLLPDMNVNALTRDRKTAFDIAEGLPLSEESADIEDCLSRAGAVRANDLNQPRDELRKTVTEIKKDVHTQLEQARKTNKNVHGIAKELRKLHREGINNATNSVTVVAVLFATVAFAAIFTVPGGNDDHGVAIVVHAVSFKVFFIFNAIALFTSLAVVVVQITLVRGETKAERRVVEVINKLMWLASVCTTVAFISSSYIVVGRHFKWAALLVTLIGGVIMASVLGTMTYYVVKSKRTRSIRKKVKSTRRSGSNSWNHNSESDSEIDRIYAI

SEQ ID NO: 130324 - protein, 108 aa, Triticum aestivum
  unsure (1)..(108): unsure at all Xaa locations
  Clone ID: PAT_TA_24742.pep
HGRAQGSLCSPFLPQESASGSPFIRKNPRSVVTMPRSNEILPGLLAAKAIAARHQIREVIDGVAQFVTEVGLRQCAIREYNAHHITGDESGYWMAELEWAYLGRDHAX

SEQ ID NO: 130325 - protein, 126 aa, Triticum aestivum
  unsure (1)..(126): unsure at all Xaa locations
  Clone ID: PAT_TA_24743.pep
TTLAIDLASGAPGRTCVHGCAVVCEAPPPVGPRLGRRGQRRPPSSTRDGPCPRPSPAPSPGRPPLPPPVPAEIVAAAXGPRRQSXEGXAGATSNWEQPPLXAQPRRNKMYFMXWLPRRKGGFSXRX

SEQ ID NO: 130326 - protein, 237 aa, Triticum aestivum
  Clone ID: PAT_TA_24744.pep
KVQGKNVGIPVCEGAATSKSPWNAHELFDLSLLGGGSLREWLFFDRPRRAFESGNRKQRSLPDYNGRGWHESRKQVMKDFGGLKKSYYMDPQPSSNYEWHLFEYEINDSNTLALYRLEFKASDPKRSVKSKLGSSSLNEIQQQMVKLSANSPVDNKRGARSKTKASQKDTNANAYPALKATNQAGASNAYEAVPLNIPNQASAPSAYQTVAPNIPNQDSTSNAYEDASQVDPDVISE

SEQ ID NO: 130327 - protein, 64 aa, Triticum aestivum
  unsure (1)..(64): unsure at all Xaa locations
  Clone ID: PAT_TA_24745.pep
SHHXDMRPCXTGAVGKVHSRCQICSSAFLSWQNLVSLYSPREHMCYTYLINVLGFLGSMGVQAW

SEQ ID NO: 130328 - protein, 100 aa, Triticum aestivum
  unsure (1)..(100): unsure at all Xaa locations
  Clone ID: PAT_TA_24746.pep
IGIGITWCAQPAPALGGSGRTXGLEAIWXNNWSPPNENGRRRIRRKIGXPVPVHGPNGSTLGXKNAFXXPNAXRGRXKMXCTGPARRXTLSGTSXNRPSG

SEQ ID NO: 130329 - protein, 162 aa, Triticum aestivum
  unsure (1)..(162): unsure at all Xaa locations
  Clone ID: PAT_TA_24747.pep
KPQPPPXGRLPDATXGSDHLRQVFGKQMGLSDQDIVALSGGHTLVSLHICSICFHVIYLDRCMHALTLFSCVSLFLXGRCHKERSGFEGPWTRNPLKFDNSYFTELLSGDKEGLLQLPSDKTLLTDPVFRPLVEKYAADEKAFFEDYKEAHLRLSELGYAEA

SEQ ID NO: 130330 - protein, 177 aa, Triticum aestivum
  Clone ID: PAT_TA_24748.pep
MKLTVMTADEQFLNLDVDPDESVENLKALLEVETQVPLQQQLLHFNGKEMNNAEKLSAIGVHDGDLVMMVASNNRTSQDIMRLNPDGSAVNPQAFQQHIRGDSQLMAQLLQNDPSLAQAILGDDTTELQNILRSHHQQRLQLKRIQEEELALLYADPFDVEAQKKIEACIRQKGIDE

SEQ ID NO: 130331 - protein, 266 aa, Triticum aestivum
  unsure (1)..(266): unsure at all Xaa locations
  Clone ID: PAT_TA_24749.pep
SESQPRQPLAKTYPVVSAEYQEAVEKARQKLRALIAEKNCSPLMLRLAWHSAGTFDVSSKTGGPFGTMKKPAEQAHAANAGLDIAVRMLEPMKEEIPTISYADLYQLAGVVAVEVSGGPVIPFXHPGREDKPQPPPXEGRLPDATKGVLTTLRQVFGKQMGLSXQDIVALSGGHTXWGRCHKERCLALRGTLGQGNPLKFDNSYFTELLSXGDKEGLLQLPSDKTLLTDPVFRPLVEKYAADEKAFFEDYKEAHLRLSXELGYAEA

SEQ ID NO: 130332 - protein, 269 aa, Triticum aestivum
  Clone ID: PAT_TA_24750.pep
MIQERGDYKSLDPADILERLNTHEFQLDEKRDIYGSSYGRSCALKAKEVSESEGEDSGSSLGDPEELSQELELLAKKFQKFSRRGHFGKSLRSNDSSSSDYKKRLCHKCKKPGHYIQDCPQWEKESKTKYKDYSSDDAKKKKSSKYSSSKSSKSSSHKKSSSKKARAFIGKEMDSKAEEHEDEEESEESESGVASLALATAFISKSIFNSEENGFTNKADEGNDDYTPTYCFMAKGAKVLKYPSSESSEDESDENLKPSYSKLAKIAVK

SEQ ID NO: 130333 - protein, 213 aa, Triticum aestivum
  unsure (1)..(213): unsure at all Xaa locations
  Clone ID: PAT_TA_24751.pep
PIKDDAVANEAXLELVRRDKLREVRAGHDGTWAAHPGLIPAIREVFEGHLGGKPNQIDAAAPADAITEEDPIQPPRGPRTVEGLRLNTRVGVQYLAAWLGGSGSVPLYNLMEDAATAEISRVQNWQWLRHGAVLDAGGVAVRATPELLARVVEKEMARVQAEVGAARFRRGRYAEAGRIFIRQCVAPELDDFLTLDAYGLIVVHHPRGTPSKL

SEQ ID NO: 130334 - protein, 69 aa, Triticum aestivum
  unsure (1)..(69): unsure at all Xaa locations
  Clone ID: PAT_TA_24752.pep
ETKKWQTQIAYIIDXFRGNRCIEPAEQTNNSIEGNRTASISKLNEEKAQTKRVISIQLSRWTNTTYKTN

SEQ ID NO: 130335 - protein, 185 aa, Triticum aestivum
  unsure (1)..(185): unsure at all Xaa locations
  Clone ID: PAT_TA_24753.pep
PNELIPPIFMINDLGSCLEWNEAMQKITGIKREDAIDKLLIGELFTLHDYGCRVKDQATLTKLSILMNTVISGQEPEKLAFGFFNTDGKYMESLLTANKRTDAEGKITGALCFLHVAXAPELQHALQVQXKMSEQAATHSFKELTYIRQELKNXNGMQFTRXLLEXSDXTEEHXNFCIKVLXQEH

SEQ ID NO: 130336 - protein, 44 aa, Triticum aestivum
  Clone ID: PAT_TA_24754.pep
RVDRAFKYIREVLKWEEDKDENYYQEESFYSTTEMSSSPFIRAE

SEQ ID NO: 130337 - protein, 223 aa, Triticum aestivum
  unsure (1)..(223): unsure at all Xaa locations
  Clone ID: PAT_TA_24755.pep
MAAFASTSPSPAISASAWRMDSLRAALPASAPPRRRPSGLAGRRPPXPRSSGAPSSPRPPPRPPSPPPPCPPRPRGRSPSATPSRSPWESSFAHRMFGTDVRGRILAMRHGKRIPRLNRPADQRKALLRGLTTQLLKHGRIKTTKPRAKAMRKWVDKMITMAKDGSLHKRRQALGYIYEKHIVHALFAEVPDRYGERNGGYTRIIPTFPRRGDNAPMAYIELV

SEQ ID NO: 130338 - protein, 71 aa, Triticum aestivum
  Clone ID: PAT_TA_24756.pep
PPGGHAKTLLAAGGSAARLVELGEEHRELEAELRKMAPPNGRSVLIFRSPCGCAKGRMEVWGAKKVRRIKK

SEQ ID NO: 130339 - protein, 157 aa, Triticum aestivum
  Clone ID: PAT_TA_24757.pep
MRRFLTHLHHHSHRLRPSPPPSRIPTTKNNLPFLVSRRLLSDDASPPAAAPSPPPPSAATPPPPPPPSAIDVPNEELKRRLETYYKVEDESELPSVAVAVLERNLADAHSDTDDELIEELRDRPLPQVHDRDFEADFDEMYETDEELTDLYNARQYV

SEQ ID NO: 130340 - protein, 201 aa, Triticum aestivum
  unsure (1)..(201): unsure at all Xaa locations
  Clone ID: PAT_TA_24758.pep
VARQIGFDHASECPHLCTLAYDYLRKNKGYEDNIFAFFHNTPDPGPLIVRFIEELDKCILGYFSFHWKCSTYMITQCDLHXVLTVEGAPKRKLRNMVLEATRSQRFERVTRNLKVTRLFSTLVEELKAIGLSPQGPAQCSDVMVPVAHCDRSPVLLLMGGGMGAGKSTVLKDILKESFWSGAAANAVVVEADAFKETDVIX

SEQ ID NO: 130341 - protein, 186 aa, Triticum aestivum
  Clone ID: PAT_TA_24759.pep
RQSNGSAKEQGRPDGVGPTASSGPGKLGARTCSRARVTAQYGTNGHGQTDEIGLSGGHTVGLAHCRTFAGRLRPTTDPTLSPRFAAQLQAWCPPNVDPRTAVPMDTVTPRAFDNQYFKNLQGGMGLLSSDQLLFTAPRGGPGADAWARSGAAFDRAFVAAITKLGRVGVKTDASQGNIRHNCAAFN

SEQ ID NO: 130342 - protein, 151 aa, Triticum aestivum
  Clone ID: PAT_TA_24760.pep
HRTSPRPSSSSGIHGPQAEKKPVAEKAEKTTAAKKTKAEKRPPASKEGGEKKGKKKSKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 130343 - protein, 157 aa, Triticum aestivum
  Clone ID: PAT_TA_24761.pep
KHLEYNCHTTPLKQLSFTTTSTGGITALMVVTVESRRTKVFTRNLCKHHDILARFLRVRTNPTQRSQPGGSQRKERLRARAAASQPGGGSQRKERLRARAAAAMVATTKGVTLEAPAIARKAGAAASFRRVGYRVGGAGHGEPMAGVPVNAREEKSN

SEQ ID NO: 130344 - protein, 97 aa, Triticum aestivum
  Clone ID: PAT_TA_24762.pep
WAIRERIEGPQGVATRTPRAGPNWTRRGWRPPPSFSPLPPSLLLLLGIGKRRGILLGLGSPSRIPHTWRAPLGPATSSLPSFIYVARGHPIDTQVNP

SEQ ID NO: 130345 - protein, 107 aa, Triticum aestivum
  unsure (1)..(107): unsure at all Xaa locations
  Clone ID: PAT_TA_24763.pep
RRGRRRRRSSCSRVVDHYDATMWWVPSDATLPGRRESRSSPSPISPQHGESPPLGPPVSPVFSPPSPRGRLPYPSCAAPRPQVPCSRFSIVRLRLVCHXPFFSESAV

SEQ ID NO: 130346 - protein, 159 aa, Triticum aestivum
  Clone ID: PAT_TA_24764.pep
MALGDLMASRLVHSSSSSSSSSLPTPSSAAVNHQTDRVDGELPVANGPELRREDAGEEDEEGRAVVLVPCLPQVVVLCEQRHEGFDEAAAAVAGPSTSGLVSKWRPKDRMKTGCVALVLCLNISVDPPDVIKISPCARMECWIGKHSVMCICLSSFLMS

SEQ ID NO: 130347 - protein, 173 aa, Triticum aestivum
  unsure (1)..(173): unsure at all Xaa locations
  Clone ID: PAT_TA_24765.pep
MGLPRPPSRHPPPRQARPATSRAPSRRPRPASPSSMSHSQGFHQGSSGVYGFSSDGFXRPGSSQDHDQQQXQXXHHVAQXSRRDKMRVQGXXPXAAAAHGLLPIDGDEHXEPGAMYXHSAVGGAXNMLXEMFNXFSAQTPSVHXAXSCWXADXXANYXFXFPGAPSRSKPLCP

SEQ ID NO: 130348 - protein, 89 aa, Triticum aestivum
  Clone ID: PAT_TA_24766.pep
PPPFSKTKKKQLWNISKSKEKDANQLEHPNAGEQPPSRKQKKQLWNISKSKEKHANQLEHPNAGEQPPFRKQKNSSGISLSLRRSTLTN

SEQ ID NO: 130349 - protein, 170 aa, Triticum aestivum
  Clone ID: PAT_TA_24767.pep
ASNPIDLGEQPYRQATAPPPANPFILCLDRSLYPLPRSLPPMLPPCPAVLCQPTNSSSACTRERDHLGVDLPPSRIGAGGGRLTRVGGPVVLRVATLHALPPLGAASLPFAPPSSSRVRLAWRARPSLRAPFAHGGAPPSTSPRLRPRVPSAGPPWAPRLQPFQGFKVRT

SEQ ID NO: 130350 - protein, 113 aa, Triticum aestivum
  Clone ID: PAT_TA_24768.pep
EEEAKLIGSFGSPAVHRVEVALRLKGVPYEFIQEDLNSKSDLLQEHNPVHHKVPVLLHGGRRPALCESLVIVEYVDEAFPRGPPPRPPPPLDRAAARFWARFIDDKCGVCTWW

SEQ ID NO: 130351 - protein, 275 aa, Triticum aestivum
  unsure (1)..(275): unsure at all Xaa locations
  Clone ID: PAT_TA_24769.pep
RVGPPAPHRPGDGLLHHRLRRRGVPPRARRRLPGPLAPLASSDSFFETSAAVDVAEPEDEALEAAAEEEPAVVEEDEEDVAAEEEVVGEYVEPPEEAKVYVGNLPYDVDSERLAQLFEQAGVVEVSEVIYNRXTDQSRGFGFVTMSTIEEAEKAVEMFHRYDVNGRLCXVNVGAPRGARVERPPRDSGSSFRIYVGNLPWQVDDSRLVELFSEHGKVVDARVVYDRDTGRSRGFGFVTMASQEELDDAIAALDGQSLEGRALRVNVAEERPPRRF

SEQ ID NO: 130352 - protein, 721 aa, Triticum aestivum
  Clone ID: PAT_TA_24770.pep
MALAISMEAIDARARELGIDLDSVDVDSITLPPGEDFDILSDDEDLLQNEDIPELEMGFSNIIVVDNLPVVPPEKYEKLENVVRKIYSQIGVIKEGGLWMPTHPETKKTYGYCFIEYNTPQEAELAREKTNGYKLDKSHIFAVNMFDDFEKYMKVPDEWAPAEIKPYTPGENLLKWLTDDKARDQFVIRAGTFTEVYWNDARRAMPELVYQKQYWTDSYIQWSPLGTHLATVHRQGAQVWGGDDKFVRLMRFAHPQVKLIDFSPGEKYLITYSSQEPSNPRDTHRVVLNIFDVRTGKVMRDFKGSADDFTTGGNMGVSGVSWPIFRWGGGRDDKYFARLGKNVISVYETDTFSLIDKKSLKVENVVDFSWSPTDPIISLFVPELGGGNQPARVSLVQIPGKEEIRQKNLFSVSDCKMYWQNNGEYLAVQVDRYTKTKKSIYTGFELFRIKERDIPIEVFELENKNDKIIAFAWEPKGHRFAVIHGDGPKPDISFYTMKAVNNNVSRVSKLTTLKGKQANALFWSPAGRFIVLAGLKGFNGQLEFFNVDDLETMATGEHFMATDIMWDPTGRFLATAVTSVHEMENGFQIWSFNGKLIYKISKDHFYQFQWRPRPPSLLTPEKEEDISKNLKRYSKKYEQEDLDVSNQVGEQERKRRTQLQEEWQGWVAKWKQLHEEERSYRMELRGGEESDKEEEAEYKEIEAEELVDVTEEIVAFDQWNL

SEQ ID NO: 130353 - protein, 229 aa, Triticum aestivum
  unsure (1)..(229): unsure at all Xaa locations
  Clone ID: PAT_TA_24771.pep
MAMASSTTASVAAASLRALAGASPAPPPKPFLVLLSPAPPRRLGLGLRAARPRGPLAPLASSDSFFETSAAVDVAEPEDEALVAEEEPAVVEEEEDVAAEEEVXEVGEYVEPPEEAKVYVGNLPYDVDSERLAQLFEQAGVVEVSEVIYNRETDQSRGFGFVTMSTIEEAEKAVEMFHRYDVNGRLSPRFFSFTPLSPSLDKQLDLHSTTKFDLLRNGRVEYRSSDHCN

SEQ ID NO: 130354 - protein, 72 aa, Triticum aestivum
  Clone ID: PAT_TA_24772.pep
ITPCAILDILSPPYSSKDGRHCSYFRRRRKSAPSGILWDRTRESEFVWLEEYQPCDSFVIRRDLYTGPTLDL

SEQ ID NO: 130355 - protein, 126 aa, Triticum aestivum
  Clone ID: PAT_TA_24773.pep
PKPELILNTTGYYYKCYVVHYVITSCSIIRSLMAPVSSNHQLGRKLFILQDGRQAAQGTCPPSIILDAFAQSLATATTHHELAILDQSSSASVHLGPAATLRPCGAAGDAGGESRQRRSRRETAAT

SEQ ID NO: 130356 - protein, 145 aa, Triticum aestivum
  unsure (1)..(145): unsure at all Xaa locations
  Clone ID: PAT_TA_24774.pep
AWWRAAVECLLGVLXSNENSHVVEAALGALCTLMDEGVDVVGGVAVLTEHNAPRHILRLVRQHRNDEQGSGAVLRRCFWALESFLENGGDRCVREVXTSDRALPSALVGAFHKGDTATXKQVAESVLRSLHRMPDYSATYMSVEL

SEQ ID NO: 130357 - protein, 544 aa, Triticum aestivum
  unsure (1)..(544): unsure at all Xaa locations
  Clone ID: PAT_TA_24775.pep
KVVGLGDKDCLNKRSDGFFILQGLISCRNFILKVLDLVLWGGSPLTXNYRGRLGGLVRVKRKKSHTELKIFSGDIHFPEEADKILGGCLIPPERQKKDSKESKKRKNWVYVQRKKILKSKEKYFVSVRPTVAYEMDEGRNLATLFPQDLLQEENNLQIRLVNFISHENSKLTQRIYHTNSQFVRTCLVVNWEQEEKEKAGASLVEVRANDLIRDFLRIELVKSTISYTRKRYDRTSAGPIPHNRLDRANINSFYSKAKIESLSQHPEAIGTLLNRNKEYHSLMILSASNCSRIGLFKNSKHPNAIKEWNPRIPIREIFGPLGAIVASISHFSSSYYLLTHNKILLKKYLFVDNLKQTFQVLQELKYSLIDENKRISNFDSNIMLDPFLLNCHFVHHDSWXEETLAIIHLGQFIXENVCLFKSHIKKSXGQIFIVNMNSFVIRAAKPYLATTGATVNGHYGEILYKXGDMVKLPLHMKNPRSSDITQGXLPKVEQTLWARAVXSLGPRISERRIEDWNXERIPRFLGAPWGXLIXAELTIPKXYF

SEQ ID NO: 130358 - protein, 167 aa, Triticum aestivum
  unsure (1)..(167): unsure at all Xaa locations
  Clone ID: PAT_TA_24776.pep
XAXAGVDXSGCRRVQVHAQQAXGSXCTNTRRFPAGAGGEGEGAWRPCCCLLPPLSRGPRAXEEAPEEQRRHLALERALQVGGHGGRSRRLPPSAVRPPRADAVRESRGRRALVAIIGSRHGGGGGAVEDGGGIGRRRGRRPGRRGSRLAAEQIRGRGHAVPPLLGLL

SEQ ID NO: 130359 - protein, 110 aa, Triticum aestivum
  unsure (1)..(110): unsure at all Xaa locations
  Clone ID: PAT_TA_24777.pep
AEAQQCGPDPEAIWRGDGGTCACKLCGEMGHNPKGPKDECPNCEGSHXSEECPIRQITCFLCEGTTHYPAQCHIYPMVQRTIPAEERSNERSPPGSFRRSCDEGRDGGHA

SEQ ID NO: 130360 - protein, 60 aa, Triticum aestivum
  Clone ID: PAT_TA_24778.pep
NFTRTKTMKFKISKSERKKVFWNKCHVCYIFHFTTHLLLLIAHFLLLIAHFLGKMHPSSS

SEQ ID NO: 130361 - protein, 145 aa, Triticum aestivum
  unsure (1)..(145): unsure at all Xaa locations
  Clone ID: PAT_TA_24779.pep
MEGAMVEWWPWFGSAVASTIFLWSMVQNHIPDALRLNLAALAAKLTAYFXPYLQFTIXENGAQRWKRSELFLAVEAYLSDACARRARRLKAELGKDSKNIXVSIDDHEGVTDDFSGXTLWWHASKQATQXQCHQFVPWRGTRKRF

SEQ ID NO: 130362 - protein, 102 aa, Triticum aestivum
  Clone ID: PAT_TA_24780.pep
PTFFFTITPPRWAASAHSQCAVNGNNPAMTRHEATEQRQKAARPCLGGEGQPESGASRPTPAHSCVFQVFNNYVLSCCCCGLFLHARLAHHRCTQQFHQDSA

SEQ ID NO: 130363 - protein, 122 aa, Triticum aestivum
  Clone ID: PAT_TA_24781.pep
LSSESFERRSPIQMVFRFIEEGVAFAASVNQFSATHSAGSAESELSSESFERRSPIQMGSVAATDYVGDVPQDTEGSAIEPESGGVEGSGEHDPAGVAWIDAPDGIHVEDGVCVGFGGGRWR

SEQ ID NO: 130364 - protein, 103 aa, Triticum aestivum
  Clone ID: PAT_TA_24782.pep
SHRHMFDSSACGICGAPDSWKHSLVDCTMSRCTWALVDEELGQQIAATSEPNAKQWLFTHMQSLSHELFIKLSVTLWAIWAAKRKAIHEGIFQSPHAIHSFVV

SEQ ID NO: 130365 - protein, 99 aa, Triticum aestivum
  Clone ID: PAT_TA_24783.pep
MSTGGADKSGSGGGRAGGPVKTPSDFLKSIRGRPVVVKLNSSVDYRGILACLDGYMNIAMEQTEEYVNGQLKNKYGDAFIRGNNVLYISTSKRSLTDGA

SEQ ID NO: 130366 - protein, 99 aa, Triticum aestivum
  unsure (1)..(99): unsure at all Xaa locations
  Clone ID: PAT_TA_24784.pep
MSTGGADKSGTGGGGAGGPVKTPSDFLKSIRGRPVVVKLNSGVDYRGILACLDGYMNIAMEQTEEYVNGQLXNKYGDAFIRGNNVLYISTSKRPLTDGA

SEQ ID NO: 130367 - protein, 146 aa, Triticum aestivum
  unsure (1)..(146): unsure at all Xaa locations
  Clone ID: PAT_TA_24785.pep
RRLNLEGSDGALLDGYALDDAXSRGEVTARAEPRPSWCLVETAGRRCHRSGGALERCSRQGRPWRGVVLHLVEETESGRDAVNRRGWPRGEMTRRVRSGAWQRELLPPASPPFGEGAWPQPTHSSATARQTSPATGFDSVGGCVLG

SEQ ID NO: 130368 - protein, 137 aa, Triticum aestivum
  unsure (1)..(137): unsure at all Xaa locations
  Clone ID: PAT_TA_24786.pep
MAKRLVLFVAVVVALVALTVAEGEAXSEQLQCERELQELQERELKACQQGHGPGSFRDISPRVPPPSSVSPVAGQYEQQIVVPPKGGSFYPGETTPPQQTSTTYIFGEIPALLKRYYPSVTSPQQVLYYPRPSFSRN

SEQ ID NO: 130369 - protein, 92 aa, Triticum aestivum
  unsure (1)..(92): unsure at all Xaa locations
  Clone ID: PAT_TA_24787.pep
MAIKRTKAEKKIAYDQKLCQLLXEYTKVLTPFARQCRLQAVQEXPQGLRGDSIXVLMGQEHLIRRWHQGHSGERPGTRFLNNSSVSWLILTR

SEQ ID NO: 130370 - protein, 137 aa, Triticum aestivum
  unsure (1)..(137): unsure at all Xaa locations
  Clone ID: PAT_TA_24788.pep
MVKFLKPGKAVILLQGRFAGRKAVIVRVFEEGTRDRPYGHCLVAGLAKYPKKXPQRTPPKKTAKESRVKCFIKLVNFTHLMPTRYTLDVDFKDVATGGPDALSTHDKKVAACKTAKARLEERFKTGKNRWFFTKLRF

SEQ ID NO: 130371 - protein, 275 aa, Triticum aestivum
  unsure (1)..(275): unsure at all Xaa locations
  Clone ID: PAT_TA_24789.pep
MAKRLVLFATVVIGLVSLTVAEGEASKQLQCERELQESSLEACRLVVDQQLAGRLPWSTGLQMRCCQQLRDISAKCRPVALSQVARQYGQTAVPPKGGSFYHRETTQLQQLQQGIFGGTSSQTVQGYYPSVISPQQGSYYPGQASPQQPGKWQELGQGQQWYYPTSLQQPGQGQQGYYRTSLQQPGQRQQGYYRTSRQQPGQEQQIGQWQQGYYPTSPQHPGQGQQPGQVQKNRTRATPGQGAQPGQGAQPXQGQQGYYPXTSLQQAGQGAQPGQ

SEQ ID NO: 130372 - protein, 157 aa, Triticum aestivum
  unsure (1)..(157): unsure at all Xaa locations
  Clone ID: PAT_TA_24790.pep
MAIKRTKAEKKIAYDQKLCQLLEEYTKVLIAVADNVGSKQLQEIRKGLRGDSIVLMGKNTLIRRCIKVHXEKTGNKDSLELXQLLVGNVGLISTKGDLKGGREEVAKYKLXPARVGLIAXVDVVVPLGTWSGSSQEVLLQVXNIPTKITRVRGNYNQ

SEQ ID NO: 130373 - protein, 77 aa, Triticum aestivum
  Clone ID: PAT_TA_24791.pep
MGLSAKVFVVLLLLLVATEEQGGSVQVALARDCESDSHKFHGACFSDTNCANVCQTEGFTAGKCVGVQRHCHCTKDC

SEQ ID NO: 130374 - protein, 75 aa, Triticum aestivum
  Clone ID: PAT_TA_24792.pep
MGLSAKVFVVLLLLLVATEEQGGSVQVALARDCKSDSHKFHGACFSDTNCANVCQTEGFTRGKCDGIHCHCIKDC

SEQ ID NO: 130375 - protein, 125 aa, Triticum aestivum
  unsure (1)..(125): unsure at all Xaa locations
  Clone ID: PAT_TA_24793.pep
MAIKRTKAEKKIAYDXKKLCQLXLEEYTKVLIAVADNVGSKQAPRKIXRRGLRGDSIVLMGXKNTLIRXRCIKVQLRRKTGNKXSLRLSNLLVGNVXGLIFTKGDLKEXREEVAKYKXGAPARVG

SEQ ID NO: 130376 - protein, 423 aa, Triticum aestivum
  unsure (1)..(423): unsure at all Xaa locations
  Clone ID: PAT_TA_24794.pep
MAKRLVLFAAVVIALVALTTAEGEASRQLQCERELQESSLEACRQVVDQQLAGRLPWSTGLQMRCCQQLRDVSAKCRSVAVSQVARQYEQTVVPPKGGSFYPGETTPLQQLQQGIFWGTSSQTVQGYYPSVTSPRQGSYYPGQASPQQPGQGQQPGKWQEPGQGQQWYYPTSLQQPGQGQQIGKGKQGYYPTSLQQPXQGQQGYYPTSLQQPGQGQQQGQGQQGYYPTSLQQPGQGQQGHYPASLQQPGQGQPGQRQQPGQGQQGYYPTSPQQPGQGQQLGQGQQGYYPTSPQQPGQGQQPGQGQQGHCPMSPQQTGQAQQLGQGQQIGQVQQPGQGQQGYYPTSLQQPGQGQQSGQGQQSGQGHQPGQGQQSGQEKQGYDSPYHVSAEQQAASPMVAKAQQPATQLPTVCRMEGGDALSASQ

SEQ ID NO: 130377 - protein, 137 aa, Triticum aestivum
  Clone ID: PAT_TA_24795.pep
MVKFLKPGKAVILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTSKDKKVGAAKAAKAKLEERFKTGKNRWFFTKLRF

SEQ ID NO: 130378 - protein, 235 aa, Triticum aestivum
  unsure (1)..(235): unsure at all Xaa locations
  Clone ID: PAT_TA_24796.pep
MTKRLVLFAAVVVALVALTAAEGEASGQLQCERELQEHSLKACRQVVDQQLRDVSPECQPVGGGPVARQYEQQSXWVPPKGGSFYPGETTPPQQLQQSILWGIPALLRRYYLSVTSPQQVSYYPGQASSQRPGQGQQEYYLTSPQQSGQWQQPGQGQSGYYPTSPQQSGQKQPGYYPTSPWQPEQLQQPTQGQQRQQPGQGQQLRQGQQGQQSGQGQPRYYPTSSQQPGQLQQLA

SEQ ID NO: 130379 - protein, 75 aa, Triticum aestivum
  Clone ID: PAT_TA_24797.pep
MGLSAKVFVVLLLLLVATEEQGGSVQVALARDCKSDSHKFHGACFSDTNCANVCQTEGFTGGKCDGIHCHCTKDC

SEQ ID NO: 130380 - protein, 137 aa, Triticum aestivum
  Clone ID: PAT_TA_24798.pep
MVKFLKTGKAVILLQGRFAGRKAVIVRVFEEGTRDRPYGHCLVAGLAKYPKKVIRKDSAKKTAKKSRVKCFLKLVNFTHIMPTRYTLDVDFKDVASGGPDALATRDKKVASCKAAKARLEERFKTGKNRWFFTKLRF

SEQ ID NO: 130381 - protein, 137 aa, Triticum aestivum
  Clone ID: PAT_TA_24799.pep
MVKFLKPGKAVILLQGRFAGRKAVIVRVFEEGTRDRPYGHCLVAGLAKYPKKVIRKDSAKKTAKKSRVKCFLKLVNFTHIMPTRYTLDVDFKDVASGGPDALATRDKKVASCKAAKARLEERFKTGKNRWFFTKLRF

SEQ ID NO: 130382 - protein, 137 aa, Triticum aestivum
  Clone ID: PAT_TA_24800.pep
MVKFLKPGKAVILLQGRFAGRKAVIVRVFEEGTRDRPYGHCLVAGLAKYPKKVIRKDSAKKTAKKSRVKCFLKLVNFTHIMPTRYTLNVDFKDVASGGPDALATRDKKVASCKAAKARLEERFKTGKNRWFFTKLRF

SEQ ID NO: 130383 - protein, 261 aa, Triticum aestivum
  unsure (1)..(261): unsure at all Xaa locations
  Clone ID: PAT_TA_24801.pep
MAKRLVLFVAVVVALVALTVAEGEASEQLQCERELQELQEXRELKACQXQVMDQQXLETLAPKCHPVVRQPGSRGTIRSKQIRGARPKGGSFYPGRDHATGKQLQQRIFWGITCTXLKRYYPSVTXPQQVSYYPGQASPQRPGQGQQPGQGQQGYYPTSPQQPGQWQQPEQGQPRYYPTSPQQSGQLQQPAQGQQPGQGQQGQQPGQGQPGYYPTSSQLQPGQLQQPAQGQQGQQPGQGQQGQQPGQGQQPGQGQQGQQPG

SEQ ID NO: 130384 - protein, 441 aa, Triticum aestivum
  unsure (1)..(441): unsure at all Xaa locations
  Clone ID: PAT_TA_24802.pep
MAKRLVLFVAVVVALVALTVAEGEASEQLQCERELQELQERELKACQQVMDQQLRDISPECHPVVVSPVAGQYEQQIVVPXKGGSFYPGETTPPQQLQQRIFWGIPALLKRYYPSVTSPQQVSYYPGQASPQRPGQGQQPGQGQQSGQGQQGYYPTSPQQPGQWQQPEQGXNPGYYPTSPQQPGQLQQPAQGQQXGQGQQGRQPGQGQPGYYPTYSQLQPGQGQQPAQGQQGQQPGQGQQGQQPGQGQQPGQGQPWYYPTSPQESGQGQQPGQWQQPGQWQQPGQGQPGYYLTSPLQLGQGQQGYYPTSLQQPGQGQQPGQWQQSGQGQHGYYPTSPQLSGQGQRPGQWLQPGQGQQGYYPISLQQSGQGQQSGQGQQSGQGHQLGQGQQSGQEQQGYDNPYHVNTEQQTASPMVAKAQQPATQLPTVCRMEGGDALSASQ

SEQ ID NO: 130385 - protein, 472 aa, Triticum aestivum
  Clone ID: PAT_TA_24803.pep
MAKRLVLFVAVVVALVALTVAEGEASEQLQCERELQELQERELKACQQVMDQQLRDISPECHPVVVSPVAGQYEQQIVVPPKGGSFYPGETTPPQQLQQRIFWGIPALLKRYYPSVTSPQQVSYYPGQASPQRPGQGQQPGQGQQSGQGQQGYYPTSPQQPGQWQQPGQGQQGHYPASLQQPGQQGHYPTSLQQLGQGQQIGQPGQKQQPGQGQQTGQGQQPEQEQQPGQGQQGYYPTSLQQPGQGQQQGQGQQGYYPTSLQQPGQGQQGHYPASLQQPGQGQPGQRQQPGQGQHPEQGQQPGQGQQGYYPTSPQQPGQGQQLGQGQQGYYPTSPQQPGQGQQPGQGQQGHCPMSPQQTGQAQQLGQGQQIGQVQQPGQGQQGYYPTSLQQPGQGQQSGQGQQSGQGQQSGQGHQPGQGQQSGQEKQGYDSPYHVSAEQQAASPMVAKAQQPATQLPTVCRMEGGDALSASQ

SEQ ID NO: 130386 - protein, 738 aa, Triticum aestivum
  Clone ID: PAT_TA_24804.pep
MAKRLVLFATVVITLVALTAAEGEASRQLQCERELQESSLEACRQVVDQQLAGRLPWSTGLQMRCCQQLRDVSAKCRPVAVSQVVRQYEQTVVPPKGGSFYPGETTPLQQLQQVIFWGTSSQTVQGYYPSVSSPQQGPYYPGQASPQQPGQGQQPGKWQELGQGQQGYYPTSLHQSGQGQQGYYPSSLQQPGQGQQTGQGQQGYYPTSLQQPGQGQQIGQGQQGYYPTSPQHPGQRQQPGQGQQIGQGQQLGQGRQIGQGQQSGQGQQGYYPTSPQQLGQGQQPGQWQQSGQGQQGYYPTSQQQPGQGQQGQYPASQQQPGQGQQGQYPASQQQPGQGRQGQYPASQQQPAQGQQGQYPASQQQPGQGQQGHYLASQQQPGQGQQRHYPASLQQPGQGQQGHYTASLQQPGQGQQGHYPASLQQVGQGQQIGQLGQRQQPGQGQQTRQGQQLEQGQQPGQGQQTRQGQQLEQGQQPGQGQQTRQGQQLEQGQQPGQGQQGYYPTSPQQSGQGQQPGQSQQPGQGQQGYYPASLQQPGQGQQGHYPASLQQPGQGHPGQRQQPGQGQQPKQGQQPGQGQQGYYPTSPQQPGQGKQLGQGQQGYYPTSPQQPGQGQQPGQGQQGHCPTSPQQTGQAQQPGQGQQIGQVQQPGQGQQGYYPISLQQSGQGQQSGQGQQSGQGHQLGQGQQSGQEQQGYDNPYHVNTEQQTASPKVAKVQQPATQLPIMCRMEGGDALSASQ

SEQ ID NO: 130387 - protein, 137 aa, Triticum aestivum; identical to SEQ ID NO: 130377
  Clone ID: PAT_TA_24805.pep

SEQ ID NO: 130388 - protein, 400 aa, Triticum aestivum
  unsure (1)..(400): unsure at all Xaa locations
  Clone ID: PAT_TA_24806.pep
MRLVLFAAVVVALVALTAAEGEASGQLQCEHDLEACQQVVDQQLRDVSPGCRPITVKPGXTRQYEQQPVVPSKAGSFYPSETTPSQQLQQMIFWGIPALLRRYYPSVTSSQQGSYYPGQASPQQSGQGQQPXGQEQQPGQGQQDQQPGQRQQGYYPTSPQQPGQGQQLGQGQPGYYPTSQQPGQKQQAGQGQQSGQGQQGYYPTSPQQSGQGQQPGQGQPGYYPTSPQQSGQWQQPGQGQQPGQGQQSGQGQQGQQPGQGQRPGQGQQGYYPISPQQPGQGKQLGQGQQGYYPTSPQQPGQGQQPGQGQQGHCPTSPQQTGQAQQPGQGQQIGQVQQSGQGHQLGQGQQSGQEQQGYDNPYHVNTEQQTASPKVAKVQQPATQLPIMCRMEGGDALSASQ

SEQ ID NO: 130389 - protein, 193 aa, Triticum aestivum
  Clone ID: PAT_TA_24807.pep
MFLRLLWRQTTHMTMLIRSRSTSAEVQPCVATVTITLIVAPNPPAAAQRSSRKEAKMVKFLKPGKAVILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTSKDKKVGAAKAAKAKLEERFKTGKNRWFFTKLRF

SEQ ID NO: 130390 - protein, 137 aa, Triticum aestivum; identical to SEQ ID NO: 130377
  Clone ID: PAT_TA_24808.pep

SEQ ID NO: 130391 - protein, 320 aa, Triticum aestivum
  Clone ID: PAT_TA_24809.pep
MAIKRTKAEKKIAYDQKLCQLLEEYTKVLIAVADNVGSKQLQEIRKGLRGDSIVLMGKNTLIRRCIKVHSEKTGNKDFLELSNLLVGNVGLIFTKGDLKEVREEVAKYKVGAPARVGLVAPVDVVVPPGNTGLDPSQTSFFQVLNIPTKINKGTVEITIPVELIKKGDKVGSSESALLAKLGIRPFSYGLVICNVYDSGSVFSPEVLDLTEEDLMDKFASGVSMVASLSLAISYPTMAAAPHMFLNAYKNVLAVALETDYSYDHADKIKEYLKDPSKFAVAAPAAAASGGAAAAAPKEEEKKDEPEEESDGEMGFSLFDD

SEQ ID NO: 130392 - protein, 320 aa, Triticum aestivum; identical to SEQ ID NO: 130391
  Clone ID: PAT_TA_24810.pep

SEQ ID NO: 130393 - protein, 396 aa, Triticum aestivum
  unsure (1)..(396): unsure at all Xaa locations
  Clone ID: PAT_TA_24811.pep
MAKRLVLFAAVVIALVALTTAEGEASRQLQCERELQESSLEACRQVVDQQLAASEYVSAKCRSVAVSQVARQYEQTVVPPKGGSFYPGETTPLQQLQQGIFWGTSSQTVQGYYPSVTSPRQGSYYPGQASPQQPGQGQQPGKWQEPGQGQQWYYPTSLQQPGQGQQIGKGKQGYYPTSLQQPGQGQQIGQGQQGYYPTSPQHTGQRQQPVQGQQIGQGQQPXQGQQPGQWQQGYYPTSPQQPGQGQQPGQGQQGYYPTSLQQPGQGQQGHYPASLQQPGQGQPGQRQQPGQGQHPEQGKQPGQGQQGYYPTSPQQPGQGQQLGQGQQGYYPTSPQQPGQGQQPGQGQQGHCPTSPQQSGQAQQPGQGQQIGQVQQPGQGQQGYCGNYYPSGANQER

SEQ ID NO: 130394 - protein, 216 aa, Triticum aestivum
  unsure (1)..(216): unsure at all Xaa locations
  Clone ID: PAT_TA_24812.pep
LVAEARGAWVLYQGCWLRPPAARSRLVVREHFEARPDDTFLLTFPKCGTTWLKALAFTVTNRSCHAVTGDGHPLLSRHPQDLXVPFLEAPYRQLHPLADLEKLASPRLLSTHMPLTLLPPCMSSXRVGRIVYLCRNPKDVFVSLWQFISKVXRTTPWDKAFELFXDGVCPYGPIWGHNLGFWEESIXXTTXSFLKYDKWRTVNTSDLASSRVPYEE

SEQ ID NO: 130395 - protein, 122 aa, Triticum aestivum
  unsure (1)..(122): unsure at all Xaa locations
  Clone ID: PAT_TA_24813.pep
MAAPNGLARIDTTHPEKKAAAAAAKHENGICHDDSSAPVRAQXIDELHSMQRKRSAPTTPIKDTERXPFAVAVSDEDRRKQQLQSINASLASLTRETRPLGPGDXARKXRRRKXAGGGQRRL

SEQ ID NO: 130396 - protein, 161 aa, Triticum aestivum
  unsure (1)..(161): unsure at all Xaa locations
  Clone ID: PAT_TA_24814.pep
ASRPIGAHFRGILDNYEHHNSGAVLHVPCCRPGRYKFYTAALLLVTAIVVGTVFLWKVEKLSLVDSFYCVCATITTQAYGDXRAAARAGLTRRVTTMDLEAADLDSDRKVGAAEFVVYKLKELGKISQEDISSFLEEFDKLDIDQSGTLSTYDLTQAQSGQ

SEQ ID NO: 130397 - protein, 70 aa, Triticum aestivum
  Clone ID: PAT_TA_24815.pep
YLLLIDRLDSKIVISHWSLVGWILKLQNLLRYSVSHILRAQSRNELAAVSELCSNHVAPWIVHCRMRTGL

SEQ ID NO: 130398 - protein, 110 aa, Triticum aestivum
  Clone ID: PAT_TA_24816.pep
GGGAKKVRFEELPAAWRREETMVEVRALLEEREAGVSYMIGHTCVFAHESSSAVKKFAVNVVYGLPPAQLAEARRRARHPPHLPHRGRHGLQGVTHIVLLAGAADRSLAR

SEQ ID NO: 130399 - protein, 100 aa, Triticum aestivum
  unsure (1)..(100): unsure at all Xaa locations
  Clone ID: PAT_TA_24817.pep
PKTTSKQTSRKAASMRTTRSCENSVTMNPGKPQGEELQATSSLATEGPFPLALASHASPSNLRGAHPRAGEXAASKPGVATTHIHLEQLSTSCLTHRHFL

SEQ ID NO: 130400 - protein, 179 aa, Triticum aestivum
  unsure (1)..(179): unsure at all Xaa locations
  Clone ID: PAT_TA_24818.pep
MANPRVFFDMTVGGAPAGRIVMELYKDAVPRTVENFRALCTGEEGRPARAASPLALQGQAFPPRGSPTSMXQRRDLTRGNGXGGXSIYXENFAERNFVHXTQPGISPMANAGPTQRPISSSDVPIGPRTGFGKSPRMAQESKGGPQRTAQQASPTWPAYWPRGPSPPLPPSPSAPCLLA

SEQ ID NO: 130401 - protein, 192 aa, Triticum aestivum
  unsure (1)..(192): unsure at all Xaa locations
  Clone ID: PAT_TA_24819.pep
SVVLLLILLSVFAFICFKRKIKAAEDDNPFKKMARALIFDLLALQEATGNFSEANKLGEGGYGIVYKGTLPDGQEIAVKKLLGATEHGLHQLRNEVVLLAELQHKNLVRLQGFCSHXKNDTLLVYEYIKNGSLDNFLFRYQXRXNTLNWXQQYNIILGTAKGILYLHEAPSPGIIHRDLKANNILLDEEMDP

SEQ ID NO: 130402 - protein, 109 aa, Triticum aestivum
  Clone ID: PAT_TA_24820.pep
MDMDASFRSAIVNGETLKMFVGQRVRTVLKFQHTQGGVLVGQSTDGHQLTIRGASEGRESHYLEVIGIADNDQSISAETCKDFDDNFDADAFNGLCKLVVNGKVKEVLL

SEQ ID NO: 130403 - protein, 283 aa, Triticum aestivum
  unsure (1)..(283): unsure at all Xaa locations
  Clone ID: PAT_TA_24821.pep
ATRPSTRPLTRGRTRGLPLSGLRRFKVGSDLPFLPIFGLGVSNMKTRMDKSICSWWNGPCLFEILDKIEVPLGDPKGPVRLPIIDKYKDMGTVVMGKLENGTIASANNLLVMPNKTHVKVTGINLDEKKVRRAGPNENVSVKVSGIEAQDIMTGFVLASVANPIGAFSEFKAHVHLLVLRDNAIFEGKTIAVGKIDAVPPVGKSTYSAEAIFDRMMRXMKWRCLEIIDCSMLVSLIHLTILLLLEKFSEFXELGRFTLRTEGXTIAVGKVVDVPPVGRSTFSA

SEQ ID NO: 130404 - protein, 68 aa, Triticum aestivum
  Clone ID: PAT_TA_24822.pep
LSPKWIHVLEEKTKMQYGQQSSKILASSEWTTHFRNSMKWHLEQHADIADFLYSRTSTVIVKIKDQLT

SEQ ID NO: 130405 - protein, 117 aa, Triticum aestivum
  Clone ID: PAT_TA_24823.pep
MQHAAALLGFSAADLLLHIRGAAAACDAAGRRRRRRWRHRAARVGAVDARRLSVGRRRRPVPLKDPPHYPLGSSSPSQGATTGRGMTRAWPGRSQLTPARPWSPCPCHVVARRPGTS

SEQ ID NO: 130406 - protein, 108 aa, Triticum aestivum
  Clone ID: PAT_TA_24824.pep
GGCFFPGGAKNVTPVCPPECQVPTGAGKKVVACRSACLAFGLDAFCCRGAYGPAETCRGSVYSRIFRDACPAYYSYAYDVAPPPARCYAQEYVVPFCPSKWGDRVAQV

SEQ ID NO: 130407 - protein, 518 aa, Triticum aestivum
  Clone ID: PAT_TA_24825.pep
DDDADDDFSVGPNARDGSDNGSGTPCSWTKRAVEIDSPQLLSSDHLAESPDSTCAQVIHPRSGIGSNRWLPTANKRNINNQKENNDDSMGKYLEIGAPRNSSLGYQSSPNEMSVNPTEKQHENLTSQNKSVNKIVIDKPTCQTADLISSIARNTESKQAARITDAPDCSSKMPNGNEMKNDSPINMPSQELGLKISETTRCETEIHDERSIPKRSNLSAFTRYHTPMASDQGGATFRGSCSPQDNSSEAVKTNSTCKMESNSDAAQIKQGSNGSSNNNDMGSSTKNAIAKPCTDRERVMSPSLVKSNQQTSAFHPVQHQVSPADAARKDKASEEIVNAVKVGHSSEAQQSSVQHHHHAHYYRHVIAQQQTLIDRASNARCGSSNASDLPLEGHAANYGVNGSISGSNNGSNTQNASSSAPNIARPNMDSGAMDKTEAGGGNGSGSGPSGSGNDMVCQNQLSQREAAVNKFRQKRKERNFGKKVRYQSRKRLAEQRPRVRGQFVRQSGQEDEAGQAEDR

SEQ ID NO: 130408 - protein, 158 aa, Triticum aestivum
  unsure (1)..(158): unsure at all Xaa locations
  Clone ID: PAT_TA_24826.pep
MASATLLKSSFLPKKSEWGATRQAAAPKPVTVSMVVRAGXAYDHELVKDPPKTIASPRKGVSLPWXDPNATCXVRRLASIGPXRTPEATAKPYRTSLVXTAPALGIFSPASSFXEXXPSXVXGKNFNHQNPQGSFPRPKHQGQAQGSPKGIKRALQWR

SEQ ID NO: 130409 - protein, 181 aa, Triticum aestivum
  unsure (1)..(181): unsure at all Xaa locations
  Clone ID: PAT_TA_24827.pep
MAASALHQTTSFLGTAPRRDELVRRVGDSGGRITMRRTVKSAPQSIWYGPDRPKYLGPFSXEQTPSYLTGRFPGRLRGGTRRGYPADPETSPRNXRELEVIHSPVGDAGGLGCVFPGXPSQERVXXREACGSKPGAIFSQGGVHTGDPTXCSAXISPSGQVVPGAPRARGPPGKRTSLPKN

SEQ ID NO: 130410 - protein, 145 aa, Triticum aestivum
  unsure (1)..(145): unsure at all Xaa locations
  Clone ID: PAT_TA_24828.pep
MASVTARTPVAALRSSASLKSTFLGQSSTRLARAPTTRRNVRAEAKGEWLPGLPSPTYLNGSLPXGDNGSDPFGSGGRTPENLPWVRASGLVNGXWAMLGVAGXLPEVLTKFGXIYPPQWYTPQALLASSTCSHPLTCSTTGIRR

SEQ ID NO: 130411 - protein, 162 aa, Triticum aestivum
  unsure (1)..(162): unsure at all Xaa locations
  Clone ID: PAT_TA_24829.pep
MAPSVMASSATTVAPFQGLKSTAGMPVARRSGNSSFGNVSNGGRIRCMQVWPIEGIKXFETLSYLPPLTVEDXLKAVEYLLXSNWVPCLHSSKGRLCPTVENHRXPGYYQRKYWTIWNCQGSVDRXTQXLKDPRRQKGSPILTVKLKLFNPKTPGSGEKPQK

SEQ ID NO: 130412 - protein, 119 aa, Triticum aestivum
  unsure (1)..(119): unsure at all Xaa locations
  Clone ID: PAT_TA_24830.pep
LAREDGACCPVVSALPGAARVAREATAELILLLLRHRQKRAAAHPRSCYSSGRSSCPDPSSARSFTPQAGRDRSSPTPRGATPMPTPTXEPLKMLADKVYLNAPEDPSSAHPTPAQGSI

SEQ ID NO: 130413 - protein, 166 aa, Triticum aestivum
  unsure (1)..(166): unsure at all Xaa locations
  Clone ID: PAT_TA_24831.pep
MTSIVSKLARAAVATHASSAPIGCTAGGSRSTARCLPGLWLTGGTIRRMCRGVSPAGGPNSEEEKGRPNSEDAVDAAAIDPIDYLHVQEDFLKSKEALWALXDYWRKYHGISRDRNEIARRFNIFCRTARHVHKVNNSGKSLKLTLTKYSDRTTREMFRPKHGPKT

SEQ ID NO: 130414 - protein, 162 aa, Triticum aestivum
  unsure (1)..(162): unsure at all Xaa locations
  Clone ID: PAT_TA_24832.pep
TCRDXGTFAPXSXXCXRPXLQXTXPYFVCVQGGWSRVKTAWLMEQAXLEGQYQLFRESPRLXVAGRRGPEFLEPXNRXTTCMHLNLPPIAXRCXEVGVAGSGGATGMPAVELSPLEGSGRWWPTDAITGGAISAAHPSSLLLCSEYFLRCTALHTGSRGTYK

SEQ ID NO: 130415 - protein, 107 aa, Triticum aestivum
  Clone ID: PAT_TA_24833.pep
ILVRAQARAAVEHIIRQFASRMTSGLGKLVEGWTSLNGSDSDAVARHFTPFVAEWTHRPTGCRGRYDYKSSQELSDTQDELDGDAALDKDDDDNMENVHHDTDPDEH

SEQ ID NO: 130416 - protein, 135 aa, Triticum aestivum
  Clone ID: PAT_TA_24834.pep
MAPKAAEKKPVEKTPAGKKPKAEKKVPASKEGGDKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 130417 - protein, 107 aa, Triticum aestivum
  unsure (1)..(107): unsure at all Xaa locations
  Clone ID: PAT_TA_24835.pep
MXXFPFVIXTPHIIREFLPIKEIFPPVKNQTVLPRTVLIGGVNDIPSCFPCPFPVCGGXAFRFNGVHDIAYRAHNLWVNLILEAVFELLGTGNGVIKGNLARGFHGH

SEQ ID NO: 130418 - protein, 176 aa, Triticum aestivum
  Clone ID: PAT_TA_24836.pep
SHRTQQPAHRPRLSPSSGLCSPSPTGACDLRRTVPCRRRRRPPRRRAPRWAAPTPASPSPPPPWRSPAPSCSSRSAAPSRRTTTSSPPTPPPRPRLPPGSGPASPPPRSGSGRKARRGSMKRVRFARRLVDKANSPGAGSGGSGGVRAGAVLGPRSGNRKRVRSPRRHRRCPQLPG

SEQ ID NO: 130419 - protein, 144 aa, Triticum aestivum
  unsure (1)..(144): unsure at all Xaa locations
  Clone ID: PAT_TA_24837.pep
FFFFSGHDTNVCTAFLFTGLFSPCTFQLRTEKSIKRDKPTHNCTNQLQPRAVYSNRTHSSKTRIHSACWGPSRTLSEGTPPHNAYKDKHNRVGTNIKETKLHTITNQLAREGRSKQGFXXHLPPASNPTFFXCSVNSQQDPMLP

SEQ ID NO: 130420 - protein, 200 aa, Triticum aestivum
  unsure (1)..(200): unsure at all Xaa locations
  Clone ID: PAT_TA_24838.pep
LSRFMASQGEGYXETALRDVVISFLLAGRETTSSALTWFFWLLSSRPDVERRIRDEVAAVRARXYPPVPVNSVQARAADVLPDGTAVGAGWFVSDVAYAMGRMESVWGEDARAYRPERWLDPDRAEGPVRPESPFRRIGCHAGPRMALGEEMACVQRKSIVACVVAVLEVAVEAEYMPRQVDSLPLDKVDRLPLVGRARS

SEQ ID NO: 130421 - protein, 58 aa, Triticum aestivum
  unsure (1)..(58): unsure at all Xaa locations
  Clone ID: PAT_TA_24839.pep
LKRIKCSSGKGRHKVIGTRKSKRADGKSIRNLHTYSSVRCSHRXVKKGHVATVPDLVY

SEQ ID NO: 130422 - protein, 73 aa, Triticum aestivum
  unsure (1)..(73): unsure at all Xaa locations
  Clone ID: PAT_TA_24840.pep
KWCFYPAXGEPALVLAAPVHCAVREAIRAARKEFGSSEIAFQLDVPAPMTCVKEMCGLDIVDKHLESLSEHQS

SEQ ID NO: 130423 - protein, 86 aa, Triticum aestivum
  unsure (1)..(86): unsure at all Xaa locations
  Clone ID: PAT_TA_24841.pep
TALXFGLQGYKHGWQTWLHETTGGAARARIGESGSRAAGPSGGTRGVPTAGGAPAGVSGGRCRRQSGADRRSAARHTASRFNVHDG

SEQ ID NO: 130424 - protein, 172 aa, Triticum aestivum
  Clone ID: PAT_TA_24842.pep
MATRVWAASAAAINPTLLPLSSSPRPSRPAPSTRPPGHLRLRSRPPLPARVVCRRAKNAAFEDYKFPDPIPEFAEQETSKFREHMTWRLEQKKEQYFGEHVEDIVDVCTEVLGTFLQHEYCGPGTLLVHPFLDMKGEIKERGLPGAPQAARAAIAWAEKNIDKDWKEWTGDY

SEQ ID NO: 130425 - protein, 187 aa, Triticum aestivum
  unsure (1)..(187): unsure at all Xaa locations
  Clone ID: PAT_TA_24843.pep
MTPPSPSLFLLDPFVGTYLPGGETADNKKTLLSSGAKRAFGFPADLDCDALMRGLALEADLAGAPDLSRLTLRGVRPFSTCIHAVDKNLIIMITSFPQSLXRGIYLIYNAIDRSLLMIPSAPSTPPSVLTSRVLVARRRDDDLSSYALVFPGTVYDIGCPGRQPVLFVSGSSSKSQWEIAKFTNFPD

SEQ ID NO: 130426 - protein, 87 aa, Triticum aestivum
  unsure (1)..(87): unsure at all Xaa locations
  Clone ID: PAT_TA_24844.pep
PPLEXRHVITVPGSGFGPGGEGFVRVSAFNSRDRVVEACARLTQLPRLNPPSAVVRLVSCSGAAVFAYSFMYTHARSYNNAARHGSC

SEQ ID NO: 130427 - protein, 170 aa, Triticum aestivum
  unsure (1)..(170): unsure at all Xaa locations
  Clone ID: PAT_TA_24845.pep
PLVRGFMAPFLYPEXEWDFRLQLVKSLNVSGHKYGEVNAGIGWCIGTSMEDLPDELILHINYLGADQPTLTLNFRNGSSQVIAQYYQLILHGFEGYRNIMHNCQENDVVRQEGGERKGRFGIWFWGRGVELPADPLXDSSQHDADQTSEFPRRFGWIEPAYRHGSPAKPT

SEQ ID NO: 130428 - protein, 282 aa, Triticum aestivum
  unsure (1)..(282): unsure at all Xaa locations
  Clone ID: PAT_TA_24846.pep
MKHVGHVQGASTSSVHDDLGVFRHIGGGAAAGAVQRDVEGVDLVAHPAAAVVDLAALLRAAVVAELGQRHRDALRARQRREVPRALRQAVDGDERRVLVLGPAEPRAARRRRLRRRLVHHLPHRLLERLGVVRRLHVHQDHAGAHVRLPGEVCVVVPHEAEVVPYSGVGXVAAGSGELLGGVREAGGAVAGGDVAAALREAVDDGAITLAGNGRGEASRGALGDEVRQDGVDVGLAAASVPGPGAVTANGVHGHAQREQSHAEKQQPAARSAKCHGASRTRG

SEQ ID NO: 130429 - protein, 394 aa, Triticum aestivum
  Clone ID: PAT_TA_24847.pep
MPTASCLRPPLRSGRSAAAGLRFPPPAQLYPAGLAIGSWRRRLAGVGVAAASASPFDELYARGRPIHGPSKKSTLWNLIQDIEPLDLSVIQKDVPLETVDAMKRTISGMLGLLPSDQFRVVVEALWGPFFKLLVSSIMTGYTLRNAECRLSFERNLELSEEDAECEKRDTTEDNLHDINLGRPVTIFRLPEDDMPQDPGKRDEGASGETMGEMFSNLTPQAEAKIIRLHSRLDPMRPPTRPLKRKNSALQMQQFVGEEKNDLLDYLRSLTPEKVAELSESTCPGVQEAIQSVVHGLLATLSPKVHSKSPPPVENAGGALNCGGEDDDCAELVENTSLPFQPLISVPRDYLARLLFWCMLLGHYIRGLEYRLELAHLLRISSDVGSFPIDDDHFI

SEQ ID NO: 130430 - protein, 146 aa, Triticum aestivum
  Clone ID: PAT_TA_24848.pep
VQRLALAGRRGWRRRPRLGVLRVLRCLVVLVHGGGFRSAACVCSESSARSGSALAGVVLGSGLGGDGGAARGLCMTSARWIRGSFRCRVSFGRKFCCTLFTCWWYDWCFLQSYCQLDRSNLAFVGLYLSINAKTVRLRKRKMNACF

SEQ ID NO: 130431 - protein, 174 aa, Triticum aestivum
  unsure (1)..(174): unsure at all Xaa locations
  Clone ID: PAT_TA_24849.pep
YHIICNXYYXCYYNHSLFXKLLANIIMFVESPKCMVLIMLPPLWPALLINFFLCFPRSCEHSTHLYLKIFITKGEMTMVMITSMRTSRAHILFGALATNSDGSPLLVCIQPTDDVTAKEAGVVSHGRTLRTYSNTRCMVFGMDTSVLAPTPSPWYRIDSLGENSLFLGQNYPMM

SEQ ID NO: 130432 - protein, 352 aa, Triticum aestivum
  Clone ID: PAT_TA_24850.pep
MCIANYEASGSQVQITLERGIPAMIGSFASKQLPYPYLSFDMVHCAKCNIEWDKNDGIFLVEVDRLLRPGGYFVWTSTLHTHRALRDKENQKTWTAIRDLANNLCWEILSQQAGDSSWVIVGRKGPLQCSGICARPRSYAWRLSFPGQGFIATYTRVNSEVFAEDTSSWDSMVRRYWSLLSPLIFSDHPKRPGDEEPHPPFNMLRNVLDMNAHFGGFNAALLKSGKSVWVMNVVPINAPNYLPLIFDRGFIGVQHDWCEAFPTYPRTYDMVHADGFLSLEKRQKRRCSTLDIFLEVDRILRPEGWIIIRDTAPLIEAARSVAAQLRWDARILDLDIASDEKLLVCQKPFLKK

SEQ ID NO: 130433 - protein, 226 aa, Triticum aestivum
  unsure (1)..(226): unsure at all Xaa locations
  Clone ID: PAT_TA_24851.pep
HEGKIPNRNRADSARSGRESATDGDRRRWRWGRGWGRRGAGXSVLVTGGAGFIGTHTVLQLLEKGYAVTAVDNFHNSVPEALDRVRHIVGPALSARLQFIFGDLTIKDDLEKVFAAKKYDAVIHFAGLKAVAESVAHPEMYNRNNIVGTVNLYDVMKKHGCNKLVFSSSATVYGQPEKGPRLEPPPPQPLDPYGRTKLPWRRPPRRPTRPYPTAGTGGDPFQTQSF

SEQ ID NO: 130434 - protein, 320 aa, Triticum aestivum
  Clone ID: PAT_TA_24852.pep
GPPYPQVELAKLFLRRDIPVVIAVPTPPASTADIFASSAPAVASVAAANPTISFHHLPAPEYPNPDPDPYLQMVDALRLTVPSLLAFVRSLPSVAALVLDTFCVDALDAAAEIGVPAYLYYTSSAADLAAFLHLPHYLAMTDGGDFKDMGKHLLRFPGVPPIPASDMPQIVQDRASRTCAVRMGQYGRKPEARGLLINTYERLEARAVRALRDGVCVPGRPTPPVYCIGPLIVKGEAAAPRTQNACLSWLDAQPERSVVFLCFGSLGAMSAAQLKEIARGLENSGHRFLWVVRSPPEDPAKYFLPRPEPDLDALLPRGFL

SEQ ID NO: 130435 - protein, 140 aa, Triticum aestivum
  Clone ID: PAT_TA_24853.pep
RLDSQLSQEDCVNYMQYEDKESRFEQNQCPIVNIYCINTTNRIHISRRTNLRACCMYVNGFQMNQRLLQLLLHQEDNKVTYAYSTHCVNRHSNSAGLPQPFKWTDSEVPDPLRHTINTFNPSPMEPTGVPEIPISGKYVH

SEQ ID NO: 130436 - protein, 97 aa, Triticum aestivum
  Clone ID: PAT_TA_24854.pep
FDHEALLALTDRIGYVSTGLRDDEIVRGLRVGKHLPFDRKHFSTETERSCSICQEEFEASEEVGRLSCGHGYHVHCIKQWLSRKNACPLCKVAVSKP

SEQ ID NO: 130437 - protein, 127 aa, Triticum aestivum
  Clone ID: PAT_TA_24855.pep
AGRAGFERDYWLGRMGMYDQYQDWRLDVDNMNYEELLALEDRIGYVSTGLREDEIVRGLRVGKHLPFDRKHFLTETERSCSICQEEFEASEEIGRLSCGHGYHVHCIKQWLSRKNACPLCKTAVSKP

SEQ ID NO: 130438 - protein, 163 aa, Triticum aestivum
  Clone ID: PAT_TA_24856.pep
TRKESDRDKAQARNSDSATPTKTRGTGSGRKREAVSRCVPGVSGVGSFSGRQTRTTVSVGCTSTTGESSWWCSEEEGKEASRSPKRLRSDRQGRPKFSNKLASLSRARRDTDLGSDYRFPLMVIDMKETLCWSVSTSGGGGRSEGISASVVARPARAIPAGLV

SEQ ID NO: 130439 - protein, 99 aa, Triticum aestivum
  unsure (1)..(99): unsure at all Xaa locations
  Clone ID: PAT_TA_24857.pep
RGPAPLPPPLASPPRAPPXPPPPRPRSGSCPLPPPAPPPPRSLAPPPPPPLPAILSPPRPALAAPTRRPLPPPSPAVYWCIRPARRNARETPFATGEAN

SEQ ID NO: 130440 - protein, 185 aa, Triticum aestivum
  Clone ID: PAT_TA_24858.pep
MAAVYPTTAALPARHSPPSFLRPSYLSWSASITQHRVPFSPRLALSPPPAANRRSFVIRAAWTRRSRGELDKSPNRKSWKQRTDMYMRPFLLNVFFSKRFVHAKVMHRGTSKVIAVATTNAKDLRTTLPSLIDDNACRTIGRLIAERSMDADVFAMAYEPKKNERIEGKLGIVIDTIKEYGIIFA

SEQ ID NO: 130441 - protein, 112 aa, Triticum aestivum
  Clone ID: PAT_TA_24859.pep
AERTMITIPLVMLHRDKEVWGPDADEFNPMRFQNGFARAAKHSHALLAFSYGPRVCVGQNFAMVEVQIVIATMLKSFSFSLSPTYVHKPSNFLTLTPKYGLPLIVRNLQLTR

SEQ ID NO: 130442 - protein, 126 aa, Triticum aestivum
  Clone ID: PAT_TA_24860.pep
FSSRPHKPIIIRDKMFGLENRVPSSTKQAKMFLRDDPTHFFLFDLVVVHKIRMCGCRITGYYNMSHQVHEPCLAWIIKGKCYSATIAHGTPNGVTASFLPCSPSSLPHREARYYTTACLQASPDIT

SEQ ID NO: 130443 - protein, 398 aa, Triticum aestivum
  Clone ID: PAT_TA_24861.pep
MAFSPATTATAARAAGAFTSGRVSSSPPPSLSSPFLPRVAGAIVARRGGRGARAAASPVRAQAAGAAKKNVLVVNTNSGGHAVIGFYFAKALLAAGHAVTVLTVGDEGSDKMKKPPFSRFSELTSAGAKTVWGDPADVGAAVGGASFDAVLENNGKDLDAVKPVADWAKSAGVGQFLFISSAGIYLQTDEPPHVEGDAVKESAGHVGVEKYIAAEFGSWASFRPQYMTGSGNNKDCEEWFFDRIVRKRPVPIPGSGMQLTNISHARDLGSMLTLAVDNPDAAAGKIFNCVSDRGVTLNGLAKMCAAAAGATVEIVNYDPAAAGVDAKKAFPFRNMHFYAEPRAAKEVLGWTSTTNLPEDLKERFAEYASSGRGEKAMTFDLDDKILAAVGAAPVGVAA

SEQ ID NO: 130444 - protein, 276 aa, Triticum aestivum
  Clone ID: PAT_TA_24862.pep
NKREYVFREPRDVRLGDIMEKLSHTYEAKMDVNHTLHIIPDSRQVNADELQPGICYLQITAVDPVMEDEDLESRRERIFSLSTGSVRARVFDRFLFDTPFTKNGKTQGGLEDQWKRRTVLQTEGSFPALVNRLVVIKSESLEFSPVENAIGMIETRTAALRNELEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 130445 - protein, 309 aa, Triticum aestivum
  unsure (1)..(309): unsure at all Xaa locations
  Clone ID: PAT_TA_24863.pep
TGGSNRSDTHGPDALRHDHDDGHRPHRPRHYARPAHLPGTRRCRAPGIAVLSEAGRAPGTARRRRSGDLTLSVSDLPMLSCHYIQEGPLXFPAPDVPMGSLVSLLVSSLSRALAVFPALAGRFVTLPDDRIVIRCNDAGVEFHHAVAPALSLNDFLVPNADVPTRLTKDLFPMDRTVSYEGHRRPLTSFQLTVLGDGAVFIGVVANHAVVDGTSFWHFYNTWAALCRGASPRLPDFRRNFFGESTAVLRFAGGVGPAVTFDADAPLRERIFHFSRDSIRELKAMANRRSSAGQDAEVYGKMAHDPNKNR

SEQ ID NO: 130446 - protein, 171 aa, Triticum aestivum
  unsure (1)..(171): unsure at all Xaa locations
  Clone ID: PAT_TA_24864.pep
NPPSLHGSQIGSTPGSASAAAAAAAAAAAAHSPGSGFDSMDPFFHALRVSPLRLPPAAAHPPEAAVQPGRSRSPMGRLLAHPXSPTSXVVSXPRLPRRPPAPRPPAAPGPPPXAPPAPSXSSPAPAPAVLPPGPPLPRPGPPXPRRASSPRRASSAPAPGAGAPAGRPPRV

SEQ ID NO: 130447 - protein, 66 aa, Triticum aestivum
  Clone ID: PAT_TA_24865.pep
FRTEGVSPEELLQDYFVFPHFLSCTTCLVLTKYASLLLVGPYTRYAKNSTCKTTFSGAQACDGDLW

SEQ ID NO: 130448 - protein, 94 aa, Triticum aestivum
  unsure (1)..(94): unsure at all Xaa locations
  Clone ID: PAT_TA_24866.pep
SRPCPTKALMDKHTMRNAWAGTLLHPQVKFHCFQTKATLGVGITDPIWYRPAQSRMVSRCQYVTDVLGKXPAHHVCWENLKHYLTCLTCVSSSG

SEQ ID NO: 130449 - protein, 194 aa, Triticum aestivum
  unsure (1)..(194): unsure at all Xaa locations
  Clone ID: PAT_TA_24867.pep
RSINWLYLSRLAALKEFAFMKALGDHGFPVPTAVDCNRHCVIMSLVPGYPLVQIRELQNPDDVFDKILGLVIRLAEHGLIHCDFNEFNIMIDDDETVTMIDFPQMVSVSHRNAQMYFDRDIGCIYKFFNKRFNLTEKGGQDGSETDDDDXGRPSFLSIPKSSGALDKELAASGFTKKEQVEIEKFIDENAEEHD

SEQ ID NO: 130450 - protein, 118 aa, Triticum aestivum
  unsure (1)..(118): unsure at all Xaa locations
  Clone ID: PAT_TA_24868.pep
VLRHAGTGAFVTHCGWNSVLEAASAGVPMLCWPQYAEQRANKVFVVDEMKLGVVMEGYDEEXAEEVEKKVRLVMESGEGEKLRARLASAKEKAAEALADGGPSRLAFAEFLKDLKLQK

SEQ ID NO: 130451 - protein, 192 aa, Triticum aestivum
  unsure (1)..(192): unsure at all Xaa locations
  Clone ID: PAT_TA_24869.pep
RSAAELKEIAHGLENSGHRFLWVVRTPPADPAKFFLPRPEPDMDALLPEGFTERTRDRGMVLKMWAPQVEVLRHAATRAFVTHCGXWNSVLEAASAGVPMLCWPQYAXEQRLNKVFVVXELKVGVVMEGYDEQLVKAREVEKKVRLVMGSEEGEKLRERPALAKEKAAEALADSGPSTMAFAEFLKDSKLFK

SEQ ID NO: 130452 - protein, 147 aa, Triticum aestivum
  Clone ID: PAT_TA_24870.pep
ISSSPVDREGGAAIAATRAHGRSQRRSPPRRRRSAAGSPLAFSFSSPARSHAPLCCPLSAVAETPTPANPLPSRRRPAARSPPLAGSPPTCRASALRTISASSAAPDRALPTYRSKLARSLGRAWREGEGIEEESGASGSATPSLLS

SEQ ID NO: 130453 - protein, 272 aa, Triticum aestivum
  unsure (1)..(272): unsure at all Xaa locations
  Clone ID: PAT_TA_24871.pep
RATHLLRKLQPIKPFIRNLIMSTVRRXGRDPMCSSGMTADLALLRGTPGFSWATSPLLVWCMHRKRRSPGSSRPVYVSVSSTVSSGAAPPLAVCTTQAKLQPLLASTVQTVVASLPRSWAQACRTTPLRLPHQLHQATPCMLTSCRDASTAHSRYAVDSPLVTSSHNVRVLVRLFPVAISLLIPIISLFLFVIVSLSIIFLFCYFLGWLRVHVSLDFAAGRTYFYYRMXXYALMFHPVFDLSSPCCILISSPSLTVVXXXVPYPCLXXCXXP

SEQ ID NO: 130454 - protein, 189 aa, Triticum aestivum
  Clone ID: PAT_TA_24872.pep
LSYAKLRQVFVEEEERTGKTTPARRPSAKKEADPWLSSRRHLQRGSSCYGAAEPWRGPCATPASASTPTAPGAFSPPCGSSSSRRPPSSRPSSPASSPRSPRRPTSSSRRRPARRRSRSGCASASPLCSRPRSAPLCCSGSPGAAAAAAAAAAAAGERWWLPAPAARACRATRSRMIPGHISATPLKNP

SEQ ID NO: 130455 - protein, 238 aa, Triticum aestivum
  unsure (1)..(238): unsure at all Xaa locations
  Clone ID: PAT_TA_24873.pep
INPAFHLEKLKRMLPAFAACCTELVQRWEGLALAAGDAPCEVDVWPDMQNLTGDVISRAAFGXSSYLEGRRVFQXLRGSKLELVLLAMSKMHIPGLFLLANKSXNRRMKQFAAEIERVLXKGIVAKRENAMRAGEATXSDDLLRAAAPIPHGRARDSKGXPHGIXTDDXXRECNFLLPRAEHXVLLXWTISCLXHPXWXDPQGRSLSRAPDPVKVNPKGKSQVSVNPGLPNPPGYRGG

SEQ ID NO: 130456 - protein, 59 aa, Triticum aestivum
  Clone ID: PAT_TA_24874.pep
RSTQRSVDCEVDEPTRSKTTRRTRSSKASLFSLCISICTQIMHIIMFTFRILHNLMGFA

SEQ ID NO: 130457 - protein, 78 aa, Triticum aestivum
  unsure (1)..(78): unsure at all Xaa locations
  Clone ID: PAT_TA_24875.pep
GTNCPRSKYCVTFPHAKPCIKAMGCEHNKPKCTRGYSSGSNFPLXXVHAXIMIHXVGQAPSSSLQGFXRKLVVXPXQL

SEQ ID NO: 130458 - protein, 285 aa, Triticum aestivum
  Clone ID: PAT_TA_24876.pep
MAWTAAASLCCRLVRAPPVRRRARRRTLCSAARSTDAVDREYAGLGLRPPCPGRAPHRRIRLHLRSSVLLVDERSPVQLISVLPMHEELPLMVDIGCGSGRFLVWLAKNSGERRNYLGLEIRQKLVERTQFWVTELGLRNVYFMFANATVSFEQIVSSYPGPLSLVSILCPDPHFKKRHHKRRVLQTPLVDSITKNLCLGGRVFVQSDVLDVATDMRERFDGYSNVFEHADRIDKDLQCDKEGWLLDNPMGIRTEREIHAELEGATIYRRMYQKTRCFSPDYSIS

SEQ ID NO: 130459 - protein, 259 aa, Triticum aestivum
  Clone ID: PAT_TA_24877.pep
MGGGSRSRAKEADGESEVRPGGMFVQRRDGEEGPTVRLRVSHGPALRDVFVPAQATFGELKRILAQTIGLEPERQRLFFRGKEKRDDEFLHASGAKDGAKLLLLEKHVPANVEQKVEPVMMDESMMRACEAVVRVRSEVDKLSAKVCELEKSVLAGKKVEDKEFVVLTELLMVQLLKLDGIEAEGEARAQRKAEVRRVQNLVETLDKLKARNANPFSDSAKSVSVSTEWETFENGVGSLNAPPARFSSTQNDTDWEQFD

SEQ ID NO: 130460 - protein, 112 aa, Triticum aestivum
  Clone ID: PAT_TA_24878.pep
PGRSPGAPGVRPLLPCPSALSVSGAVAPSLASGPQTLVCGALSRAQLKSRESAYQAWLGYYNSNKTIGGNKSRLVTLGEEFSRSMGLAAPPAIPKLILRKMGLSKVPGFRST

SEQ ID NO: 130461 - protein, 182 aa, Triticum aestivum
  Clone ID: PAT_TA_24879.pep
AGLPPAPAPSPGAPAHPPPAGAPVKPPPPAPPPPAPPPPVAPPPATPPAVKAPPPVTPPPVSAPPPATPPPAAAPAETPAVLPPVATPPPVAEAPAVLPPAEAPSKSKNKHKRKRSGKKKSPAPAPEPLSPPAPIAPEPTTVEDVSGPAPSANDLSGSGRQYGHWGIVVQTAMAALLLSLAW

SEQ ID NO: 130462 - protein, 186 aa, Triticum aestivum
  unsure (1)..(186): unsure at all Xaa locations
  Clone ID: PAT_TA_24880.pep
PHDAAIKHSSHPPRGRPQGIASAEDEHRLFPLGLEKYGKGDWRSISRNFVISRTPTQVASHAQKYFIRLNSMNRERRRSSIHDITSVNGEASAAQGPITGTNGQAAVPGKSPKQSPHQPGNLPPGVDAFGTTIGQPVGGPLVSAVGTLVTLAXAAPPHMEYAMHAPVPGTVVPRAPMYPMPPPPSR

SEQ ID NO: 130463 - protein, 169 aa, Triticum aestivum
  unsure (1)..(169): unsure at all Xaa locations
  Clone ID: PAT_TA_24881.pep
GPQPPHYLTATCAVVHAMAASAAASSRRGFLRLVVAAAVLAAFGLGAARAAGSSVDRAPLSVASLFPGPACPTTAXARTHAAXFSEDEISTRRPXXLLVIPKGNXGXXXFXAEQNGQFIXAXXPXNRPGXDKXLPXQPGXKTRXRXSQPXSREPTPXKRNSVTRXXPXX

SEQ ID NO: 130464 - protein, 275 aa, Triticum aestivum
  unsure (1)..(275): unsure at all Xaa locations
  Clone ID: PAT_TA_24882.pep
MRRRRSPLASARTPPCCAGSPVSHAWSALQQPLLLCHGFPPGSEASRHRAHGRRLPENPAISAADGFLELTEYTREEILGRNCRFLQGSETDQTTVDKIREAIREQKEVTVQLINYTKSGKKFWNLFHLQPMWGRRGGDQYFIGXVQLDGSDHVEPLRNRLSENTEIQSAKLVKATAGNVXDEAVRELPDANLRPEDLWAMHSYXXSSKPXKRNNSXWRAIEKXYRTGEKISLKHXXPXNLGXGDLXMXLVECRXWXNIAMKAWQIVDVDRPRGY

SEQ ID NO: 130465 - protein, 157 aa, Triticum aestivum
  unsure (1)..(157): unsure at all Xaa locations
  Clone ID: PAT_TA_24883.pep
MNRRSRRRGKRGRTSPDPPAKRRRGPLESMPGELEAAPAPAPSVVMVAGLPPGCGVIELKSRLGGVTAPSARTXRIDAAAATGHVTSRSAAAATAAIAASLRPPSXGITIGSKKVFCSGRPASPTASSIRPSVQYLADWAFASSNIQEHKGENILYV

SEQ ID NO: 130466 - protein, 459 aa, Triticum aestivum
  unsure (1)..(459): unsure at all Xaa locations
  Clone ID: PAT_TA_24884.pep
MGSLRAPPHLAGGTSLGRGYPPCLASSGVPISKVLSVSCPLMSYRLSVLRDTEVSGLKARPRIDFTSIFSTVNPIVEDVRVRGDPAVKDYTXKFDKVTLDNAGVRVNDVPDAXELMHLLRESFDVAYDNTCANQASKTLPIYRYARMYRGVSLNSFLKYITVQSLTEEGLRRLGPYVAKMAEVEGLEAHKRAVTLXTARDRSHCNCLNCXNMVCCASLFDAWELIFFLILIGWDLPEFKVKNTKLFHGIMLLMSILGPSEVLVIADKYANPVHVAADLLSQAEHGPDSQVVLVIAGDGVDLGAIEAEVSKQCDALPRGDFASKALGHSFTVFARDMVEALSFSNMYAPEHLIINVKDAEQWEELIENAGSVFLGQWTPESVGDYASGTNHVLPTYGYARMYSGVSLNSFLKYITVQSLTEEGLRRLGPYVAKMAEVEGLEAHKRAVTLRLQEVEATVTV

SEQ ID NO: 130467 - protein, 131 aa, Triticum aestivum
  unsure (1)..(131): unsure at all Xaa locations
  Clone ID: PAT_TA_24885.pep
XXXLFPXEMRXQQSLETXGEGARRTLDWXSRSSXVRQXDPLGKRQXWTRRXGXSCRRAPSARSDARPTGXESVSGCCAGGSCTAAGGGRCNSLRHWRTYVKCVLLRPAVSVTSYNVWLLAHRVRSAGCGYG

SEQ ID NO: 130468 - protein, 192 aa, Triticum aestivum
  unsure (1)..(192): unsure at all Xaa locations
  Clone ID: PAT_TA_24886.pep
FVVVALLSVVLRWSELRREGSLTTASVSKPASAPDLELLIFPPQLSSCLRGGGRGDAVEAGLISSYAASAISILEHISRRAWSGATARIVRLPASATVLLLLVEGRPSGALLAPFFPPGASSPDGSQFSSGQASVTSSAGAPLKMAQQIRRPKWFVPGDGGSGLRLVLFSLDRIAFSFPPPGSXMQDARTVL

SEQ ID NO: 130469 - protein, 311 aa, Triticum aestivum
  Clone ID: PAT_TA_24887.pep
MATGGEGPPGEEDERDWADLTAVCLAEAFSRLGPEDLWRGAMACCRAWREAARSRPALFAALDLEPAFDAVGADAAEWWTPAFQRRVDAMLRSAASLAAGELREVRVRHCSDDALAFAAKSSPQLSILSIQSSPSVTDRSMLTVASCCPILTELDISYCYEVSYKSLEVIGQSCPNLVVLKRSIFNWLDSSEHVRTVPAEYLRACPQDGDREAIAISRSMPKLKQLVLRFAKLSGVGLNSIAEGCKELEVLDLFGCANLTSRGIEQAAANLKNLETLVKPNFYIPRSAFHMERYGHWQLYDERFQTNVFQI

SEQ ID NO: 130470 - protein, 199 aa, Triticum aestivum
  unsure (1)..(199): unsure at all Xaa locations
  Clone ID: PAT_TA_24888.pep
MALVLHSGAGNKNAFKALIAAEYSGIKVELTKDFEMGVSNKTPEFLKMNPLGKVPVLETPDGPVFESNAIARYVARLKDDNPLFGSSRIEQAHVEQWMDFAATEVDPGVAWYLYPRLGYLPYVSTTEETAISSLKRSLGALNTHLASNTYLVGHAVTLADIVMTCNLYHGIARILTKLFTSAXVXXFWXNTYSALATGI

SEQ ID NO: 130471 - protein, 146 aa, Triticum aestivum
  Clone ID: PAT_TA_24889.pep
QVDEQQDHGRGQDKRKIRKTTYYGDDEEPPQEKRRIKKTSFVDEQGKRRTKKTYVNEEVPLEEPVKRCTHCLSHTTPQWRSGPLGPKTLCNACGVRYKSGRLLPEYRPANSPTFVSFMHSNSHKKVMQMRKSVENEHEHEYSHSDM

SEQ ID NO: 130472 - protein, 99 aa, Triticum aestivum
  unsure (1)..(99): unsure at all Xaa locations
  Clone ID: PAT_TA_24890.pep
PPGTSAASTGPSTSPSSTRSASSYPPPPGAGRGGRPYARGFRLGLVSCCSALISLLKDACRARSIYRNTYQGTNNNCWHVHPYLLFPGVSDLTRVILXC

SEQ ID NO: 130473 - protein, 186 aa, Triticum aestivum
  Clone ID: PAT_TA_24891.pep
VRTAFVCDCGSLGGTPVHVCITDGRSQVEKAGCATSLESLGELTTSLLRTSNVRAFSAAKLPVEAPGTPALRGRYNVTAARRLSKSSEIVTCHDLTYPYAVYYCHTSNPTAAYAVTLASVDGGAAPATMEALAVCHLDTSQWSLKHPFFALHNVKPGDVAVCHFLTKLSVVWVQAGEPGNAHAAAR

SEQ ID NO: 130474 - protein, 574 aa, Triticum aestivum
  Clone ID: PAT_TA_24892.pep
MTAPPPPPLPPTARWSVAGHGSLMTAPPPPPPPPARWSVAGDGSLMTTPPPPPPTARWSVAGDGSLMKAPPPPPPPPPPTARWSVAGGGSLMRAPPIPLSRERLALPYQDGEPPATTDDLSMRPTSSPPPTSAEETQGARRSSVSPAPVTTGMATSRGPSTLIEAEEGRATERKEIVVKLLKARAKDNLELGGIAAIFGFAVLFGWSCFPEEMKRPGNLKFIFSLLLAIATFFSGTALTLLSMNIVGLPESLVSAGQLVASKCLFLICTALSAMTLVSLLALLPSMLYLCLGLVVMTVVVLPAIVVHCYMRRHTEGGDEAAALEEHKEELEAASKITSCVTNSAFGGLVGVLFSASKSKVSGAPTAVYTAMFFMFSTAIFGMVVMTMSKKVSKVANRRLRQLLVWAIRLANAFLLCSLACAAFAASFAVIRCQIFAAFGPLAITAVICLILHHCTVRPGEADPRNQENQKARLKVMEDMASKVTAATLGAIMSVLAGSVGEEHHEKKGATDAFMVVLTSTFVSSFGFMLLAAAPSSARVYLAPVSKVLIWSSVALFGATAVSVYSAEISRAVSQ

SEQ ID NO: 130475 - protein, 148 aa, Triticum aestivum
  Clone ID: PAT_TA_24893.pep
VREMVALAGAHTVGFSHCSEFAHRVYNYKGKGGGASGHDPSLNPEFARALQSSCAGYESNPDISIFNDIVTPREFDELYFKNLPRGLGLLASDAALWEYPPTKVFVQQYADNRTAFFQDFAKAMQKLGTVGVKTGRQGVVRRQCDILD

SEQ ID NO: 130476 - protein, 225 aa, Triticum aestivum
  unsure (1)..(225): unsure at all Xaa locations
  Clone ID: PAT_TA_24894.pep
QLDNFYANHSRYVKSRNDAQIRGNKRSNTTTSCDPARFTADGKPIVPCGLIAWSLFNDTYSFTRGKENLTVNEKDISWKSDREHKFAKNVYPSNFQNGALIGGKKLNSSIPLSEQEDLIVWMRTAALPTFRKLYGRIYVDLKANDTITVRLSNNYNTYSFGGKKKLVLSTATWLGGKNDFLGFAYLIVGGLCIFLGIXFTLLYLIKPRKLGDHNYLSWNRHPAGR

SEQ ID NO: 130477 - protein, 291 aa, Triticum aestivum
  Clone ID: PAT_TA_24895.pep
METHSAKLKRNVRKSSTATVETQANTVEPEKWKRNPRKFNGSPADSVPDSQLSELEKVKRNLKKAANSMAEASKISTKADVSKVPNSIADELKILGSMAEPSKKSSKLNGISDHQDSECEKALESTREALFPLETQDSHSGNLLENSNIGKLVPDIKYDLEASFLGDKVNEPTTVAQADEVIQLQNLDNGYDIIERKEETRSKEEPLPNGSLKTKRRSSFSNSEYPESGTKNTPVPSRKPSYMAPTESLKAKLRGPPRLDSDLPVDKNAFTRRQSLPSAANNRAIKTEWRR

SEQ ID NO: 130478 - protein, 105 aa, Triticum aestivum
  Clone ID: PAT_TA_24896.pep
TLSSSSVIIEAFQQQAAARPGVGTKAIINLGLEKVPVPGEPGFPFPGLFTLPQSGEEAELLRNYLKQIREETSGRLLNCAYRANGTPNKWWLAFAKRKFMNVVIL

SEQ ID NO: 130479 - protein, 114 aa, Triticum aestivum
  unsure (1)..(114): unsure at all Xaa locations
  Clone ID: PAT_TA_24897.pep
RRRGRRRPAAGPPHRQLQGRLDCFVPRLLAGAASSTTTARVPAASPPVRPSVHGGDSHRHQQDKRGGGHSAFRVLQNPHPAXPPPPAAQRNLELILTPPATVSVTRILVLGVKP

SEQ ID NO: 130480 - protein, 160 aa, Triticum aestivum
  unsure (1)..(160): unsure at all Xaa locations
  Clone ID: PAT_TA_24898.pep
MASEQTFIMIKPDGVQRGLIGEVISRFEKKGFYLKGLKLQNVEKSFAEQHYADLSSXPSSAGSVEYILSXPVLPMVWEGKSVLSNWDAKIIXATTPASDPGXSVGDFAVHIXEDXIHGSLNFXCQEEFPXWSXEGFQIGGPTQRFILNFQMVSQVLNHYK

SEQ ID NO: 130481 - protein, 150 aa, Triticum aestivum
  unsure (1)..(150): unsure at all Xaa locations
  Clone ID: PAT_TA_24899.pep
RPRRRRRHLVSHTQPPLPTPHLGPPLPPPSRRSSGAGHRRKVGFSYGSSPLGGPSVLFAGGELFGSGSSPLVFLTLLLTEGGGMDLLLSSLIPLCLRRGGPSQRTPQRVGAPSPPTPAPPXXXAEXRGGDGLPRQRLSXXXSXTPXXLKX

SEQ ID NO: 130482 - protein, 150 aa, Triticum aestivum
  unsure (1)..(150): unsure at all Xaa locations
  Clone ID: PAT_TA_24900.pep
QRSSGPAVLAAERAPPAPPVRRRVRLPAAAPWRCAPALPVPPRPPAPPPPXPAPPPPPAARPRPPPPRAPRPPRPAAPPRPARAPPPAPPSPRRRPPPPPGPAPRLPPPAAPPARPPVVPLAPSLPVAVALLVHGFVPVSAGSIGSPFFL

SEQ ID NO: 130483 - protein, 382 aa, Triticum aestivum
  Clone ID: PAT_TA_24901.pep
MHIPPRSATRPPAGRRLHSPSDSGGAPPRPPTPHPPPPLPRARPQHGEIRGGRMSGFGDGYVGTAQDAVKIRRLEKQREAERRKIEELKNKNADGQPGLLQFGSSTSEILETAFKKETVGLVTREQYVEKRVNIRTKIEEEEKEKLQKLQQEEEELQMQKRKKRRVRGDPRLSFYDDIGNGSDEDEFENQETQKKQLGKDPTVETSFLPDRDRDAEEQAERERLKMQWSREQELIKNEPLSITYSYWDGTGHRRAIQVRKGDSIGEFLRAVQQQLAPEFREVRTTSVENLLYVKEDLIIPHQHSFYELIINKARGKSGPLFHFDVHEDVRTIADATKEKDESHAGIAWSRPRYEKNKHIFPASRWEIYDPTKKWERYTIHGD

SEQ ID NO: 130484 - protein, 121 aa, Triticum aestivum
  Clone ID: PAT_TA_24902.pep
STRTTRGSKSVSVGVEEGLTFTEDKILAASGHQLKILVESCTAISSEGQGDKVIVSPGHPLASGRPAWSCGGSVSKRKFNISDDQEKLQQESPSISKRLHRTSSVPFDLNLPIDEDGSSDV

SEQ ID NO: 130485 - protein, 150 aa, Triticum aestivum
  unsure (1)..(150): unsure at all Xaa locations
  Clone ID: PAT_TA_24903.pep
PPPPWPPPPPPPPPAPRPRRRRPPPRPTTGPRSPWSPSASARCARSRTASRKMEEAVAGRQDAQPRSRRRXCAPSPPSPPSSTSSRRLRGAASPSAVAEGGLRRPRPRPRAPGPAGPAASGLPPLALLPPAPRFDVKPQRLHRHDGRARA

SEQ ID NO: 130486 - protein, 155 aa, Triticum aestivum
  Clone ID: PAT_TA_24904.pep
MDGDTTFTKLFVGGLAWQTQRDAMRRYFEQFGDIAEAVVIADKHTGRSRGYGFVTFRDPEAAARALQDPTPVIDGRTANCNLAALGASQRAHPAAAAPFGMVRSTPPATSSSSYQSSAAAAIAASYFPQQAHYAYPYYYGYTGGYSQRKHVSKCK

SEQ ID NO: 130487 - protein, 224 aa, Triticum aestivum
  unsure (1)..(224): unsure at all Xaa locations
  Clone ID: PAT_TA_24905.pep
GPRTSPFHELSESGHTIQHTSQFRFLDKAAIMLPPSDKACVAPPTSSWKLCTVTQVEELKILLRMFPVWASFVIFHAVTGQLSSTFIEQGMVMDNRVAGFAIPPASLSIFGVFSVLVWVPVYETVLVPLARRCTGNLKGFSQTQRLGVRFALSALTMVYSAALETKRLANVPVPMSILWXAPSHVLHGAAGAFAGIGMTEFFXQQXPXAKKNLCAGXAQISXSV

SEQ ID NO: 130488 - protein, 124 aa, Triticum aestivum
  Clone ID: PAT_TA_24906.pep
WDMYDPEGYSLWFCDYKYNDENTVSFVTLNKVGGFLQRMDLCRKYAFGKMLVIGSEPPFKLKGLWLFRGQDVPKFVMDEVYDMELYEWTKVDISDEAQKERVNAMIEDQEPFEGEALLDAKCFK

SEQ ID NO: 130489 - protein, 168 aa, Triticum aestivum
  unsure (1)..(168): unsure at all Xaa locations
  Clone ID: PAT_TA_24907.pep
MAPLTKLFLLLLGLNLMVTAVHGGCGPHCPTPTPPPPPSTNGGTCPIDTLKLGVCATVLNLVKLGLGVPPNERCCPLLAGLADLDAAVCLCTAIRAKVLGVINLNVPVXLVLLLNQCHKTCPPGFTCPALINRRTCPSMPCCGHMPCTARFPPSHNTLGFLTYKSCMP

SEQ ID NO: 130490 - protein, 120 aa, Triticum aestivum
  Clone ID: PAT_TA_24908.pep
MEMKKPHAVIVPLPTQGHVTPMLKLAKLLHCKGFHITFVNTEYNHRRLVRSRGDAAVEGLPDFRFATIPDGLPPSDAGATQDIPSLCYSTMTTCLPPLKRLLGEAQQGWAAGDVRGGRAT

SEQ ID NO: 130491 - protein, 230 aa, Triticum aestivum
  unsure (1)..(230): unsure at all Xaa locations
  Clone ID: PAT_TA_24909.pep
ARGFCGGVTASTTHQWTTLSGSGAEDVRVMTRKSVDDPGRPPGIILNAATSFWLPVPPSRVFGFLRADASPSVSGVLPVGAGVHAMAHIANGSHHGNAVSLLRVNNANSNQSNMLILQECCTDATGSYVVYAPVDVVAMNVVLNGGDPDYVALLPSGFAILPDGPAGAPDAGGSLLTVAFQILVDSVPTAKLSLGXSVATVNXSLIACNVDRIKGAVVVNPGDNTGAAAR

SEQ ID NO: 130492 - protein, 162 aa, Triticum aestivum
  unsure (1)..(162): unsure at all Xaa locations
  Clone ID: PAT_TA_24910.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDXRIRKLSDNCTGXCRGSLVFNAGGGVGTGXWALGASSLVPLL

SEQ ID NO: 130493 - protein, 111 aa, Triticum aestivum
  Clone ID: PAT_TA_24911.pep
MASKRILKELKDLQRDPPTSCSAGPVAEDMFHWQATIMGPSESPYAGGVFLVTIHFPPDYPFKPPKVAFKTKVFHPNINSNGSICLDILKEQWSPALTVSKVTQFFLFMAL

SEQ ID NO: 130494 - protein, 148 aa, Triticum aestivum
  Clone ID: PAT_TA_24912.pep
MASKRILKELKDLQRDPPTSCSAGPVAEDMFHWQATIMGPSESPYAGGVFLVTIHFPPDYPFKPPKVAFKTKVFHPNINSNGSICLDILKEQWSPALTVSKVLLSICSLLTDPNPDDPLVPEIAHMYKSDRAKYESTARSWTQKYAMG

SEQ ID NO: 130495 - protein, 148 aa, Triticum aestivum; identical to SEQ ID NO: 130494
  Clone ID: PAT_TA_24913.pep

SEQ ID NO: 130496 - protein, 275 aa, Triticum aestivum
  unsure (1)..(275): unsure at all Xaa locations
  Clone ID: PAT_TA_24914.pep
MMSMMADLSCGASGVTVNDHQLAAPAPEDSAVAGSEKMGRGRIEIKRIENTTNRQVTFCKRRNGLLKKAYELSVLCDAEVALIVFSSRGRLYEYSNNSVKATIERYKKANSDTSNSGTVAEVNAQYYQQESSKLRQQISSLQNSNSRSLVRDSVSTMTLRDLKQLEGRLEKGIAKIRARKNELMYAEVEYMQKREMELHNDNIYLRSKVSENERGQQPMNMMASGSTSSEYDHMVPPFDSRNFLQANILQQQQQQQXYSQQLQPTALQLGQQYFN

SEQ ID NO: 130497 - protein, 269 aa, Triticum aestivum
  Clone ID: PAT_TA_24915.pep
MQILNEQLAAPSTGLMVKESASPGSGSGSPGGAAEKMGRGRIEIKRIENTTNRQVTFCKRRNGLLKKAYELSVLCDAEVALIVFSGRGRLYEYSNNSVKATIERYKKATSDTSSAGTVAEINAQHYQQESAKLKQQITTLQNSNRTLIGDTMATMSHRDLKQLEGRLDKGLGKIRARKNELLCAEIEYMQRREMELQNNNFFLREKVAETERGQQQTLNMMGAASTSNEYEQNMIHCDPRTFLQFNFMQQQPQYYSQQEDRKSLNSVGI

SEQ ID NO: 130498 - protein, 116 aa, Triticum aestivum
  Clone ID: PAT_TA_24916.pep
MARAQVMLMAVALVLMLAAVPRAAVAIDCGHVDSLVRPCLSYVQGGPGPSGQCCDGVKNLHNQARSQSDRQSACNCLKGIARGIHNLNEDNARSIPPKCGVNLPYTISLNIDCSKV

SEQ ID NO: 130499 - protein, 83 aa, Triticum aestivum
  Clone ID: PAT_TA_24917.pep
MVPVPHHVQLGRSAQVRSYRWRPPMLCSPIISSVQLTKTIIDVRSENDKAKAGVPQLPSNAKNKIIALPLEELPNKIKGMVRN

SEQ ID NO: 130500 - protein, 389 aa, Triticum aestivum
  Clone ID: PAT_TA_24918.pep
MAFTPTSVSATLAPSAPPPPAATKGTPRRAPWNAAPLAAAAASSTAALMAATPAARAAALSKEDVAGSFTKVVDTVDVVIGVGGKVAEQSFVVLRALGEAAKPALPVLQNAGEQALKLASPVVSDASRQATEALQGAGVDLAPFQSAFKTVADAAQPAIGAAKPIASETVQTIGSLEGTDYVVAAGAAFLAYLLLPPAWSLLSYGLRGYKGDLSPAQALDMVTSQGYLIIDVRSENDKAKAGVPQLPSNAKNKIIALPLEELPNKIKGMVRNAKRAEAEIAALKISYLKRIGKGSNIVVMDSYGDNSKIVAKTLNSVGFKNCWVMAGGFSGGKGWAQSRLGTDSYNLSVVEVVKPSRVIPAAAERFVTVSSTSTPSRTTRKLLPGNVDS

SEQ ID NO: 130501 - protein, 194 aa, Triticum aestivum
  unsure (1)..(194): unsure at all Xaa locations
  Clone ID: PAT_TA_24919.pep
MHISDAYPISTAPVSAAGKAKKPKKNSSQASPLKRPSGVLRKTKKAGGDWRDAGMSGVGEDPARAASEMKNEWKDQDLGLNQVSFDESSMPAPACSCTGXVLRQCYKWGNGGWQSSCCTMSMSMYPLPXMPNKRXAPXAGGKLXERLTSCXPXTGXATFLRXXASKDXWAXTDSYHIRLFNKGESRPVPYGHNL

SEQ ID NO: 130502 - protein, 233 aa, Triticum aestivum
  unsure (1)..(233): unsure at all Xaa locations
  Clone ID: PAT_TA_24920.pep
MADEEACMFALQLANSAVLPMALRTAIELGLLETLVGACGKALTPEEVAAKLPSANPDAASMVDRILRLLASYNVVSCVVEEGEGGSLSRRYGAAPVCKWLTINEDGASLAPFALLATDKMLMESWCYMKDAVLXGGNPFVKAFGMTARECNGXDIRLNRVFNDAMTHHSGIITGKFLELXTGFDGIGTLVDVXGSVXXLXHAIVLKLXAIRGDTLDFPFRSQRPRITVAALR

SEQ ID NO: 130503 - protein, 119 aa, Triticum aestivum
  Clone ID: PAT_TA_24921.pep
NNSLVGSFLLQPRCRGLQAPCLEDSRMKPAIYKGKQKIIKGNLRGAKSSSYGCPHRETSCHQNRQGTTCVLTQLPPSNFTFYQSKLFLRLHWYAAKSHTCIEITITICVAFIEVTPSVP

SEQ ID NO: 130504 - protein, 177 aa, Triticum aestivum
  Clone ID: PAT_TA_24922.pep
VDRVLQGRLPKFEDVKELKYLMRCINESMRLYPHPPVLIRRALVDDVLPGNYKVKTGQDVMISVYNIHRSPEVWDRADEFIPERFDLEGPIPNESNTDFRFIPFSGGPRKCVGDQFALLEAIVALAIVIQKMDIQLVADQKISMTTGATIHTTNGLYMNVSLRKVEQEADLALSPSG

SEQ ID NO: 130505 - protein, 67 aa, Triticum aestivum
  Clone ID: PAT_TA_24923.pep
SSHLLFAPNVRPTSPLWQQAHVVITLSYALKFLENSSPLMNHLVERIFLYFKIDFRSGTYVKPPPPS

SEQ ID NO: 130506 - protein, 92 aa, Triticum aestivum
  Clone ID: PAT_TA_24924.pep
SAFGRRNRRYIGFCCCQAISQKIRLFNLDLERMHRRFLNVIVQDLSTRINSLYLVDLWKHLFCRSTGKAQAAEDAKLGEEKSSSVDRSLEVA

SEQ ID NO: 130507 - protein, 245 aa, Triticum aestivum
  unsure (1)..(245): unsure at all Xaa locations
  Clone ID: PAT_TA_24925.pep
EXEVLPQTWRSSGEWCPRXTIPVRRTLEGDLLRASSVRRFGMKPRSAAARRDSTSNGHEHAVGYVSGGQFYGAKASLNVWPAQVSSPAEFSLSQIWVISGSFGNDLNTIEAGWQVSPELYGDNSPRFFTYWTNDAYQETGCYNLHCAGFVQTNGRVVIGAAITPVSAYGGRQFDITLMIWKDPKKGNWWLQLGPSGALVGYWPSSLFSPLGAHANMVQFGGEVVNTRPSGSHTPTQMGSGHFPRE

SEQ ID NO: 130508 - protein, 499 aa, Triticum aestivum
  unsure (1)..(499): unsure at all Xaa locations
  Clone ID: PAT_TA_24926.pep
ERADPSVVVVVLLRLPGVLDAVRAPDLPVRRPGPALAAALRGLHRLRRRAPGGPLGVPPPLHRRRRPAPGRLLRPPPRLPRRPAPRLRPPAPTIATTGCTPRRPTHQPSMHMFDPLGAPPFLRRRHPRLEVDPLPCKSRKRVEXTTKVQGXPVFRAGANPAAWMLDVTSTQMEQILGVDFAEYYRQSKLFLQXKEIVEALSKPNSEVKELTFSTKYAQPFCAQFIACLWKQNLSYWRNPQYTAVRFFYTVIISLMFGTTRPKFGSTRETQHDIFNAMGAMYAAVLFIGITNATSVQPVISIERFVSYRERAAGMYSALPFAFSLVTVEFPYILVQSLVYGTIFYSLGSFEWTAVKFLWFLFFMYFTLLYFTFYGMMTTAITPNHMVAPIIAAPFYTLWNLFCGFMIPRKLIPVWWRWYYWANPVSWTLYGLLTSQFGDLDQPLLLADGIRTTTVVAFLEEHFGFRHDFLGVVATMVVGFCVLFAVVFALAIRNLNFQRR

SEQ ID NO: 130509 - protein, 173 aa, Triticum aestivum
  unsure (1)..(173): unsure at all Xaa locations
  Clone ID: PAT_TA_24927.pep
XAILPRQGXKENPNSSRLVSAPNLRDRIKRRRSRGRTRTPGGLRFGLEEVASVRPQGTVGNPESYLSPAQIRAGLVNRPNWGRDTSIPPRSPRLSPEFQGSRRLPAARVGDWVPAIGGKAGRGLRVRLGAERLRIWCLGCDSVPFGGCLVWWRGRPAVFNLKGREAEKESRKP

SEQ ID NO: 130510 - protein, 158 aa, Triticum aestivum
  Clone ID: PAT_TA_24928.pep
PPHLSATSLPDHAALVPSLPDHSPEHPPPPRRPFATSPAAPWRSSIEQRRRFQEIQPEKRRCFQELLARAASLFPEAPSRHVFVLSPKSADYILSPEQMPLLRSFTRAVPRRLHPGLLYFLTPTLQQVLSQACKFCHEEEIVRMLQNFYYMIVVGPVN

SEQ ID NO: 130511 - protein, 479 aa, Triticum aestivum
  Clone ID: PAT_TA_24929.pep
MDQYEVLEQIGKGAFGSALLVRHKVEKKKYVLKKIRLARQTDRTRRSAHQEMQLIATVRNPFIVEYKDSWVEKGCYVCIVIGYCQGGDMSEAIKRTNGTYFSEEKLCKWLVQLLMALDYLHTNHILHRDVKCSNIFIARDQTIRLGDFGLAKILTSDDLASSVVGTPSYMCPELLADIPYGSKSDIWSLGCCIYEMTALRPAFKAFDMQALINKITKSIVSPLPTKYSGPFRGLIKSMLRKSPEHRPSAGELLKHPQLQPYVFQVQLKSSPTRNIHPINESLTDKVKKMTVPDDVPDSARRRMVRRNSLGSHRIVTFSKPSPERNSVSSTRSIKEYTTTQSCKELSIDSSQAEDDEVTSKAMITKTSSILRTPKSNPVKTFTSRNRLETPKTSYNRTNRAEPPSVTPVNKSARLARRVSLPLSTYETPIKRSISILDQLGSPDVSMNAPRIDRIAEFPLASSEDPFHSIHKLSSAHGSC

SEQ ID NO: 130512 - protein, 128 aa, Triticum aestivum
  unsure (1)..(128): unsure at all Xaa locations
  Clone ID: PAT_TA_24930.pep
EVAAMVRETITSIDYDEYTQELVDWVEEHKTERLMEKGVIGLGTPTLNQTVFASFPLDTDFGFGHAVLAMPMCDYGRLSSGYLSIGARPGGDGSWLVNAYIWPRLAAALESDQXRIFKPLTAEYLGLV

SEQ ID NO: 130513 - protein, 87 aa, Triticum aestivum
  unsure (1)..(87): unsure at all Xaa locations
  Clone ID: PAT_TA_24931.pep
PRPFTALEVRQRQATGSASLFAWLGLGPVTLFQGLALAAXRGLCPRRRDSFLVKDLYPSFTPAVLLFLGGTSGDGPVRYFEGEKSKG

SEQ ID NO: 130514 - protein, 144 aa, Triticum aestivum
  unsure (1)..(144): unsure at all Xaa locations
  Clone ID: PAT_TA_24932.pep
RTSTSTSARPRGAARSAPPTPRPAPTSTSSTASTPAPPPMPPVPPPPPATTPAPKPPPTPXPAPTTRPTRRAPSCSTPWSSTPPTPTTARRRGSQTTAAMQTPRTTARATPTWAGRRGERARSMTTRLARAMGTTTTMRTIIRA

SEQ ID NO: 130515 - protein, 79 aa, Triticum aestivum
  Clone ID: PAT_TA_24933.pep
MAAVSTKSIALLAAVVLVALVASAAGRIVEREEEFFLGSLAPSLAPAPAPAAVVGAAGAVAPGAWAVAAVVSLLAFLAH

SEQ ID NO: 130516 - protein, 79 aa, Triticum aestivum
  Clone ID: PAT_TA_24934.pep
MAAVSTKSIALLAAVVLVALVASAAGRIVEREEEFFLGSLAPSLAPAPAPAAVVGAAGAVAPGAWAVAAVVSFLAFLAH

SEQ ID NO: 130517 - protein, 349 aa, Triticum aestivum
  unsure (1)..(349): unsure at all Xaa locations
  Clone ID: PAT_TA_24935.pep
MGRIPSLKNFNAFPHAEDHLLKKTYSGAIVTILGLIVMVTLFAHELTFYLTTYTMHQMSVDLKRGETLPIHINVSFPSLPCEVLSVDAIDMSGKHEVDLHTNIWKLRLDKYGHIIGTEYLSDLGEKEHGTHDHDHGXSRRRRLVKCEVTQIVDANKVMKPGELAMGYCECVRLCSXVSSVGLLDNYHLSELGLNILVADQIFDGSSHVNVSHVIHXTSFGPEYPGIHNPLDDTSRILHDTSGTFKYYIKVVPTEYRYLSKGVLPTNQFSVTEYFVPIRPTDRSWPAVYFLYDLSPITVTIREERRNFLHFITRLCAVLGGTFAMTGMLDRWMYRIIESISSSKPRSGMR

SEQ ID NO: 130518 - protein, 223 aa, Triticum aestivum
  Clone ID: PAT_TA_24936.pep
WCVAFCYAVCGIIFTLQFPALYQQGPNNLFFDWYRILGWMANGLYSSLAIFFLNICIFYDQAIRSGGQTADMASVGTTMFSCIIWAVNIQIALTMSHFTWIQHLFVWGSIGTWYVFIITYGMALKSRDNFQIMTEVLGPAPIYWAATLLVTAACNIPYLIHISYQRSCNPLDHHVIQEIKYLRKDVEDETMWKRERSKARQRTKIGFTARVDAKIKQLKGEVA

SEQ ID NO: 130519 - protein, 110 aa, Triticum aestivum
  Clone ID: PAT_TA_24937.pep
LNRGPQVNRTVLLGLTSGVTSVESRAELPKLCPCADAGSNNVISRSAAYQQKHLCCPCQAQVHLPWTKSFHKQKADAQDYSPDKNSICYQHDLGPIRVGCLVVPRRLSVA

SEQ ID NO: 130520 - protein, 179 aa, Triticum aestivum
  Clone ID: PAT_TA_24938.pep
GSPHTLARDGGTKEGRGGGSSTAAAAAPWREAEARRRHGRACDGWRRRGSPPRGRSPVGEWGSRPPWDLAAVGGVDGVDAAHGGELVPDLLRAADPAGAAVAARSSAHAWGGSGDALGAAQLQSAGGRPGSARRQRWRRGAAGRRHVRRRVYDVRLGLPVRPRLRVQHPPGGAEQGRRG

SEQ ID NO: 130521 - protein, 173 aa, Triticum aestivum
  Clone ID: PAT_TA_24939.pep
MSRSVEPLIVGRVIGEVLDTFNPCVKMVTTYNSNKLVFNGHELYPSAVVSKPRVEVQGGDLRSMFTLVMTDPDVPGPSDPYLREHLHWIVTDIPGTTDASFGREVISYESPKPNIGIHRFIFVLFKQKRRQTVTVPSFRDHFNTRQFAAENDLGLPVAAVYFNCQRETAARRR

SEQ ID NO: 130522 - protein, 80 aa, Triticum aestivum
  unsure (1)..(80): unsure at all Xaa locations
  Clone ID: PAT_TA_24940.pep
SEEQTIQDYQXDYNXYLERNLEARERELARAEELEEKXPKVKAKSKMSXAEKLARKKQKVQAFQQSKQKSKSMKNSKRWN

SEQ ID NO: 130523 - protein, 293 aa, Triticum aestivum
  unsure (1)..(293): unsure at all Xaa locations
  Clone ID: PAT_TA_24941.pep
DADHPPPRYQWNTSYPERGGSGRTVWARYSRKCGFGDKILCHSANLLVXRGEKIAIIGPNGCGKSTLLKLALGMEKPQEGEVILGEHNVLPNYFEQNQAEALDLEKTVLHTVAEAAEDWKIDDIKGLLGRCNFRXDMLNRKVRFLSGGEKARLSFCKFMVTPSTLLILDEPTNHLDIPSKEMLEEAISEYMGTVITVSHDRYFVKQIVNRVIEVKDQTIQDYQGDYNYYLERNLEAGERELARAEELEEKAPKVKAKSKMSKAEKLARKKQKVQAFQQSKQKSKSMKNSKRWN

SEQ ID NO: 130524 - protein, 41 aa, Triticum aestivum
  Clone ID: PAT_TA_24942.pep
ISRTKLQVSYFPCNLKVYKSSTIEGLQKFNKIMILMFSKAS

SEQ ID NO: 130525 - protein, 114 aa, Triticum aestivum
  Clone ID: PAT_TA_24943.pep
MGNAGSAGSPEQAKKPEQADGGGGGGAPPSTVRFFPAAAQHTARQPPPIKLEGEDLPPPPAEGVEEDMAAPRNLWQVYALGAFLVARWGWAKWQESKDRDDSADGQLPPPAASS

SEQ ID NO: 130526 - protein, 150 aa, Triticum aestivum
  Clone ID: PAT_TA_24944.pep
MGSDTETEKKKTPVALAPIAKPLAGKKLSKKTLKLVRRASEAKCLKRGVKEVVKSIRRGSKGLCVIAGNISPIDVITHLPILCEEANVPYIYVASKEELATAGTTKRPTCCVLVMTKPAKGEITEEVKEKLESEYKQVVSEVAEATSALF

SEQ ID NO: 130527 - protein, 214 aa, Triticum aestivum
  Clone ID: PAT_TA_24945.pep
VVVVVGRERALLSCGHDGSPEPGALRGRQRRRGRRPAPAPAVPARPPRRLRPPGRPRLPARQAGRARPAPGRRLRLPPQRPPPPGGPRGPPLPGALLLQPAPAAAPAPSPAAAPPRAAGLPPVGAPAAAPARAAVPRRARRVAPRPAGPRARRLGDASPGGRLQPRVRERELLEEAAPDQVQPGSKKEMRRLPPRSKGWRIKPRTGAKRLRPNG

SEQ ID NO: 130528 - protein, 76 aa, Triticum aestivum
  unsure (1)..(76): unsure at all Xaa locations
  Clone ID: PAT_TA_24946.pep
TSEKIRLLTSSGDRCSSHILHQLTTHSSKHTVGGPINHPTINNTEIFVRIQXEELYMDIKETYGLLTTLRYRSLYK

SEQ ID NO: 130529 - protein, 164 aa, Triticum aestivum
  unsure (1)..(164): unsure at all Xaa locations
  Clone ID: PAT_TA_24947.pep
GNLRSKRSQGSLVLLLKMQIFVKTLTGKTITLEVESSDTIDNVKAKIQDKEGIPPDQQRLIFAGKQPEDGRTLADYNIQKXSTLHLVLRSVXGMQILXSKTLTGQDITSRLIPPDTSDNVKXRFKDKEGXPPDNSSHPFWEQLQGLAHLPDYNIQKESPPTGLK

SEQ ID NO: 130530 - protein, 690 aa, Triticum aestivum
  unsure (1)..(690): unsure at all Xaa locations
  Clone ID: PAT_TA_24948.pep
RIFRGESLDTDRQFASSGSHATLFGFSRLLVLCSIVLPGLHARGACFSPTPPPRPSSAASSCTSPRAGFFSRPPTPGTKGRGPGRSGSVRCTPEVADASVQAPRPRAPKTRVPGVRGGIGGLTMARAASRKGFQVLVLERDMSAVRGEGQYRGPIQLQSNALAVLAAVDIPEPDFXIASDRINTLQFYENELRXSFSFCIYIYSYCSSXDLNLIHIHTKSSSHXMVATDYELIFHEXHVMLYICTPSSLLKLRCCNXYFWTSLLIECQIFYRRKSKIFHGNYSXVMMPNFISDQSTPFACAVFYQDVDMLFLGHKQYFVSSDVGGGKMQWYAFHKEPAGGTDPENGKKKRLLEIFSGWCDNVIDLLNATEEEAILRRDIYDRPPTINWGKGRVTLLGDSVHAMQPNLGQGGCMAIEDGYQLAVELEKAWEESVKSRTPVDVISSLRSYEKERKLRVAIIHGLARMAAIMATTYRPYLGVGLGPLSFLTKLRIPHPGRVGGRFFIKVGMPLMLSWILGGNSSKLEGRPLSCRLSDKASNQLGRWFEDDDALEQAMGGEWYLFPMSSGDDSALQPIRLIRDEQRTLSIGSKPDPSNSDSSLSFPLPQVSEIHATITCKNKGFYLTDLGSEHGTWFNDNEGRRYRLPPNFPVRFHPSDAIEFGSDKKAMFRVKVLSTLPYDSARGGGEVLQAA

SEQ ID NO: 130531 - protein, 160 aa, Triticum aestivum
  unsure (1)..(160): unsure at all Xaa locations
  Clone ID: PAT_TA_24949.pep
LKRQAEMMASFWPLCALVVLLAAVGSVSIASASVADAGSSSLNSSLLASAAPPPTAVLPRKVLRPAGVGADVPHRVSLGCPGPDDFPSERAPGTTLPSGAPSYTVDIINRCSGAGREACAISGIRVRCGWFSSVTLVEPNKFRRGGARRLPRQRRXAALG

SEQ ID NO: 130532 - protein, 165 aa, Triticum aestivum
  unsure (1)..(165): unsure at all Xaa locations
  Clone ID: PAT_TA_24950.pep
QNRYRESEXFTTLKEEECPXTRPHETXESQATGTRQKFPFVIFXMSSPRPPPCXCTGGAGGRRQDPAAGRTGQVWIDIRYLRTGIAGVQPPAAGAGQGRGRRRGGGPRKRAREVPTGEVELGHRRRAAGGAAARQCIHGLPHRCRRDGRYIGSQLGELFFECHRQ

SEQ ID NO: 130533 - protein, 127 aa, Triticum aestivum
  Clone ID: PAT_TA_24951.pep
PKPYSGRSGAEAAAAEVREMSRAVRIRGDELETTEREAKRRSVAEEGEGTALHSTSPRSPGELAVRTSHPEIHLAIFEPNKAQSEAKQDRVYDVVESVAEESSDPPSPPIYQPYIPDELVDDLGRTR

SEQ ID NO: 130534 - protein, 198 aa, Triticum aestivum
  Clone ID: PAT_TA_24952.pep
RPGFGGGAPSPAPSSDPGSQADLSPAPAPSGLPEYDVGLIAVYMSINVTYPNLKPHLHELAELLAKELEIDSSQVRLMNVTGQGNSTLIRWDIFPAGSSNSMSNATAMGIIYRLTQHHVQLPEHLGSYQLLEWNVQQPVSRRSWLQEHVVSILVGVLLVVFLSLSAFLGLYLWRKKFRGQAAYRPVGSVGPEQELQPL

SEQ ID NO: 130535 - protein, 107 aa, Triticum aestivum
  unsure (1)..(107): unsure at all Xaa locations
  Clone ID: PAT_TA_24953.pep
MGKGTRALSAVGVLVATIMDYAGVMSASLLLQLLSNTNRATDIYWVLPFCDRDRIVGAPWYDHGLPGLTYAFSGGARGPGIPPPFGALVMAAGEIXIIQLXPGLINE

SEQ ID NO: 130536 - protein, 96 aa, Triticum aestivum
  Clone ID: PAT_TA_24954.pep
KRDNASLKQELKESLGKNKLLSKGWDGSLSTEQTIVSNLNHLVNSSLSPGSTPDDLELNNVLLNVEANCEYLQQYPPGPPARLQETGVYILMARSS

SEQ ID NO: 130537 - protein, 157 aa, Triticum aestivum
  Clone ID: PAT_TA_24955.pep
LPDLLARFSDKGLDARALTALSGAHTVGWARCTTFRTHIYNDTGNAAVDPAFATQIRAKACPSAGGDGNLAPLELRAPAAFDNGYFQDLVARRVLLRSDQELYGSGVGDGSTDALVRAYAANATLFAVDFAAAMVRMGNLALTGKNGEVRLNCRRVN

SEQ ID NO: 130538 - protein, 103 aa, Triticum aestivum; identical to SEQ ID NO: 107316
  Clone ID: PAT_TA_24956.pep

SEQ ID NO: 130539 - protein, 72 aa, Triticum aestivum
  Clone ID: PAT_TA_24957.pep
AVGPQARDGGRATATPASAPRRRLPATAPTLLPGTAPPPVARLPPTPGPPSSQTAGSPRLPPPRCSGQPVLL

SEQ ID NO: 130540 - protein, 150 aa, Triticum aestivum
  unsure (1)..(150): unsure at all Xaa locations
  Clone ID: PAT_TA_24958.pep
MEWPQRVSSRRASHHVDDSAAGNGPAGATAGPRKAARGRPPPAGGPPEGPPAGRGGGPRRGAPEEPPGVSXPPSAGAAPPPPXPASVCDWKSAGLLGGGNKPDHGHHQAQDEAGLRHHEHLPQRRLIATGHWSLFLFLFLSRQCYPDGAS

SEQ ID NO: 130541 - protein, 207 aa, Triticum aestivum
  Clone ID: PAT_TA_24959.pep
METEGAAPPPKNPPRRPRRRDLNALDPYLEESDGQDIGIPEVGMVFNNHMEVNRFYRRYARRVGFGVSVRRSSFSQEGTCLYLELMCCKGGRPRYEPKFRKRASSTTNCPARIRVKLWGDKLLHVELANLDHNHPVSPAMARFLNSYKQLSGPAKRRLRMGGPGAMPVEEPSKMPVDKLGALEELLFGESKNHSFVERGRLKLQPGD

SEQ ID NO: 130542 - protein, 161 aa, Triticum aestivum
  unsure (1)..(161): unsure at all Xaa locations
  Clone ID: PAT_TA_24960.pep
RRGPPPPSPRPPRRPPPAPPAPPATRPXATPPAPPPRPSSPPPPPPPSRSPSPPLPPTAPPASLSPPGPXPPPPVPPAPLPHPPARRPPVPLVPPXPPGARVLAAPAASAAQPPGRPIPPPPRAWRRLVLCGRPLALLLPTRGRRVLLTSACWFAIKNPRW

SEQ ID NO: 130543 - protein, 100 aa, Triticum aestivum
  Clone ID: PAT_TA_24961.pep
ECFSCVFLHFRLNFTLHPRRSASLAPPPLAARSVSPSSPACRHVRRWTWLLDGVKLASEHRQLHCTLQKKNSRKFRIRKIRSSRRTKALPSLVCLQTARL

SEQ ID NO: 130544 - protein, 102 aa, Triticum aestivum
  Clone ID: PAT_TA_24962.pep
FITFYIKNPCFSAKQRFLFMVNLHMLHTKPQTSLDLEGALAHIFTLDADCGWVPFQPAKNCQSRRSRYSSTVVYLRSGYSSVASTPKDGSISKLAWSPLTKM

SEQ ID NO: 130545 - protein, 126 aa, Triticum aestivum
  unsure (1)..(126): unsure at all Xaa locations
  Clone ID: PAT_TA_24963.pep
PHAKFKLQTKPHSLLLPDPSTMSGRGEGGKGLGKGRGQAAPGRSSRDNTQGITNPGIREXARRGGVXRIPGLLHEEPRGVXSIFLKNIIHDAVTYADPARRNTVXQARTLVYPLQRQRRPLYGFVG

SEQ ID NO: 130546 - protein, 401 aa, Triticum aestivum
  Clone ID: PAT_TA_24964.pep
MASVAPEVEKKEEEEQVVNPWEVSAGKGGIDYDKLVDQFGCQRLDAPLIDRIARLTGRPPHRFLRRGLFFAHRDLNEILDIYEKGDKFYLYTGRGPSSEALHLGHLVPFMFTKYLQDAFKVPLVIQLTDDEKFLWKNLTVEESKRLARENAKDIIACGFDVERTFIFSDFNFVGGAFYENMVKVARCVTYNKVVGIFGFTPEDHIGKISFPPVQAGTSFPSSFPKHFSGNDQLRCLIPCAIDQDPYFRMTRDVAPRIGYQKPALIESRFFPALQGENTKMSASDPNSAIYVTDSTKDIKTKVNKYAFSGGQDSVELHRKLGANLEVDVSIKYLNFFLEDDDELERIKKAYKEGRMLTGEVKQLLVTVLSEMVERHKRARARVTEEMVDAFMAVRPLPNMFG

SEQ ID NO: 130547 - protein, 191 aa, Triticum aestivum
  Clone ID: PAT_TA_24965.pep
MDDLVSSSSLKSVLSCSEAEAQPEESSWTDYFVDFMMSEEEEKRQGASYCTFDQDDEEEGSMISDAASLAPAALADRYKGLKKLKKKVFKALDHDDSLEDTASSPVNSPKVSALSQLEFSPKIRCNVTDLAKGAGIGNYYGRDGIDCEDADAVMEGVRFLDQSQRGITPCAELKDKGLCLVPLSMLLNYQG

SEQ ID NO: 130548 - protein, 144 aa, Triticum aestivum
  Clone ID: PAT_TA_24966.pep
LEIYISFGQTLDKCQLGDIVRQSPKKLDSTVVENGENWSVGQRQLFCLGRVLLKRSNVLVLDEATASVDSSTDAIIQQTLREEFGDCTVLTVAHRIHTVIDSDLILVFSEGRIIEYDTPSRLLEDENSEFSRLIKEYSRRSKGF

SEQ ID NO: 130549 - protein, 86 aa, Triticum aestivum
  unsure (1)..(86): unsure at all Xaa locations
  Clone ID: PAT_TA_24967.pep
IFAVLAAVVTLLVIAPPSPAPAPPASGARPAPPSPAPALPPRPRRPPAXRPPPGRPPPDRPVPPGPHPAVLLGAAPPGGPLPPPRF

SEQ ID NO: 130550 - protein, 205 aa, Triticum aestivum
  unsure (1)..(205): unsure at all Xaa locations
  Clone ID: PAT_TA_24968.pep
MRHELQETLEKAMCSYTATTHLSPACIRRRRRATSTRHPSTAAAAPSATALAGAALPLPFSARPQPARFSAVALPRTAPPPPALRLRSVRRLAAAEGGGXAGMKETLDKVVSAHKVVLFMKGTKDFPQCGFSHTVVQILRSLDVPFETLDVLANDALRQGLKDYSSWPTFPQLYIDGEFFGGCDITLEAYKSGELQETLEKAMCS

SEQ ID NO: 130551 - protein, 136 aa, Triticum aestivum
  unsure (1)..(136): unsure at all Xaa locations
  Clone ID: PAT_TA_24969.pep
PALCEILSLYKASNRSSAPELLDDHLEAVLVNVRLVYLLRRAXWDSTPNWEDVLSLGEQQNLGMARLFFHHPKFGILDECTNATSVDVEEHLYRLATNMGITVITSSQRPALIPFHSVELKLIDGEGNWELCEIQH

SEQ ID NO: 130552 - protein, 79 aa, Triticum aestivum
  Clone ID: PAT_TA_24970.pep
SGLFNTGGLMKEKVLFCSSEVGRTSFVRQLESDFHIDASLEIISQLSRFIRCQLFVSSMEGGQLAANVFNSPSLEEFFS

SEQ ID NO: 130553 - protein, 395 aa, Triticum aestivum
  unsure (1)..(395): unsure at all Xaa locations
  Clone ID: PAT_TA_24971.pep
RQELVGRASVGLQGCAEVKTSCHQCRRSVNAVWCTSCDRRGYCGGCISRWYSDIAIDDIQKVCPACRGXCNCKFCLQGDNLIKARVQEISVVDKLKYLHSILGXFLPVLKQIYPDQCFEIGVETRAYGPKMDIIRAXMNSDEQMCCDFRMLPGFHHPPHCPWSFPALRLDASRDFWRSPTYGPCGEYAGSVNDKLFPQPIDANDIGIRSLFPTWRVNNDGSITCGPHEAGGCGSSKLVLRRIFKINWIGKLVKSSQEMVNGCKAHDLENGCSSCNDSSKIGLNCDGIDGNSVYSSVLENLKYEGIVHFRKHWINGEPVIVRNAFEPSLSSSWDPLSIWRGIQEIMDEKMDENAIVKAVDCSNQSEVHIKLNQFIKGYSDGHKGEDGKLMMLKLKD

SEQ ID NO: 130554 - protein, 196 aa, Triticum aestivum
  Clone ID: PAT_TA_24972.pep
MVCIRQATIDDLLAMQACNLMCLPENYQMKYYFYHMLSWPQLLFVAEDYGGRIVGYVLAKMEEDPSEPCHGHITSLAVLRSHRKLGLATKLMSAAQAAMDQVFGAEYVSLHVRRSNRAAFNLYTSTLGYQIHDIEAKYYADGEDAYDMRKMLRQPVPKKHHHHHHAGGGCCSHDAPAAAAAGSSPTSASPEKKADS

SEQ ID NO: 130555 - protein, 202 aa, Triticum aestivum
  unsure (1)..(202): unsure at all Xaa locations
  Clone ID: PAT_TA_24973.pep
MVCIRQATIDDLLAMQACNLMCPPENYQMTYYFYHMLSXWPQLLFGQPEDXTAGRIVRLRAGEAVEGGTPLGAYVHAHITSLAALPSHXRKLRLAPKLMSAAPSPPWHQVFXAEYVSAPTSAAPTRAAFNLXYTSTLGYQIHDIEAHYYADGEDAYDMRKMLRQPVPKKHHHHHHAAGGRCSHDAPAAAAAGSSPASASPEK

SEQ ID NO: 130556 - protein, 127 aa, Triticum aestivum
  unsure (1)..(127): unsure at all Xaa locations
  Clone ID: PAT_TA_24974.pep
MRAATTPSRRVRATPPPVRPKIEQVFTPAKTHRHRRQPPATMPPTRPWPPGSTKPRPPPERAAQPPPXAAAPAFKTLTPPHPRPAAIPTKETSRKVAPFAPXATPAPRPNRPATRPPSTRLAAPGAR

SEQ ID NO: 130557 - protein, 126 aa, Triticum aestivum
  unsure (1)..(126): unsure at all Xaa locations
  Clone ID: PAT_TA_24975.pep
MAVHRPPPAMMTPDFVLRDFIQKLFMDNREQLTXLFKGITVGTDKFQVTPLSQEVLIVWGEHDQLFPVDKAYSIQRSLDGNARVEIIKKTGHAPQLEDPARFNNIMLDFLTPMAARYEMHSHYLPH

SEQ ID NO: 130558 - protein, 350 aa, Triticum aestivum
  Clone ID: PAT_TA_24976.pep
PRPADPAARRGLLAAALRPHSVTLPYPDGGSTGTCTVHYWAPAGEPRLPPLLLIHGFGPRATWQWRCQVGPLSRQFHVIVPDLLGFGGSSWDSPSAPPPSEATQAAALAALLDSVEGLKGKRVAVAGTSYGGFVAYWLARAAGPRRVGPVVIASSDLLKTAADDRAFLKRAGEGWSGAHELLLPAEPAAMRRLMEMAVHRPPPAMMTPDFVLRDFIQKLFMDNREQLTHLFKGITVGTDKFQVTPLSQEVLIVWGEHDQLFPVDKAYSIQRSLDGNARVEIIKKTGHAPQLEDPARFNNIMLDFLAPAAAPAEPPRPYRRPRWHAEPPATPPLAFRASLPFGPVHPAGSC

SEQ ID NO: 130559 - protein, 107 aa, Triticum aestivum
  Clone ID: PAT_TA_24977.pep
CIEILSLQIEPKSDVRLYIDKVSQHPNSLSFHRANVINSAIPEISSPGNASTTPKRHCPLDFRVPLVHHLPPANNTSTSTSSNKWHFSIVFLHQSPTPKSPVGYPRL

SEQ ID NO: 130560 - protein, 137 aa, Triticum aestivum
  unsure (1)..(137): unsure at all Xaa locations
  Clone ID: PAT_TA_24978.pep
ASTHPXSNGAAVLNTTSPVTPVNPTYGSPPGGSYNSPPGPGGYYNSPPIYGSMSPPDYGGKHQRRHGNDARQQVHDGRDNVADMPPRHDDVPRPAQVRSEVHMVLIRAQNALGCQNELKRIQMNRHQFASKKTEEAP

SEQ ID NO: 130561 - protein, 331 aa, Triticum aestivum
  unsure (1)..(331): unsure at all Xaa locations
  Clone ID: PAT_TA_24979.pep
PRVRSHGTSRASQVVCDARRVTGSLTPAGRERTGRSIHPGRRRRRRRRLQKHEPSIARPQNIPRPFRFRPPLLLPSSNKKASQSPTPPPLPPINQTARRRRRRAXRPTTTRRPNRPTXPTPPESSSFYVNQPNPVQQPFNCPPXRSARLMFSVSSDLTSPPRPAASGLLGGQNPRLPIPGVQRNKGPFIQAIPASVKFAMGGCVGKGRSIVEEKLDFKGGNVHVITTKXEDWDQKIEEANKDGKIVVANFSASWCGPCRVIAPVYAEMSKTYPQLMFLTIDVDDLMDFSSTWDIRATPTFFFLKNGQQIDKLVGANKPELEKKVQALGDGS

SEQ ID NO: 130562 - protein, 234 aa, Triticum aestivum
  Clone ID: PAT_TA_24980.pep
MCPRRSDHRKEKSLGLLTQNFVKLFLTMEVETVSLDEAARLLLGERHAESNMRTKVRRLYDIANVLSSLNLIEKTQQVDSRKPAFRWLGQAKRKEGATVTVALPPPWQCFPSKRAFAADFSNFHLTRGGLVSETENKPKLMQGGSSMLKTFESQLGQGKSSGFVYGPFHPAGARKHEVDDQTVRENEMKNIQDWENLAVSFRPQYQNHALNDLFGHYVEAWKSWYLDLTRESTS

SEQ ID NO: 130563 - protein, 136 aa, Triticum aestivum; identical to SEQ ID NO: 106789
  Clone ID: PAT_TA_24981.pep

SEQ ID NO: 130564 - protein, 168 aa, Triticum aestivum
  Clone ID: PAT_TA_24982.pep
RPPPSLLERLLPSSHRSSSISLQHPPFSFFLSSSHAFHFFLFPLAMQGARAGSLAVAATTRTSSRHRHLRVNRPPPLVLPCDRHWAALRAGKPAPAGGSVGTARGSIRCNTTVTEMLLGLYVTATETPSRSFLIIQSASQLSSSLKMFHGNHADYFVFGFPHGRIRCC

SEQ ID NO: 130565 - protein, 101 aa, Triticum aestivum
  Clone ID: PAT_TA_24983.pep
KLHLVCKLHLLAAPPTPKSFFTLHNLRMCMINRLTPTGLAGRRAGVGGKNNRSFSDWQSSARNTLREARGSGSAGSLRRAWRGGGRPDGGAPATRPAGRTP

SEQ ID NO: 130566 - protein, 274 aa, Triticum aestivum
  Clone ID: PAT_TA_24984.pep
YSLAYKSSSTVVQLGGTPGLPNSPVASVDELADEVAEVLDFFVLSSVMCLGVSAGAYILTLFATKYRERVLGLILVSPLCRTPSWTEWFYNKVMSNLLYYYGMCDVVKDCLLQRYFGKRVRGGSAIPESDIMQACRSFLDQRQSMNIWRFIQTINQRHDLTESLKHLQCRTLIFVGENSQFHTEAVHMTAKLDKRYSALVEVQACGSIVTEEQPHAMLIPMEYFLMGYGLFRPSHVSSSPRSPLNPFCISPELLSPESMGVKLKPIKTRANLRV

SEQ ID NO: 130567 - protein, 263 aa, Triticum aestivum
  Clone ID: PAT_TA_24985.pep
MMRPRPFGSGVASAAAAEASVGAGCRGGWAWRPRPRARPGQRVRVRGEPGPHAAAAAAASAVHAEPHHGVRFRPFGLPRAGFGSDLEAGIEKVIYACRFMAFLGIAGSLAGSVLCFLKGCTFVMDAFVEYYLRGDGKVVLMLIEAIDMYLIGTVMFVFGTGLYELFISNMDIAKQSHDRSSLFGLFKLPERPKWLEIRSVSDLKTKLGHVIVLVLLVGISEKSKRVTITSCTDLFCFAGSIFLSSGCLYLLSKLGSTKGGSHA

SEQ ID NO: 130568 - protein, 83 aa, Triticum aestivum
  Clone ID: PAT_TA_24986.pep
QDGLRKNVHLHVLPVAWPQSIEKNVKVHLIDAFLGPVFVATRSKGALCCVVPIILGIVMVIDMANNPMRCKNFYLVTFLKNVT

SEQ ID NO: 130569 - protein, 144 aa, Triticum aestivum
  unsure (1)..(144): unsure at all Xaa locations
  Clone ID: PAT_TA_24987.pep
XRGGSDACIVGGNTVPRDDPXXLTARQARGHVPVRIVMSQTCNLPEEANSWNVHEAYTIVATQRGARRDFQKKLAMKGVEVVEFDMLNPRDVMSYCYDRGYLSVLWECGGTLSAAAISARVIHKVYAFCAPKIIGGVTAPTPVG

SEQ ID NO: 130570 - protein, 204 aa, Triticum aestivum
  unsure (1)..(204): unsure at all Xaa locations
  Clone ID: PAT_TA_24988.pep
GRPQGLPPLREPPFHVAPRPLAAAAPAERSYRRGGAVGAATPLGSSRDRRRRPQLRARAERRDAAPPGRASLRESAARRLDAWWRLLAAXAVPDIVAGQAIRVKRRRDEEQRLKAARGREKSSDEVFVCERVCTSKRMLKKVGAFSKDPIPDTCVTVCGVSELDACADACGRTVCVNQHQVPNWNDVCLKRCQSECLKLSSTVM

SEQ ID NO: 130571 - protein, 154 aa, Triticum aestivum
  unsure (1)..(154): unsure at all Xaa locations
  Clone ID: PAT_TA_24989.pep
MVVLAKGELEQIALPAAQPPLAHVRAVDLSAAPGPGRAAAARALVSACEEQGFFKVTGHGVPPXLVRAAEAAAAEFFALPQAEKEAAAGRPLGXTAATRIGVSGDLRGGIEYLMRGRHPRRXRWPRRLLSASWTLPCARAAAAPLAVPPSPLRD

SEQ ID NO: 130572 - protein, 225 aa, Triticum aestivum
  unsure (1)..(225): unsure at all Xaa locations
  Clone ID: PAT_TA_24990.pep
GTRVGVTACVLGDMSSRPNFGLNELDFVFSTLVVGSILNFVLMYMLAPTAGVSAAASAAAAAAVSSLPSHMFEPGPYSLGSRVATLVSKGTTFAVVGXFGAGLMGTAISNGLIALRKRMDPAFETPNKAPPTLLNAGTWALHMGISSNLRYQTLNGVEFLLGNVMPPPVFKVAVIALRCMNNVLGGMSFXVLLARLTGAQKSDKPASSGFRSQRRRLIEGRCHCC

SEQ ID NO: 130573 - protein, 145 aa, Triticum aestivum
  unsure (1)..(145): unsure at all Xaa locations
  Clone ID: PAT_TA_24991.pep
MRPSQALSLLVVVLLLVSSSASILEDTCKRFDGADIYDICIKFFKANKDSATTDKRGLAVIATKIASATAVDTRKRIAILKAEEKDQMIQQVLAYCDNMYSRAMGLFDKAARGILSGRLGDAVTNLSSALXIPKYCDDEFPRXKA

SEQ ID NO: 130574 - protein, 84 aa, Triticum aestivum
  unsure (1)..(84): unsure at all Xaa locations
  Clone ID: PAT_TA_24992.pep
XCPFFNANPSALLGAAXFXPAHRLTSPVTMYITQAKVPRGSGKWVALQALNVGALXVVSLLAAVGSVADIVQRLGHVTMFKTQL

SEQ ID NO: 130575 - protein, 153 aa, Triticum aestivum
  unsure (1)..(153): unsure at all Xaa locations
  Clone ID: PAT_TA_24993.pep
SKTTHIANPQGERTKRGNTTLKQTKSAACAIERNQPTKTKPRHCTVDTVKRLRASETGQRRXHHLCRGAHSKGHTRPRRMSQRLRATKHSRRASPSRPNHGTVPSTQSKGTCQPRLHKGRDTKLCWGYIRTVIRGRDCATTPVVPPAXPXGTA

SEQ ID NO: 130576 - protein, 734 aa, Triticum aestivum
  unsure (1)..(734): unsure at all Xaa locations
  Clone ID: PAT_TA_24994.pep
MGRGGIGGAVAAADLENSDSTRGFVRDVKRIVVKVGTAVVTGQNGRLAMGRLGALCEQVKELNFQGYEVILVTSGAVGVGRQRLKYRKLINSSFADLQNPQLDLDGKACAAVGQSGLMAIYDTLFSQLDVTSSQLLVTDRDFRDPSFGHQLRETVVSLLDLKVIPVFNENDAISTRRAPYEDSSGIFWDNDSLATLLAKELDADLLIMLSDVEGLYSGPPSDPQSKIIHTYINEXTGSFEKINFGEKSRVGRGGMQAKVAAAVTAASKGVPAVIASGFVTDSIIKIMRGEKIGTLFHNEANVWDCSKEVTTREMAVAAKDCSRHLQNLSSEERKKILLDIAGALDANVDLIISENEADLAAAQDSGYEKSLVARMTLKAGKITSLAESIRAIADMEDPISHTVHKDLNNKEVSFRVDVXPSGNLQIILVCRSHVLVCNAHLXNSLRHEYSSEACTLGYVDDVQSANDHINRYGSAQTDCSITTDVSAAEAFLQQVDSAAVFHNASPRFCDGTRFGLSAEVGISIVGIHARGCVGDNGLPTNLGILRRIGLDVKVDKGVVCTDMEILFVYGKENLLXNLDDLMIGLATPXGVLFGGPVPQKKVSEQAEGSDPHEDSSIACTLEFVDDVQSAIVHINRYGSXAHTDCIITTNNNXGVAFLQQLDSAAVFHNASTRXCDGTRFGLGAEVGISTGRIHARGPVGVDGLLTTRCILRGSGQVVNGDKGVVYTHKDLPLQ

SEQ ID NO: 130577 - protein, 104 aa, Triticum aestivum
  Clone ID: PAT_TA_24995.pep
GHARGARHTNSACSRRCATTMPASVSGATIGLHYGELEFPSAHLLQFILYGNGHYFCDARERDVDCIEDYYDGEQNEHGLENLDDGQMSSCSIVAGPRGCSTMT

SEQ ID NO: 130578 - protein, 337 aa, Triticum aestivum
  unsure (1)..(337): unsure at all Xaa locations
  Clone ID: PAT_TA_24996.pep
MADASSXRTDNSTVLDNDGKIYRLEQGQSGGAIMASNSSDRSDRSDKPLDQKTLRRLAQNREAARKSRLRKKSYVQQLESSKLKLAQLEQELQKARQQGIFISSSGDQTHAMSGNGAMTFDLEYTRWLEDQNKQINELRTAVNAHASDSDLRLIVDGIMAHYDEIFKVKGVAAKADVFHILSGMWKTPAERCFLWLGGFRPSELLKLLVNHLEPLTEQQMLGLTNLQQSSQQAEDALSQGMEALQQSLAETLAGSLGSSAGSSGNVANYMGQMAMAMGKLGTLENFLRQADNLRQQTLHQMQRILTIRQASRALLAIHDYFSRLRALSSLWLARPRE

SEQ ID NO: 130579 - protein, 81 aa, Triticum aestivum
  Clone ID: PAT_TA_24997.pep
TATIGGVDGVQALPAPWMNRRGRQSHWWAGPAPCRSKAQGKQGGFPFLFILRFIFIYFCFTFSYCFAISIKGKGILVQQGT

SEQ ID NO: 130580 - protein, 229 aa, Triticum aestivum
  Clone ID: PAT_TA_24998.pep
MAQLRAFADEQQQEALHGHGGDSNSNKKARAGLCGVLRERKVVELARAKRRLVEVPYTATLANAANALLAGRVSAATVAAPPGHWIGAGGSLIVESDPATGAARKHYIGMVNMLDILTHIAETGHDDDADATAVEDGGGSPPVDLDRRMSVPVSSVIGHSLEGLTLWTLHPNTSLLDCMETFSKGVHRALVPLESSADNVVAVELVESAPVYRMLTQMDVVRFLRAHGA

SEQ ID NO: 130581 - protein, 150 aa, Triticum aestivum
  Clone ID: PAT_TA_24999.pep
MVPGLDAITPPRRRLPFPLRPQKRRLEGATSPAAMVNSKEPPTEPPSSNRAIESSVGQAGGTAAEVATMSLSAHRETLSSLSSTLKTPGSHRVLRYAPVNRAGEAIAPAWAPPRKISTKVRQRLQLGPPVKLNAAPGVGKPKGQRVPCGH

SEQ ID NO: 130582 - protein, 148 aa, Triticum aestivum
  unsure (1)..(148): unsure at all Xaa locations
  Clone ID: PAT_TA_25000.pep
ALXGVGQVGCXPHELARYSPDGATCVGRIDGAIQIFNRRLVGLVDQMNTLPGAHFTYINAYNIFNDILANAAAYGFTESTAGCCGVGRNNGEVTCLPYQAPCANRDQHIFWDAFHPSEAANIIVGRRSYRAQSPNDAYPMDISTLASL

SEQ ID NO: 130583 - protein, 381 aa, Triticum aestivum
  unsure (1)..(381): unsure at all Xaa locations
  Clone ID: PAT_TA_25001.pep
LPIFVSPRKPASLAVAAGAGAVELGLLACVVAAGALALATAARGDPQVPCDFIFGGSPVDSGNNDYTTSLARANHPPYGIDFAGGPAGRLTXGLTTVDVIAQLLGFDYFIPPYAATGGDQRLNGVNFASAAAGIRAETGQQLGGRIPFAGHVQNFQTAVQTLVNILGDRDTASERLSQCIFTVGMVSNDYLXDVVPAVPGDQRQQGPAHLLGRLPPVGGGQHHRRPAVLPRPVAQRRLPDGHQHARVPLIPIHERSIQYRSVQVPFPVANKXHGKGLILFAYISLFLFSFCDEYDAMQVVTAIADXYGFTESTAGCCGVGRNNGEVTCLPYQAPCANRDQHIFWDAFHPSEAANIIVGRRSYRAQSPNDAYPMDISTLASL

SEQ ID NO: 130584 - protein, 261 aa, Triticum aestivum
  unsure (1)..(261): unsure at all Xaa locations
  Clone ID: PAT_TA_25002.pep
WVEPDIGYTAELIDCDRSYNAGCGGGLMTYAYKFVIKNGGIDTEDDYPFREADGTCNKNKLKKHVVTIDGYKEVPPSKEDLLLQAVAQQPISVGICGSARAFQLYSQGIFDGPCPTSLDHAVLIVGYGSEGGKDYWIVKNSWGERWGMKGYMHMHRNTGSSSGICGINMMASFPTKTSPNPPPLPGPGPTKCSVVTSCPEGSTCCSSWRALGFSHDYPICDTARXRCXKGNGNFSSIEGIKRKQAFSKVPSWNGLLELLDQ

SEQ ID NO: 130585 - protein, 76 aa, Triticum aestivum
  Clone ID: PAT_TA_25003.pep
IVSQHNTTRLSHSSKDYKSSLTTRLEVHSSQCLVLPHALTSEDSICSFLFHAVSIRTSRVHIPPDSSSEENVVGGT

SEQ ID NO: 130586 - protein, 195 aa, Triticum aestivum
  unsure (1)..(195): unsure at all Xaa locations
  Clone ID: PAT_TA_25004.pep
PGFPRTPPATHQPHEPQPPSPVTPRATPWAXDTSHPLPPPAAPRRSSRATAPPSPPSPPSTTXPPTAPTSQPPLRPTPEPLDRAAASRVPTPNHWILPPXPPNSSPATSPSVPATYDPLVDAHCHRPRAPAPPARSTTATISVRMEVSAREHSLGRMAGRVGKKGRSRWRVEQVGAGTSPRQGCLPASQASWPFL

SEQ ID NO: 130587 - protein, 178 aa, Triticum aestivum
  unsure (1)..(178): unsure at all Xaa locations
  Clone ID: PAT_TA_25005.pep
MAGMAALQGAMGALSVSAASTSAFWGQPARRHLLRRAVWGQXMAKTSPIEMRLKRWERKKCKPNSLPMLHKMHVRVGDTVQVIAGREKGKVGEVVRLYKHNSTVIVKDLNLKSKHKKGTEDEPGEIVMIEGPIHSSNMMLYSKEKNVTSRVXGHKILVRMAPMVRYLXETGEVIDSVG

SEQ ID NO: 130588 - protein, 148 aa, Triticum aestivum
  unsure (1)..(148): unsure at all Xaa locations
  Clone ID: PAT_TA_25006.pep
NWNHHRNSQVTPKPPFPPPPQSLLRSWRRRLRVGPAGLCCRHPTAAPTHPPPSSSPAATPPTCWASPSASRPRPPPGASTTARAPRRTTRARSECKRPQGSASRWAPRPAAAKPPXPAVHPRPPPGARXRPAGRPQGPQAVTRGAVAA

SEQ ID NO: 130589 - protein, 89 aa, Triticum aestivum
  Clone ID: PAT_TA_25007.pep
PLKNEEPQSARTPRKNIQADEPAPIGYASIYGELPKLELKKEVSDIPFIPSDRPWETIFTGSSHALPPLTKLCSVFLSSLLEKRPVTDE

SEQ ID NO: 130590 - protein, 64 aa, Triticum aestivum
  Clone ID: PAT_TA_25008.pep
RISCFLIYFMVSSTYLFLPPCTAAPVLWYCKGSHCHGTLKVFRVSNCHHSDLVSACFVIAKELV

SEQ ID NO: 130591 - protein, 107 aa, Triticum aestivum
  Clone ID: PAT_TA_25009.pep
ETESKNTEEKNNHVECEDSEVKPDETIVSGGAEVDATAPIDAQDDASAPKDAPDDHVECENSEVWPDETDGSVGAEVVATAAIEVLDDASAPKDAQDDSSVTEKPKS

SEQ ID NO: 130592 - protein, 127 aa, Triticum aestivum
  Clone ID: PAT_TA_25010.pep
PSDSTPLHRSIPAGSHKLCTAIGSDQASPVILKRLAMSAGSSAIVADTARGHYHLKIDGYSVTKFALPKGECLRSQPFSVGGRRWVIEVLPQRRPTRGPRGTFPSNLVLERTSSPGESAWRKVQVWL

SEQ ID NO: 130593 - protein, 25 aa, Triticum aestivum
  Clone ID: PAT_TA_25011.pep
LNFNLVLHTVLHHLDIVSGIDSKQN

SEQ ID NO: 130594 - protein, 321 aa, Triticum aestivum
  unsure (1)..(321): unsure at all Xaa locations
  Clone ID: PAT_TA_25012.pep
MAKRNLLLLLALMALATSMEAASATTSTRKLMFLVQPKPNLLTYHNGAVLHGEIPVSVLWYGRFTAAQKAIVSAFLLSLSSAPRASPAPSVSQWWSSIHQLYLSKAAAVGKHGAGATKAARVVLSGQVSDEACSLGKSLKLSQLPALAXRRGPAKGGIALVLTAQDVGVEGFCMSRCGRHGTVDAKSGTAYVWAGNPATQCAGQCAWPFHQPAYGPQAPPLAAPNGDVGMDGLIINVASMVAGAVTNPFGDGFYQGEREAPLEAATACPGVYGKGAYPGYAGQLLVDGATGASYNAHGAHGRKYLLPALFDPATSACSTLV

SEQ ID NO: 130595 - protein, 145 aa, Triticum aestivum
  unsure (1)..(145): unsure at all Xaa locations
  Clone ID: PAT_TA_25013.pep
DKDHVVKVADFGVARFQDQXGIMTAETGTYRWMAPEVINHQPYDNKADVFSFAIVLWELLTSKIPYDTMTPLQAALGVRQGLRPVLPEKTHPKLLDLLQRCWETIPSNRPAFSDILTELEGLLAEVQVTSGETSKQPKDISASTD

SEQ ID NO: 130596 - protein, 266 aa, Triticum aestivum
  unsure (1)..(266): unsure at all Xaa locations
  Clone ID: PAT_TA_25014.pep
LKVVFFXNSGTEANELALMIARLYTGSHDIISLRNGYHGNAAATMGATAQSNWKFNVVQTGVHHALNPDPYRGAFGSDGEKYARDIQETIDYGTTGRVAGFISEAIQGVGGIVELAPGYLPAAYDMVRKAGGLCIADYGSTGVARTGSHFWGFEGQGVIPDIVTMAKGIGNGIPIGAVVTTPEIAKVLTRRSYFNTFGGNPVSTAAGHAVLKVLEKEKLQENAFVVGSYLKEKLNALKEKHDIIGDVRGKGLLLXVELVTDRQKKT

SEQ ID NO: 130597 - protein, 478 aa, Triticum aestivum
  unsure (1)..(478): unsure at all Xaa locations
  Clone ID: PAT_TA_25015.pep
MQRLASSRRLLQAALAPGRAHSSLSAAAVAAAPENGAGAPKMPPFAYTPPPYDGPRVAEIAQKRAQFLSPSLFHFYDRPLNIVDGKMQYLFDEDGRRYLDAFGGIATVCCGHCHPDVIEAIVNQAKKIQHSTVLYLNHAIADFAEALAAKMPGDLKVVFFTNSGTEANELALMIARLYTGSHDIISLRNGYHGNAAATMGATAQANWKFNVVQTGVHHALNPDPYRGAFGSDGEKYARDIQETIDYGTTGRVAGFISEAIQGVGGILELAPGYLPAAYDMVRKAGGLXIADEIQAGGPPSGSHFGGGHGQRITHNIGSMAKXEMAQVLTRRSYFNTFGGNPVSTAAGHAVLXVLENDKLHDNPFVVEVFEKEKLNENAFVVGSYLKEKLNALKEKHDIIGDVRGKGLLLGVELVTDRQKKTPAKAEIAQVMNHMKDMGVLVGKGGFFGNVFRVTPPLCFSKEDSDFMIEVMDIALSKL

SEQ ID NO: 130598 - protein, 357 aa, Triticum aestivum
  Clone ID: PAT_TA_25016.pep
MPAAAFASAFASPPPPWAPRPPPRHASLRLPPPRSSSNNSGGGGGDKPTTSWVSPDWLTSLSRSVLGRGNDDSGIPVASAKLDDVQDLLGGALFLPLFKWFREEGPVYRLAAGPRDFVIVSDPAVAKHVLRGYGTRYEKGLVAEVSEFLFGSGFAIAEGALWTVRRRAVVPSLHKRFLSVMVDKVFCKCAERLVEKLETYALSGEPVNMEARFSQMTLDVIGLSLFAYDFDSLTSDSPVIDAVYTALKEAEARSTDLLPYWQIDLLCKIVPRQIKAEKAVNTIRNTVEELITKCKAIVDAENEQIEGEEYVNEADPSILRFLLASREEVSSLQLRDDLLSMLVAGHETTGSVLTYPI

SEQ ID NO: 130599 - protein, 161 aa, Triticum aestivum
  Clone ID: PAT_TA_25017.pep
FHGSLPAGVALPPSLRVLVLSGNDFSGEIPTSLFTPASSLDELDLSRNAFTGAIPPQVASLGALTRMELQHNRLTGSLPSMGKMRSLVHLDVSDNKLSGPLLDAPGRLPPTVLAVVARDNRLSGPFQGRGLSPLLEDARAWTSTNNAVNRRRPGRGSNPGL

SEQ ID NO: 130600 - protein, 429 aa, Triticum aestivum
  unsure (1)..(429): unsure at all Xaa locations
  Clone ID: PAT_TA_25018.pep
TSRSGRRAQAGKWQRAKYVGVSLVGKTLAIMGFGXVGSEVARRAKGLGMHVIAHDPYAPADKARAIGAELVSFEEAIAKADFISLHMPLTPATSKVFNDESFGKMKTGVRIVNVARGGVIDEDALVRALDSGKVAQAALDVFTVEPPAKDSKLVLHENVTVTPHLGASTVEAQEGVAIEIAEAVGGALRGELAATAVNAPMVPAEVLSELAPYVSLAEKLGRLAVQLVAGESGIKGVKVVYTSARDPDDLDTRLLRAMVTKGIVEPVSSTFVNLVNADYTAKQRGLRIAEERVLXDNAAAEAPLESIQVRLSHVQSRFAGAISDGGDIVVVGRVKYGVPHLTVVGAYEVDVSLEGNLILCRQVDQPGMIGKVGNILGERNVNVSFMSVGRTSRGKQAIMAIGVDEEPDKKTLEKIGAIPAVEEFVFLEL

SEQ ID NO: 130601 - protein, 133 aa, Triticum aestivum
  Clone ID: PAT_TA_25019.pep
IGCISTPERQKTSLVTYVDFPIHDLDLSSYIRDRSGQMSNHYQLYAVSNHYGSMGGGHYTAYVYNDGKKKWYDFDDRCVSGLENEDSIKTSAAYVLFYRRVHGDTSLVDTETTTIVESTDCTTSGVAAAGDDL

SEQ ID NO: 130602 - protein, 186 aa, Triticum aestivum
  Clone ID: PAT_TA_25020.pep
MSVMGEEKHNSSWVVDMEKMLADDDPQWRRMQAERWEAQSIYRVPEWLKRMNAKAYQPRLVSLGPFHHGDSNLLPMEEHKAPPRWCTSSSQAKSPLQDFISANRPTWRRSSKQAYGGGTSMANRAQPRNLHPHECSRAGCLPLPGILPPFSRFTNILSLQFKKIHSNLFNKHLLLSQKILGCVISG

SEQ ID NO: 130603 - protein, 94 aa, Triticum aestivum
  Clone ID: PAT_TA_25021.pep
MHVNLFPELPLQISNMWYLITYENSRSRFYQVRHTCINSNISSLFRGIIPKTIFKPSTGAQEVVTNQKPNESRFISSVNSSSPNVNTVEMMKQL

SEQ ID NO: 130604 - protein, 171 aa, Triticum aestivum
  Clone ID: PAT_TA_25022.pep
PAPPPPPLPSLAPPPRAAPLWRPQQEPPPADAPVSVPSPWSSQALFPLPAPLCRAYPGPRGCAAPTRWPAGARARVASPAARAGGPSQPLLLPASGLPRAFSALVPSLALLCGRAPLCRLRVADPNRGQLLRGWRLALRLQQVRTQWSPDPLWSNEISTVFVKQDRIGGSK

SEQ ID NO: 130605 - protein, 62 aa, Triticum aestivum
  Clone ID: PAT_TA_25023.pep
NSLGQADTGQGTPCTTGSSFSASPSRSNAGSGRELIQSTGRTANWQHSFIDQETTILYTKIM

SEQ ID NO: 130606 - protein, 392 aa, Triticum aestivum
  Clone ID: PAT_TA_25024.pep
VLELLKSAVAAIAIIAQISVALPANAVLYSPDTNVPRTGELALRRAIPANPSMKTIQNSLEDISYLLRIPQRKPYGSMEGDVKKAMQIATENKEAMLASMPAELKEKGSELYTTLLEGKGGLQTLLKYIKDKDNDRLSVALASSLDTIAELELLQAPGLSFLLPKQYLEYPPRPPRAVVEFTVEKGDGSTFYPTAGGEPKSAATIQVVVVAWSPPRSAGNIAKLVLDGAYDGATLKSVSQAIIVDSETGKKGYTLPLEVMPAGQFEPLYRSPLSIQDGELPVLPMSVYGSVAMSHSEDSDEYSSPTQFFFYLYDKRNSGLGGISFEEGQFSVFGYATDGRDVLSQIKAGDKIRSAKLIQGRERLVLPAAASAPAPADPAPAPADPTLAPAES

SEQ ID NO: 130607 - protein, 168 aa, Triticum aestivum
  unsure (1)..(168): unsure at all Xaa locations
  Clone ID: PAT_TA_25025.pep
TLLIDIANFEAILNAHLFEGLDGEYDIPXAANAKTVRDFDEGLTRVSFGFRSVDDYYSNSSSSDSIKNVSIPLLCIQADNDPIAPSRGIPREDIKANPNCLLIVTPEGGHLGWVAGDEAPFGCPWTDPIVMEFLEHVHNETGSTSKNSVANEPQGVPKTSVPHLSEHV

SEQ ID NO: 130608 - protein, 119 aa, Triticum aestivum
  Clone ID: PAT_TA_25026.pep
GGHPGTYLYSYSIRLSVPEACMLGGVYFSSCQLHSRHWIIRCKDTVVSDVNGEGVIGKFPLLLPGQDEFVYESCTPLNGSSGSVEGSFTFVPGRVTQPEGKPFNVTVAPFPLQVPDYIF

SEQ ID NO: 130609 - protein, 464 aa, Triticum aestivum
  Clone ID: PAT_TA_25027.pep
MASPPTGPAAPAGLESMEGLALDTIIAKAGARPAAALACASTHLRAAVAEDAVWRSFCARDLGLDAPLDPEDRPLPSFKDAYKVWSESFGMYPLPLVKRVKLFWSSLKGWISENFPEALRTLSKGASEAQIRSAEDDLGFKLPMPTKLLYRFCNGQLPFSRNHFEDVRMAPLGIIGGYVFYDHSVNVHLSSLEQMVEETKEFNLDLEEQGLPIGPNLALVASSWYHPKTFILNCSSGDLYVGTANLSAGEMMPCVPKSLIKPTDSDMPQDGLLLWLEEHLRRLQNGMIKIRPLKTSRYICLYPEASPLCSSAVTNGVKVRASAVFAPEHPYGGHPGTYLYSYSIRLSVPEACMLGGVYFSSCQLHSRHWIIRCKDTVVSDVNGEGVIGKFPLLLPGQDEFVYESCTPLNGSSGSVEGSFTFVPGRVTQPEGKPFNVTVAPFPPQVPDYFLSAIAPAPLIRGVSP

SEQ ID NO: 130610 - protein, 131 aa, Triticum aestivum
  unsure (1)..(131): unsure at all Xaa locations
  Clone ID: PAT_TA_25028.pep
QGKERKLANYFSFLYGAYEEQRAGYVLGGSCYHVYRFIAHSCRRKNHGYEGEEPHIVLSLGNAAQSIYAGKIVQHVDMLRVKAPVIHTKIINTAAARRIEGYSCDGYYTSYPSYXLKYFLQIANNDLPDGN

SEQ ID NO: 130611 - protein, 149 aa, Triticum aestivum
  unsure (1)..(149): unsure at all Xaa locations
  Clone ID: PAT_TA_25029.pep
EPATLAADPPPTRPGAAHPAAATRRRGADALHQWXAATTPGAPAAEQSTPSPTRRRQAPAPPPLSAAAPSRPRPAPCRRPXDPDPPGGRKAPPPPRLTGLRPSARAGGGEGGVEEEGGLLPAARVSPPRRPRERPGGEGGGTFPNSSSS

SEQ ID NO: 130612 - protein, 309 aa, Triticum aestivum
  Clone ID: PAT_TA_25030.pep
GRPVTFIQLNRVHAPNVNVPQSSDFVPLLKKLKFRAEHRRAFEQVFGRTVICRDLETATRVARSNSLDCITLDGDQVAKKGGMTGRPRDRRRSRLKFVKVIRDNKAEIEKKTAHLENVGKKLKDIDKKITDLITKHQQMDAERDHAKSELEQFKADIASATKQKGSLEKALAKKEKSLANIRNQIEQIQSGIAMKNDEMGTELIDQLTLEERDLLSRLNPEITRLKEKFLSCKNSRIEIETRKEELENNLSTNLMRRQKELEAIISSADSKTLPVEVEAKEQELKESKRTLDEATTVLKANVGAINAPS

SEQ ID NO: 130613 - protein, 120 aa, Triticum aestivum
  Clone ID: PAT_TA_25031.pep
FPFGTDDLDEDLPGFPGLMNTPSMISSAGTSTTGLGSIMSTRTRAAAQYFKGMMSSATSEDQPGKFSLNRILDGRTKKQAASMFFETLALKSYDYIDVHQEEAYGDISVSVRPSLSSAKL

SEQ ID NO: 130614 - protein, 129 aa, Triticum aestivum
  Clone ID: PAT_TA_25032.pep
LVPSWAPHPEGLAKEATGGFLVHCGWNSVLESLVHGVPMVAWPLFAEQRQRGVMLSGGVGVALRVPVTSGKKETSAAVREVLPGAGKGAHVRANVAALQKAAKEALLEGGAATTALDEVVRKWTCGEYC

SEQ ID NO: 130615 - protein, 182 aa, Triticum aestivum
  unsure (1)..(182): unsure at all Xaa locations
  Clone ID: PAT_TA_25033.pep
EALAMGKIVICANHPSNEFFKQFPNCRIYNNDEEFVQLTLNALAEQPTPLTDMQMYDLSWEAATDRFMEAAEMNLPTAEPRIQQASKTYFPTFLRTRKLKQSLEDASVYLHQALSGLEVXRCAFGAVPXTLQPDEQLRKDLGLGFSPKEEKARNKKLIDVTLQVRPPAPRCCAYLPCVYIIQ

SEQ ID NO: 130616 - protein, 40 aa, Triticum aestivum
  Clone ID: PAT_TA_25034.pep
TSHVGINSVLLARSVCVVSGEEVKWDSFQGFPNPGSLSYI

SEQ ID NO: 130617 - protein, 121 aa, Triticum aestivum
  Clone ID: PAT_TA_25035.pep
KIKICYPSYRGISSYRRTYPSYRGMSSLTVRGSDVNMTPSHSARCFDVNEHTFPLLDDSQLVPTLCCHQECGCLLVHTVARINSFASNPACILMWDILIISDQGPVCFLPGLLVIKALFDK

SEQ ID NO: 130618 - protein, 134 aa, Triticum aestivum
  Clone ID: PAT_TA_25036.pep
PGAAVAELVGRCARRLSRAARRLHVRRPPGSSFPSRAVVPFLGAAGGKAKRALSWPATSSSKKGREAGPTEEWGMEADDGVWRKEILMGERCQPLDFSGAIYYDAEGRRLGAPPTPRTPMRSPLPASLKLAANA

SEQ ID NO: 130619 - protein, 216 aa, Triticum aestivum
  Clone ID: PAT_TA_25037.pep
VLKHFLDRSQNFARAVGKTQMQKICTCLVVCALNLTDFMKGHIDASKLKTRLFGRLSPDDLVSRPRLRRGKRDLSPEGRRGIQQERTKRAARHEEPAHQANATPSTARVATVMRPVRHCRFLGIQSSGGAQFACKPWWPFRIVPSGYGYGLSVRLPPRAPHPGPGILGRAPGDLITSNSGIQLPNQGSLLPRPLRERSDGMRRTGSGGDEQLHPAP

SEQ ID NO: 130620 - protein, 279 aa, Triticum aestivum
  unsure (1)..(279): unsure at all Xaa locations
  Clone ID: PAT_TA_25038.pep
ACPSGDAGGAGDGYLSDGGLLQSPGKRRRAQERKKAVPWTEEEHRTFLAGLEKLGKGDWRGIXKNFVTTRTPTQVASHAQKYFLRQTNPNKKKRRSSLFDMMASDLSPAPNCPILPPTMAKFHDMVTMTNQLQNSSLEGVSSSNAANLAKQVTRDLPPPVPSFTATNVDGSLSKMNHMDCFSRVPSLFRPIPIVPEGTPPSAPATANTSALTFEANLTSCTSAFLIPRSGPSPLPPATTAKTDHPAENKDLELTVGLPSQQNITNNISSQNAVGVIQVV

SEQ ID NO: 130621 - protein, 122 aa, Triticum aestivum
  Clone ID: PAT_TA_25039.pep
PWCPLRDFRGSFASESRNNIRYGASRVPTRIGPIPIVPEGTPPSAPATANTSALTFEANLTSCTSAFLIPQSGPSPLPPATAAKTDHAAENKDLELTVGLPSQQNMTNNISSRNAVGVIQVV

SEQ ID NO: 130622 - protein, 83 aa, Triticum aestivum
  Clone ID: PAT_TA_25040.pep
YNLTYSAFASQGCLRRLCACCTCAVCMYASLCCLGLVAPMPGGDGRLLDDEEPLEDPHEQHPAAAPAVVLPRPAGPGRRPRNA

SEQ ID NO: 130623 - protein, 205 aa, Triticum aestivum
  Clone ID: PAT_TA_25041.pep
MDDFTFPTTAAAAEHAEPLFLHHHHRLPPFPHFASSPLWFPGDGVAVAPVAAVVSRRTADGMEEQEPTSSDSAAGRRSKGERGGEADEEGAVVRATGADGEDKMDKLWENFNEELEALRRAGSCPKKTAAACGLDELSDTESEAGERGRGCAPMLRASSRGGATGQYYRRSGSWVLLMRIFKRLFVVEKTAVSAAHRRHKANAAE

SEQ ID NO: 130624 - protein, 117 aa, Triticum aestivum
  Clone ID: PAT_TA_25042.pep
MPPPNLEARDYIGLGPSAAPAPASSSCSSSASGDAGPHLALRLGLPGCGSPGRDGPEDAAVDAALTLGPSPATAHASHRGRRQSAGSPTRSTAPLPGLVGGRKNKKGERRPEGGSAS

SEQ ID NO: 130625 - protein, 90 aa, Triticum aestivum
  Clone ID: PAT_TA_25043.pep
MASTCFRAAARAATAACRSAASRSMPSVGRSAARRAPLISRVPLELGCCAGMSLLPLHSAVAAARLTSRLSTASRSSSALSQEMGLSAPR

SEQ ID NO: 130626 - protein, 88 aa, Triticum aestivum
  Clone ID: PAT_TA_25044.pep
MESSGMVTSSSDSFASESYDGARCTNASVGEMIQGGDWVQEQNQGFWPESNQTFQPQDSELSGWVQGFSESESLAENFWSLEDIWKMQ

SEQ ID NO: 130627 - protein, 63 aa, Triticum aestivum
  Clone ID: PAT_TA_25045.pep
VFLIKQPISKKNGRKNMFKILSDCLRKKILMIGFPSQVLNHVVYYHEPQLMLHITQVLIIFQS

SEQ ID NO: 130628 - protein, 141 aa, Triticum aestivum
  unsure (1)..(141): unsure at all Xaa locations
  Clone ID: PAT_TA_25046.pep
DTPTSPPSAHAARPPAMSSAAPAPAPEEQPPRPVRFGIMGCASIARKLARAMLLAAPAAALAAVGSRSEAKARLFAADNGLPAAARLHGSYEGAPGRPGPFDAGYPPPPAXLAVXWATXAAAVRPKHVLFEEIQRAFLRGN

SEQ ID NO: 130629 - protein, 98 aa, Triticum aestivum
  Clone ID: PAT_TA_25047.pep
QNGSRAFDVPTEIIELYSTYFPSSWILETATGRAAAGCAAGLTRRARKTSLGSRGPRRRRRRRLNLEGARRRGGGRAGTAEAASPLGWARGETRVSIP

SEQ ID NO: 130630 - protein, 154 aa, Triticum aestivum
  unsure (1)..(154): unsure at all Xaa locations
  Clone ID: PAT_TA_25048.pep
RGRGRGTCPGGIICVGGDGVVNEVVNGLLGRDDLKEALQLPIGIVPAGSDNSLVWSVLGIRDPVSXAATALAKGGFTPIDVFAVKWIQAGVTHFGLTASYCGFVADVLQFILKTSACSLGPFPLRHXLAFLKFXLSLPQYKIRWNLSCLSTKNP

SEQ ID NO: 130631 - protein, 240 aa, Triticum aestivum
  unsure (1)..(240): unsure at all Xaa locations
  Clone ID: PAT_TA_25049.pep
QXLTCLRSLVVDGSLEWLHVVNSPPPLLRSLKLEGTLGEIPGWVGSLMHLVKLYLRGSAIKEEGKVMEILGPPPNLMHLRLGSGSYIGEKLAFKTGAFLNLKKLDICLAELREVKFEDGTSPQLAMIHIRWCNLASGIIGVNQLLKLKEISLGSYGRVAKLGMLQSEVDAHPNSPVLRLSKERSHHDPGGVVIQVGEATGESSSLHPEPAAAGESSRSQAVGMAAANISQDDVLYTYNSC

SEQ ID NO: 130632 - protein, 228 aa, Triticum aestivum
  Clone ID: PAT_TA_25050.pep
SSSSSTRVSQLGAASLAALLAAVCLLHAGGAAAAELSVDYYDCTCPDSFTSSKADAENLPGPFDGLDVLRAKFRNATLDDTTDLVALSGGHTFGRVQCQFVTGRLYNFSGTNQPDPSLNPTYRAFLSQRCPQNGDGTSLNDLDPTTPDNFDKNYFTSLEVNRGFLQSDQELKSDPGAAGTTAPIVDRFAGSQDAFFKAFANSMIKMGNIRVITDPSKGEVRKRCAFVN

SEQ ID NO: 130633 - protein, 347 aa, Triticum aestivum
  unsure (1)..(347): unsure at all Xaa locations
  Clone ID: PAT_TA_25051.pep
MHHFISLRVRRNVMSSSSSSRVSQPGAAGLLAALLAAVCLLHAGGAAAADAVRRTTTNCTCPDAYKIVXREVLVQAHQSDPRIFAXSLIRLHFHELLRATGCDRRRLLLDTFHGMEPEQAASPQAXAARGVDVVDAAKAALGVACRGXVVPCADTLPIGAEMSARLSGGPGGSVLXGRLGSFTYSKADAENLPGPFEGLEKLREGHGRXRLSKILPTSVALSGGHTFGRVHWQFXVRAGCKTSDGTNQPDPTLDATYRAFLSQRCPXNGDGTSLNDLDPXTTPDNFDKNYFTNLXVNRRFRFSPTKEPQSQPGAAGAXTTAPIGRSRFASSQAAFFSSFVTSRGTLG

SEQ ID NO: 130634 - protein, 249 aa, Triticum aestivum
  Clone ID: PAT_TA_25052.pep
QRAEDAELPRGKTGRARGRASSTPATPPLSGPDARRGDAAAPTIRPRRARASSAGGLLPPAPPPPPAAPGPPPPRPQRRAKTGPGPGRAQSGAAAGGAVGRRAVARGRGRRRARPVVLAGEDAAPDRAGAGAGDSGVGRARSLTDDDLEELKGCVDLGFGFSYNEIPELCGTLPALELCYSMSQRFLDEHQAPSKVEDLAPEPPAVVPPSPVQPIPNWKISCPGDSPDEVKARLKYWAQAVACTVKLCS

SEQ ID NO: 130635 - protein, 172 aa, Triticum aestivum
  unsure (1)..(172): unsure at all Xaa locations
  Clone ID: PAT_TA_25053.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQXQPQQPFPQDSTTQQXFPQQPQQPFPQDSTTQQHFPSPATQQLSQPNNIAQPNNATSSHHKASPHILK

SEQ ID NO: 130636 - protein, 230 aa, Triticum aestivum
  unsure (1)..(230): unsure at all Xaa locations
  Clone ID: PAT_TA_25054.pep
TYQRLKKLFAWRGLKQAVEEFVHQCAVCQHAKHEHIKPPGLLEPLPIPTEPWHDLTMDFIEGLPLSEGCEVIMVVVDRFTKYAHFVPLRHPFTAATVARAFWDSIIKLHGXPHSIASDRDPIFTSKMWRALHDAAGTKLSYSXTAYHPQXDGQSERVNQCSEMYLXCAXMTIPKQWRKWLRHGXFWXNTTFLPFAHHVPVSTDPPTGWLLGPTCRVHHFSPPLDRRALGA

SEQ ID NO: 130637 - protein, 155 aa, Triticum aestivum
  Clone ID: PAT_TA_25055.pep
VRRGGSIALALGECPWVALQRQLGDGGCLQAPCSSSFRPEERRWLPSPSAGVTAGLALGGTLDWIDACPVVQLLDARAPGGGRRRRHAGPDPPLGEAQVRPLESRPAEVVAGPRPSPHGRRASPPPADPGAKGWVVGFLAGRWMVGGLGLGSCRI

SEQ ID NO: 130638 - protein, 188 aa, Triticum aestivum
  unsure (1)..(188): unsure at all Xaa locations
  Clone ID: PAT_TA_25056.pep
TCATGTRSPRWPGFPKGTKPLLTLDNPFATNLPDNLFGDKWAFVQLPFDDCGEQVELLERRYAFGAGLDLDLLGFELAATTLVPGVAVESARATPRRQRPAARMNGIEIRSMEVDTGRANLILAAGVSTXRYVYAGYLPRAAPSQVAGPRQAAQYAGGGLHFLAIQXNLNSDSCVGFWLLLDLPPPPV

SEQ ID NO: 130639 - protein, 86 aa, Triticum aestivum
  Clone ID: PAT_TA_25057.pep
VVVYYSTVEISRYCRMVAWIRSPSSAAVKTHYRCRQQTQTWIHQSLLLSFSFRNIRNHKENLSGHCRLLSYDLIAARREGVGDVVG

SEQ ID NO: 130640 - protein, 81 aa, Triticum aestivum
  Clone ID: PAT_TA_25058.pep
FKLNNQNEACSLEMESNELNVPAKQQTVPQECEEFIGCTITNEVNIHPPNDNRSRGRINRIKGNKEKGSKKGNNNKAKVRN

SEQ ID NO: 130641 - protein, 88 aa, Triticum aestivum
  Clone ID: PAT_TA_25059.pep
NSGGDVYGERWRMAPMRAYGAVTGLICGTSPRPETASGGGLRGQQPHNGVLTEANDQTPLALSSEPSSKTKLAVPRPHAYSGLTRFLT

SEQ ID NO: 130642 - protein, 126 aa, Triticum aestivum
  Clone ID: PAT_TA_25060.pep
ICGQIYLENSSNYGRNPHASPQKSLQLDLLTDYDCYGGWSGELQRACPQGQVHSAMAEFDGVGAVVEPDESRRGGEPPAWAWRSVGDGVQTSSRRGRMEERGRRRSDQLRTRGRRRRRRRGWCSLV

SEQ ID NO: 130643 - protein, 109 aa, Triticum aestivum
  Clone ID: PAT_TA_25061.pep
MTGQQQLLLSLQNALGAGRLPTLLAKLLALVVGTVWERDGVAWRRQGKRSSLICLFVGVAGGEKKGGSHDHHDGGHETQDARALLQHRHGVQYKRAGVCLRSPTLVPNS

SEQ ID NO: 130644 - protein, 315 aa, Triticum aestivum
  unsure (1)..(315): unsure at all Xaa locations
  Clone ID: PAT_TA_25062.pep
MSFRSIVRDVRDGFGSLSRRSFEVTLASIYGLTGHHKGKTQSSSHVLDDSPSIIRESRWANLPPELIRDIIRRLEADESTWPARKHVVCFAAVCRTWREMCKEIVLSPEFCGKLTFPVSLKQPGPRDGNTMVQCFIKRNKSKSTYHLYLCLSNVVTSESGKFLLSAKRHRKTTCTEYTISMDSGNISRSKRTYIGKIRSNFLGTRFLIYDTQAPYNGAVVPPAGRTNRRFNSTKSLQKLPSVSXTSHKYXYXLNVXGXKGPRRMLASSXSIPASSXXPSGNIAXTAXQIVLNSGGIITFFIVCSSQSTQGTFNKK

SEQ ID NO: 130645 - protein, 174 aa, Triticum aestivum
  Clone ID: PAT_TA_25063.pep
KVSSILPCASRISADVALLLENEIGSRPGKRGNDAESVPGCGGGGDADEGNEAKGKEDALASSRLLDPEFKPSKLSQDQLDKFKELHKKRLQIKEKTKSKGKPKGRTGENTNVANDSKFNNKDKSIDSAAIDVQHTTSTTGAQANLAPSLPLRNKRKLHWGLDVKERWERKANM

SEQ ID NO: 130646 - protein, 173 aa, Triticum aestivum
  Clone ID: PAT_TA_25064.pep
MKVINDAVQSGERALMLAEFKLSLNSYLSELATSPVRSLSDIIDFNNKNPVEERMAEFGQSYLLRSEATNGIGPAEERAIAKLNKLCEEGLEKIMRANQLDAIVAPGASAHSLLAIGGYPAITVPAGYASNGVPFAICFGGLKGSEPMLIEIAYSFEQATKVRKPPILQHSVI

SEQ ID NO: 130647 - protein, 120 aa, Triticum aestivum
  Clone ID: PAT_TA_25065.pep
CRSSGSLYTAPECYQSSRYTDKCDVYAFGMILGVLLTGKDPADLFFSGESGRGSLARWLRHMQHSGDMKEALDSSIVGEEVDEEEMVMAVRVAIVCLSELPADRPSSDELVAMLAQLHSF

SEQ ID NO: 130648 - protein, 72 aa, Triticum aestivum
  unsure (1)..(72): unsure at all Xaa locations
  Clone ID: PAT_TA_25066.pep
MQRLCPPFVCGDVAVHVDERAICRCSCRCSCSCRREGFCRCFCRCSCRCSCSCRXRAICRCSCTCSCSCSCS

SEQ ID NO: 130649 - protein, 161 aa, Triticum aestivum
  Clone ID: PAT_TA_25067.pep
MASYDGEDDSGRRRPPQQQHRPSGGGSGDLAASAKLVAEAAKAALQDHNLGKVDKGRTAEAAADLLHAASLYGKLEGKPVGGYLNKAEDYLHKFGAKEGGGGGGKHQTSGHGGSGGRYEEEDEYRKKPTSGGGRYEQVMMSTKKKPRGGGRCGGDDEKPTG

SEQ ID NO: 130650 - protein, 92 aa, Triticum aestivum
  unsure (1)..(92): unsure at all Xaa locations
  Clone ID: PAT_TA_25068.pep
PSRFCSLLFSPAPCPRHWSSWRLARPPPSXLXAFGLLLMLGLPNCIGERKIQMYLRLVGSHIKSHHSVSMRTLASFQFTCRSERKESALPSI

SEQ ID NO: 130651 - protein, 218 aa, Triticum aestivum
  Clone ID: PAT_TA_25069.pep
MRRSSKKSSSSSAAAVPTKAVSKEIERIDQLFYTYADGSSSMIDPEGIETLCSHLEVPHTDVRILMLAWKMGCEKQGYFTLDEWRTGMKALRADSISKLKKAFPELVQEVTRSSNFQDFYPYAFRYCLTEDKKKCIEIPVACELLNLVLSLQFRPQVEKLINYLKHQNEYKVINMDQWMGFLRFCNEINFPSLDNYDADQAWPLILDNFVEWLRASEN

SEQ ID NO: 130652 - protein, 121 aa, Triticum aestivum
  Clone ID: PAT_TA_25070.pep
IGTAEAIKEAIKSAFGLRTRRAFWLEDEDEVVRSLDRDMPVGVYALHLDNGITIKLCTFEDADRMTVRTEDKTFYTEDDFRDFLSRRGWTLLREYSGYRVADTLDDLRPGAIYQGMRSLVD

SEQ ID NO: 130653 - protein, 146 aa, Triticum aestivum
  Clone ID: PAT_TA_25071.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTTTKSPKKKVAAKE

SEQ ID NO: 130654 - protein, 136 aa, Triticum aestivum
  Clone ID: PAT_TA_25072.pep
PPRPPPVLPQPRPSFGLLSRPRRGASAFPVRPQLLARAPSSPLPQLLPAPPPWSPQPRRGQAPRLRPPPARGLPPSSRPPRRRPASPPRAPPPSARPMGSGHQRWPLPSWMQENDRSGRGWLAEASATLIRECEAR

SEQ ID NO: 130655 - protein, 195 aa, Triticum aestivum
  unsure (1)..(195): unsure at all Xaa locations
  Clone ID: PAT_TA_25073.pep
MSRSNWLSKWVSSCSDHAQPAFAAVTVPLLYSSSRPAPPTPSSRPSSSASDFAARIRPVWAAYLFPETVSSSVVTLRAPISLQAPGICSADGLCPREGATSRCVVERHEAKGLVNVVLLGGGLAPVARNHGLDPLRVPVVLGDNRDNSFNSHNCAPLPXRYILGTFCGSRYWPPSKITDTRYYQPDAALYAVGMS

SEQ ID NO: 130656 - protein, 332 aa, Triticum aestivum
  unsure (1)..(332): unsure at all Xaa locations
  Clone ID: PAT_TA_25074.pep
SGRRRRLPAAHPPHRSPRPSSPPGAGCFRPAAPSIPLLLLLRRPTRHPCAPPAPPGRVSSRRAGLYGRMARDRDLRGPGFLKGAEAPGSLSRAASFPLTHADVFPSLDAAGRPARKAADPPVRAIVLYLEPVFAAEIAKSFMEVFLPHFDKAIXFQNLSMYHFSMFHASHHLQPILATKDEIEAEVDAVKGVTEAVCPLKISLDRVVLTSTGVLLGLWQVESGTDPADIRSKLREALPRAPQKQLYDPVLLHTSFARILGPPKLPQQEDTSSFSHIKFFHDLVAQVNGKIRGFQAKVSELWYVEEYDVLALALNGKMRVRRLHLGCNEGQDN

SEQ ID NO: 130657 - protein, 107 aa, Triticum aestivum
  Clone ID: PAT_TA_25075.pep
ASSTKREGIVLYFPLPSSPSPVWSGLLLLSPSLFLLSSCTLRFYICPPPTLLLQLLLGVNGELCHFRRSGDPLNWSISIVSSDDCSNFDYYRFFSPLFCNDLWVARN

SEQ ID NO: 130658 - protein, 66 aa, Triticum aestivum
  Clone ID: PAT_TA_25076.pep
DPASADLQYIKDDISSVERHRLDLYRTKERYSMRLRMLLDEPAASKMWPSPMDKPNSAFVPNSRAY

SEQ ID NO: 130659 - protein, 48 aa, Triticum aestivum
  Clone ID: PAT_TA_25077.pep
GGSNSSFSNMPKQNKILGFSSVEPLINDDVTACYGCNFSTKFIRSTSA

SEQ ID NO: 130660 - protein, 193 aa, Triticum aestivum
  unsure (1)..(193): unsure at all Xaa locations
  Clone ID: PAT_TA_25078.pep
XSMMVXXXXXXPALFQSVMVALFNDGRVQTASRVMKSMIEKGVTEDVDMAHKIVEALFMRGHVEEAIGRVNLMVENGCMPDLDKLLAALCEKDKVMEAQKLADFALDRDFEVSFSTYDRVLEALYTEEKTLPAYSMLCKIKHKGGVVDQKGCDALMDSLKAGGYSKQADILSRILVENGSSTSKRGKKSAMGA

SEQ ID NO: 130661 - protein, 154 aa, Triticum aestivum
  Clone ID: PAT_TA_25079.pep
QLPVPRVHCHKAEEHGVACVEFLAGKEGHVDYDLVPGVVYTHPEVASVGKTEEQVKASGIAYRVGKFPLMANSRAKAIDDAEGMVKVVADKETDKILGVHIMAQNAGEIIHEAVLALQYGASSEDVARICHAHPTVSEALKEACLQTHSKAIHI

SEQ ID NO: 130662 - protein, 327 aa, Triticum aestivum
  Clone ID: PAT_TA_25080.pep
GYTQPSNRGPGDPSTSGAEELTSEDEVARLLNCADHYSAFGFRLYEIIDVSVLKREYKKKAMLVHPDKNMGNDKAADAFKKLQNAYEVLLDSVKRKTYDDELRREELLNYFRRFQGASQKKGGHGTFQQGFSPSEGVDEGPSALSRRIACKKCGDFHLWIYTGRPKLQGRWCQDCKEFHQAKDGDGWVEQSFQPVLFGMLHKPDLPRAFVCAESSIFDVTEWFSCQGMRCPPNTHKPTFHVNASLAKQGSGKGSTSGPRGGVPNMDAGVDEEFFEWLQNAMQSGMFEAQGDPPSPGSGTHAKSSGGGGGGGGGGSSNRKKRKGKKQW

SEQ ID NO: 130663 - protein, 272 aa, Triticum aestivum
  Clone ID: PAT_TA_25081.pep
GGESKQWRWDPRIYRRGEARDGIWEQQGRFAAGRRRGQGAEWEAEGEEPDAPAGGSCFRGFTPECDASGGVPAPPPPLPLGVESSKGGETPSLTHIGISDEDASSAPKSNPTEVRTIPLSDTDRDQDDDVLQNVTATRTAVDDDQSPNPSDRPRPCFGVNFGLSRAVSLGSSVACSIMSTGLSSSANPSIGNMDHPSDANIPQQGGASTSGIYSSLDMLRDSVTTQARAAHQARRNLLESEDANLRHSHRRIGPQEPSEGSVRFSRTLSVGR

SEQ ID NO: 130664 - protein, 151 aa, Triticum aestivum
  unsure (1)..(151): unsure at all Xaa locations
  Clone ID: PAT_TA_25082.pep
LAASDPWLVSTSKAVAAAVVLAAVXAXMWPGREASAALSCGAGGTPKLAPCVAYVTGEGGVLRSSKGSACSRRARGAETGLGPQASPGPQKDKPCKGASKEAPATKQSKSIKHVGKGSSRALGPGKVRGRQAVPFPNQANVQTKPANKLST

SEQ ID NO: 130665 - protein, 178 aa, Triticum aestivum
  Clone ID: PAT_TA_25083.pep
AEIQSSHALCLLRWGWTIPSLHLRRRRRPAPAQRRVKLSVGKLIFGRDLRWCPTFSNLKTLLLNDWCVAIDFRALLCILEHSPVLEKLTLQLCKRQEFITVLAGNCYPLEKLPAISEHLNTVEIRCRDIDGRVCRILKFLSRFVSVTQINIKLTAQLSTCFSFETWLSASPANGDDYS

SEQ ID NO: 130666 - protein, 254 aa, Triticum aestivum
  Clone ID: PAT_TA_25084.pep
SLSSQSQSRQPWHDHPPDEQLLPWCSCGSYLSTAVTLITLSASAGSWTRALSMAVATRVLRSPWPSCTRPRQRRRVCAGTEGLCWNRVFFCWIHHFFLLQPLCFLLSSPFVFMNIFVFCGNGCSCLLQPAGVCATRLVPRQGSYIQQQGVLYPTLFECRELQSCTPELQPVTGGAAREDGHFLLMHFLLNQFFVFVGTGVFFCWNQDNFLLHRMQSSQMLMSFLLAPKLVFARSIFLILLQPTTGFRPRVKFFA

SEQ ID NO: 130667 - protein, 178 aa, Triticum aestivum
  unsure (1)..(178): unsure at all Xaa locations
  Clone ID: PAT_TA_25085.pep
DTEMYLXYLCTGRNPMLIRYCPIYWDWCHLLCYDPDVAAGPAASLRPAAXAATAPRETHAQLGCYVMKLYRNGTYAIVSRHDCSKMASCXLSCGGGDVVVADGKPLGAAPLPVTASAPQGMQLPPSSHVAGFQRCGDRAMALPLPVAAGPLLEAPRAPRSRRACPRANRRAPFRPFWG

SEQ ID NO: 130668 - protein, 133 aa, Triticum aestivum
  Clone ID: PAT_TA_25086.pep
IPAHAEATSLLLMAASSPAPSNSTDLAPLLAFKSQLSDPSATIANNWTTYASFCSWTGVSCSRRHHQRVTALELPDIPLHGELSPHLGLLKEEDRVKLQAGVKRLAHAAAALTDRSFPRDRLLLRDRDGLQIG

SEQ ID NO: 130669 - protein, 276 aa, Triticum aestivum
  Clone ID: PAT_TA_25087.pep
MATATTLSFSGGGGGTTLLRGHVALTSGRCCTFPSSRWRPPRLSASRADDSSPAPFEMTVEDALKLLGVAEGASFDEILRAKNAVLASCKDDQDAVAQVEAAYDMLLMQSLSQRRAGKVANNRIRFADVKPVKSAGAGTVPQWMQATMKNAPITFETPSSSSLGIQSCVYGALMVFTYASGSSTSLPSAYSSPDVPGFILATGFGASLYFLAKKNMNLGKAALVTVGGLAAGATVGSALENFLQVDLVPFLGIHSPAVVVSEFILFSQLLVSLFVR

SEQ ID NO: 130670 - protein, 235 aa, Triticum aestivum
  Clone ID: PAT_TA_25088.pep
PQPIVLKVDLHCAGCANKVRKAIKHAPGVESVTPDMAAGKVVVTGPADAVELKERIEARAKKPVQIVSAGAGPPKKEKDKEKEKEKKADGGEKKADKEKGGGGAGGEKKADKEKGSGEKKADKEKGGGEKKADKEKGADKPKEEKKKPKEETVTLKIRLHCDGCIERIKRRISKIKGVTHVAFDAAKDLVKVTGTMDGAALPAYLREKLSRDVEVVAPGKKDGSGGGGDKKDKGA

SEQ ID NO: 130671 - protein, 142 aa, Triticum aestivum
  unsure (1)..(142): unsure at all Xaa locations
  Clone ID: PAT_TA_25089.pep
SLGVLLLHPMNGYLEQELDRLFRFWDSPPDGGAEFLRAVVGNAGYKADAALIDALLSLENVASSVGIDRGDLTKCRERGIXLTDVLTDAVGLVISAVRKITHGDRYVRASLWKAKGDYTWRSLEENIGRARLKKSTFFFLKF

SEQ ID NO: 130672 - protein, 651 aa, Triticum aestivum
  unsure (1)..(651): unsure at all Xaa locations
  Clone ID: PAT_TA_25090.pep
MPASPEMLRRRWWAAVAVLSVVLAVSRVAANTEGDALYSLRQSLKDANNVLQSWDPTLVNPCTWFHVTCNTDNSVIRVDLGNAQLSGALVSQLGQLKNLQYLELYSNNISGTIPLELGNLTNLVSLDLYLNKFTGGIPHTLGQLLKLRFLRRNNNSLSGQIPQSLTNISTLQVLDLSNNNLSGAVPSTGSFSLFTPIRCAFSLSFGAGLLLPSLGTPFPLSPXASNPPRCGPASTRPCPGAPPAAPPPPFNPPTPPAAQGDPTSGAIAGGVAAGAALIFAVPAIGFALWRRRKPEEHFFDVPAEEDPEVHLGQLKRFSLRELQVASDNFSNKNILGRGGFGKVYKGRLTDGTLVAVKRLKEERTPGGELQFQTEVEMISMAVHRNLLRLRGFCMTPTERLLVYPYMANGSVASRLRERGPNEPALEWEKRTRIALGSARGLSYLHDHCDPKIIHRDVKAANILLDEDFEAVVGDFGLAKLMDYKDTHVTTAVRGTIGHIAPEYLSTGKSSEKTDVFGYGIMLLELITGQRAFDLARLANDDDVMLLDWVKGLLKEKKVEMLVDPDLQSVYVEHEVEALIQVALLCTQGSPMDRPKMSEVVRMLEGDGLAERWEEWQKVEVVRQEAELAPRNNDWIVDSTYNLRAVELSGPR

SEQ ID NO: 130673 - protein, 163 aa, Triticum aestivum
  unsure (1)..(163): unsure at all Xaa locations
  Clone ID: PAT_TA_25091.pep
HTLPHRLLRSNLRQHRRQAQHGSHEGCCRLTLPHDPRFLCRPDQRPFSHRSASSLSAGPTPARRACLLFRASSPLAWSNAGLPPRGYSCAPYSRARPLGGSRLRFSSSSSCSGGLLSFLPCSLLFQLLRATSDXRFPRLLEPSISCVPSNGPGFQKRCLLCHA

SEQ ID NO: 130674 - protein, 95 aa, Triticum aestivum
  Clone ID: PAT_TA_25092.pep
VRTIVQSLRESGVFTSAITAGQPAVNAKLSPKETNAQSQNVTAPGNMTRVVRSTDSKASGRKILQAVDLAFSDTNVTAVPPLSPPSLDEHRHHSE

SEQ ID NO: 130675 - protein, 265 aa, Triticum aestivum
  Clone ID: PAT_TA_25093.pep
STHASDGLNVLWIDPATGVGTGFLDAVAALSDSPEVVLLLLTLIFALVHSGMASLRETGEKIIGERAYRVLFAGISLPLALSTIVYFINHRYGGVQLWDVKGVSGVHELVWLSNFVSFLFLYPSTFNLLEVAAVDKPKLHMWETGIMRITRHPQFVGQVIWCLAHTLWIGNSVAVAASVGLIGHHAFGVWNGDRRLASRYGEAFDVLKKRTSVVPFAAIIDGRQKLPDDYYKEFIRLPYITIVALTLGAYFAHPLMQAASYRLPW

SEQ ID NO: 130676 - protein, 371 aa, Triticum aestivum
  unsure (1)..(371): unsure at all Xaa locations
  Clone ID: PAT_TA_25094.pep
KKKKWGHSVSVDLVNWFALDAALQPSRSFDANVXWSGSATILPDGSPVMLYTGIDARGDQVQNVAFPKNASDPLLVEWVKPEYNPVIPVPADIKRDDFRDPSTAWLGADGLWRIAVAARVHDVGGATLIYRSKDFLRWERNADPLYLAHAAGMVECPDLFPVSEPGVEVGLPASGAGARHVLKMSVMDTVQDYYVVGSYDDTADTFVPEDDDDCRSWRRLDYGHVYASKSFFDPXARTGACSGAGPTSPTACPTISSGDGPVFRLXPRKIWLDEDGKQLRQWPVEEIETLRSKRVNLLIPEVNAGGVNEIIGVMGAQADVEVVFEVPALEHADVLEPNWLLDRRACAAKKGASVPGSVGPFGLLVMAFRDM

SEQ ID NO: 130677 - protein, 126 aa, Triticum aestivum
  Clone ID: PAT_TA_25095.pep
RWIKAAVGDEIHANITCTDIDSNNIVQIDDLASSLEQLHLGPSYHSIDVYQPRRRPRRRTRRSRDKPAAVEGHAMAAQMNQAAGLAVGEDEQAQGTESGNQADGSYRRQQFWSGKGDKARGRARAR

SEQ ID NO: 130678 - protein, 160 aa, Triticum aestivum
  Clone ID: PAT_TA_25096.pep
VTFPFSFPASNHSQFMCLLLISCCRATHFKLRTMLPDVEDASGRRTRGRISLHHPHTKMNQSSCGLPTPLRTSPARILTATNPVQIDELGSTIAKLHSGPSQPPIGGYQLGRRPKRSTRRQTSRGRRSPWGRTRESSCRGIRWGASFERERGSGGGKRKS

SEQ ID NO: 130679 - protein, 256 aa, Triticum aestivum
  Clone ID: PAT_TA_25097.pep
VNTQSLRIFSLIDRRRMSTTEDTTHDINKEACAWYPEQREGVLSPNRKKHTAKPTKPKTKVADQMSTMSNISNSNTGTPRASKIAPSRRGTTSRRHRHPIRQAGSMVSPDARRGAQKKAMAAPSRSKTTSASVAAASIGKPSRAFAWPESEQSHIHQIRIRRCRSQHACQSLPQTEGGAAPAADKNTSFATAGMVDGVGEAAWQRADTGGRVAADAAGNSEPEGSAAPCCRRRSHQDTGEPKVLEETQQLSAGAET

SEQ ID NO: 130680 - protein, 264 aa, Triticum aestivum
  unsure (1)..(264): unsure at all Xaa locations
  Clone ID: PAT_TA_25098.pep
MGRRRAGGGGRGGGRDRGRGGEGRGGGEEEDLQLHKAARSGDAAAAESXLCESNPLALNSRDRLSRTPLHLAAWAGHVDVVKCLCKHKADVGAAAMDDTAAIHFASQKGHLEVVRELLASGASVKAKNRKGFTALHFAAQNSHLDLVKYLVRRGVDITTKTNAGQTALHVAENDDVRAFLKECEQSLKKGVELPSEKKDDSVAEKADDGKVSGEDRKDGVDAGQGEKRKSEEIGAGTRPPEVKKAKVSLSHLENDMEEEDEADE

SEQ ID NO: 130681 - protein, 155 aa, Triticum aestivum
  Clone ID: PAT_TA_25099.pep
PLLPPSRRCSLPRTHPKLSSPRHRHRRGHCRRLRVVGHPGDPRRPASSVPGISSSRRGSYARHRRLLHHVHCRRPSSIPTVPVHIRPPRRSSSAPRPRDDADDPVIDYVNRRHFFLFRQDASRGAAPASEQPRRPPLLPPSLPSPSWCPSANKSK

SEQ ID NO: 130682 - protein, 204 aa, Triticum aestivum
  Clone ID: PAT_TA_25100.pep
PAAPGLDGTRGPKISDFGLAKLYDGWQTHVSTKVAGTFGYLAPEYAMRGHMTESPNVFAFGVVVLETLAGRPNYSTEDENKVYISGSVSGLYENNHPLDMVDQRLEEFDSEEALRAIKVALLCTQGSPHQRPSMSRVVAMLTGDVEAPDVVTKPSYITEWQITGGNTTYMSTDVSGQPSSAPRANSPSSRTSSPFLSSVIDEGR

SEQ ID NO: 130683 - protein, 242 aa, Triticum aestivum
  Clone ID: PAT_TA_25101.pep
GPESRSPRVRRCRPRPPRPPPRPLAPPVPSPAGPLRLIGHGEPVQLAPARRLRDAPRPPQDSQAGGAGGSGGGGDHSPRDHQERGAGGWDHGGGGGGRGGQRSHHNNGGRRGGGNGGPGGPGGGGVPHHGGFGGRRRGGFDGGFFRGPGMGIGPYMRGAPPPPPPLAVAPPFMGHPPPPGSHMRAFAGPMMAFHDMPSPVSPVSPMYYVGPPPLPEALRGMAFAPHMVGPPAYPYFQPPAEA

SEQ ID NO: 130684 - protein, 205 aa, Triticum aestivum
  unsure (1)..(205): unsure at all Xaa locations
  Clone ID: PAT_TA_25102.pep
HDEGFTHSVQVIRVKWSLHAREEILLELLRHLRGSATIFILEREWQSARXMLEEQEAVRGRLFTIQEVMQSTVRAWLQDRSLRITHNLAIFGGGGIVLSIITGLFGINVDGIPGAQNTPYAFGLFAGLLFFLGIILVGVGLMYLGLTNPVTSEKVKVRKLELQQLVSMFQHEAEQHGKVREGLSRHGLSPSSAAASGDEGYILIS

SEQ ID NO: 130685 - protein, 192 aa, Triticum aestivum
  Clone ID: PAT_TA_25103.pep
PHEQSRENNTHSNPQFQNIRIKRSKTHGLGLFVLERRWVRGVGQIRRPRGGSTRAPPPRSARPRWPPPPSPGPPASTRRWRAAPSAPRPAARSRRSSPGPPPSPAPPPTPPTPGTPPSRGAPSPTPTCTPPAGTGSPPPPRPPSPAPRCTASSPAGAPRPTPAGTAPAAPARSEGWRPSRAAPTRPPRARGG

SEQ ID NO: 130686 - protein, 97 aa, Triticum aestivum
  Clone ID: PAT_TA_25104.pep
FILLAFATVTPVQALPLPEATLGRRHPPHPLCTPNLSFRSRPRLLIGVDPQPKHEHRSRQASSPNSATGAWLPCGLNLGARQQSSQRGELWLWMRGG

SEQ ID NO: 130687 - protein, 145 aa, Triticum aestivum
  unsure (1)..(145): unsure at all Xaa locations
  Clone ID: PAT_TA_25105.pep
QPPPQSQQPFSQQPQQIFPQPQQSFPQQQQWMIQSFLQQQMNPCKNFLLQQCNPVSLVSSLVSIILPRSDCQLMQQQCCQRLAQIPQQXLQCAAIHNVAHSIIMQQEQQRGVQILRPLFQARPGSGVSSNLNKPTQLEGIRVIGY

SEQ ID NO: 130688 - protein, 120 aa, Triticum aestivum
  unsure (1)..(120): unsure at all Xaa locations
  Clone ID: PAT_TA_25106.pep
MICLRAIPSPRLLHLPLPRLASSPLRRLRPSAVLCAAAAMSSSPSVAAPTVAAPVEHIVLIKVRPEAVASGAAAAMVSALQALSTLVPGVSYIHAGPXVLRLRSXPAAEALGPTHLLHSR

SEQ ID NO: 130689 - protein, 340 aa, Triticum aestivum
  Clone ID: PAT_TA_25107.pep
RNARRQCSDDQSALQAGCSEVNRDQHGYDVNRFEEISQEVSKKLRAFYQFCRPHTIFGTIIGITSVSLLPMKSLDDFTATVLKGYLEALAAALCMNIYVVGLNQLYDIQIDKINKPGLPLAAGEFSVATGVFLVVTFLIMSFSIGIHSGSVPLMYALVVSFLLGSAYSIEAPLLRWKRHALLAASCILFVRAILVQLAFFAHMQQHVLKRPLAATKSLVFATLFMCCFSAVIALFKDIPDVDGDRDFGIQSLSVRLGPQRVYQLCISILLTAYGAATVVGASSTHLLQKIITVSGHGLLAVTLWQRARHLEVENQARVTSFYMFIWKLFYAEYFLIPFVQ

SEQ ID NO: 130690 - protein, 144 aa, Triticum aestivum
  Clone ID: PAT_TA_25108.pep
TAPGTLPLCFVGGIDRGRERHHELPAAGHRVPSAGPSSRRTRRRATVTATLRRARSSRSSSSRHTRRRRTARRRPSPPTTTSPRTAGAYPPQQQQAYGAPPPVAANYYPPPQQQQQAQPPPEAQSRGSDGFWKGCCAAICCCCL

SEQ ID NO: 130691 - protein, 284 aa, Triticum aestivum
  unsure (1)..(284): unsure at all Xaa locations
  Clone ID: PAT_TA_25109.pep
MAAQPPSSGCPAAAGNTKRTSAGVFKTKPAAPSALNPNWAQLQSKLPASTFLGKRKRPAPFPPPGPSPTPEAAELSFKLEPTSDDTSLTKALALDCEMVGVGAGGSKSALARATLVNSFGNVVYDEYVRPMERIVDYRTHISGIRPKHMNKAXDFSIVQKDIAELITGRVLVGHALHHDLKVLLLGHPKMDIRDTSEYEVFRREGKRRSLKDLAAQELSVKIQQQEHCPIEDARAAMFIYKKHKKSWEKNKKEQFRFKNKQKKRGNKKSAEANEKDPNVPIVLL

SEQ ID NO: 130692 - protein, 191 aa, Triticum aestivum
  unsure (1)..(191): unsure at all Xaa locations
  Clone ID: PAT_TA_25110.pep
DTKVSSVGQGAKKPPPSTHALHCLKGSRATQPLQAGCPALHRREAGTTGPGRRPGRKGGGGPGHRRRRRRGAPGWTWKTGGLKGRVQRGQWSTCLSILTASSTRGLYAAVTMAPPSPPPAASCFMWPSGRSCRAFLELVSALSGKALLLPSTAAPCILXWPLGKENRCLCLRPNFFQEVGEEGRGLRTKGA

SEQ ID NO: 130693 - protein, 72 aa, Triticum aestivum
  Clone ID: PAT_TA_25111.pep
HWHPSGMHLGDGPPGGGMNFLQYARQSLLLQCPFLRIWLHTGLEVAIADDSIKKANARNRICVLLISSYKLN

SEQ ID NO: 130694 - protein, 128 aa, Triticum aestivum
  unsure (1)..(128): unsure at all Xaa locations
  Clone ID: PAT_TA_25112.pep
ASCASTSIASPRSQIRSGENPSPCLPSEVACTLAALILHDDGIPITSEKIATVVKAAGIKVEAYWPALFAKLLXEKRSVDDLILSVGSGGGGAPAAAAAAPAAGGAAAAERERRERKKEEGKXKKTDE

SEQ ID NO: 130695 - protein, 192 aa, Triticum aestivum
  Clone ID: PAT_TA_25113.pep
QPLLPQQERDSYYSKKKKKERVARPSNPIHGDGGVFSPSPVSAPAPPGRPRFLPLRGLRARLLAAAPAAQAWTGEIRGRVVCDVCADSAIGPEDHVLEGAEVAVLCITKSGEVINYQAFTNYKGVYSVAETMPESDRWDSCLARPISSFHQHCTRRGDAHSGVKFTYNKQSGSSHNVKTFLYKPANVPLYCS

SEQ ID NO: 130696 - protein, 192 aa, Triticum aestivum
  unsure (1)..(192): unsure at all Xaa locations
  Clone ID: PAT_TA_25114.pep
LRGQFPPTPPSTIPRLGRTGXPKHREVGGCKAGGGPPERGIEKPRLXISRTPKTSSPDVXQLMTHPHPAAAGRESGSPGSRWIRSGSGDTRDHRAVPTQPPPGNSQTATTAPHDIAGRPAAAPPNPTLARRSPRPHCPAPARTRWMGKEPRRRPASQASPGGVADGGEEGEGRMEVRGAAARVSPRVARGDD

SEQ ID NO: 130697 - protein, 73 aa, Triticum aestivum
  Clone ID: PAT_TA_25115.pep
VLKCFHLIIFLAFFFATLSYYSTSINIYILNPLSTRTHAGLRCPRGGRNLFGFASSERATSRSMLTAVDSSPV

SEQ ID NO: 130698 - protein, 209 aa, Triticum aestivum
  Clone ID: PAT_TA_25116.pep
RVNTAKLARNITQGCLVRLSRRVQENMSEEMSMFGRAGVGRDSAHPGHREIPIEHAPQTSIDELLKVIKGANGMPVLFMPTSDGRLAAVAVDGLESLMPAKREGSDPVKKIGGGFPCLVVCPDITGCYCHLRRTAHSTPVASGRMTTGTWLVPRLCEINLAEDFVVVCFLSMGISFIAGTWNSNAGPTQLWPAIFVLAINIVYMTGDPD

SEQ ID NO: 130699 - protein, 252 aa, Triticum aestivum
  Clone ID: PAT_TA_25117.pep
AGIVICLLVLGAMFAFFVIKRKSWKLSRGQDPEQKEPLSPLASGFKQMKSIKIISTTGKDQFQKTVSMSLKPPTKIDLHKSFDENDLTPKSVTRKISLSSIKIPAYTVADLQIATGSFSADHFISEGSFGRVFRAQFNDQKVLAVKKINFSAFPGYPSDLFIELVANISRLNHPNLAELVGYCAEHGQCLLVYEFYQNGSLCDLLNLVDDQSKPLSWSSRVKIALGSARALEYLHDKDVQQRELHPARPRIR

SEQ ID NO: 130700 - protein, 130 aa, Triticum aestivum
  Clone ID: PAT_TA_25118.pep
CCLLSPRTHRPPRMDPPLVPPDPGSGRCAALGSGRRAAPATGSSRRQHTLPPPTAARHQSTFGTAPPPYPPPPSRTSAPASTASPHARRPSSPLWRTSDTIWTSPSSPENFFSNIFFALFLISIPSCRCW

SEQ ID NO: 130701 - protein, 66 aa, Triticum aestivum
  unsure (1)..(66): unsure at all Xaa locations
  Clone ID: PAT_TA_25119.pep
GQTPSDRVDIVVRVYHMKLIEYLDEIKXGRAFGPIMAVFYTVEFQWWGLAHVHIKHRWRGVLDGHV

SEQ ID NO: 130702 - protein, 91 aa, Triticum aestivum
  unsure (1)..(91): unsure at all Xaa locations
  Clone ID: PAT_TA_25120.pep
ATTTITAGXKGQAPAPAPAAMEVKADTGAEAQPQKVAEGREEMNGGKKAGVVVGVFSAAAVLCLAGVVYRKRQANIRRSRYADYSARLELV

SEQ ID NO: 130703 - protein, 59 aa, Triticum aestivum
  Clone ID: PAT_TA_25121.pep
RGTELSCIDHQLMVVVGELGVGVSVMGWFLAPHITKLMEIARECAASKCMLYGDSTEML

SEQ ID NO: 130704 - protein, 117 aa, Triticum aestivum
  Clone ID: PAT_TA_25122.pep
LLFSFDEGEMEAKKRAATIAALCMLLIMSVPSQPAGVHHVLLQLLPAVLTPGAGIAPLGGSATSTVLGNCDVGDREDSLAACIMVCSTDSVCGPVVAPAYAQGVADCIAECNKRWGQ

SEQ ID NO: 130705 - protein, 397 aa, Triticum aestivum
  unsure (1)..(397): unsure at all Xaa locations
  Clone ID: PAT_TA_25123.pep
TRLRAAARSTSDVKPEEFAMLVRDVPVPPPNQTIKDSVDSYFRALHPDTFYKAMVVTDITKADQIFQEIEGHRHKIAHAEAVYAESKTSNRPEGTRPTHRTGFLGLIGKKVDTLEYCNEKIKELLPKLEDEQKSTLSEKQQRAAFVFFNSRAAAASASQTLHAQMFDEWTVTEAPEPRAVIWTNLPRKIYDRQTRQTVVYLIVFVTVVFYMIPITAISAVTTLEQLRKKLPFLKVVVDQPLLKTVLQAYLPQIALIVFLALLPTLLVFLSKSEGIPSQSHVVRASSGKYFYFIVFNVFIGYAIGSSLFSALQKVIENPTGIVTTLGSRLPGNATFFLTFVALKSFXGYGLELSRLVPLINFXLKRNYXCKTEDEVKXRMGSKRLGYNXRVXMTANVL

SEQ ID NO: 130706 - protein, 56 aa, Triticum aestivum
  Clone ID: PAT_TA_25124.pep
EYPSYIRPFHVKSAYRTCALRWHPDRHHGSSKATAEEKFKRCSAAYQTLCDSLATA

SEQ ID NO: 130707 - protein, 178 aa, Triticum aestivum
  Clone ID: PAT_TA_25125.pep
APASGPGLARSRSRHAALARSTRLCSARSSPCKHITAAGRGNTIDSRHGSSASLQRAAPTSRQRRCTEPLTSAALEHRDQSREWCIGAGGRRRRALHCSSVAGDLQLHCSSATCAELLHCSSVAGVERSIEAPPPTPSGSIVAPPPAPSGSIAALPPASSAPLELRRLRRALHWSSAA

SEQ ID NO: 130708 - protein, 326 aa, Triticum aestivum
  Clone ID: PAT_TA_25126.pep
MMDDPPPSLHRLLLPPLLLVLLVLVSVSCPLAHGSPATGGGLGAEEWTARTDAASVQLRNSHPRRLLQVGGGNHLPPQFLQPRHRHHRRTHSPAPSPAPFTAPSPSPSAFRPSLAPPQLAWPLPSTPQPSHDPQVGAPVNPLHKHSWRAYGLVSAGGAALLVMAAAFAVYCRAKKVGTVRPWVTGLSGQLQRAFVTGVPSLKRSELEAACEDFSNIIGSTANCMLYKGTLSSGVEIAVVSSLISSKNDWPKECESQYRKKISSLSKVGHKNFINLLGYCEEENPFTRAMVFEYAPNGTLFEHLHVREAENLDWMARLRISMGIAYC

SEQ ID NO: 130709 - protein, 34 aa, Triticum aestivum
  Clone ID: PAT_TA_25127.pep
KNPRHVPHAEAAPVDQWERSFRAASSGGGCSCDP

SEQ ID NO: 130710 - protein, 153 aa, Triticum aestivum
  Clone ID: PAT_TA_25128.pep
MALQMQAPSLTRAPAGSPARLRSAFCAPPLLVRVRLPAPGRARSAAAARITMRFGRVETKQAYICRDCGYIYKDKTPFEKLSDDYYCPVCAAPKRRFRPYEPPVAKNANATDARKARKEQLKKDETVGKALPIGIAVGIVALAALFFYLNSVY

SEQ ID NO: 130711 - protein, 132 aa, Triticum aestivum
  unsure (1)..(132): unsure at all Xaa locations
  Clone ID: PAT_TA_25129.pep
TNRPDQERRVHHRRHHHPRRARAGIDPCPRTRARAPGSCARCICADWDPVDPADAWGLVGFGLGWSLPEDPFLVGFPGPFAGATKIPRGKRDGFWRPSNEEAPPRFDGANSPDNPFRAICKNXGSKKAPTKI

SEQ ID NO: 130712 - protein, 98 aa, Triticum aestivum
  Clone ID: PAT_TA_25130.pep
FRSRIWLGGSFTTVFGVDCVVSLSVLVLDLDDVVCFDLNPSTTVVKLLLSLSYCCCCCRRRRSTPRRRRSKPRRKTTSRRRGEQAQLKLLLFMLLHAC

SEQ ID NO: 130713 - protein, 131 aa, Triticum aestivum
  Clone ID: PAT_TA_25131.pep
MKTFLILVLLAMATSMVTAARPLNPSDQELQSPQQQFPEEQSYPQQPYPQQAFPIPQQYSPHQPQQPFPPPHRPTPRRPQRPGPRRPNLPRPSLPLAPTSRPLASPTALFPARDSTGPPPSSDFQCPGGLL

SEQ ID NO: 130714 - protein, 203 aa, Triticum aestivum
  unsure (1)..(203): unsure at all Xaa locations
  Clone ID: PAT_TA_25132.pep
PLRRSNPSAGYAMHLDRPPSFLKKNLHRLHVLVLNTGHHWNRGKLKANKWEMYASGPPNNNREIAGMWKAKNFTIHXIVKWLXAQLPRYPHLKGIXYRSLSPRHFFNGEVGQPGXHXANNNGFLXAXGYQXVFQNPSADADGEGVVKGTRIKLLDITALSRLRDEGHISKYSIXATPGVQECLHWCLPGGPDTWNEILGRSTV

SEQ ID NO: 130715 - protein, 113 aa, Triticum aestivum
  Clone ID: PAT_TA_25133.pep
QLIFSSCSWVRSMKTPPARSGRTPSQMAPCRCSILQSLVDAPSGIDTPITAPSRSDSVNVFAPWPRGAALCTPARLPPGVSPPFRSVADISPWMSPSPLVGPCCQTKTVSPTS

SEQ ID NO: 130716 - protein, 196 aa, Triticum aestivum
  Clone ID: PAT_TA_25134.pep
IPPLLENPTKGNKSWSSTAVAAALELVDPPGCRNSAPGSFSSTTIHLTDDFAAKVSDLDFWNGTKGSDSVTDGCTMLDTESIVHQYGIILLEILTGRVPFPEQDLPLEQLASIYFEGKMPLAELMDSSLGSFPEETARALCDVARSCIDPDPSKRPRMAQVAAQMKEITAVGPEGATPKVSPLWWAELEIMSAEAT

SEQ ID NO: 130717 - protein, 226 aa, Triticum aestivum
  Clone ID: PAT_TA_25135.pep
MDSAVPIQVKTQRWGQVECPTKFISAQDNFRHQLVPNNQMSGVSFSQRMHDAVGLKAGNPLRQSTDSQRDEMSMMERILTEEVKQLRSQVTALAEQCQQKDLIVKVYKQRLDETWLIVRDEAAKCKAAKDVIKVLTNQCNALSAKLSVGQQPENSKMTPNSIPEQAPSPGATDRSFSHQNIARTFDRDGYTTEADSVTPVEGVIQIERGVYVTLGRIPWWERHKGG

SEQ ID NO: 130718 - protein, 99 aa, Triticum aestivum
  Clone ID: PAT_TA_25136.pep
MVQSKKKFRGVRQRHWGSWVSEIRHPLLKRRVWLGTFETAEEAARAYDEAAILMSGRNAKTNFPVPRSANGEIIVAPAAATGRARWRRLVVLRRGRGPQ

SEQ ID NO: 130719 - protein, 193 aa, Triticum aestivum
  unsure (1)..(193): unsure at all Xaa locations
  Clone ID: PAT_TA_25137.pep
QPQQPQQQFPQPQQPQQPFPQPQQAQLPFPQQPQQPFPQPQQPQQPFPQSQQPQQPFPQPQQPQQSFPQQQQPLIQPYLQQQMNPCKNYLLQQCNPVSLVSSLVSMILPRSDCQVMQXQQCCQQLAQDXPAKLQVCKPSISVVHSNRHASKEQQQXNTRFSGQLVQAPSKGKGIIQPQQPGIGGRFGPFQNKV

SEQ ID NO: 130720 - protein, 57 aa, Triticum aestivum
  Clone ID: PAT_TA_25138.pep
QYWGACRMNSTCMGVAGNHGCAACYRLWCGVGVVEPTNLPSLIFDGLLTRLRLGWSG

SEQ ID NO: 130721 - protein, 71 aa, Triticum aestivum
  Clone ID: PAT_TA_25139.pep
ILPRVTSSNSCYDNNVADRGPGRPRPPSPNSSSHQLPRRCCTRGSEVVAKMLVGVSTNDDTGGRRIVRMQF

SEQ ID NO: 130722 - protein, 42 aa, Triticum aestivum
  Clone ID: PAT_TA_25140.pep
DAWVCLCWMAGRLCGNRGGLFLVISWRENKQRKGETVKRSSP

SEQ ID NO: 130723 - protein, 51 aa, Triticum aestivum
  Clone ID: PAT_TA_25141.pep
AMQAQVCMPEWPTAFYLQALALSKLGMETDAQDMLNDGATFEAKKQNSWRG

SEQ ID NO: 130724 - protein, 479 aa, Triticum aestivum
  unsure (1)..(479): unsure at all Xaa locations
  Clone ID: PAT_TA_25142.pep
PTPSGDPPLIPFIGRIAPSDTYRICXRGAALRADMTLAGLDGFRIQRSDQTFLFLGDGARPEDAGGKELLPGSLIVLSHKDKEITDALEGAGVQPTESEVAHEVALMSKTNMYRPGIDVTQADLVPHMNWRRQERTEAVGQGKAKVYDMLNVLVTVKSXRVPGAMTDEELFAMDGEEKNGRSAELETELDEVLTAEERKQLDSALRGNQEEESDDRAEEGDKGADHLDANGAGKDKKGWFWNGKKGAKNDEKAPKAVSKDESGDAGKGKEKGNGKKKKGGVSSGDSNKLQSEYNKGLRPVXLWVTPDFPLKTDELIPLLDVLANKVKAVRRLRELLTTKLPTGTFPVKIASPRGPTIRVIVTFTKFEELQPLDEFATPPTSPTQFQDAKSKDSEGSASWYSWVRGGRGAQSSDSGDSKNWKDEVDPFHIPSEYTWVDATEKKRRMKAKKAKGRRGTARKQSSKSTSSEGGQHPMMDGFE

SEQ ID NO: 130725 - protein, 91 aa, Triticum aestivum
  unsure (1)..(91): unsure at all Xaa locations
  Clone ID: PAT_TA_25143.pep
REAERKVLEARKKKDAAPKTNAAYLGGFAMPNDPAEQLKHRGYHMVAGAVDIGXFRKAALEDVKRFKEASMEIGEAEGEEEDEKENGYWSE

SEQ ID NO: 130726 - protein, 123 aa, Triticum aestivum
  unsure (1)..(123): unsure at all Xaa locations
  Clone ID: PAT_TA_25144.pep
HEAPPESLLLPNRATMSGRGKGGKGLGKGGAKRHRKVLRDNIQGITKPAIRRLARRGGVKRISGLIYEETRGVLKIFLENVIRDAVTYTRSXARRKTVTXAMDVVYALKRQGRTLYGFGRLDL

SEQ ID NO: 130727 - protein, 200 aa, Triticum aestivum
  Clone ID: PAT_TA_25145.pep
SCLMCRLLLAQAVELIFASGSAVPYFSLLFLCAGTRGAVTACAMNRRRLAATSGDRRGAGRPAATRGAAVLQPHARKAGTGVPRCYNRHAAMLQSTRGGDDHYWRFATTAVSTVATGDKKCYNRPSICWNRYQFLLPSATDLLEPDACSSSTCDICWNQCMFLLELAFPFATIFFVCYNRTNSSLPSELFCWNQRFFCWN

SEQ ID NO: 130728 - protein, 61 aa, Triticum aestivum
  Clone ID: PAT_TA_25146.pep
GMATHASGKTSLYPGREGAGSIDAELTLSPDNMAALEEDDEFWAAVTPDAPVPSAPEKKAT

SEQ ID NO: 130729 - protein, 159 aa, Triticum aestivum
  Clone ID: PAT_TA_25147.pep
MASTASFLAAIMVCAVLSSNTCHGTRNLADTTPPASPTAAPVPGIPAVPTLPAVPTVPAVTVPQVTLPPMPAVPVPTVPAVTVPPMSTMPTVPQVTLPPLPVVPSVPKMTMPPMPSIVVPKLTMPPMPAIVVPKVTMPQIPAIPSINVPMPFLAPPPSA

SEQ ID NO: 130730 - protein, 67 aa, Triticum aestivum
  Clone ID: PAT_TA_25148.pep
KKKNFHSETPAATIKTVSGSQWPLKQTWHSNNVDCMQQRCRNLLLTLHMFAIRQTTMLYINKPVEFL

SEQ ID NO: 130731 - protein, 115 aa, Triticum aestivum
  Clone ID: PAT_TA_25149.pep
CMTLNNESVGIVDHKFLSALKKGSYLINIARGRLLDYTAVFNHLESGHLGGLGIDVAWTEPFDPEDPILKFPNVIITPHVAGITEYSYRTMAKVVGDVALKLHAGEPFTEIEFVN

SEQ ID NO: 130732 - protein, 556 aa, Triticum aestivum
  Clone ID: PAT_TA_25150.pep
HAARVLGAPAARPRAPAAAATTPRPLPRPPPVPPPLSAAAPGPPPPPLPSGPPPRPAAPPPLRPSPRAAPPRPPLPPRRPAALPPPVLGAAPAPGPARARAAPGGGAGACVYRAGAGLRVPNGSGAGLGGGTVHLETTKAHSWTCMDLYVFATPYRVTWDYYFLGREHTLEIKEWESKAEYDYVKHNGVSIFLMPSGTIGTLRALWDVFPLFTNTGWGENANLAFLKKHMGATFEERPKPWVSELNPDDIQSGDFLVLSKIRGRWGGFETLEKWVTGAYAGHTAVCLRDSEGKLWVGESGHENEEGEDIIAVLPWEEWWEFETTKDDSNPQIALLPLRQDLRAKFNETAAWIYAKKMNGKPYGYHNMIFSWIDTISNNYPPPLDAHVVASVMTVWNKLQPDYAASMWTEALNKRLGTKGLDLPEIIVESEKRGMTFDKLLTIPEKDNWVYTDGQSASCVAYVLMMYKEAGLFEPISSSIEVTEFTIKDAYILNFFEANMTRLPSWCNKDDTVKLPFCQIKGRYRMELPGYNAMEPYAHMNERCASLPPDYLRDENC

SEQ ID NO: 130733 - protein, 53 aa, Triticum aestivum
  Clone ID: PAT_TA_25151.pep
KFCAIKRKDQARALDMIKSDPELMGLNIMQAPLVDMEIRGVPALKFLGDIVWK

SEQ ID NO: 130734 - protein, 122 aa, Triticum aestivum
  unsure (1)..(122): unsure at all Xaa locations
  Clone ID: PAT_TA_25152.pep
DVXHLLSQSSSSPLPLRTGAXIDRSMQYWGWTALGRRKFKPTSVSFRVLRGGGVVVLVREATWLVSTAVTGRRSENDGAMVRGRRVAARSGALGRLWLVSGRVVAVSREPELEVGGGGVRTK

SEQ ID NO: 130735 - protein, 99 aa, Triticum aestivum
  unsure (1)..(99): unsure at all Xaa locations
  Clone ID: PAT_TA_25153.pep
MVGATKENAQAFNANLIKRALSGNAGTPYRPDADVSAYIFALFNEXNKKPADEQNFGPFYPDGQPVYRSTSAQLCPGPCHGLVLANPGFIPALDQQRAD

SEQ ID NO: 130736 - protein, 113 aa, Triticum aestivum
  Clone ID: PAT_TA_25154.pep
HAPPPLAPPPACSDQREPHPNPPRVLPSPNPKSPTVSCFQTHPAPDFPPNPRPPPPRDPAASSRADRIRIPPGARARGGREGGRARNSGARLRLAPPGSPWMVALDGVARAEI

SEQ ID NO: 130737 - protein, 105 aa, Triticum aestivum
  unsure (1)..(105): unsure at all Xaa locations
  Clone ID: PAT_TA_25155.pep
MEAAAELRTQLQAHLTMMYATGAVDAYFQELQELDEGSASTGHVAEVLNIFLNDGDRILKDIXQAWLNKPLHKVFSPRWDALVQXLKGSNSTVGAKKMNLPLHGS

SEQ ID NO: 130738 - protein, 145 aa, Triticum aestivum
  Clone ID: PAT_TA_25156.pep
EKGAVESQADSGSLSEDTKAGTGDEHSAETLPDETGNIPAVHNANPQGDAASSTSDAYGHSNSETVHIEVGSEHEGATTSSVTTSGDAEKGNSVETNPSDSISVEEKAGGDGDKGSETSTANEASGAKEANPEEGNAAAEVRADQ

SEQ ID NO: 130739 - protein, 61 aa, Triticum aestivum
  Clone ID: PAT_TA_25157.pep
HANSVLYMCSSVKFRSVHICGVCMIVDIASRLVYIALGLEIPAKRSMNGDWHAHTRRNDLC

SEQ ID NO: 130740 - protein, 180 aa, Triticum aestivum
  unsure (1)..(180): unsure at all Xaa locations
  Clone ID: PAT_TA_25158.pep
QSSAFPSSTSPALAMASACTNATTTVRSVRLFRIDGFSLVSSTMGHDECFKFRWDVDGYEWELHCFPSYFSAVWLKLMFLSDADATCNVRASLGYLLVHPGLDGLSQERRTSDVFKRPNDCTQQVYLVNKVDLPVPSRSSDDHLTVQCTITILKDLPEVPTSVPVPTRTCTCTPDSADXT

SEQ ID NO: 130741 - protein, 113 aa, Triticum aestivum
  unsure (1)..(113): unsure at all Xaa locations
  Clone ID: PAT_TA_25159.pep
RRRRPRWRSRSPPRRSRRRRKPPRRWRPKSRRLPPSRLRRPRRRRRQQLRQRRRRSPSQQPAAEPXPRRPPWSRQRTKEAVGWGQPPPARPWRLSGACCPRPPGAPPRPTPIR

SEQ ID NO: 130742 - protein, 178 aa, Triticum aestivum
  Clone ID: PAT_TA_25160.pep
PEDDGVTHRTDIANRQPLHVHARQTQPHRPPLAGKELKWQNRTAHGRAQNHATRRRPGFLSRPSSLRTRSQVSAIDPAMHPTIQVVLRRGRSCIICWRRAGRSRHRGTPWRARGRRTDGPASGASLGGGVRAGAGVHRGAAERAGVRGGGGALEPGQRAAPWKRWPHGRCARTSPAAN

SEQ ID NO: 130743 - protein, 616 aa, Triticum aestivum
  unsure (1)..(616): unsure at all Xaa locations
  Clone ID: PAT_TA_25161.pep
MMVLKLNLESVSSVLTVRPFSRTYWNRPEVTAHSTLLGRLFGSGTTASPASVDNTRQSSRTFMEVIREVFKQGSAHGARAAIIADDKSYRLVQLISPALDDHNILCRKHDGKESSDNGAKATAFLCGARIGMVAXPSAEFVAEIFGTRLSGGVAVPLALMYPVVELLHVMNDSDMSXVLRTKEHHDIMESISNKCSTRYSLLPSVESIPPKIDAQEPLSSVVTSSVSSLMAEIDTLKKIKGDDPALILYTSGTTGKPKGVVHTHEGILSQVQILTEAWGYQSEDQFLHCLPLHHVHGLFNALFAPLYSGSVVEFLPKFSVRGVWQRWRESYPNDGSKNDEAITVFTGVPTVYTRLLQGYDSMNPDQQSACSYAAKQLRLMMCGSSALPSPLMKRWQEVTGHRLLERYGMTEFVMALSNPLHGARKEGTVGKPLPRVEAKIIMDDGTETKTGVGELCIKSPSLFKEYWKRPEVTAESFIDGGFFKTGDTVTVDEDGYFIILGRTNADIMKVGGYKLSALEIEAVLLEHDTVLECAVLGLPDEAYGEAICAIIVPKEDAKEKAEQASKPALTLEALTSWSKDKLAPYKIPTRLHLWDSLPRNAMGKVNKKELKKLLEV

SEQ ID NO: 130744 - protein, 171 aa, Triticum aestivum
  unsure (1)..(171): unsure at all Xaa locations
  Clone ID: PAT_TA_25162.pep
MKTFLILALLAIVATTATIAVRVPVPQLQPQNPSQQQPQEQVPLVQQQQFPGQQQPFPPQQPYPQPQPFPSQQPYLQAAXPFPQPQLPYPQXPQLPYPQPQLPYPQXPNHXRPQQPFPQSHPLHSPTSSPQFRIRAPSHFPTPSMSQPPTTCHHQPDSLNQHFGKQTWIPC

SEQ ID NO: 130745 - protein, 104 aa, Triticum aestivum
  unsure (1)..(104): unsure at all Xaa locations
  Clone ID: PAT_TA_25163.pep
TLAVGCSPLSLLDRFTVEPAKVVEVEKLENMPCLLAFDREGSYIFLHEPRKDGEERVXHLFCKAILNILDETWTSAELGQLVPENAIHPMFYGMSFPPDCGLLE

SEQ ID NO: 130746 - protein, 225 aa, Triticum aestivum
  unsure (1)..(225): unsure at all Xaa locations
  Clone ID: PAT_TA_25164.pep
ELNIPESRLVPLGTPGKYANXLNRGPKDGGVAAVVDEMPCVEIFLSTHCNFRIVGQEFTKEGWGFAFQRDSPLAADLSTAILQLSESGQLQRIHDEWLTDPTCGDDDSGLGAVRLGLGSFWGLFLLCALICVFALMVYFARICWQYSRYSSSEPPSEPSDSAAAVTTATIAQIRPEKPKPTRLGSFKELIQFADTKEEEIKKVMKRRLSEKDTRATGSAHSVSSA

SEQ ID NO: 130747 - protein, 172 aa, Triticum aestivum
  unsure (1)..(172): unsure at all Xaa locations
  Clone ID: PAT_TA_25165.pep
MKTFLVFALLAVAATSAIAQMETRCIPGLERPWQQQPLPPQQTFPQQPLFSQQQQLFPQQPSFSQQQPPFWQQQPPFSQXQQPILPQQPPFSQQQQLXLPQQPPFSQQQQPXLPPQXSPFPQQQQHQQLGATTXPVVQPSILXQQAKPCKYPPSSMQPVAMPQVWLVPMVQQ

SEQ ID NO: 130748 - protein, 208 aa, Triticum aestivum
  Clone ID: PAT_TA_25166.pep
SADAWAATVAKEALEGHCIYDGGYCKIHLSYSRHTDLNVKAHSDKSKDYTIPEGAHQAAPQPAGVPPTTAGWQGNSQAAGPYGPPGVAGQNPDTNGQVPNWNPGNSGYPPAPGQYPGHMYSAPPQQYTATSGGFSAPPPPPPHEMHPSHQMPPAHHGNEMHPSHQMPPAHHGNEMHPPHQMPPAHHGNQQRPASGAPGTGQPPPYYHH

SEQ ID NO: 130749 - protein, 117 aa, Triticum aestivum
  unsure (1)..(117): unsure at all Xaa locations
  Clone ID: PAT_TA_25167.pep
MLFLYRLRFTIPVNAHSDTTQPYAVPSRTAPSSATSQPGGPYEPPIVAAHTRSSTIRMTSWHRANSEYQRASAEXPSRLLSAPPTHKPVATSWGLTSPPPPPPDVRRLSHPSPPAAS

SEQ ID NO: 130750 - protein, 224 aa, Triticum aestivum
  Clone ID: PAT_TA_25168.pep
MAPSQQVAATKEPSANGTAAPAPKTKTPALNERILSSITRRSVAAHPWHDLEIGPDAPTIFNCVIEIPKGSKVKYELDKKTGLIKVDRVLYSSVVYPHNYGFIPRTLCDDSDPIDVLVIMQEPVVPGCFLRAKAIGLMPMIDQGEADDKIIAVCADDPEYRHFNDIKDLPPHRLAEIRRFFEDYKKNENKEVAVNDFLPSEDAYEAIQHSMDLYATYIVEGLRR

SEQ ID NO: 130751 - protein, 231 aa, Triticum aestivum
  Clone ID: PAT_TA_25169.pep
MAPSQEVAAPAAKEPSANGNGTQGTPAAAPKTKAPALNERILSSITRRSVAAHPWHDLEIGPDAPTIFNCVIEIPKGSKVKYELDKKTGLIKVDRVLYSSVVYPHNYGFIPRTLCDDSDPIDVLVIMQEPVVPGCFLRAKAIGLMPMIDQGEADDKIIAVCADDPEYRHFNDIKELPPHRLAEIRRFFEDYKKNENKEVAVNDFLPSEDAYEAIQHSMDLYATYICEGLRR

SEQ ID NO: 130752 - protein, 228 aa, Triticum aestivum
  unsure (1)..(228): unsure at all Xaa locations
  Clone ID: PAT_TA_25170.pep
RSPRDDSQHRPRAGPPAEKRAAEPTSQAPRQNERILSSLSRXRPVAAHPWHDLEVGAGGQAMFNVVVEITKGSKVKYELDKKTGMIEVDRILYSSVXYPHNYGXSVPRTLCEDNDPIDVLXVLMQEPVLPGTFLRARAIGLMPMIDQGEKDDKIIAVCADDPEYHNLNHLSELSPHRLQEIRRFFEDYKKNENKEVAVNDFLQADDARAAIQHSMDLYAEYIMHSLRQ

SEQ ID NO: 130753 - protein, 150 aa, Triticum aestivum
  unsure (1)..(150): unsure at all Xaa locations
  Clone ID: PAT_TA_25171.pep
MGKIKIGINGFGRIGRLVARVALQSDDVELVAVNDPFITTEYMTYMFKYDTVHGHWXKHSDIKLKDDKTLLFGRRSQLPSSGVXRNPEEIPWGXRLGADYFVDPPVSSLDKDKAAAHLXKGGCQEVGISAPSKDAPMFVXGVNEDNYTQT

SEQ ID NO: 130754 - protein, 151 aa, Triticum aestivum
  unsure (1)..(151): unsure at all Xaa locations
  Clone ID: PAT_TA_25172.pep
MAFMSQLIPSAAVLLAVLAATSATVGTQCVPGSDIPYNPLQACRDLLSTKICSVGPVYASAGMLKRRCCDQLSRVPAYCRCEALRILVDGAETPARVRSRAAPPAHARPPRFTMGYATPLGAPVGCHPXTARASPPRPALSGSRSGGAVTL

SEQ ID NO: 130755 - protein, 101 aa, Triticum aestivum
  Clone ID: PAT_TA_25173.pep
FVSCMVWKNRCTILIGLLLCSCVGVICIEKLSRDTMKCEIHVEITVSHTHSNSTTRHKSITTLYCNTHRFVQQFKRFLSYSRMVGPNGVPARSWLVLILKK

SEQ ID NO: 130756 - protein, 191 aa, Triticum aestivum
  Clone ID: PAT_TA_25174.pep
MAIAVSSLTSGSLPPYSPEVSRQRRSSLVSASPRRRQALAGLAIKSRGINRVQPTTRGATQIPAAAAGPSSGDRAGGNFPVPNVPSWVKLLVGVFFAAVPLYRQMRALEDKVEQTAEVAIEVVEKVAEAAEKIADDVSEAFPGNDNLKKAASRIKAVADEIEKDAEKAEGLIEKGDEIEKEMDSVLGSVNK

SEQ ID NO: 130757 - protein, 150 aa, Triticum aestivum
  unsure (1)..(150): unsure at all Xaa locations
  Clone ID: PAT_TA_25175.pep
MVNIGGGGVLRHSNSSRLSRMSFSGEDGRGRGRPGXAPGAGADRPMVTFARRTHSGRYVSYSRDDLDSELANSELAGGGGGFSPDREEFLSYHVHIPVTPDNQPMDPAISARVEEQYVSNSLFXXGFNSVTRAHLMDKVIDSXXSXPQMA

SEQ ID NO: 130758 - protein, 97 aa, Triticum aestivum
  unsure (1)..(97): unsure at all Xaa locations
  Clone ID: PAT_TA_25176.pep
KNVCGFERXSRHXXELFASXPGVQSVEVXFHXXXPRRSAGYAFVSFSSKEEAEAAISTFNGKELMGRSINVMFKEDTVKKNKDEEKLEEAESEESDS

SEQ ID NO: 130759 - protein, 216 aa, Triticum aestivum
  unsure (1)..(216): unsure at all Xaa locations
  Clone ID: PAT_TA_25177.pep
LLLLQQGRWAEAQPSPGYYPSSKVSSMPFSQWYSNLWGAQHQSLSPDQTSLTLWMDRSSRSGFKSKRAYRNGYFGVSMXXQPGYTAGVNTAFYLSNNEAYPGYHDEIDVELLGTVPGEPYTLQTNVYVRGTGDAHPIVGREMRFHLWFDPAAAFHHYAVLWNPDEIVFLVDDVPVRRYQKKVEATFPEREMWAYGSVWDASDWATERAAASGPNYR

SEQ ID NO: 130760 - protein, 153 aa, Triticum aestivum
  unsure (1)..(153): unsure at all Xaa locations
  Clone ID: PAT_TA_25178.pep
XXRKXQFXXXSKSCFLVPFDXXKXQKGVLVGKPQSREDMTANGXRRRRGXGPSRSGGPAPTSRGSRTASNRARRXWPPSASRPLPQTPGRRSAAMRAGGRARGGAGLRVSVGGPACGEERRKGDARSAESGVFDYFFAQSGERRGGWEGGRGG

SEQ ID NO: 130761 - protein, 228 aa, Triticum aestivum
  Clone ID: PAT_TA_25179.pep
MTAEVTLPVLAPASATPAMTTLGMEKPGVKLNGKKSHTEMMQIMDEASELLKKGNDFLSLNEENVKPLLSMDGSADAWWLDSGASNHMTGSRCKFKEMDESIRGHVKLGDGSTALIKGKGSVIVECKSGEQLHLTEVYFVPSLPSNIISLGKLAEDGNRVVLDGTFLWVRGRSGKMQMKVKRSPNRLYKVLLKTAVGASHVSSTKLSPESFRHQQQQPHMYGDANKKG

SEQ ID NO: 130762 - protein, 119 aa, Triticum aestivum
  Clone ID: PAT_TA_25180.pep
VRPRVRGRVGGFSVFMGFSVPQYFNEYTSVAGFGPVHTRARWFNDMVNVLFSSKAFVGGIVAYVLDNTLHRHDGAVRKDRGYHWWDKVPVDRTGPKGRGVYSLAVNLNQVFPLGWTKLG

SEQ ID NO: 130763 - protein, 189 aa, Triticum aestivum
  Clone ID: PAT_TA_25181.pep
PRTSVAVENVGLLAVTHVGSRRVVQISAGFMIFFAVLGKFGALFASIPLPIFAGMYCVFFAYVGACGLSFLQFCNLNSFRTKFILGFSFFIGISVPQYFNEYASVSGHGPVHTGARWFNDMINVPFSNKPFVAGLVAYFLDNSMHLHQSAVRKDRGYHWWDKFRSFKKDARSEEFYSLPFNLNKFFPSV

SEQ ID NO: 130764 - protein, 135 aa, Triticum aestivum; identical to SEQ ID NO: 130416
  Clone ID: PAT_TA_25182.pep

SEQ ID NO: 130765 - protein, 361 aa, Triticum aestivum
  unsure (1)..(361): unsure at all Xaa locations
  Clone ID: PAT_TA_25183.pep
QWCCLSKGSCCCLYPTVAKCVKFVPPELILLVILAVYLHHTIHMMTSIFDLGPVLFIIPVVWFHAYLHVVGXSLQRCLTXTHFHCRTDRSVXIGGATXIGATYPFQWGAPTFDAGEAFAMMAASFVALVESTGSFIAVSRFASATPLPPSVLSRGVGWQGVGILLDGLFGTGNGSSVSIENAGLLALTRVGSRRVVQISAGFMIFFSILGKFGAVFASIPAPIFAALYCVFFAYVGSAGLGFLQFCNLNSFRTKFILGFSVFMGFSVPQYFNEYTSVAGFGPVHTRARWFNDMVNVLFSSKAFVGGIVAYVLDNTLHRHDGAVRKDRGYHWWDKFRSYRTDTRSEEFYSLPFNLNKFFPSV

SEQ ID NO: 130766 - protein, 87 aa, Triticum aestivum
  unsure (1)..(87): unsure at all Xaa locations
  Clone ID: PAT_TA_25184.pep
MAAAPPPKADELQPHPPKEQLPSVSFCITSPPPWPEAVILGFQHFIVMLGTTVIIPSALVPQMGGGNEEEARVIQTXLFVAGINTLL

SEQ ID NO: 130767 - protein, 145 aa, Triticum aestivum
  unsure (1)..(145): unsure at all Xaa locations
  Clone ID: PAT_TA_25185.pep
MKTFLILALLAIVATTATTAVRVPVPQLQPQNPSQQQPQEQVPLVQQQQFLGQQQPFPPQQPYPQPQPFPSQQPYLQLQPFPQXPQLPYSQXPQPFRPQQXPYPQPQPTVIRNLQQTNXSQASKQQASNQQQAXRNXQLLQQILA

SEQ ID NO: 130768 - protein, 74 aa, Triticum aestivum
  Clone ID: PAT_TA_25186.pep
KLYRDYMVLFGTIKPRNTYGVCRGPVASGLKIETLNNLTLETIFFNLCKACQIKSMASIPPSAFSASRIRDTQA

SEQ ID NO: 130769 - protein, 193 aa, Triticum aestivum
  unsure (1)..(193): unsure at all Xaa locations
  Clone ID: PAT_TA_25187.pep
PLTGAIGVLILVTGIVKXFHNFNINLLILGYFIVILTIFQXXREGGREGTLQGKHTILVTKGLRXGIILFIVSEIFFFVSFFXAFFHRSLAPNIEIGAIXPPTRIIPFNPFQIPLLNTIILISSGGSCNXAHHAIXENNNSQITQGGFITIILGIYFTILQAYEYFEXAPFTIADRIXGXTFFXATGFHGLQC

SEQ ID NO: 130770 - protein, 130 aa, Triticum aestivum
  Clone ID: PAT_TA_25188.pep
NKTFIHNICVVHKTTASNTVFCILPKISHLIDEINRFLGNISFRAVIMGRGNRSNRGRGRRNFTNPMPVATVPVNLRPSFCVPVTVNVSSTGSATVGTSVPSSLAGKAWRSNIYRRYPSPSAQPQATGYY

SEQ ID NO: 130771 - protein, 159 aa, Triticum aestivum
  unsure (1)..(159): unsure at all Xaa locations
  Clone ID: PAT_TA_25189.pep
MKQIVANQKVKIPEGLTVHVKSRLVTVKGPRGVLKRNFKHLAVDIRMVGPRVLKVEKWFGSKKELAAVRTVCSHVENMIKGVTKGFQXYKCVQVYAHFPINCVTIEGNSVIEIRNFLGEKYIRRVKMAPGVTVVNSPKQKDEXLIIEGNSFGGMCPQLL

SEQ ID NO: 130772 - protein, 202 aa, Triticum aestivum
  unsure (1)..(202): unsure at all Xaa locations
  Clone ID: PAT_TA_25190.pep
MKTFLILSLLAIVATTATTAVRVPVPQLQPQNPSQQQPQEQVSLVQQLQYPGQQQPFPPQQPYPQPQPFPSQQPLPQPQPFLPQLPYPQPQPFPPQQPYPQPQPQYPQPQQPISQQQAQQAQQQQQQQQQQQQQQQQQQQQQQQILQQILQQQQLIPCRDVVLQQHNIAHASSQVLQQSSYQLLQQLCCQRLWQXXXQSXCQ

SEQ ID NO: 130773 - protein, 296 aa, Triticum aestivum
  unsure (1)..(296): unsure at all Xaa locations
  Clone ID: PAT_TA_25191.pep
HPQSNSTSRPRGSLLRLPSLLVPAAARPAALLRHRGRCLHTSPARLFPAATTAGASSAAPVKMETRGGDREGQVTPRSTDFNAWYTDVIAAAELADYGPVRGTMVIRPYGYAIWEAIQDYLNVKFKETGHSNMYFPQFIPYSFIEKEASHVQGFSPELAVVTIGGGKELEEKLVVRPTSETIVNHMFTKWIQSYRDLPLMINQWANVTRWEMRTKPFIRTLEFLWQEGHTAHATLEEAEKEAMQMIDVYTKFAYEQAAIPVIPGRKSRVETFAGADRTYTIEAMMGDKKALQARTX

SEQ ID NO: 130774 - protein, 105 aa, Triticum aestivum
  Clone ID: PAT_TA_25192.pep
MCRGAEPLARFREHRLSASACSNRTQVPACSMKLKYAPYLKLPGGLGLQGATLVVIKPSGDGAGGCHVGRKETDAFVSGAFDGPFRFAAKALMKRRTYLLEMNGF

SEQ ID NO: 130775 - protein, 80 aa, Triticum aestivum
  Clone ID: PAT_TA_25193.pep
YSQRSYISLQRHFKLNYDAQWLLLKCSGRSRIRAAIISIYTRRVDRCLGASRSTARPINDRVRTTLGPRGTHSHQGTLQS

SEQ ID NO: 130776 - protein, 147 aa, Triticum aestivum
  unsure (1)..(147): unsure at all Xaa locations
  Clone ID: PAT_TA_25194.pep
PGQGAAVRDAAAGPPPGLPQGRPHHGPRSSTPSPAPSTPPRPRPRPAPARARSPMAQAAAGTRKSAAVRPAVPGAGGTPSAATTTRTRSGATTSPGTPAATPRPXRPGIPHASPRPPPTAPPPAPPQPMTTPPAPALRRRPACYGVA

SEQ ID NO: 130777 - protein, 180 aa, Triticum aestivum
  Clone ID: PAT_TA_25195.pep
ARGKLEEAARYELRYRHKNRAGKANTKTASKPEDVILSELLGGDSVQGQLSRRESLGSEVPGRTVSTASASSSGSRKASMDGNGDGSLSTEAQNYELNNTASIFTPEELRQQAVEEKGKYKILKSEGKPEEALRAFKHGKELERQAAALELELRKSTRMATKAPNVKCRLLGPERLRIYD

SEQ ID NO: 130778 - protein, 90 aa, Triticum aestivum
  unsure (1)..(90): unsure at all Xaa locations
  Clone ID: PAT_TA_25196.pep
MADKISTVVLKVDLECTRCYRKMRKVLCKIQDKMNIKTISFDEKSNSVTVXGPFDPDKLCRKLCCEAGRGDQRKFMMKGAERRDGPAVLP

SEQ ID NO: 130779 - protein, 171 aa, Triticum aestivum
  Clone ID: PAT_TA_25197.pep
ARGSPSQPVARRHLQQKKQRASQDGGAEAEGEGHGHHARGRAGSRGGGRRRRGRLLLLACRCGRRRHDEGPKAPPDSSSHARPSWATRNSTSISCATPDPRQRPPPAFTREAQHMHPCMHVPPHWLLHSPRHLTARSGRWVPVHLMLLVHGPVSGHPPLQRSFCRSYRSSM

SEQ ID NO: 130780 - protein, 267 aa, Triticum aestivum
  unsure (1)..(267): unsure at all Xaa locations
  Clone ID: PAT_TA_25198.pep
LSGRPGRSNKPLVVTYTGLIQTCIDSGSIENAXYIFKEMCNYCXPNNVTCNIMLKSYIDHGKFEDAKDLLENILNGRIRNKAGLGQQAVADKFTFNSFLDACAEAKKWNDFEYAFREMLSNGYHFDERRHLRMVLDAYRSGKEQLLEHVWDYLCHSGRVPPAAMIMERFCLKLRQGHTTAALSCISSFEESKIGSVSSKSWSNLLNRNADLLEEESVAKLVHELDDFSRPGSSCPSLYENILSSCTEFLGGSGGKAASDGRMPLCNS

SEQ ID NO: 130781 - protein, 451 aa, Triticum aestivum
  unsure (1)..(451): unsure at all Xaa locations
  Clone ID: PAT_TA_25199.pep
PASAAPRFIRCIKPKNLQLPAIYGQELVLHQLKCCGVLEVVRISRSGYPTRMTHQKFARRYGFLLLEDVASQDPLSVSVAILHQFNILPEMYQVGYTKLFFRTGQIGNLENTRNRTLHGVLRVQSCFRGDQARRHASERIRGVLXLQSFIXAENARQSYSSLLRKHRAATLVQKNLRGWRARRYFIKIRKASVVIQSGIRGCLVRRCAGNVDLLNVLREFESKKEADGDQILIKASFLAELQRRILRAEATVREKDEENEMLHQRLQQYENRWLEYEQKMKAMEEMWQKQMRSLQSSLSVAKKSLALDETPRMSDSSVEQSWESNGNHVGGGSSQQLAAAPRITGREMNASMSVIGRLAEELEQRSQVFADDAKFLVEVKSGQADASLNPDVELRRLKQNFDSWKKDFGSRIRETKVILNKLASGGGGGNESSPNSAKRKWWGRLNTSKFS

SEQ ID NO: 130782 - protein, 134 aa, Triticum aestivum
  Clone ID: PAT_TA_25200.pep
LSMTFVRNRAPMLGRRLQHTTTRSEQQMLLAAPPKTSRSTAGSASPEHPEGTAQTTLPQTTIPTRSHHAIRLQTVAGRATSGPPASIAPDPAGEARQIRPLPARGRQPREPASPSGTPRRRHARSRRPWASTLR

SEQ ID NO: 130783 - protein, 125 aa, Triticum aestivum
  unsure (1)..(125): unsure at all Xaa locations
  Clone ID: PAT_TA_25201.pep
MKTLLFLTXLAMAXTIATANMQVDPSSRVHWXQRXQPPPQSQQPFSQQPHHXFPHAPFNTFPHQPQQXAFPQPQQTFPRRPQQQFPQPQXPQHPFPQPQQPQLPFPQQPQHFIXPSLNKXHXPFP

SEQ ID NO: 130784 - protein, 231 aa, Triticum aestivum
  Clone ID: PAT_TA_25202.pep
MDMELDAARHGFAKMGFGCKHYRRRCRIRAPCCNDVFHCRHCHNYSTKDGHELDRHAVESVICLVCDTEQPVAQVCSNCGVCMGEYFCRACKFFDDDVDKEQYHCKDCGICRVGGKDNFFHCHKCGSCYSVTLRDKHVCIEDSMKNNCPICYEYLFDSLREASVLRCGHTMHLQCFHEMLKHDKFTCPMCSVSIFDMEKFLRALDAEIEAKFLHMGKGWIVCNHCWDTTRV

SEQ ID NO: 130785 - protein, 129 aa, Triticum aestivum
  Clone ID: PAT_TA_25203.pep
LLTVLDNFLHCHKCGSCYSVTLRDKHVCIEDSMKNNCPICYEYLFDSLREASVLRCGHTMHLQCFHEMLKHDKFTCPMCSVSIFDMEKFLRALDAEIEAKFLHMGKGWIVCNHCWDTTRVYPGMTGQRK

SEQ ID NO: 130786 - protein, 259 aa, Triticum aestivum
  Clone ID: PAT_TA_25204.pep
MAALPASRRLLLLLRPELEPCLRSRALNPCSGRARWAGGLRRAPPLVSCRRGFSDEGGAYAAKNSAPDEQFLQLSLDEGEGDGVVPGISESVLKDAKKSAIELLAVRAYSVSELRKKLCGKNYSVDTVNSVIADFKSRGLLNDGYYAESFSRSRWQSSTWGPRRIKQALRQKGVPEAEVDQATRSVFQDDRGDEDQASHGLSEASMDHLFAQASKQWLRGSSLPLEKRRARIVRWLQYRGFSWGVTNSIIRKLEAQHPP

SEQ ID NO: 130787 - protein, 57 aa, Triticum aestivum
  Clone ID: PAT_TA_25205.pep
LPQFSTYVFSRAWYKLVLACKNYLFSQRISLIIPEHVLIQTFHQIHCYPIAWQLYLL

SEQ ID NO: 130788 - protein, 104 aa, Triticum aestivum
  Clone ID: PAT_TA_25206.pep
GCVTRRRTSASPWAVDAPPQLNLLVAGSLMLPVALRSALPRAPQEILSGCVCTSEKLTHSKEGSLFLIGEGLVFSWCMCGTYTSIFHQDLQKERSSQDHASSTI

SEQ ID NO: 130789 - protein, 155 aa, Triticum aestivum
  Clone ID: PAT_TA_25207.pep
VEDDYFAAPQRPPPAPWSHLPCPLPWLCTLVAVSSGASQLNYLNKALDTFDLAMVSPVYYVMFTILTIVASSIMFKDGAGQSLSSIASECCGLVTILSGTILLHAAKQKEVASSPASTWPLDRGISWYISVGSDNLLRNVEDDYFAAPQISPTTP

SEQ ID NO: 130790 - protein, 183 aa, Triticum aestivum
  unsure (1)..(183): unsure at all Xaa locations
  Clone ID: PAT_TA_25208.pep
MRAAAGHGASFLALPLLLLLVVSAEARSAAAAGRRKGEGTRYSVMAFHAAGDGKTDDSKAFEETWDSACRDSGGATVYVPEGRTFLLGETKLQGPCKSPITMQVDRGQFVAPKXPRGPLSFPCPLPSLGLAYLAVDGSGQIDGRGAPWWDCYNKKKCHYRPQLVSFSFCNGLRVTNIRLKDSA

SEQ ID NO: 130791 - protein, 161 aa, Triticum aestivum
  Clone ID: PAT_TA_25209.pep
SFQVSEGDPLSSSYSSSSPVLVVIGECYVASVGCGSTALHCTAKAEHGGSCEWHEDRGDAVPVTGGDGGLCAGGRTVHGRRAPRRPDNRRGRAHPARRQVRAPWWPTEPAPRVSRPGRWRPPSRRPCRRRRRAPVGRDPCRWGPRAPWGRRRGTLRRLSGH

SEQ ID NO: 130792 - protein, 82 aa, Triticum aestivum
  Clone ID: PAT_TA_25210.pep
RRRRPRWRSRSPPRRSRRRRKPPRRWRPKSRRLPPSRLRRPRRRRRQQLRQRRRRSPSQQLRPEPEAEAPAVVQDREQGGRG

SEQ ID NO: 130793 - protein, 186 aa, Triticum aestivum
  unsure (1)..(186): unsure at all Xaa locations
  Clone ID: PAT_TA_25211.pep
MACSFSPSSATRLQAVDAAAVKNARVPLKASVSPAPRSLGGCRAARQEFEGATQDPSVSVSSARTQLDLLEQLTSSSTPNGTENDTATETRVLTTIREQLVELYGDRGGEFTFTLPLGKRLXEGLKTLNTLTVSXQRKKIKQQAMLTKVSGRNDSVFFATVGAFVLVPPIAILAIAVLTLYVQLLP

SEQ ID NO: 130794 - protein, 288 aa, Triticum aestivum
  unsure (1)..(288): unsure at all Xaa locations
  Clone ID: PAT_TA_25212.pep
SCLAGAAXGEQTGQLTVFWGRNAGEGTLREACDTGLYSTVVISFYSVFGHGRYWGDLSGHPLAGVGADIKHCQSTNILVLLSIGGPGNGYSLPSSASAAAVADNLWNAHLGGRRNGVYRPFGDAAVDGIDFYIDQGAPDHYDELASRLDGYNRFYRGRKGVRLTATPRCGLPDRRLGAALRTGLFERIHVRFYGNDTCSLGKGGTYGVVEQWEKWTAAFPRTQVYLGLAPAESGVPEGAQGTVAVYLKYLYYDLLPKVQKANNYGGVMVWDRFADKKTRWSSVVNGWA

SEQ ID NO: 130795 - protein, 118 aa, Triticum aestivum
  Clone ID: PAT_TA_25213.pep
DAWALQNHLTANLRLAFRRPLALHPLVIAFVLVSCLAGAATAKQTGQLTVFWGRNAGEGTLREACDTGLYSTVAVYLKYLYYDLLPKVQKANNYGGVMVWDRFADKKTRWSSVVNGWA

SEQ ID NO: 130796 - protein, 131 aa, Triticum aestivum
  Clone ID: PAT_TA_25214.pep
KVNTKNSSLNEVLGACEEGGAESAAMARGPLGWTPRWAAPQKTKLQMWNQHNMGEEGGAGVREEAATWGKLGESDMATCRLRRSKEPYTRRPDEYGGARDEIFSFWRRSSEIRMTAWKSTPVAGMRASFGE

SEQ ID NO: 130797 - protein, 139 aa, Triticum aestivum
  unsure (1)..(139): unsure at all Xaa locations
  Clone ID: PAT_TA_25215.pep
AYRSTYMGVSLLRKQHSVGGGGLERRVVDAAQGVQWRCAWWGRAGRPXEEXKVRWCPVGYLKQPGSSWGLLKRKGRRRXNXLPTXXGAINXPLGGVXXTSXRXXKGNNXTXKXGTGGVPGXRAXSXPGGATXNKGSXPX

SEQ ID NO: 130798 - protein, 278 aa, Triticum aestivum
  Clone ID: PAT_TA_25216.pep
SRPPPHFQDDFPVAMQISQKYGLVYVITKLGLLFVYDLETAAAVYRNRISPDPIFLTAESSTTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGRAWRSCKDVDAAAVDAAA

SEQ ID NO: 130799 - protein, 129 aa, Triticum aestivum
  unsure (1)..(129): unsure at all Xaa locations
  Clone ID: PAT_TA_25217.pep
TKAMATDERPIDPSCPCMVCKNXTRAYLHCLVTKDPMGSQLLSYHNLSFMARLSRDLHMSILEGRFPEFVRGFLRVQFPKGDVPKWVHNAMEVAGIDISECCTPTNCQHDAMEAAGVDISDFCPPTKCP

SEQ ID NO: 130800 - protein, 193 aa, Triticum aestivum
  Clone ID: PAT_TA_25218.pep
MASPAPVPASPGSSSQKKRGATESIGLYAVQCCECHKWRTVSTKDEFETIRENFTEDPWFCSKRPECSCEDPPDIEYDSSRIWVIDKPNIPKPPPKTERLVIMRGDLSKMDIYYVLPNGKRARGIGDVQKFLDTNPEYKDRISAESFSFTVPKIVEETVSQSSLWKTKKAKKQDKINASSSKKDKANASSSEN

SEQ ID NO: 130801 - protein, 160 aa, Triticum aestivum
  Clone ID: PAT_TA_25219.pep
MADHHRDRGVLGGGGAFGDRSGHGGYGGDHHEQHQQKQPALMCALKAATAATAAGSMLLLSGLILAGTVIALTVATPVLVIFSPVLVPAAIALALMSAGFVTSGGLGVAALSVFSWMYKYLTGKHPPGADQLDHAKARLASKARDIKDAAQTRIDQAQGA

SEQ ID NO: 130802 - protein, 137 aa, Triticum aestivum
  Clone ID: PAT_TA_25220.pep
MSVEILDGKTVQSFVEDEGAFHSSVDSRFAALDTNHDGLLSYSEMAQELMSLRVLEKHFGVDESAMSRGELVELYRGLFARFDRDGNGTVDLEEFRAEMKEVMLAVANGLGFLPVQMVVEEGSFLKVAVDRELAKAT

SEQ ID NO: 130803 - protein, 367 aa, Triticum aestivum
  Clone ID: PAT_TA_25221.pep
SGVPEVGWCVSVLIASAISQDAAVSALVKALGAAFPPLSLYGVKSDTCRTLARLSAVGERGFCGMASALGLQKLRCMSITSCPGVTELALVSIAKFCPSLKQLYLRKCSQISDGLLKDFAEAAKVLENLQIEECNRITLMGILSFLLNCSPKFKTLSLVKCTGIKDICSAPAQLPVCKSLRSLTIKQCPGFTDASLAVVGMICPHLENLDLSGLGAVTDDGLLPLIRSSESGLVHVDLNGCENLTDAAISALVKAHGTSLAHLSLEGCSKITDASLFAISESCSELAELDLSNCMVSDYGVAVLASAERLKLRVLSLSGCLKVTPKSVPFLGSMPASLEGLNLQFNFIGNHNIASLEKQLWWCDILA

SEQ ID NO: 130804 - protein, 108 aa, Triticum aestivum
  Clone ID: PAT_TA_25222.pep
MQGAPVDSPGAAEAAARPSRYESHKRRDWHTFGQYLRNHRPPLELSRCTGAHVLEFLRYLDQFGKTKVHAAGCPFFGHPSPPGAVPRARLRQGPRGSLDALVGRPPAA

SEQ ID NO: 130805 - protein, 181 aa, Triticum aestivum
  unsure (1)..(181): unsure at all Xaa locations
  Clone ID: PAT_TA_25223.pep
AWGRRNSSNKRPDAIRCQICGKPGHTAKDCWYRFDDDGDSSSDEKVAGAADGSYGVDTNWYVDSGATNHITGELEKVTMREKYRGKDHIHTGSGEXTKKVLYRGRCVRGLYPLIPEIRRFNKQVFSATKLSSTRWHDRLGHAAFPLVKHLLRKNKLSYVGEHNVETICDSCQKAKSHQLPY

SEQ ID NO: 130806 - protein, 69 aa, Triticum aestivum
  Clone ID: PAT_TA_25224.pep
RHFLPPALRPPRAGGRTCRAPTPPASGAPCRRPPPRGPPSPPPAASPSSPPRSPPPPPSSPSPCAPPSR

SEQ ID NO: 130807 - protein, 259 aa, Triticum aestivum
  Clone ID: PAT_TA_25225.pep
PPAGAMDRKRINDALDRHLRAATERSSPSTSRAAAKPKPPSAAAPKPKEQLDSDSSEGGSAGGPSEADDTFWINWFCAMRGNEFFAEVDDDYIQDDFNLCGLSAQVPYYDHALDLILDLEPVQGDVFADDQNELIVASAEMLYGLIHARYILTTKGLAAMLEKFKNCDFGRCPRVSCSGQPCLPMGQSDIPRSSTVKIYCPKCEDLYYPRSKHQANTDGAYFGTTFPHIFMMTHSQLKPQKPAQQYVPRIFGFKVHKKT

SEQ ID NO: 130808 - protein, 122 aa, Triticum aestivum
  unsure (1)..(122): unsure at all Xaa locations
  Clone ID: PAT_TA_25226.pep
EEMLYRLIRARXILTPKHFDNTLVNFKNCVFGRGPRVFGTGQPCIPRGHPDISRXSRSVKIYCPKCGDLYYPRSKHQANTDGAYFGTTFPHIFMMTHSQLKPQKPAQQYVPRIFGFKVHKKT

SEQ ID NO: 130809 - protein, 119 aa, Triticum aestivum
  Clone ID: PAT_TA_25227.pep
CIINRPISTRSQWRTHKQILLLLFLVLVLIHVLVLGVLHLLLVLYHNSRCMRQTWARSAAAGTGFRGTRAGEAAGEGARGEGGGPWALAPSLRGGGRGRGCRRRKGELAFRPPRPASSG

SEQ ID NO: 130810 - protein, 146 aa, Triticum aestivum
  Clone ID: PAT_TA_25228.pep
RAGWQCHHPLQAPAIPSPPRLVVPHAADAAPVTSSSPSSSSSPSSSRFFRRAKAWRHPCKLSSEKWWRVLYWHAGKPGNFFPSVPTCFRFPLLANCCPCSRCFRSLRSTFRLFVSRFVANFKAIRSIDVIYHREIDMAIQILYNYV

SEQ ID NO: 130811 - protein, 250 aa, Triticum aestivum
  Clone ID: PAT_TA_25229.pep
EAAPEARGGYLDKVAAATQRNEWRQSLDAQASECGKALAAAQSETTVRERKKAFCPPSPPTHAPPATPAPNTGNRPRVRDTGAAAPVVCWPPIRSFRRNLASTSASKQPPEPQIGEADAKAVLDCKKSPLVKINMDGIPIGRKVDLAACDSYERLSLAVKDLFHGFLQVQRDPSKVERTQQGADEKIFSQLLDGSGEYTLVYEDSEGDRMLVGDVPWNVFVSTAKRLRVLRSSELSHGLIGATPERAANG

SEQ ID NO: 130812 - protein, 103 aa, Triticum aestivum
  unsure (1)..(103): unsure at all Xaa locations
  Clone ID: PAT_TA_25230.pep
MADLASTCKDKLAYFRIKELKDILHQLGLPKQGKXSKDLIDRVLALLSDEQGQRHHGWGRKNSFTKGAVAKIXXGIYXXXMQIQFAPXXNTKSTLGXIFPAKN

SEQ ID NO: 130813 - protein, 130 aa, Triticum aestivum
  unsure (1)..(130): unsure at all Xaa locations
  Clone ID: PAT_TA_25231.pep
MKTFLIFVLLAMAMSIVTAARQLNPSKQELQSPQQLYPQQPYPQQPDQPLPPLPQPLLSHPHQPLPQLPRRPFPLXPQQPFPQQPSTNNXLXQPQXPSPLQXXLVPQLQXPLSQQPXXXFPNLHSPIIHS

SEQ ID NO: 130814 - protein, 198 aa, Triticum aestivum
  Clone ID: PAT_TA_25232.pep
QHQIQQQQQQLQQLQQQQLQQHQMQMQPQGQQLQQPQQQQQRQQQQRQAQQEQHQQQQQQPQQRDQQQPQMQQQQLQQQQQMLQLQQQQQQQQQHQQQMQQLQQQMQQQQHQQQQQQQQIQQQQQMQQQQQQQQQQQMQQMQQQQQQQPQQLQQQPQMVGTGMGQQQFMQGHGRAVQMMQGKIAPQGPGNMSGGGYLS

SEQ ID NO: 130815 - protein, 176 aa, Triticum aestivum
  Clone ID: PAT_TA_25233.pep
VTYPVLSARRSTSHNLQIYPPFRQFPIVCYARARLIPTPTRGRAGRVVRIGRWRRARRGGGASGPTPEREKQGRAPTALRGRRSEGGRANSRSPVSGIVGRVFRLPSCSSCATNGGGLAELGAAVFTSPGTTTGYKPAGPLPGECSSRCQGEAAVSLRTAARGGGGDPAKGMEVTR

SEQ ID NO: 130816 - protein, 189 aa, Triticum aestivum
  unsure (1)..(189): unsure at all Xaa locations
  Clone ID: PAT_TA_25234.pep
MPPPPMPFDRYSALDSVGGSEKYFDHHHHHQFHHHSHLMPNANASSAPAICEGVDFVHRQQSEQHLGDRMPTQDKHSFNNVEVNIVNACDLFKQPLRASRPDHIVIILRGLPGSGKSYLAKALRDLEVXEWXGSATRIHSMDDXFMIEGEKKVQDNEXXNPSTGSKGRXTVXKKVXXYXYEPEMXGDLQ

SEQ ID NO: 130817 - protein, 139 aa, Triticum aestivum
  Clone ID: PAT_TA_25235.pep
VATLLAFLLQIPPPASPYPAQVPTSNLGAHAHFFRCPWLQIPSAPAGRSWISPSTRPNLNEGLVILFVLSKPKADTHPLSPKSPNSMVARASSPAADAAPLPPGRFSSGEIFLQPPAKKPIYLLRRPPSVCKHLGAGLC

SEQ ID NO: 130818 - protein, 265 aa, Triticum aestivum
  unsure (1)..(265): unsure at all Xaa locations
  Clone ID: PAT_TA_25236.pep
AGQQKRRQRGIEKVLLMAETIGLKVIEASKHDLNMVVDNRPHQGLVLDASPLEMVNSKELERVRVRGGKAPVWIALDEVMDPQNLGAIIRSAYFFGAEGVVLCAKNSAPLSGVVSKASAGSLELIELLSCRNMMQFLSSSAENGWRVLGGTVAPKAIPLXDYTTGEPTILVLGSEGTGLRPLVERSCTHLVKIAGNADGFVVEEEIDATDADIGEEGDNYSGNQDMKSFLAVESLNVSVAAGVLLYHLAGKNAHPVTEKPSISPV

SEQ ID NO: 130819 - protein, 89 aa, Triticum aestivum
  unsure (1)..(89): unsure at all Xaa locations
  Clone ID: PAT_TA_25237.pep
MPSLQXALPPELADNALRLYRECLRRAKFIGSQQHNTGLLVSMVRQQFKKNMHETDPEKIQKMKDDAARGLINHIIYESEKMTGRKFSG

SEQ ID NO: 130820 - protein, 201 aa, Triticum aestivum
  unsure (1)..(201): unsure at all Xaa locations
  Clone ID: PAT_TA_25238.pep
GRPARKGLTRAAKSLHQKLSKKLLLQSSVPTAVLYHGSVTDFDSRLYGFDIGTCLEVIEHVEEDQASLFGNVVLSSFCPAVLIVSTPNYEYNPILQRSALPNKEEEQEQDAGPCKFRNHDHKFEWTRSQFQRWATGLAASHNYSVEFCGVGGSSDEPGYASQIVVFRRMARDQGESSRNEDDSHQPYEXLWECPDPPAPSL

SEQ ID NO: 130821 - protein, 74 aa, Triticum aestivum
  Clone ID: PAT_TA_25239.pep
EVSYGVEFTPDAEGGYTVIVQKTRKVPANEEPIMKGSFKASEPGKVVLIVNNPTSKKKKLLCRFKVKSSTESSA

SEQ ID NO: 130822 - protein, 380 aa, Triticum aestivum
  Clone ID: PAT_TA_25240.pep
EEEGTKTVEAIEETAVPAASEPEAAPAAEPKEELIWGVPLVGGDERSDTVLLKFLRAREFKVKEAMAMLKAAVLWRKSFGIDALLGADLGVPELENVVFYRGADREGHPVCYNVYSEFQDKDLYEKAFGDDEKRERFLRWRIQLLERGIREQLDFSPSGICSMVQVTDLKNSPPMLGKHRAHRAVTRQAVALLQDNYPEFIAKKVFINVPWWYLAANKMMSPFLTQRTKSKFVFASQAKSPETLFRYIAPEQVPVQFGGLFKEDDPDFTTSDSVTELTIKASSKEAIEIPVTENSTIVWELRVLGWEVSHGAEFTPDAEGAYTVIVQKTRKVPANEEPIMKGSFKAGEAGKIVLTVSNAASKKKKLLYRSKVKSSAGESL

SEQ ID NO: 130823 - protein, 173 aa, Triticum aestivum
  Clone ID: PAT_TA_25241.pep
PNTHTHTGHVRTHDKTQLMHGSCRKKTKQNKTVTRGHKRVPYLNTHALATPAGRRVLVMHGVAVLEDRALRRLVFHGGAVGHPLIENEIKMPLHRPVPLYQEVDGAALPVAPDLQPPGFVNLQAEAAWLHAWPALDGELGLTAHVEPGTSGTLQGFHGDAAHDLGAEHGECEI

SEQ ID NO: 130824 - protein, 160 aa, Triticum aestivum
  Clone ID: PAT_TA_25242.pep
LATAAMAAAKLALVILVAAAVACTGNSQSPVQLCDYEFVVSTFNENWAGTDSDLTFTVFSTEVVGGVALKTIQSAAGSRFDVGSKTKFTIQGGPCVKPCGLRLEVHKTWWLEIGSDWKCRSVDLLVKRNGAVQWHFYLIFNQWVKDGSPVEYKPAQCPIL

SEQ ID NO: 130825 - protein, 152 aa, Triticum aestivum
  unsure (1)..(152): unsure at all Xaa locations
  Clone ID: PAT_TA_25243.pep
HGVXVDQQNRPQDLLLDWFFHPVLVLKDQIQVLKMTEQEVKFLEKSTLFVGSSSATASADVWDNGAETPRDPVRTAQTQATGWQDGGDSEEHVQVPDVPQAIQACGEATGGVRGGAGRVVRVVGVRSVGLLRNHTPRSVDNAVVFCFFFVSI

SEQ ID NO: 130826 - protein, 174 aa, Triticum aestivum
  Clone ID: PAT_TA_25244.pep
MASPTGSSRSSKIPEFLAGSGGRPVPALGIGTASFPFVAEDVKNAVLAALELGYRHLDTASVYPSEHLVGEAVAEAGRRGVIASREEVFVTTKVWCTQCHPDLVLPSLKESLQNLQMEYVDLYLVHWPMSVKPSKPHFPMKREDIVQMDLKGVWQAMEECHRLGLAKMIGVSNL

SEQ ID NO: 130827 - protein, 57 aa, Triticum aestivum
  Clone ID: PAT_TA_25245.pep
TARQPNHIHSKNSNCSHANTKFQQSCLVRKNITSISSKHYMHFVQKSSNMTSKKMYY

SEQ ID NO: 130828 - protein, 84 aa, Triticum aestivum
  Clone ID: PAT_TA_25246.pep
TTLHSPVHDFEVQESWHVSLVPPHSHDLICETSPQVIKQYPTESRRQVKPIDIANVVYNANTTLLHANRPLVQLHSQKFALFAS

SEQ ID NO: 130829 - protein, 140 aa, Triticum aestivum
  Clone ID: PAT_TA_25247.pep
FFCTLSRAPCTSGAAPPGGGGRSGRRPRPGSRISPPAAVLRRRPSRHRGGSAGDSGGAGPAAGWCQAGDPWPGVPRVRGAREMRRPPQERRDRSRQSSRATPPPPRPGGPAREAAGAPIARGARRLRRECWGRRAEVPCL

SEQ ID NO: 130830 - protein, 227 aa, Triticum aestivum
  unsure (1)..(227): unsure at all Xaa locations
  Clone ID: PAT_TA_25248.pep
KKFPRPGRPPAPPTPAGVPPSPLPTASQTTPRGHLHLHRYGCAKYACPSSCVCCFCYPKVKYMCVQAHVCVVFCIQKSNIRLNRLMYMLFLVSKSQIYSLYKLMDVLFLLSKSQTYACPSSWCVLFFCARQWSMISKQRRIMKRRXRMRTTRMCTILCLRRNSHFDVKALGVAPCCMAASGCHRAVLSPWTAQSRSWPYSSSFDAQFFLSHICSICTLSIEESLFSS

SEQ ID NO: 130831 - protein, 117 aa, Triticum aestivum
  unsure (1)..(117): unsure at all Xaa locations
  Clone ID: PAT_TA_25249.pep
LPMAGGSPSPSQAGATPNRLKRKASASSAVASSSTSLGADEAADEGDIEELGEGCGPILGRRDTPSTAVDAAARFIDATVSRLXRPPPARLRXNSKVDHNLPLGVRTPKXEQNISEN

SEQ ID NO: 130832 - protein, 238 aa, Triticum aestivum
  unsure (1)..(238): unsure at all Xaa locations
  Clone ID: PAT_TA_25250.pep
GAYDESVFSPRFQYDYLYCGSSLYGNLSAGRMREWVAYHAHFFGXRSHFVFHDAGGVSPEVRAVLEPWIRAGRVTVQDIRAQAEFDSYYYNQFLVVNDCLHRYRHAANWTFFFDVDEYLYLPNGQALDQVLGRLSGYTQFTIEQNPMSTKLCVKNPRNDYSREWGFEKFVFRNSITRVRRDRKYAIQARNAYATGVHMSQNVYGRSTHKTEALIRYYHYHNSINVLGEPCQEFVPRPG

SEQ ID NO: 130833 - protein, 166 aa, Triticum aestivum
  unsure (1)..(166): unsure at all Xaa locations
  Clone ID: PAT_TA_25251.pep
MAQESLRLVCPPVSAHEGRLPRQYTLEGQGAKKDISPPLEWYGVPDGTRSLAVVVQDVDADERVPWTHWVVVNISPEEKGLPEGFSGAGGNANAGGGDGGVQEGVNDWKQPGWRGPVPDSHGHRIQFRLYALDDVLSLGNKVTVXDKVMEAIEGHVLGEAEITAVF

SEQ ID NO: 130834 - protein, 146 aa, Triticum aestivum
  Clone ID: PAT_TA_25252.pep
MATEVTLRRFDLSDVDAMMAWASDPEVAAFCRWAPFASTETEALLAHIRDTALSHQWYRAICLAGDARPVGSVSLEPTADPCRGELGYVVARAHWGRGVATAAVRAALAAVFGEVEGLARVEALVDVDNAASQRVAEKAGFRREGV

SEQ ID NO: 130835 - protein, 66 aa, Triticum aestivum
  Clone ID: PAT_TA_25253.pep
MNIKVVQDMEHHKSSNMKGMARWPHARNHHRHQARPPPPKPPPRPPPPKPPPRPPSLCQIGVTGVD

SEQ ID NO: 130836 - protein, 128 aa, Triticum aestivum
  Clone ID: PAT_TA_25254.pep
MNIKVVQDMKHDKSRNMKGMARWPHAQNHQARAPPPKPAPPPKAPPPPKPPPPPPPKPPSRPPPLCQIGVTRVDGEGVEPPVPGPSLPSATHSSNVGTCGGSPAGGGGGPICGGSVRLVQDANIAVII

SEQ ID NO: 130837 - protein, 228 aa, Triticum aestivum
  unsure (1)..(228): unsure at all Xaa locations
  Clone ID: PAT_TA_25255.pep
FPQQPQQPFPQTQQPQQPFPQQPQQPFPQTQQPQQPFPQLQQPQQPFPQPQQQLPQPQQPQQSFPQQQRPFIQPSLQQQLNPCKNILLQQCKPASLVSSLWSIIWPQSDCQVMRQQCCQQLAQIPQQLQCAAIHSVVHSIIMQQQQQQQQQQGMHIFLPLSQAATSGSRSLIQXGKASIQPQQPTQLGGVXSLGVCKXFHPMCNVFVQPDAPSMRDINISDWWQWKTK

SEQ ID NO: 130838 - protein, 140 aa, Triticum aestivum
  Clone ID: PAT_TA_25256.pep
STAECERLAFLDAYSGYHQIRLYGPDEIKTAFISPFGCFCYITMPFGLKNAGATFMRMIQKCLLTQISRNVEAYMDDIVVKSRKGSDLLTDLAETFANLRRYDIKLNPSKCTFGVPGRKLLDFLVSERGIDANPEKVSTI

SEQ ID NO: 130839 - protein, 75 aa, Triticum aestivum
  Clone ID: PAT_TA_25257.pep
MNLLSKMARIASYWVCFSSSRIHLHICRVQNFTCLNGKHLQQIIALEIKIARRGSLIASMVRLAAPEAHNHASSF

SEQ ID NO: 130840 - protein, 178 aa, Triticum aestivum
  unsure (1)..(178): unsure at all Xaa locations
  Clone ID: PAT_TA_25258.pep
EPGQGGPGQGGRYPKFPQQXLGQGQQXPGQWQQSGQGEQGHYPTSLQQPGQGQQGHYLASXQQQPGQGQQXGHYPASQQQXPGQGQQRALPSFSSSSPGQGQQGHXYPASQQEPGQGQQGQIPASQQQPGQGQQGHYPASLQQPGQGQQGHYPTSLQQLGQGQQTGQPGQKQQPGQGQ

SEQ ID NO: 130841 - protein, 454 aa, Triticum aestivum
  Clone ID: PAT_TA_25259.pep
PRVRFAYSNAKTEDLWAALEEGSGEPVKTLMHSWTKQQGYPVVSVKLKDGKLELEQTQFLSSGSEGVGQWVVPITLCCCSYSVQQKFLFRGKQDDFNLSGLVECQKKDDFWIKLNVDQTGFYRVSYDEELASRLRHAVETNILSAADRYGVLDDTYALCMAGKQKLVTLLHLIAAYKNETEYTVLAHAINTSLSIYEMMAVAAPEELVNMKKFLIDFLEPFAQRVGWDAKSGEGHLNALLRGTLLSALAELGHQSTIDEAVRRFNVFLEDRETPLLPPDVRKAAYVALMQTVNKSNKSGYESLLKIYRETDLSQEKVRVLGSLASSPDPDVVREALNFLLSSEVRNQDCIFVLRGVTAAAHEVAWTWLKENWDYIAETFTGHLLTYFITVTVSPLATDEKGDEAEEFFKSRTKASIARTVKQSIERVRIKAKWVKSTKGEADLGNVLKELAHKH

SEQ ID NO: 130842 - protein, 108 aa, Triticum aestivum
  Clone ID: PAT_TA_25260.pep
FNLSCKGLHRCSAPIRSKEGVLFMALTMHYSLPTVLGKESHPCCRKLLKASHFLYTLELPPSLRLGITICALRYCIVHQCIHSPCISHSFLMGVMFNLSCRVCILLFP

SEQ ID NO: 130843 - protein, 129 aa, Triticum aestivum
  unsure (1)..(129): unsure at all Xaa locations
  Clone ID: PAT_TA_25261.pep
VIVTNAATGQPTGSAYVEFLHTESAERALSLNGTSFMTRILKVVRRSSHEAAHFYGWPGSGRSSYARGRMAYPRGVLPGSSFRGRTPMKAGXRSFQWKREPSGTESNAGAKPDMSVALASAEQVLPPAT

SEQ ID NO: 130844 - protein, 197 aa, Triticum aestivum
  Clone ID: PAT_TA_25262.pep
MVKTAAAGSTGDGAVAAKQQQLGGKMRTYKGVRMRSWGAWVSEIRAPGQKTRIWLGSHSTAEAAARAYDAALLCLKGASAAADLNFPVRFPFDLPAAAMSPKSIQRVAAAAAAGASANVFDFAAADDSASANAVDFAGADDSASAVTPEYCSSFFQSPKCMEYAMMDPCSTFFAPAPIAMEDECSWEEGGDIALWSY

SEQ ID NO: 130845 - protein, 277 aa, Triticum aestivum
  Clone ID: PAT_TA_25263.pep
MADALDMSLDDLISKNKSSSQRGRGRRNPASGSGSGSASGGPAPAGRRFQARAATRAAAAPYHQFNFPPPAPAAFAYAAQQAHAHAHAQVMAMVAPPTGVETGTKLYISNLDYNVSNEDIKELFAEVGDLKRYSINYDKSGRSKGTAEVIFSRKSDALAALKRYNNVQLDGKPMKIEVIGTNIEAPPPPPAIFTLNTPTIGNFIPSYSGGRGRGGDGGRGWPRGRGGFGGRSAAGRGRGRGDVGRGQGRGGRGSQPVSANDLDADLDKYHSEAMQTS

SEQ ID NO: 130846 - protein, 303 aa, Triticum aestivum
  unsure (1)..(303): unsure at all Xaa locations
  Clone ID: PAT_TA_25264.pep
HSQKYQDWEDSFQTLYYMFRKNLLNIFYVYAAQFVALFINETVXEKQSCNAYLSQSTRGMRSLLRKQGVCFSMPLCKAKVEQATEVRLVEFSKIRTLNLGQTLHIDALSEVDNTTESLLSFTGNKSVHGLYDVLLNYKSFLNSLSATDVPVLYSPVPFQNGCLHIPEVICREMRKADTGLSSSTGLDEEPGSVFAPPPGNMCYSMEIKDVVIPPWVASGICAAMSSDTDRFDLTMGTEPSSMGLNAAFTSIGVSGQSKAPSESSPEGCEAIGIPSAVLVRSLHSASLRRLSYNHGEYLAHTTV

SEQ ID NO: 130847 - protein, 113 aa, Triticum aestivum
  unsure (1)..(113): unsure at all Xaa locations
  Clone ID: PAT_TA_25265.pep
MARAQVMLMAVALXVLMLAAVPRAAVGHPTAATFDSWVETLAWSYVQGRPRPXGNCCGGVQSSHNQARSPERFCQARXCNCLQGDLLPGIHISNEXDNARSFPPPTAGSLPPH

SEQ ID NO: 130848 - protein, 327 aa, Triticum aestivum
  unsure (1)..(327): unsure at all Xaa locations
  Clone ID: PAT_TA_25266.pep
MVLIERTPCAGAAPFSPLQRSTPRASREASPPSDPILPYLRSIKKAIDEIRAHPECYHAALEQLKIYVTECIDKYGDDYQYSTDPRLLKIWILYGDAVSDFDKVYAHLEEKRMFLEDALLYESYALFLCAQGRALEADKVYGIGISRKAEPLDHLKKMHINFLKQLEGIVEESDEDAQPKPSKIQKRSLVWXDPWSDSTMSNLLTKINGGLKKLTGYHKSNKIYSGKVPLTSSHNALKNKVVELGGKKYHIKGSSGTGAFAKLYKASVDGNTEEIVALKVQKPAFPWEFYMYRQLDMRISDIQRPSYGYAHEVHVFADVSVLVCNFL

SEQ ID NO: 130849 - protein, 69 aa, Triticum aestivum
  Clone ID: PAT_TA_25267.pep
PRVRPRVRGRVGNIELLVTTRISVLAKRDTFLNELVEKRVTWYQEGKCQSPCIAADVGQENCLCTLHKS

SEQ ID NO: 130850 - protein, 189 aa, Triticum aestivum
  unsure (1)..(189): unsure at all Xaa locations
  Clone ID: PAT_TA_25268.pep
ILGIRYVSVSGHKFVGCPLPRGXVSLMGASMPLVXSSLVGVLGSENAKVRVRKSGHSCILLWYTLNRWDYRVLTLVGAVFTTFQIVQNAHYLNDRLKDAGISAMLNELSSTVVFERPKDEEFVRRWQLACEGSISHVVVMPSVTVDKLDTFLNELVEKRVTWYQEGKCQSPCIAADVGQENCLCTLHKT

SEQ ID NO: 130851 - protein, 109 aa, Triticum aestivum
  Clone ID: PAT_TA_25269.pep
MVCLQIRVTSGTTDNQHTNSKRIKHDTVSTVSGDATPSANGHSNGHDTRGAAEQSSKELESLKEMNKAMQQELNELHERYSEISLKFAEVEGERQQLVMTVRTLKNSLR

SEQ ID NO: 130852 - protein, 126 aa, Triticum aestivum
  Clone ID: PAT_TA_25270.pep
MAFRRPSCVILGALLAVSFLAATAAACDHGLTVFWGRNKDEGSLGEACDTGIYNTVIISFYSVFGHGKYWGDLSGHPLYGIGADIKQCRGKGIVVLLSIGGGGTQYSLPSSQSAADVADNLWNAHL

SEQ ID NO: 130853 - protein, 99 aa, Triticum aestivum
  Clone ID: PAT_TA_25271.pep
MASGGGKTTASSWAAAMSVGAGTVEALKERHAGLCRWNHQALPCVFQQRPGTWAAGNGACGKGKAATTAGGMAARRKARQEQEEELRTVMYLSNWGPNN

SEQ ID NO: 130854 - protein, 116 aa, Triticum aestivum
  Clone ID: PAT_TA_25272.pep
QASVAHDPISNPTLGHVASGGGKVTALSWAAAMSVGAGAGTVQALKGRHAGLCRWNYHALPCVQQHTGTAVAGNGKTMAAPAAGGAAARRRKARKEEEEEEELRTVMYLSNWGPNN

SEQ ID NO: 130855 - protein, 257 aa, Triticum aestivum
  Clone ID: PAT_TA_25273.pep
MRAPSFQIPHHIPILLLSNQTFSERYQLPSILLPSPPRFPSIGSGGVFPGYPCVSVCMGLDVGEIGMPLDLGLDLKLFVAKTAGRLAAAKEAPAVDACIRGLEEERRKIEVFRRELPLCARLLADVIEFMKEEAAKRSERRDADDNDKRKWMSTAQLWVDTRATDAADPVKEQKKESSLSKPMLLGGAIGAPMAVSCRAMPPPAAPQYFGRDDKIVGSQGLLALPMISPAANRQFSPPADDRHQAFAAKFAAPMPPP

SEQ ID NO: 130856 - protein, 88 aa, Triticum aestivum
  Clone ID: PAT_TA_25274.pep
PPGPQAVVTAKEVTSAEREPATAAGPVRYAIWYPALHSQHKVVSVTHIKGFFLDLQIMVFQTQYTDCSFCELVLYKKIIEPFQLSLCH

SEQ ID NO: 130857 - protein, 91 aa, Triticum aestivum
  Clone ID: PAT_TA_25275.pep
VLPVSSNTVRSSTKLFGLVCSFGAAVLPYPFFKTGSARGFDHWFPGRTSGLDGLAERMRSQRRCKHIQYAHVYMFLMPCTMQVAQGRCFKK

SEQ ID NO: 130858 - protein, 176 aa, Triticum aestivum
  Clone ID: PAT_TA_25276.pep
TNPSTQIGNQSAAMSSSNDAPVSPRSQLVLSCFEELLDFAQADVASERHRGARLRPQPHALPPTSCSSVFGPLASPGTTPTQRTLAPAGSRDAGSTWARRSFSGRRTPPSPQSSSTACTIAAPSSRAAQPRTSRSAWAKAAKLAQRPRGAAQLDGTETATGRSIATIHSRSPDRKL

SEQ ID NO: 130859 - protein, 59 aa, Triticum aestivum
  Clone ID: PAT_TA_25277.pep
VSIILEVAYNVLNRKYFDNFSFINFIYVIKVYFILFCFYLYILLKFVLFCFKLLIYFIL

SEQ ID NO: 130860 - protein, 101 aa, Triticum aestivum
  unsure (1)..(101): unsure at all Xaa locations
  Clone ID: PAT_TA_25278.pep
XCVPLXDLAAEFRMRTQXCINRIVTXWXSMDRLSGVMDDRGKFIYISTEEMKAVAEYIRKQGRVSISHLANNSNQFIDLEPKAQYEVESLQDDSAEAGTEA

SEQ ID NO: 130861 - protein, 231 aa, Triticum aestivum
  Clone ID: PAT_TA_25279.pep
MILPYHVAAHGGTSASMNPRSDPKEKRVNTVQAKGKEPIGEKMSKQGKEEDNAETTKQGKEPISSETTKQGKEPITTKQGKEPISSGTTKQGKEPISSETTKRPRGRPRKIPKQTNETTLDCAKISDKETTHIEIASNKEPKKESDTETGEKMSKENAPEDNEMEKHAMATQKVDNESDLARTLSSLRRGSMDSEMRERENGDLAEASARSASSAVKKFYKRRNSNQSFKK

SEQ ID NO: 130862 - protein, 237 aa, Triticum aestivum
  unsure (1)..(237): unsure at all Xaa locations
  Clone ID: PAT_TA_25280.pep
FALTPPRVTAWVFRTAGTLNGVREHESREGVGAGAGAGQPFVVRSKVRILLCDSDPDSSQAVLRHHCTCSYQVTCAKSPRQVINVLNCEGAEIDIILAEVDLAVSKCFKLLXYIGRNKELRHIPIIMMSNRDEVSVVVKCLRLGAAEYLVKPLRMNELLNLWTHVWRRRRMLGLAEKNFFIDNLELVLSEPSDANTNSTTLLSDETDDKPRGNRNHETITSSQHEYESPAMDPPKTD

SEQ ID NO: 130863 - protein, 65 aa, Triticum aestivum
  unsure (1)..(65): unsure at all Xaa locations
  Clone ID: PAT_TA_25281.pep
VMTEQRPRMQSRPMVLPLGLGDAAIIATGPRRLHAAAGFYRXVHLRHAISRSSPWASGWVWSCCC

SEQ ID NO: 130864 - protein, 183 aa, Triticum aestivum
  unsure (1)..(183): unsure at all Xaa locations
  Clone ID: PAT_TA_25282.pep
EQILXDAYNKYMFDDVGLPXWFAEDEQEHTVPMKPITKEEVAAMKAQFREIDARPSKKVAEAKARKKRVAAKKLEKARQKADIVADQSDINEQSKAKMIDKIYRKAVSTQRPKKEYVVAKKGVQVRTGKGKVLVDPRMKKDKRSAGSGKKGGKGKKGAGGGQKKGGKAGGGGRKAGGGKGGPR

SEQ ID NO: 130865 - protein, 103 aa, Triticum aestivum; identical to SEQ ID NO: 107316
  Clone ID: PAT_TA_25283.pep

SEQ ID NO: 130866 - protein, 165 aa, Triticum aestivum
  Clone ID: PAT_TA_25284.pep
MERRRAAWAAVLVAVAACAALPATTTANKIKVNWLPNTNYSGWEQEHGPFYKGDWLVFYYTAGQADVVEVNESGYNRCDASNAIYNYSKGRSFAFELNETKTYYFICSFGYCPGGMRLAIKSQKLPPPSPPPSAQHHRSAALAGPRAGVALYAAVAVLAALLRAV

SEQ ID NO: 130867 - protein, 67 aa, Triticum aestivum
  Clone ID: PAT_TA_25285.pep
GDSRRRTPAPLGHQLTAGHASPGQRRRRRLQRCRRRHLQRCHLGLRRSDDHLGDILWPVVLNIASME

SEQ ID NO: 130868 - protein, 178 aa, Triticum aestivum
  Clone ID: PAT_TA_25286.pep
RCGPSSSSSSSSPPGRSRRCSPRRLPAPRPPPPESSSARRPPRAPLPRPRRRPGRRGSASTPPRGRTPAASAWRRPASRPPGSRRRRGGRRWTCSAPRPPDAGRTTRGSWPWPPRRPPRPPTCPPSPRPGAGPAPAPAPRRWAPEGTRPGCGSRSSSRFSYRCRYQCSVLCGRPRRPR

SEQ ID NO: 130869 - protein, 201 aa, Triticum aestivum
  Clone ID: PAT_TA_25287.pep
MWYTRRVEILFPLTSRIPSVRDWSVNGIICHAYSLPGQKFYERGLERDTASLKFQGRKALERKDYHSAIELYIKAMGLDYEDATLYSDRSVCFLQIGEGDKAFADAYTCRMMRPDWPKACYRQGASLMLMKDYEKACGALFDGLKMDPRNLEIENALRHAISFIQFYCTLYFIQDANSATLAVTRAKNSLKHDPQGLFSTC

SEQ ID NO: 130870 - protein, 234 aa, Triticum aestivum
  unsure (1)..(234): unsure at all Xaa locations
  Clone ID: PAT_TA_25288.pep
KCVKLLIQAGADVNGVXYITPLIAAVGLTECMKCLLEAGADPNVPDEFGRMPIEFAAICGTREDVEILFPLTSRIPAVRDWSVNGIICHAYSLPGQKFYERGLERDRASLKFQGRKALERKDYLSAIELYTKAMGLDYEDATLYSDRSLCFLQIGEGDKAFADAYTCRMMRPDFLQACYRQGASLMLMKDYEKACGALFDGLKMDRRNLQLENLIRVARDSLIGQRPAIGREHL

SEQ ID NO: 130871 - protein, 89 aa, Triticum aestivum
  Clone ID: PAT_TA_25289.pep
PFSFSFPGNQSLNQQVQFQPQLPPRRPFLLCIDIPLRLFRYLLYTFPVLVQEGFVGDFSFGFFMHSFGSVFSLPFFFFGLFFTNFLSYQ

SEQ ID NO: 130872 - protein, 104 aa, Triticum aestivum
  Clone ID: PAT_TA_25290.pep
EDATLLSDSQVVHVQASYLTVRYLIQASYSTGASQPSPSICLLILPHPLSLPVPRPAGRLATPPRHYVDRTAMERRRMDGIAGVLPDWGSARSAVVGSRLGLGQ

SEQ ID NO: 130873 - protein, 159 aa, Triticum aestivum
  Clone ID: PAT_TA_25291.pep
FDSKPRWMYNMQSYIVVKSLVSLDVYKKAGIVRRPKQQVGWELKKWKAWEDKRREAEDIRCRVHKHEHALFGNAEKMGKMYQSLQDKPHDVAERLRAELNQVLQDMPDNPSQPKSPRRLNWVEQKQDYEKLMARSVKLKERAQVMKQAHDNILEHHCKF

SEQ ID NO: 130874 - protein, 194 aa, Triticum aestivum
  Clone ID: PAT_TA_25292.pep
SARPPAGRARRPPRGRLREADRAHLRRDRSEQVTLELKLDKASFDQYKEVQAGLNNLQGRCGTSSDQIRALAVASAARDIKVDKQHVQCLLQIKKNTWKVACTVLLGASAVAFGVMNVVSAHSRDDNLKAADALFQKKIAKLEKDFNAKLDSTAKLAVGGCAGPSGHCRRATNRTSLLRALAAPPPEAQAAPLS

SEQ ID NO: 130875 - protein, 158 aa, Triticum aestivum
  Clone ID: PAT_TA_25293.pep
RSETRSGQNQGLCLIDWGRGIDVNLFPAGTEFLGDCGTSGFSCIEMQEERSWTYQVDTFGLCVVAHMMLHGEEMSIVKVAGTGGSYMYQPKLSFKRYWNVALWKQLFTTLLNPGSNGNHVGDLRSLRRSFQDYMCSNYQLLVKLNQLLTKQKASLCSS

SEQ ID NO: 130876 - protein, 106 aa, Triticum aestivum
  unsure (1)..(106): unsure at all Xaa locations
  Clone ID: PAT_TA_25294.pep
LPLPPLPLPHPRLEASLLFSLXSHRHRHILCGCNDRDGRMAMSSSPLRAFLAAMLLKLPPRSCDDIQPHTPPMPSAFQNLAGGQVPVGAPPPKCKNRXKSXTLEAG

SEQ ID NO: 130877 - protein, 85 aa, Triticum aestivum
  Clone ID: PAT_TA_25295.pep
QIQSMKLMGPDGYDKSVSDDTSTSETSSISLGQILNRRQAILTYSSDTSANNKFSGKRKKFAFTGLSVFLAKQAKSKKKRGSDEN

SEQ ID NO: 130878 - protein, 162 aa, Triticum aestivum
  unsure (1)..(162): unsure at all Xaa locations
  Clone ID: PAT_TA_25296.pep
MAAAAESDNGSEVGPTGDSGAFASPVKARERAPESEAGASAATASESSETRVDDGNIQEAESSLREGLSLNYEEARALLGRLEYQRGNVEGXALRVFDGIDLQAAIQRFQXAXFQKNQSSKRDNKLRPDSPISGSQHAASLVLEAIYLKAMSLXKLGKAIEA

SEQ ID NO: 130879 - protein, 203 aa, Triticum aestivum
  Clone ID: PAT_TA_25297.pep
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLNEIDRYASENVNKLLVGNKCDLAESRVVSYEAGKALADEIGIPFLETSAKDATNVEKAFMTMAAEIKNRMASQPAGNASKPATVQMRGQPVAQQNGCCSS

SEQ ID NO: 130880 - protein, 177 aa, Triticum aestivum
  unsure (1)..(177): unsure at all Xaa locations
  Clone ID: PAT_TA_25298.pep
FISGEAISVLLGVDFKIRTVEQDGKXTIKLQIWDTAGQERFRTITSSYYRGAHGIIVVYDVTDQESFNNVKQWLNEIDRYASXENVNKLLVXGNKCDLAESRSGFLRGWPTALADEIGIPFLETSAKDATNVEKAFMTMAAEIKNRMASQPAGNASKPATVQMRGQPVAQQNGCCSS

SEQ ID NO: 130881 - protein, 163 aa, Triticum aestivum
  unsure (1)..(163): unsure at all Xaa locations
  Clone ID: PAT_TA_25299.pep
MPMEQAFMHCDKDTLKMAMLKHEETFRQQVHDLHRLYRIQKLLMRDLKREIKSQQSDLSASPNGSPXAEYDHRRRASALDASSYEQHWQYGATRRGSHAAATPRAAQLSPGRRPTTKKPDWSSRSPWSGKRDSDGHCSPGESFSSFTTEWTRRAANCSRRRRP

SEQ ID NO: 130882 - protein, 158 aa, Triticum aestivum
  unsure (1)..(158): unsure at all Xaa locations
  Clone ID: PAT_TA_25300.pep
MGFPAAYSEMPRLLLNLLFLLGHLRRLSSWLLRLVGAGVDDDXSSFDYSDTAAVAYFADHHLRARTTTTHHGHGLEELEEHSPAVRFDALPSDGDDGTAPLLPEGCAVCPGDFTGAXRGAPGARVRKSFNGGAQRWAANATNWPVRGSAGPGFSNPFG

SEQ ID NO: 130883 - protein, 57 aa, Triticum aestivum
  Clone ID: PAT_TA_25301.pep
GSLNSASAGILIYMSLVDLLATPRADPGPRTNTKLQLMTYLALFLGAGMMSMLAIWA

SEQ ID NO: 130884 - protein, 630 aa, Triticum aestivum
  Clone ID: PAT_TA_25302.pep
MDKTSHGLGFGDSINSLNTSQYQSAVEHTAQHRDTTLDSTSYSSFSFTNTKALKRKWGTMAGAEGTGDALLTLGLGRSPSSSDDSKVSSATACAMSPCSLKEADEESSVDLSLNFELSLGNDVAHFQRKSSAGLVAKSPKLDLQLSLSTGSPESAVTCTNMVSPNIHDGLDIPVTYSLPAIIGNGSAPSSWGFEHSVISSSYASEATYAFPFSKIPRQENGTLSSPVISSTLPASVKSSVACTSVVTNPQQRNLNTKTCQFPGCGKGARGASGHCIAHGGGRRCQKPGCQKGAEGRTIYCKAHGGGRRCEFLGCTKSAEGRTDHCIAHGGGRRCSNDGCSRAARGRSGLCIRHGGGKRCQQEKCTKSAEGHSGLCISHGGGRRCQFPECAKGAQGSTKFCKAHGGGKRCTFLGCTKGAEGSTPYCKGHGGGKRCLFEGGGVCPKSVHGGTQYCVAHGGGKRCAISDCTKSARGRTEYCVRHGGGKRCRFDGCVKSAQGSTDFCKAHGGGKRCSWGLPDSSFGIGTEQCDKFARSKTGLCSAHTALVQDHCVHGGGTLGPVIHHFATDVKPDEMEVAAAVKVDPVSMQSEPPLPEGRVHGGGLLALLSRGGNHTGPVGNSENGASVMMAWM

SEQ ID NO: 130885 - protein, 120 aa, Triticum aestivum
  Clone ID: PAT_TA_25303.pep
AHNGRVKGVLFLMPCHSTPYYSTLHSSLPMRFLDCTPSDNKGTLDESDRFLMNPLDFVGEVFGNLSSFSHIVLFESEERHVIQLLLHDSFQEVRRFFHSHFKIDRDLQSSVVVYSRRDVL

SEQ ID NO: 130886 - protein, 84 aa, Triticum aestivum
  Clone ID: PAT_TA_25304.pep
MSREASRKLLLAALLLVLLLAATGEMGGPVAVAEARTCEAKSHRFRGPCVRHRNCANVCKTEGFPGGKCRGFRHRCFCTTHCRQ

SEQ ID NO: 130887 - protein, 82 aa, Triticum aestivum
  Clone ID: PAT_TA_25305.pep
MEASRRLLSAALLLVLLLAATGELGGPVMVAEARTCESRSHRFRGPCVRRSNCANVCKTEGFPDGKCRGFRRRCFCTTHCHH

SEQ ID NO: 130888 - protein, 82 aa, Triticum aestivum
  unsure (1)..(82): unsure at all Xaa locations
  Clone ID: PAT_TA_25306.pep
MEASRXLLSAALLLVLLLAAAGELGGPVMVAEARMCESRGHRFRGPCVRRSNCANGCKTQGFPDGKCRGFRRPCFCTTHCHH

SEQ ID NO: 130889 - protein, 149 aa, Triticum aestivum
  Clone ID: PAT_TA_25307.pep
TFLFTPDDPRGVVEYERHFHSCISSAYAFQYASWIMERSFQNIRCTGNVLCTFDSFTNFESPWVSAPHVHANCECLGYFRSYHAKLQHSTMSLSGSQNACEWQPNIGDAEANSTEVVPLLCLEASVAVHATCCREVEPRCLINDTGRAL

SEQ ID NO: 130890 - protein, 322 aa, Triticum aestivum
  unsure (1)..(322): unsure at all Xaa locations
  Clone ID: PAT_TA_25308.pep
MFIQKAWRTAAFGLYGFTQFTKSGFVEHAKKFREEDMQIRLDGKNCLVTGANSGLGYATAQGLASHGATVYMLCRNKERGETALNEIRSKTGNMNVHLEICDLSSINEVKSFATKFSSLEKPLHVLVNNAGLLEHKRTTTPEGLELNFAVNVAATYTLTELVMPLLEKAAPDARVITVASGGMFTGPLNTNLQTAKAIYTGQXYARNKRXQVALTEWWLEKYRQGCRFYSMHQGWADTLDPNKCWSTENFRNSGNLRSKKDRADEPGWLGLQPXQELTNGYFXLDRAEAQKHLKFPGTAASHKKIGSIVDSTRATCNLPANP

SEQ ID NO: 130891 - protein, 79 aa, Triticum aestivum
  unsure (1)..(79): unsure at all Xaa locations
  Clone ID: PAT_TA_25309.pep
GPIVRWARESFIGEQRTPEXFIGKEAVITSQCLNGWYLVKALDSGESTRLQYRSLRKVPELQLQTQARLQPLAFLGGRQ

SEQ ID NO: 130892 - protein, 73 aa, Triticum aestivum
  Clone ID: PAT_TA_25310.pep
LYLLSTPVFKLHITYSDNQENMSTGPKSFSHQERECGDGPEQLDLLHDVDAPPARLRDGGQRARTPTEPVRGA

SEQ ID NO: 130893 - protein, 282 aa, Triticum aestivum
  unsure (1)..(282): unsure at all Xaa locations
  Clone ID: PAT_TA_25311.pep
PPPTEPQAPPPSVSPIIKPPTNPSPTSPTVPATPTAPSPPSTPGFGPPSLPTSPTTTPPTPIGPNMPQDPSLQDSSRSPSSHGLSNGTKAGIGIIVAILVLSLIAAGCWYKKKQRRMTGYHAGFVMPSPSPSASPQVLLGHSDKTKANYSAGSPEFKDTMSXEYSMGNCRFFTYEEMHNITNGFSDQNLLGEGGFGSVYKGCLPEGGEVAIKKLKDGXGQGEREFQAEVEIINRVHHRHLVSLVGYCISGDQRLLVYXFVPNDTLHYHLHGRGVPVLEWATK

SEQ ID NO: 130894 - protein, 73 aa, Triticum aestivum
  Clone ID: PAT_TA_25312.pep
FQNSLFLYQIIGLLHLQFQIFDCLCRGHVLHFSEREPRVNQFQKSSYIYVPVCVAELCKICEIYISICNLLFE

SEQ ID NO: 130895 - protein, 137 aa, Triticum aestivum
  unsure (1)..(137): unsure at all Xaa locations
  Clone ID: PAT_TA_25313.pep
MADPPLYPSGSAPHRDESTTDGSGRRLYNPYQDLNIPTAYKNLYDLPTSPEFLFQEEALVQRRSWGENLTYCTGVGYLSGAVAGAAVGLREAAHAAERGDTAKIRANXRLLNSCGSAGRPRXGNRLGVIGLLYAGHG

SEQ ID NO: 130896 - protein, 57 aa, Triticum aestivum
  Clone ID: PAT_TA_25314.pep
EARAILLKFEATLNFMMHVPYLLNFVHVRPLQTGPKHISRNPYNDNISPRLQTSPRC

SEQ ID NO: 130897 - protein, 136 aa, Triticum aestivum
  Clone ID: PAT_TA_25315.pep
MARPARRRVVEEEEEEEEEEESSGEEQQDQSDAGGSGSGEEEGGGGEAEEEVDEDEIEAVTTGAGADDEEEEEDGGEEDEEEEPESDDDDDEAEDPAGIPEVGKQERARLKQLQKLKKQKIQEILQTQNAAIDADM

SEQ ID NO: 130898 - protein, 178 aa, Triticum aestivum
  unsure (1)..(178): unsure at all Xaa locations
  Clone ID: PAT_TA_25316.pep
SSSKLRXGDVAVLGAGAAVTEPDLERLPYLQSVVKETLRLRMAIPLLVPHMNLSDAKLAGYDIPAESKILVNAWFLANDPKRWVRADEFRPERFLEEEKAVEAHGNDFRFVPFGVGRRSCPGIILALPIIGITLGRLVQNFQLLPPPGQDKIDTTEKPGQFSNQILKHATIVCKPLEA

SEQ ID NO: 130899 - protein, 506 aa, Triticum aestivum
  unsure (1)..(506): unsure at all Xaa locations
  Clone ID: PAT_TA_25317.pep
MDFVFVEKLLVGLLAAVVGAIVVSKIRGRKLRLPPGPFPVPIFGNWLQVGDDLNHRNLAAMARKFGEVFLLRMGQRNLVVVSSPPLAREVLHTQGVEFGSRTRNVVFDIFTGEGQDMVFTVYGDHWRKMRRIMTVPFFTNKVVQQYRPGWEAEAAFVVDNVRADPRAATDGVVLRRHLQLMMYNNMYRIMFDRRFESMDDPLFLRLRALNGERSRLAQSFEYNYGDFIPVLRPFLRGYLRLCKEVKDARLKLFKDYFLDERKKLVSTKATDNNGGLKCAIDHILEAEQKGEINEDNVLYIIENINVAAIETTLWSIEWGLAELVNHPEIQQKLRDEMDAVLGVGHQITXPDTHRLPYLQAVIKETLRLRMAIPLLVPHMNLQDAKLAGYNIPAESKILVNAWFLANNPEQWKRPDEFRPERFLEEEKHVEANGNDFRYLPFGVGRRSCPGIILALPILGITIGRLVQNFVLTPPPGQDKLDTTEKGGQFSLHILKHSTIVAKPRVF

SEQ ID NO: 130900 - protein, 147 aa, Triticum aestivum
  unsure (1)..(147): unsure at all Xaa locations
  Clone ID: PAT_TA_25318.pep
NEKTHPSGCNFRRIPPEPITRRATPRRGYDSPADXSKILVNAWFLANDPKRWVRADEFRPERFLEEEKAVEAHGNDFRFVPFGVGRRSCPGIILALPIIGITLGRLVQNFQLLPPPGQDKIDTTEKPGQFSNQILKHATIVCKPLEA

SEQ ID NO: 130901 - protein, 189 aa, Triticum aestivum
  Clone ID: PAT_TA_25319.pep
MRRTSSRLVSFSTGGPIACQGLSEEPCSPTFSCRSSFSAFSAARAPAPSCGALLFSFGDSPEPMKDAAPVVLMPSFSFFCGLGSDEPEPLVASGDITTEKGAHCVEDAAVVCLNTSSSALRRMAEAALRGAAVTRANPSSRSRRNHTIGAGDERGHQHDLDMAVAESVIRWASCTHLSTTLSLRASLVC

SEQ ID NO: 130902 - protein, 63 aa, Triticum aestivum
  unsure (1)..(63): unsure at all Xaa locations
  Clone ID: PAT_TA_25320.pep
LFXFVXAGLFLCYQSNIYNNKISTVNTTSSSLENCEAIHSYAGASSYSYKQIKAKKKQISRKK

SEQ ID NO: 130903 - protein, 101 aa, Triticum aestivum
  Clone ID: PAT_TA_25321.pep
MRSHDGGTAAPAPAASRAAAASRRSMPLRRAMVLGGEWSGGLGLWGSGAAIQEVIEEAMLTDKGMAVRQRAKVLGEAVRAAVADGGSSSKGLDDFVAYVTR

SEQ ID NO: 130904 - protein, 244 aa, Triticum aestivum
  Clone ID: PAT_TA_25322.pep
MASSARAAASAARSALRRAPLAASSSSSAAGILRRSAAAGLETRMPLHSAASAARLGSCITRDGNNAFSWNSRRMFSSNEKHLPAISDPKIETAFKDLMAASWNELPGSLVEEAKKAVSMATDDKAGQEALENVFRAAEACEEFSGVLVTLRMALDDLCGLTGENVGPLPGYLEEAVKSAYSRYMTYLESFGPEEHYLRKKVESELGTKMIHLKMRCSGIGSEWGKITLIGTSGISGSYVEMRA

SEQ ID NO: 130905 - protein, 211 aa, Triticum aestivum
  unsure (1)..(211): unsure at all Xaa locations
  Clone ID: PAT_TA_25323.pep
MTAETATQAELLRAVLEEQKLAAQGDEPVVEDDDDEEDEDDDDEDDKDDDVEGVDASGRSKQSRSEKKSRKAXMLKLGMKTITGVSRVTVKKEARNILFCXIPSHDVFKSPASDTYVIFGEXAKIEDLSSQLQSQAAEQFKAPGILAASSQTLRLSTAVQEDDEDCDETGVEPKDIELVMTQAGCAXRPRLCKALKSADGDIVSAIMELTN

SEQ ID NO: 130906 - protein, 249 aa, Triticum aestivum
  Clone ID: PAT_TA_25324.pep
FIVAEKGNFEPADSEKERMQAINIQKENGEESPLLKNTFAYTDEVKEKFNRILKHYVGTRNFHNFTTRTKAEDPAAKRYIISFTANSVVSLDGIDFVRCEVVGQSFMLHQIRKMVGLAVAVMRNCAPESIYDVAFRKDIRLNVPTAPEVGLHLDECMFTSYNSKWMDTHEAVSIEPYAEEAEEFKIKYIFPHIAAMEHKEGAVALWLHALNSRNYPDFRYMETAGSEAKVGAEVENMEEVQMPSNNISE

SEQ ID NO: 130907 - protein, 118 aa, Triticum aestivum
  Clone ID: PAT_TA_25325.pep
MARPLFLLALLATALAATSTLGRRGGLLGGWSPVPDVNDAHVQELGGWAVAQHPSLANDGLLFRRVTRGEQQVVSGMNYRLLVVAADGSGKSVIYLAQIYEHWSGTRKLTSFKPAAGG

SEQ ID NO: 130908 - protein, 160 aa, Triticum aestivum
  unsure (1)..(160): unsure at all Xaa locations
  Clone ID: PAT_TA_25326.pep
KDAIASLNATDLEKQRKLQEWSSATSYDKCVSHEQARDIAAGLGVGSVFWDWDLPRTREGFYRFQGSVASAVVRGRAFAPHADVLWMETSSPNIXECTAFAEGVRAAFPEAVLDPXLSPSFNWDASGMTDADMAGFIPHVAKLGVSLEFINGPGFEPAWS

SEQ ID NO: 130909 - protein, 299 aa, Triticum aestivum
  unsure (1)..(299): unsure at all Xaa locations
  Clone ID: PAT_TA_25327.pep
RALCFFLXEEQGQDIGFVQYPQNFDNVVHNDSYGNPINVVNELDNPCLDGWGGMCYYGTGCFHRRETLSGQIYSKDYKEDWARGVGIAENADELEETSKSLVTCTYEHNTPWGIEKGVRYGCPLEDVITGLQIQCRGWRSVYYNPARKGFLGMAPTSLGQILVQHKRWSEGFLQISLSNYSPFLLGHGKIKLGLQMGYSVCGFWALNSFPTFYYVIIPSLCFLSGVSVFPEXTSPWGIPSIYALGRFPRPRSLPRVRSRVGSRQPHWGACADTLLCGITPPDSRGPFDTWGWCPIFQLT

SEQ ID NO: 130910 - protein, 304 aa, Triticum aestivum
  Clone ID: PAT_TA_25328.pep
MNYIIGAFKPPCDIFVTFSDERSRKQVAVKKDNGKTTMVPAFQSLETIAGEVSIAPVPGKRIEHMGVKIELLGQIELYFDRGNFYDFTSLVRELDVPGEIYERKTYPFEFSTVEMPYESYNGTNVRLRYILKVTIGRNYVGNIVESRDFCVRNYSPLPSINNSIKMEVGIEDCLHIEFEYSKSKYHLKDVIVGKIYFLLVRIKIKNMELEIRRRESTGSGPNTYVETETLAKFELMDGAPVRGESIPVRLFLTPYELTPTYRNINNKFSVKYYLNLVLVDEEDRRYFKQQEINMFRLDETPQPS

SEQ ID NO: 130911 - protein, 127 aa, Triticum aestivum
  Clone ID: PAT_TA_25329.pep
MDTSAPSPFVNGETLKMFLGRRVRTVVQVQHNEGGVLLGLSTDGHQLTIRGASGAPEPPHYIEVIGIADSNLSIRAESCTDFGENFDGVAFNGAMQALRMTKYNYLFLVEFNITPGWGVNQAMLVNW

SEQ ID NO: 130912 - protein, 185 aa, Triticum aestivum
  Clone ID: PAT_TA_25330.pep
MAPWGSRSRSRLVPPVFRSPPLAVPPVFVVPPLAARIRMLAPAYEFMFGKLARGGLFDDLFHSLGDSHAHLNATMSTNGGEAHFRWPRDLNDPHTFVDLLVSTLKPTMRLSSSVYYPKYGIGAFGTFPLYMANAFCSAPFGVMGLACRSDYGVIGARYVPENLPIGAPFVAWLAAGEVPYGAWLV

SEQ ID NO: 130913 - protein, 266 aa, Triticum aestivum
  Clone ID: PAT_TA_25331.pep
MAAAVDLEDAFGAVFGEAKPEGHPTARPILFRAHARSAATLRVVATDCHSLAWGCSLSVSDLDDLRDDVGIGGSWVDFLDYLKSSLSSGEVKLLFAGDQLRKSTGSDGAKLVATKAKGLPLITISLHSVTGAVTSDVIAEFSLGLYGAYRTARELVSKEQEQMSQLMGSLSTEREKNEIMQKQLESLSFLDKRKATKPKLLADQVPSVSAVTLGSDQVTAPVQQQISVPSPSKAPPAKVTKRVAPTSRRARVRGALLQDNEDEDDN

SEQ ID NO: 130914 - protein, 76 aa, Triticum aestivum
  Clone ID: PAT_TA_25332.pep
MAGAGSSSGGGGGREGDWDYGGCGNRNYAFRSLYNRCKQLRLLVDPNTPRDSKWLPRAGDWICNDLISSCSAPARP

SEQ ID NO: 130915 - protein, 76 aa, Triticum aestivum
  unsure (1)..(76): unsure at all Xaa locations
  Clone ID: PAT_TA_25333.pep
RRSSRRAKRPWACCDHTQCLRVLPXACLCHDTVAQCASACQHCDEVSHGRYVCLDLYEGWPGPKCTHEVDVAAVGN

SEQ ID NO: 130916 - protein, 321 aa, Triticum aestivum
  Clone ID: PAT_TA_25334.pep
DAPCALGILMDQVDAPVRRTFQNVHQGHPRETMLRFLKAREWNVSKAHKMLVDSLNWRIENEIDSVLERPILPVDLYRSIRDSQLVGLSGYTKEGLPVFGIGVGQSTYDKASGHYYVQSHIQINEYRDRIILPMLTEKFGRPITTCVKVLDMTGFKLSALSQMKMLSSISTVDDLNYPEKSETYYIVNVPYIFSACWKVVKPLLQERTKKKVKVLSGCGRDELLKIMDYSALPHFCRREGSGSSKHSSSNADDCFSPDHPFHKELYELTNQQSSHKELLKMGSLHVSIPEPDPNDAKIVEVIQAEFHKMGEQNGSTNGHKV

SEQ ID NO: 130917 - protein, 299 aa, Triticum aestivum
  unsure (1)..(299): unsure at all Xaa locations
  Clone ID: PAT_TA_25335.pep
SLAYILADSGFDVWVANNRGTRWSSRHVSLDSSSRRYWDWSWDDLVVNDMPSMVDYICSHTAQKPHFLGHSMGTLVALAAFPAXRNGGQAQVGGAADPGRLSVPHDHPPRHTASQGIRRRXITILGVAEFNPVTPAVASLFKELCRHPGTNCYDLLTDFTGKNYCLNSSAVDVFLQYEPQPTSTKTMVHLAQTFRDGVLSKYDYVWPGVNVEKYGQPDPPAYNMSNIPPGFPLFLSYGGRDELADPVDVGRLLGDLRGHDPGRLTVQYLEQFAHADFVIGTCAKDYVYKDVVSFFNRFN

SEQ ID NO: 130918 - protein, 79 aa, Triticum aestivum
  Clone ID: PAT_TA_25336.pep
VKKGILVPCWTIELLYKQSAKLFLAKQVLRILTGKLSLHLLMMQIISTCALYTLRLSDHKFTVLCDRALLMQDCTCIML

SEQ ID NO: 130919 - protein, 153 aa, Triticum aestivum
  Clone ID: PAT_TA_25337.pep
KTKVMVQQNPQSFSTLRIMYWFLVERNGRQTLHIYCTDHEIDPRMGTPCREHIKFPDCLENKGHGSTESTKFQHSERKPLCRILMMVPRTLKILPNQTWRRDQYQKEFTTSMQVKVPLLTTYRVKTCWLGFEDIFEVFDSDLLDISSSSYVYV

SEQ ID NO: 130920 - protein, 258 aa, Triticum aestivum
  unsure (1)..(258): unsure at all Xaa locations
  Clone ID: PAT_TA_25338.pep
MARPSRQTLAPPSATSRRRLYGHSKPPPPPASAFRRAAAALLLAAAVALPCAVLYRAVVSNAPPLVQDRDLDPISADDLDSEYLKLEQVLQAASMDNKTIILTTLNAAWSSPGSVIDLYIDSFRHGVRTSSLLKHLVIIAFDRKAYRRCTEIHTYCYALVTGNVDFSQEKRFLTAGYLEMMWTRLDFLRLVLEKGYSFIFSDADIMWFRNPFPYFYPDGDLQVACDHYVGNATDLRNIAXNGGFNYVKSNNQSKRVLQ

SEQ ID NO: 130921 - protein, 152 aa, Triticum aestivum
  Clone ID: PAT_TA_25339.pep
AGIRFRARAGGKIQEDAMKLFESGLHDFWGSRNAGWSITSLSVTASKIFDIPSGTNSILKYIKGRSSDASSAILDSSSTPESTPSVDNKLYMTPVHEERCESSSMKEDCDNSNSAKQCSSIEGKGLPKKLPKVQVCRFFPPRGPPLCRRVGR

SEQ ID NO: 130922 - protein, 176 aa, Triticum aestivum
  Clone ID: PAT_TA_25340.pep
WCIPFIYVVAASYSWSLMESLQCGDTAEEWWEAQNAQIMRLMTTTILAAIDAIDGMVGVLESGFELSELVVELHESQRYERGKKGKMEFGRMFGMFVIITTIALFNLVCLVGRLGRVELRGGAEGLGPLFLQAVASVAIVVINAPVYEARIVSRDSGGLPYFVTLVFVSSVSLQAI

SEQ ID NO: 130923 - protein, 125 aa, Triticum aestivum
  unsure (1)..(125): unsure at all Xaa locations
  Clone ID: PAT_TA_25341.pep
DKPTDDVGNSSFQVAASWQLNTXYIVKGKLGPSKSSAALAYKFPPIFTCSVTVENVHWKGPRSYGLGIGVEDFREPRCQTLDQDCKVLKQHGMDVDGKERVLEFDFGPGNYDNLPTGLKPIDKIL

SEQ ID NO: 130924 - protein, 149 aa, Triticum aestivum
  Clone ID: PAT_TA_25342.pep
PETSLLVMVGGTTKRSHQTTSTIKTGLTVASDTTMAGPQPHTKKNGPKNGPRRSQTGTSIHIQTQEQNLRRRHSRSSSTSRKWLLRPGRTACRLPSAQPTTSTVWSKTHMCRSTRFLPVGVTSRASPRQAGSDRPDLFSFLFRRGHCCW

SEQ ID NO: 130925 - protein, 192 aa, Triticum aestivum
  unsure (1)..(192): unsure at all Xaa locations
  Clone ID: PAT_TA_25343.pep
AAARAGHCSRSLMTKRFEGLFFSGXXNGTTGYEQAAAHGIVSXINASRHSDGKPLIVLERESSYIGTLIDDLVTKDLREPYRMLTSRSEHRPXFRSDNADSRLTPXGXEIGLIDDRRWELYKSKQAXRIKEEKERLKHTRVSGGEFSAEVTAVSNQPVKGSSTLEAILIKPHVPXSLLAKHXXXNXHXSPLX

SEQ ID NO: 130926 - protein, 106 aa, Triticum aestivum
  unsure (1)..(106): unsure at all Xaa locations
  Clone ID: PAT_TA_25344.pep
MYLVKDIGGAIGLMAAALVLLGTWPVVLAVLERRGRLPQHTYLDYSITNFLAAVLIALTFGXXGADTPGDAQLPHSAPPAPKTNGPLXMFALXGGXVXNLXNVGNQ

SEQ ID NO: 130927 - protein, 202 aa, Triticum aestivum
  Clone ID: PAT_TA_25345.pep
GEQFERDLITNLYAPGNLWDGCCRLQEVKAHCESELREVVARSISMVQDVEARSKSRYDKLRAEFLEKSASMVAESEKMQAEFQDNMSAETEALRAGLVQKVYEMVATWREEMATNLMRMKVQMKKMAEEDNATATDVIEFMERSFPQLSLISTLSAFAPAPAPAPAPVDSDNTRPGCNHPDELPLSLTLPGPGGAVKRRRG

SEQ ID NO: 130928 - protein, 190 aa, Triticum aestivum
  Clone ID: PAT_TA_25346.pep
MALEARLRLPLAGPTPATAFLSGSNPKPSHISFSLKPTSTSLSAANAPPIVVVGSANADIYVEVDRLPLVGETVAASAGHSLAGGKGANQAACGGRLALGPTYLVARVGDDANGRLLEGALADAGGVRLDRVARAPGAPSGHAVVMLMPDGQNSIIIVGGANMGGWAPEVDPEDLDLIRQAGVLLLQREI

SEQ ID NO: 130929 - protein, 286 aa, Triticum aestivum
  unsure (1)..(286): unsure at all Xaa locations
  Clone ID: PAT_TA_25347.pep
LDDKAFFIEELEEHMQKLHENRALAVSERRAADFADESGVIEAAVSAAISVLSKGPSSANLSAASHAAQAAATAARESANLPPELDEFGRDINLQKRMDLKRREENRRRRKARSESKRLSSARKSATEHIEGELSTDESDTDTSAYLSSRDELLKTADAVFSDAAEEYSSLTIVKDKFEGWKTQYPLAYRDAHVSLSVPSVFTPYVKLELLNWDPLHETTSFFDMQWTNVLVGYGVQDEDSADPTDLDLNLIQVLAEKVALPVLHHRIKHCWDILSTQRTQHAVDX

SEQ ID NO: 130930 - protein, 238 aa, Triticum aestivum
  Clone ID: PAT_TA_25348.pep
MATIALVVVAMVLSLAQLSAGSRRLMELYVPPESDRLTYHQGGVLSGDIPVSILWYGKFTPAQRSIVSDFVVSLNSAPDGAATPSVGQWWGTIEQLYLSKAAAANGEAAATHVLLAEQVTDEQCSLGTSLTLAQIDQLAASIGAKKGGIALVFTDEDVAVEGFCSSRCGRHGSSAGGDSTHIWVGNSVKQCPGQCAWPFAQPQYGPQGAPLVAPNGDVGMDGMVMVLATMVAGTVSNP

SEQ ID NO: 130931 - protein, 128 aa, Triticum aestivum
  unsure (1)..(128): unsure at all Xaa locations
  Clone ID: PAT_TA_25349.pep
ENPARANGHIFNVGNPNNEVTVRELAQMMTEVYANVSGEAPLDEPMIDVSSSQFYGEGYDDSDKRIPDMTIINXQLGWNPXTPLKDLLETTLTYXHKTYKEXAVKRQMFAGFSVDLDKPCPLGSRPRA

SEQ ID NO: 130932 - protein, 232 aa, Triticum aestivum
  unsure (1)..(232): unsure at all Xaa locations
  Clone ID: PAT_TA_25350.pep
RNEDKWWLPEPCVPESGLSDALHRELQHKRDQASQIHKMAMEINNAILSEMQIPSSYIETLPKTGKVGTGDVIYRYMSSGDQFSPDHLLDFLNLSSEHEALEIADRVEAAMYVWRRKASMTHVVTKWENVTELNXADGDKKFDPGKAGPGSLLLCLKQRFPGLSQTTLDTSKIHYNKDIGQAILESYSRVLESLAYSIVSWIDDVLLADENAKQGNSTRIQKQVFSQVSPQR

SEQ ID NO: 130933 - protein, 78 aa, Triticum aestivum
  Clone ID: PAT_TA_25351.pep
MGAVVTAVIAIAAVVLGWITIEMACKPCLETGRRAMDRALDPNYDPDDSPAANSTAPPTSEPLLADLSASAAAPAKAI

SEQ ID NO: 130934 - protein, 195 aa, Triticum aestivum
  Clone ID: PAT_TA_25352.pep
SDVLARLRPRGRLGRPISSPGRATPASSRRSSRRGPGTGPAPEERTRSRRTRPNQHQRRAQPGSRRPQRRAATGTPRRSPQHRLHSTRRRGRAAAAGAAGSRPTRRPVPRTGNAPRPGPRTGGAAAGRRAAPGPRRRRRPPSCAPWRAGRRGRPSCRWPCGGPCGAARGRPWRARAPRRWPRPRSGPPPRRRAPA

SEQ ID NO: 130935 - protein, 180 aa, Triticum aestivum
  Clone ID: PAT_TA_25353.pep
LGRTVVRRHHERSQHENVHTSAVSVAVLPQADEVDVQLRNEDLRIDTYRSGGSGGQSVNTTDSAVRITHLPTGTAVAIQDERSQHQNKAKALKVLRARLYELERHRLHADRSKLRSEQIGSGDRSERIRTYNFPQGRVTDHRVGVTHHSIVDVMEGESLDVFIEALLLQEEMDAIASFAS

SEQ ID NO: 130936 - protein, 100 aa, Triticum aestivum
  Clone ID: PAT_TA_25354.pep
MCPLRVILIFLSATIAGFFLLRGLNAEPDLFQDDDAAAVAANDEDDEGSPGSPRDPAPLHSKVASAAKTGFWTMVDMASGRYLWRTLVASPAKSDSEKAR

SEQ ID NO: 130937 - protein, 69 aa, Triticum aestivum
  unsure (1)..(69): unsure at all Xaa locations
  Clone ID: PAT_TA_25355.pep
RRGSXGNTEEVRRQVGETIYARDKVDKMFAAFTGQPIDIVQQWTERDRFMSSSEAMDFGLVDALLETGC

SEQ ID NO: 130938 - protein, 211 aa, Triticum aestivum
  Clone ID: PAT_TA_25356.pep
MADEDEYRCFVGNLSWSTTDESLKDAFSKYGKVTEAKVVMDKFSGRSRGFAFVTFDEKKAMEEAIEDMNGLDLEGRAITVDKAQPQGVGRDRNGDRDFDRDRGSRGGRDYGGGRAPRGGGGGGDCFKCGKPGHFARECPDGDGGRGDRYGGRDDRYGGGRSDRGGDRSDRGGDRSDRDGDRSERGSDRYSSRSRDGGSGGDRYSCDRSGPY

SEQ ID NO: 130939 - protein, 219 aa, Triticum aestivum
  Clone ID: PAT_TA_25357.pep
MADEDEYRCFVGNLSWSTTDESLKDAFSKYGKVTEAKVVMDKFSGRSRGFAFVTFDEKKAMEEAIEDMNGLDLEGRAITVDKAQPQGAGRDRNGDRDFDRDRGSRGGRDYGGGRAARGSGGDCFKCGKPGHFARECPDGDGGRGDRYGGRDDRYGGGRSDRDRSDRGGDRSDRDRSDRGGDRSDRDGDRSERGSDRYSSRSRDGGSGGDRYSRDRSGPY

SEQ ID NO: 130940 - protein, 177 aa, Triticum aestivum
  unsure (1)..(177): unsure at all Xaa locations
  Clone ID: PAT_TA_25358.pep
LHFTSTQPPVAAAAAATISPIHVEPSARPEAPPPEHHERQAAPAPRPPRPAXPPPLPPCSAPSPGAGSSAPPPLLPXAPPPPPSAPSPRRPWSRRPPPRRRRPSHALVALTRRRSAAPEQRGGGERGVAGWRATPPRTATRRGPRPRTGTPPAGWGAARPAGTASPGWASRAPGGRR

SEQ ID NO: 130941 - protein, 494 aa, Triticum aestivum
  unsure (1)..(494): unsure at all Xaa locations
  Clone ID: PAT_TA_25359.pep
MKEMMVGSVAPVGPVGSLGAAPPRQLLERMKDYGQEGAFALWDELSPAYRHLLVRDFSCLDLCRMKPWSRRAADGHADAPTPAESLVESSVTGAAEGGSKEGERHWNSKVGSNASQFGXIGGVLSVAXELSSLGFSGTVXDCWIFCXVIGPDSECVLAFAICHKLAAQSSDSPRNTIPIHWYIMTSPFTDDVTRKFFESCKYFGLEADQVTFFQQGTLPCVSDDGRFIMETPYKVAKAPDGNGGVYAALKSKKLLDDMSSRGVKYVDCYGVDNVLVRVADPTFLGYFIEKGVSSAAKVVRKAYPQENVGVFVQRGRGGPLSVVEYSEMDAAMTTEINQSTGRLRYCWSNVCLHMFSLEFLNQVANSLEXDSVYHLAQKKIPSIHGYTMGLKLEQFIFDAFNYSPSTTLFEVLREEEFAPVKNANGSAYDTPDSAKLMLLRLHSRWVVAAGGFLTHSVPLYMTGVEVSPLSSYAGENLEAICRGRTFHAPSEISF

SEQ ID NO: 130942 - protein, 111 aa, Triticum aestivum
  unsure (1)..(111): unsure at all Xaa locations
  Clone ID: PAT_TA_25360.pep
SFGFENSFLVFPKMSEAAKKAAAEMKLSLDEEKNLGFLIAMSKTNTEKITKEILEGLSEDTGDSESYDVDSGGEDSEDRPWRPSHSVYGKSTIKENHLVNMRGRYFRXLXV

SEQ ID NO: 130943 - protein, 170 aa, Triticum aestivum
  unsure (1)..(170): unsure at all Xaa locations
  Clone ID: PAT_TA_25361.pep
WQPRVKWRGAPAAAAAAAXRTAMDYSLAALKLLASQLEGSTTAPSSEGSSPAEMLFGIRFQRAWIQGVILRVDYSAGDNGRLFVDDGSCVTEFMLRSEDAKGQPWRPGMYVLIIGAYIAPDSTENLPAVKVHKIVDLSAQPDREAMWYMEVAEAYNFFYEADASGVGSPS

SEQ ID NO: 130944 - protein, 115 aa, Triticum aestivum
  unsure (1)..(115): unsure at all Xaa locations
  Clone ID: PAT_TA_25362.pep
LVVCLEFSXGEFSRTVRRRWFPXWSTAPAANVDVGGRRLLTAAAXGFPAGGDAAGAHAVHLLRRKLQLTTTTSSSSSTSSVHRGLSAPVGIVRRRALQSAQLPAVAGTVAALSLS

SEQ ID NO: 130945 - protein, 374 aa, Triticum aestivum
  unsure (1)..(374): unsure at all Xaa locations
  Clone ID: PAT_TA_25363.pep
MCLRAIRFWLRGRAPVIGPRPVRPLAHGXPSVFPAFRTAVEAEDAVARPLRPRRRWNPSNRGHNPGASPNCRRQHTPPLPCLPAARGIFLTAGGTQAIEVIIPVLAQTAGANILLPSPGCTSTQPRXAHYKPWRFDLQTSPRSGHLAKAAEAARNPRHIGSLLIRCYGKLVLGQRPXFIPMGVFGHIAPVLSIGSLSKSWIVPGXWRLGWVAVYDPTXFXEKTKISTYITNYLNVSTDPATFVQGSSXPKFVENTKEDFFKKIIGLLKESSRXIICVREIKENKYITCPHKPQGSMFVMVKLNLHLLEEIHDDIDFCCKLAKEESVILCPGSVLGMENWVRITFACVPSSLQDGLERIKSFCQRNKKKNSINGC

SEQ ID NO: 130946 - protein, 166 aa, Triticum aestivum
  unsure (1)..(166): unsure at all Xaa locations
  Clone ID: PAT_TA_25364.pep
XIGXSLXVVDRANVGGKLDQLDTFDGDADALFQENTKELYFPPRRNGKGKPNTSQHPAIDETEEETSEAEQVTKAASHTKNSRPNKRKKALEHAEPEEEAECGSHGRGQSTRRGRGRGRGAKSATPEPMRRGRGRPRKGSPGAAPSEAGSSARGGKKSGKRGRPRK

SEQ ID NO: 130947 - protein, 137 aa, Triticum aestivum
  Clone ID: PAT_TA_25365.pep
MQYGAAAAEQAWSYMPVVAPSSAVETAAERVERLASESAVVVFSVSTCCMCHAVKRLFCGMGVHPTVHELDHDPRGRELERALACLLGASGASAAGAPVVPVVFIGGRLVGAMDRVMAAHINGTLVPLLKDAGALWL

SEQ ID NO: 130948 - protein, 128 aa, Triticum aestivum
  Clone ID: PAT_TA_25366.pep
RNSAGSSIRSHLPARSSKEGRKPSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 130949 - protein, 114 aa, Triticum aestivum
  Clone ID: PAT_TA_25367.pep
MCVFLRETTSESCVRKKKKRRCGGGGANRLDLVLDPRLAGESCTCRDEMRRVLDVALLCASSLSIDRPSMRSVVKQLLEVSNPVVAVVDWSWRTRNLFMCDPCMAMSQKAMLVW

SEQ ID NO: 130950 - protein, 127 aa, Triticum aestivum
  unsure (1)..(127): unsure at all Xaa locations
  Clone ID: PAT_TA_25368.pep
EKYNASILCRANFATWTGKLPWMLSLFHVSHGLLGYIHRLQRYDSKLAWRYSKALXAWDNKHPMRLILLLQVFQLNPLGYVGKNLDRTVFGPVIXVLHRGGLPEEGSAPCTSPGLAEKDYGQGCAST

SEQ ID NO: 130951 - protein, 112 aa, Triticum aestivum
  Clone ID: PAT_TA_25369.pep
DWTPARPTPGTRTEPCSRRASPPPQPAGRWCRRPPPPPSRRAPPPRTSGPRGAPGRTRSPRTAPPAGPPHRSGSPPSTWPPPPPGAWRPRGGPLRVAAAAAAATSFVCCIGR

SEQ ID NO: 130952 - protein, 174 aa, Triticum aestivum
  unsure (1)..(174): unsure at all Xaa locations
  Clone ID: PAT_TA_25370.pep
GGQPQAPPRVAVGLLPVAVALPLALAAAVPVDLPVALALAVALPLVVAEAAQRRRCRRSEPQPRVGRPRPARPEACLAAAREQGAGRAWAHRRVQRPDRRLRPPLHLQGLPPHALAAGLPVPLRPRHLLEVPRGSRRQPGAAAAAAAMAIGRNRVVEEFLGRXPLLLPQQSCMP

SEQ ID NO: 130953 - protein, 353 aa, Triticum aestivum
  Clone ID: PAT_TA_25371.pep
PRVRGNKICQEIDLNKASWTALFEPFIFFEAYTKYLVVDIVADNDDDLRLWKGWVESRLRQLTLKIERDTNGMLQCHPYPCDYSNPTVQCAHCSFYMGLSRKEGMKIHGQNFDIRGTVDEFMHEIGMYTLWKSGMDLAVTHVRKKQIPYYVFEQGYKKPCPPMHANQQEQSDRHDTEDDTLTASMLGQLKRKRDFDEAGHSESCKSVKRSSVCLGYEESPPEYGSIVSKVVSGNTVKLVSSALCNGVQNGLSHGNVNLESANCSSSPHGSEESAASGTSCAAVETVHMVYETVGPESSMACVINGMVQTMAVHTPLKCVAEKDEPKFEGIGSLANSNSAEFMEQTEMLTKRPW

SEQ ID NO: 130954 - protein, 185 aa, Triticum aestivum
  unsure (1)..(185): unsure at all Xaa locations
  Clone ID: PAT_TA_25372.pep
IGEFTFRSDVRAVKLGKDNIVIVLETKIYVYNFTDLKMLHQIETLPNPKGLCCLSHHSNTSVLACPGLSQGHVRVEHFGLKVTKMITAHDSHISCMALTMDGLLLATAXSMKGTLIRIFNTMXDGTRLQGGAXRALXKPEIYSIALSPXNVQWGWQWPADKRTGQYFQVQKSRVAGEDSSYDXRP

SEQ ID NO: 130955 - protein, 86 aa, Triticum aestivum
  Clone ID: PAT_TA_25373.pep
RMGGKQLQRTILIDPAFCLSTMLTPHLEALRRAKQQRKLQIRPNLLGENSPPPSWVASLVVHGQDPDALNQPHGTRANLLQPFTDR

SEQ ID NO: 130956 - protein, 103 aa, Triticum aestivum
  unsure (1)..(103): unsure at all Xaa locations
  Clone ID: PAT_TA_25374.pep
MTEEQVDQPELPGPVDAPEDASKENVSPTKESDEAEDSGEVPLKFRNYLPHDERLRGGKVAPLSLPKXFEDFIAADAAEPKQLENPFGNIVPKNPNWDLKRDV

SEQ ID NO: 130957 - protein, 179 aa, Triticum aestivum
  unsure (1)..(179): unsure at all Xaa locations
  Clone ID: PAT_TA_25375.pep
RPGRAPSRAQSRTAEERPKTPEAPAPAPDAGAGDGARGAPGGPPPPPACPAPVDAPEDASRENVSPTKESDEVEDNGEVPLKFRNYLPHDERLRGGKVAPLSLPKFEDPIAADAAEPKQLEEPLWETSPQRTRNWXLKRDVQKXIDKLEKRTQKALAEIALEQQKEKETLEEGGDAAQE

SEQ ID NO: 130958 - protein, 139 aa, Triticum aestivum
  Clone ID: PAT_TA_25376.pep
KDWGPPIAVLRQVSDYTLATTATPADERFDGLQPAQYLRAPQPAAPPDPRQPAKRGRDQHLLCEGGEGTFLASETLRDLQASDGLDDLQASEGLDHLQAAECLQRPTIKLVDLQPHVPFWWDPRPVPVRSSFCGTTCIC

SEQ ID NO: 130959 - protein, 264 aa, Triticum aestivum
  unsure (1)..(264): unsure at all Xaa locations
  Clone ID: PAT_TA_25377.pep
QYYVYLAAALYSGDVKIVNTTQXCLYKRLREAHTSICSSVQFIPWRPWTAITGGLDSKLAVWDFSKGRTLFSIDYGSPELQNSSSSGSTGQCLNPAFVHSVAVSEEGILGGLYKVCAVARGDGAVDVVDLEYELAPAKSKGPSRARGSTMSSKTTDLGDGSNNQCQRRRIHLDYSMGGHTAAVSCVAFSAFGEKGKLLVSGGNDASLQVWDWSKGFSPETSSNSELVLDIDVKKKVNWLCTAPTDSDNLIVCDTSKVVKVYNFS

SEQ ID NO: 130960 - protein, 224 aa, Triticum aestivum
  unsure (1)..(224): unsure at all Xaa locations
  Clone ID: PAT_TA_25378.pep
DSPFLPFAPALPAASSRGRSVIGVLEANFIEPAHDKQDFERTPLFIRLETKLKQIIVDYWKEKCHLIGYQPIDPKLRSQYKAALKDSGGPSVKIRHEASTAQKTGGHLSNLLPQTYDDEAAFRLTANRAGSALHSSGQGSMDSAGLEEDLVDIGSXGVLDPSCNEKLSEENLVLFTRREDLRQRDTQLKQTIGELEHELEETRRKCSQLAAELQLRRSQQQHYM

SEQ ID NO: 130961 - protein, 237 aa, Triticum aestivum
  unsure (1)..(237): unsure at all Xaa locations
  Clone ID: PAT_TA_25379.pep
MSSAMSRAIRGAVAAGVSRRGLASVEAMGAAKGAPPAAGRWAGRGRGGPGPVEDGARVQWVFLGCPGVGKGTYAGRLSRLLGVPHIATGDLVRDELASQGPLSKQLSEIVNHGKLVSDEIIINLLSKRLEEGGEKGELGFILDGFPRTIRQAEILEGVTDIDXLVINLKLXERVCLPKCXLGRRXCNQVLEGNSNVXXMDMEGENGGAPNVLSPLLPPSTSANQXYLPRPDDTGRSG

SEQ ID NO: 130962 - protein, 153 aa, Triticum aestivum
  Clone ID: PAT_TA_25380.pep
MASKAVAEIVDDKQCSKSAAESSEAAPSRRQSEELIGGASKSGPASPRAVPPGDVATSSGVKEQDKDCSSVDGSVKLDEDEDAEKSSLRGSVKDSSVSAKFSDGASSLTKASGSTKVSGHADLVQSGKSSVYRASAGSDVSDDSTCSSICSSA

SEQ ID NO: 130963 - protein, 99 aa, Triticum aestivum
  Clone ID: PAT_TA_25381.pep
KKGDYMSSSSRSTEALWQAFFANPLDWWDTRKDKKNPRYPDFKHKSTGEALWVEGRNNPNWVVSQLAILDSRMGSLQDKQRKPVSYMYADDFMTSDASD

SEQ ID NO: 130964 - protein, 212 aa, Triticum aestivum
  Clone ID: PAT_TA_25382.pep
MSSSSRSVARGRLAVWMSATDTTWVTLAFWDDLAVIASTHVKQRGCGFVSGRLVSDTVEEGPYKRQVYYKVVVQQFNFIESFQPVRLYSESSQDGGKHGDYVGNDSTSGSTENKKGDYMSSSSRSTEALWQAFFANPLDWWDNRKDKKNPRYPDFKHKSTGEALWVEGRNNPNWVVSQLAILDSRMGSLQDKQRKPVSYMYADDFMTSDASR

SEQ ID NO: 130965 - protein, 98 aa, Triticum aestivum
  Clone ID: PAT_TA_25383.pep
EPSALTENKNVFSWAGVPRGQLGHGEIIDRNTPKMIDALTRDGTACKQLESSNAVPMTAKVWVPPSKRFAIVPEENVSKPGNGTDKHAPEGDAKRMRV

SEQ ID NO: 130966 - protein, 192 aa, Triticum aestivum
  Clone ID: PAT_TA_25384.pep
MSLSSIARRLCCSRQSSTSRLSVVLARLHSTEAAKDTGAKRYKYPEVYDPYGPMPPASEKVVGLADRIAALPPEEIKQIAPALLLRLNQPAPQAISGQGFSMGSQGGAGAGAAKSEEKKAEKLVFDVKLEKFEAAAKIKIIKEIRTFTDLGLKDAKELVEKAPVILKQSLTKEEAEAIIAKIKAAGGVAVME

SEQ ID NO: 130967 - protein, 173 aa, Triticum aestivum
  Clone ID: PAT_TA_25385.pep
MGDAASAAQPPPAASPAFSYLAVFGNCPLIAAVLAFAIAQSIKVFTTWYKENRWDAKQLVGSGGMPSSHSATVTALAVAIGLQEGFSCSLFATAAIFASVVMYDAFGVRLHAGRQAEVLNQIVYELPSEHPLAETRPLRELIGHTPPQVFAGAVLGFAVATFTGMMAGLGNSG

SEQ ID NO: 130968 - protein, 194 aa, Triticum aestivum
  unsure (1)..(194): unsure at all Xaa locations
  Clone ID: PAT_TA_25386.pep
MPCYYNVDDILMEEELISVVFQVTANGVGMLDPGAERNSVEKGAKVDLPFWLAHGMLSLEQAVSINVPPCFTQKTRKEIQADAAXVDLRVRCPYFYELGCKIVPLVGDKSIGQFLRYAFTSRYKEVLSKAHSSSTMTVPKFATRLTKEEAQVFESARESISAFRKWRVGGARLQKASILGRKRKTKVPEGPSTP

SEQ ID NO: 130969 - protein, 98 aa, Triticum aestivum
  unsure (1)..(98): unsure at all Xaa locations
  Clone ID: PAT_TA_25387.pep
YLTPXKWXPCLGSARLGSSSREHNASPWVLMMAGTWTMWKLPMFGCTDATQVINEVEEVKKEYPDAYVRIIGFDNMRQVQCVSFIAFKPPGCEESGKA

SEQ ID NO: 130970 - protein, 141 aa, Triticum aestivum
  unsure (1)..(141): unsure at all Xaa locations
  Clone ID: PAT_TA_25388.pep
GXISXXXVEXPPLXPXXFCPRAAXKGAGPGARPVWGLGAGGVREIAGAQPRPPHDKESWRACASRVRAGGVKEGKAAEIPAQVPRQRPLQDQLQMWTAVRSSDRLLAASIADYSSTDRYLSTLRLPIYCIYMNKCSDLISM

SEQ ID NO: 130971 - protein, 82 aa, Triticum aestivum
  Clone ID: PAT_TA_25389.pep
MASIVLLLSELLGGAGSTSMLEASCYMGGHSLREFRPAAAATGDRAPPEPKLSTKAKDEEPSSLDLEDLSTVSRISVDVMWP

SEQ ID NO: 130972 - protein, 85 aa, Triticum aestivum
  Clone ID: PAT_TA_25390.pep
MASIVLLLSELLGGAGSTSMLEANCYMGGHSLREFRPAAATGERAPTEPKLRGTTSTAAKDEEPSSLDLEDLSAVSRISVDVMWP

SEQ ID NO: 130973 - protein, 245 aa, Triticum aestivum
  unsure (1)..(245): unsure at all Xaa locations
  Clone ID: PAT_TA_25391.pep
ILYNVVFKVLRKRRRWSETEALWDVMLRDGVQPDNTTFSTVISCARACGPPGKAVEWFEKMPESGCSPDMLTYSVVIDAYGRAGDAEMALRLYDRARSERCQLDPRGGASGTDPHSTSGNFDGALNVFEEMKAVGVKPNLVVYNTVLDAMGRAMRPWVVKTIHREMVSQKVQPNRATYCCLLQAYTRARYGEDAMIVYRKMKDEVMDIDVVLYNMLLSMCADIGYVRRGRGIXSXDMKXSMGQQA

SEQ ID NO: 130974 - protein, 132 aa, Triticum aestivum
  unsure (1)..(132): unsure at all Xaa locations
  Clone ID: PAT_TA_25392.pep
ARALGRAPPRAPPRVFFFFFFFFFFFFFFFGQRCFSLLITRIHSXQIVXIYYVHVHKHSHRLHSHTSMLSRPMLVHERGHTHILRNKQXKINGEGKPKAMSELTKRAMALYMWPVVSELFRPCRXSPQPGWL

SEQ ID NO: 130975 - protein, 347 aa, Triticum aestivum
  unsure (1)..(347): unsure at all Xaa locations
  Clone ID: PAT_TA_25393.pep
MGKGKQRVRARGDGAGGEPAGEGEAAVAGGGGAAGGGHTPSTVFVSNLPYTYKSSDLETVFSEVGPVRRCFMVASKGSETSKGFGFVQFATVQDAERAIQQKNGFAVAGRKIRVKLAIQRAPRKRGLQKKEXVHVDDSNAKDEEDDNSTPVPVKHKEPLHKADTGPPQLPAKDTKVAKEVSINATDKAKSSEKQRIAKTVIFGGLQDFSMASEVFRLAGEIGTVVSVNYPLPKEEMELHGLARDGCTSDAAAVLFSSVKSAWEAVVLLHHKEIKGAIVWARQLGGEGSKIRKWRVIVRNLPFKVTIKEIMDIFSCEGFVWDVSIPQKSDDGKSKGFAFLSFTRKQDA

SEQ ID NO: 130976 - protein, 142 aa, Triticum aestivum
  Clone ID: PAT_TA_25394.pep
MAVGALRPEPAPGRRWLPPPRHAVPDGGQGGQEAGTGAAVGQVAGAAPQPRPGGPRAADARGGEDPQGQVAVYVGGGGPGEPLRYVVPVVYFNHPMFGELLREAEEAFGFQHPGGITIPCAAAKFERAAAVAAAGKKGFARW

SEQ ID NO: 130977 - protein, 207 aa, Triticum aestivum
  unsure (1)..(207): unsure at all Xaa locations
  Clone ID: PAT_TA_25395.pep
RXLLKRGTLLTKATLPAPTTLSIGERHGQLPEQGVYAAAARDAAAARPRRAGGAGGEGGGGGAAQEHRPGAAAGGRGGGGGGAGVRVAGGRDEGEGGPDEGGAGVAHGAAQERRAAPRGRPPPDGQRPRRRLQAAARRRLAPAPRVHPRVPRGRRRHLAPQRTHGARPSALDRSPLPGHRARSELDLLHELVAFLLRSVRLCAWSMV

SEQ ID NO: 130978 - protein, 76 aa, Triticum aestivum
  Clone ID: PAT_TA_25396.pep
GRVPRATALDLLEPIAGQALKEDPVFVVPPKRPPLARCKLPVGIRLFVSAGHTESDISKVCSSLKKVYASVLSNHN

SEQ ID NO: 130979 - protein, 178 aa, Triticum aestivum
  Clone ID: PAT_TA_25397.pep
LYQSVPIGYDKENHVKKSLGSLSEIKTLGITGSFMKYLSKGCILTKLPVVFTRLEDIYLTICFWDQRQVLTAYSLFQNAPNLKKLAVWSQSLSTWDQDQASIPELTMQVQLDHLVTASVKGFRGVDCEVGFVEKLLNWAPALEEVKIEWQCKTECSMVLAKLLALPRVSPRAKVIVTF

SEQ ID NO: 130980 - protein, 114 aa, Triticum aestivum
  unsure (1)..(114): unsure at all Xaa locations
  Clone ID: PAT_TA_25398.pep
IIHHYIHQLFEQNLIVETFRWQESCLAKVRARASKESTTSLKVCFCSRRDLKRPRLGGKGSSVPCLPNWDSPGGGARSERSGPSTPVGLAPWGCHGGWVNPXXAGLTXGAKKPP

SEQ ID NO: 130981 - protein, 199 aa, Triticum aestivum
  unsure (1)..(199): unsure at all Xaa locations
  Clone ID: PAT_TA_25399.pep
LEFFLVDPNTIMDVIPGDMVVNTMMVAMLAHSGEQAQTIYHVTSSMSNPASYMTLRESAHRYFVDNPPRGENGEPIRLNKMRFFSTVARLRVHMVIQVPSSLFGTLHLXNVRAYXGVFSGRYNELSGKYRLAMHLIELXYAPYTLFKGRFDDMNLEKLEEGHGAXVMEGEYYFDFDPKKIDWDDYFYMVHFPGVLKYLA

SEQ ID NO: 130982 - protein, 116 aa, Triticum aestivum
  Clone ID: PAT_TA_25400.pep
QCGDSTDPLRRRGAIRCRLADGNTDLSTERGCRYRRDHEAEHPVQRGYLSPLACMLMRHASPFIMMVCNQVFATGAVQYRLLLVSLYNYVAIYYLEANYCVLNFDFGPKFSSFDHS

SEQ ID NO: 130983 - protein, 322 aa, Triticum aestivum
  unsure (1)..(322): unsure at all Xaa locations
  Clone ID: PAT_TA_25401.pep
AKERAPSIAWWNXLRCVERPVYGRNIIXLLTIRHSMCDVFEKKNNPSCYMDFSSSLADLVLSSVERLNKMLGFIESFTFAIPAARAATSICWCKKKNSPVILGPAYSSTMYEXFSPILSPIRPAIVRRQVYFPDRRLIQFDCGKLQELAVLLRRLKSEGHRALIFTQMTKMLDTLEEFINLYGYTYLRLDGSTQPEERQTLMQRFNTNPKFFLFILSTRSGGVGVNLVXADTVIFYDSDWNPAMDQQAQDRCHRIGQTREVNIYRLISESTIEENILKKANQKRTLDDLVIQRGCYNTEFFKKLXPMEFFSGHTALNVEXQP

SEQ ID NO: 130984 - protein, 270 aa, Triticum aestivum
  Clone ID: PAT_TA_25402.pep
PELLMEDSSAWLSRIKGLHFPLPDESQLKARQIQSDEMLALKLQEQFNQEQPHASASQQVDTTLAWTLQEEDAARARIAAREGQSSSSQRDRSMAHLYSYGWRSQVQGSTSWPPSHTSAPITSRRWLPRNSGPGSEQQNMIISQLTKGCFGQENMDLEMRMAVLDSLQEALESCPDTYPTDSDDDDYENLIALDDNNHHRGASDSEIDSLPLSVAEGESCRDEPCPICLDCPADGASLRHLPCAHKFHKECINRWLRMRTSCPVCKSAVF

SEQ ID NO: 130985 - protein, 133 aa, Triticum aestivum
  Clone ID: PAT_TA_25403.pep
TVHRARHDAHHPFGFSGHDSVSLHTGEPSRKPCSGQSMPMAKLTRADGTLLPPRTFSNSALTSMSSSSVVATSSFSAIASTLTITFSAVVDSSWGKVKVGVAAPSSTLPLSTSPMVPSMLSRSMSTQSSSSTS

SEQ ID NO: 130986 - protein, 162 aa, Triticum aestivum
  unsure (1)..(162): unsure at all Xaa locations
  Clone ID: PAT_TA_25404.pep
MVRSPSGAAAVAVLLLCLSGLCRGAERLGARECEELGFTGLALCSDCNALAEFVKDXELVDDCRKCCTEDSDDSISKLVYSGAXIEVCMRKLVFYPEVVGFFEEDKDNFPYVESRYAYGSPPKLIMLDDKGXLKETIRIDNXKCKHIRQFHTEKEKPAKSET

SEQ ID NO: 130987 - protein, 120 aa, Triticum aestivum
  unsure (1)..(120): unsure at all Xaa locations
  Clone ID: PAT_TA_25405.pep
KNITAYEWADALEASIAAVSKYGGARAGYRTMLXILYDILCKAAYASXKTKHPVTAFIASAEAAAAGAESTKQMQAKAGRSSYISPDHLVSIPDPGAMAAAAWYRAAALSVKNKLHASES

SEQ ID NO: 130988 - protein, 176 aa, Triticum aestivum
  unsure (1)..(176): unsure at all Xaa locations
  Clone ID: PAT_TA_25406.pep
ACGGPRGSSPALRRRCPPRPLLASHPRRTSVPRLHGARRCSIAVVVVICLXFVMAFGWSWGPLGWTVPSEIFALETRSAGQSITVAVNLFFTFVIAQAFLSMLCAFKFGIFLFFAAWITVMTVFVYVFLPETKGVPIEEMVLLWRKHWFWKKVMPDMPLEDGWGEGGGERADNKGH

SEQ ID NO: 130989 - protein, 125 aa, Triticum aestivum
  Clone ID: PAT_TA_25407.pep
ASSTCRGWCGRACGTTPSPTSPASCARPRTRRATRHRCSSTSSSTTPPSPAWSPACPTATSPTSTASTTHGTSSTTTPSPTTPSGSAPSSSPFSTRNKSGPPWTGSAFVARRLKSSNTWLIRLQS

SEQ ID NO: 130990 - protein, 111 aa, Triticum aestivum
  Clone ID: PAT_TA_25408.pep
SASGLMGLCVAMLANWPSRASRPAACCRSSTRAVGAVCLAHNIRHPDSILGGRCSASQLCLADLRLNNYVEACCLLWSCNYFQSQCCAVDVHAHNNQAVAFSKEGVIRALC

SEQ ID NO: 130991 - protein, 86 aa, Triticum aestivum
  unsure (1)..(86): unsure at all Xaa locations
  Clone ID: PAT_TA_25409.pep
PAPQLRSGGRTGLGPGGTEERGMKEEDXREKXPPGRSPHRTPPAGAASTTAVAGEYAGXRNGTEATGEKKGVXMDKIKEKLPGGQH

SEQ ID NO: 130992 - protein, 489 aa, Triticum aestivum
  unsure (1)..(489): unsure at all Xaa locations
  Clone ID: PAT_TA_25410.pep
MPLVSKQGPTIEGGQRDAIHVGSGLCTATKAPSSLCARFPNVGSVGCDPSGCRPGHGYRSANIALRLVPSLAASGIGLPWFVSSTIDDSGLDWLVYCKILVSLRLKSPPKITFIGLLLGCSCLSALHLIDCEKIDSVEWLEYXVGMESLEELVVKNCKGINHHDFLKFGSGWMKQXEFERKRERFDCLMXVYDSLYDAHSMDAYDFCCESLKDLRLAHIKTWPEVGVRVLLGKCKALEKLCLEYVHALNDNDMIALSRSCSNLKSILLRLNLQRYSSDVSYCETRTSFTDASLYALALNCRMLQMVDLSSIGCSPDWPSIGFTQQGFLVLIQSCPIRVLVLNTANFFDDEGMKALSSSPYLEILELILCEAVTDAGMCFIGQTPRLSNLKLRLCHEVTDVGVSELGHARKLESLVIECCSMVSLRAPRGVAKSVRYSSYVAQAPSLAMGMGVIRPSGPRMVLLVPAAVAIMLFTVRQSTGVRCIPPGVS

SEQ ID NO: 130993 - protein, 93 aa, Triticum aestivum
  Clone ID: PAT_TA_25411.pep
LQIYTKTWSWVLSSLIYKTVLSFYQCTRKQAFALFIKGKKKKSPSMERNRERSTLLIFLDAVIVVQEIPQYFQSNIRIVNINSSIVVQFVFSF

SEQ ID NO: 130994 - protein, 227 aa, Triticum aestivum
  unsure (1)..(227): unsure at all Xaa locations
  Clone ID: PAT_TA_25412.pep
MATATAAAGEVLQHMGPVPRVEETNNAAAAAEELGGDDEEILRFMDSADGYLLLMDSLSSALRQGWLDLASARHSMGASRVSSTLFDXKEQSAATKLQVVYPADLQPSESNPHFSLSKWCXQEESNSSDIVCAQDSATAKLRYRGSAATPDSSNGSDATTAKSSTGVDVNSQVQKARSKALSVFGALVSPKLRTAQVSFETALELIVELANARSAILSSFSQIKHEA

SEQ ID NO: 130995 - protein, 115 aa, Triticum aestivum
  unsure (1)..(115): unsure at all Xaa locations
  Clone ID: PAT_TA_25413.pep
MAPPQPKSGLFVGINKGHVVTKRELPPRPCHRKGKSTKRVSMVRGLIREVAGFAPYEKRITELLKVGXKDKRALKLAKXRKLGTHKRAKKXKREDMAGVLTKVRSDGHATLTRCK

SEQ ID NO: 130996 - protein, 111 aa, Triticum aestivum
  unsure (1)..(111): unsure at all Xaa locations
  Clone ID: PAT_TA_25414.pep
MAQKDAANGNGATTRPPPTPSPIRFSKFFQGQHADPGQPAGAGFIGSHLVXDKAQWENEERNEGQLVLDNFFSXGSKKXNLEXKVGIRAPKDFGLNPGHRMFTRNQAPGGG

SEQ ID NO: 130997 - protein, 81 aa, Triticum aestivum
  Clone ID: PAT_TA_25415.pep
ERGGGAPRAARVKVRPQNYFSACRRALSRPFSASSALCFLCYEGGVMAGQSCGLSLTRSLLLLARRRRQRERSAAGGEGGE

SEQ ID NO: 130998 - protein, 122 aa, Triticum aestivum
  Clone ID: PAT_TA_25416.pep
SPQLAPKICTVSSSRTFPLRNHHAIAPLPHVASHASAPLPHALGCTLTFGRREAEEERRPAARRARRAAPSAAPAASRRRLPRRPAAKGGVPRLRARRLLRRPTAKGGSVGRWLPRLPCRAV

SEQ ID NO: 130999 - protein, 219 aa, Triticum aestivum
  unsure (1)..(219): unsure at all Xaa locations
  Clone ID: PAT_TA_25417.pep
SCWNGPRGRRLLVHPFYAAGSLRRFLQIWINDSRSRARFCKLSIGIVKGLGNLHTSTQKPIIHGNLATSNIMLDADXTDPEEAGGDIKVTEARRSSDCSRTXAVHGYIYPSRVVLVVISVVPDVYSLGVILLEMLAQKEAANDSPNARDIHLPASFKDLVLERNIANAFGSAELYYXRLSRRYRYVRSXSELATACYNPSPSLGPDSRRILKRLEEISR

SEQ ID NO: 131000 - protein, 75 aa, Triticum aestivum
  Clone ID: PAT_TA_25418.pep
RRSIEVLFPIHLVSAVLSITLHLALRLGWRFKIYKKTLAGDHCASALICENLEQQRVRDTPIDDACSVHTLGEGS

SEQ ID NO: 131001 - protein, 288 aa, Triticum aestivum
  unsure (1)..(288): unsure at all Xaa locations
  Clone ID: PAT_TA_25419.pep
SSRSRAAARDLDPELQSSVIRDLVLLSCVGLRPILVHGGGPEINSWLLRVGVEPQFRNGLRVTDALTMEVVEMVLVGKVNKNLVSLINLAGGTAVGLCGKDARLITARPSPNAAALGFVGEVARVDATVLHPIIASGHIPVIATVAADETGQAYNINADTAAGEIAAAVGAEKLLLLTDVSGILADRNDPGSLVKEIDIAGVRQMVSGGQVAGGMIPKVECCVRALAQGVHTASIIDGRVPHSLLLXEILTDEGTGHNDHRLRCKMPPWYFLILSCSYCQSAMLFMPM

SEQ ID NO: 131002 - protein, 129 aa, Triticum aestivum
  unsure (1)..(129): unsure at all Xaa locations
  Clone ID: PAT_TA_25420.pep
MAGDDEQRPLHILFFPFPAPGHLIPVADMAALFATRGAKCTILTTPXVNAATIPPGRRXVPTNARRWNSGFPAPAGDPDLRSCPSLNVGLPPGRRTPTGPCPGPPRPAVLLPFHPVPGPVAPFPFSQVL

SEQ ID NO: 131003 - protein, 210 aa, Triticum aestivum
  unsure (1)..(210): unsure at all Xaa locations
  Clone ID: PAT_TA_25421.pep
MAGTSSWSSSSSCASSSGSPDHDVVCVTEPDSVGAAGAVADAEGSVKFLCSYGGRILPRRTDGTLRYVGGDNRVLSVDRPIRFYVLQRKLRELCGGWEAXLRCQLPTEDLDALISVTCDDDLAKLLEEYDEASKDRLQSLKIRAFLFPTRTPAPSILQRRSPPSIAHLHWQNTSPPPAAAGVSLTCAPRWWAAPQASRQAQNYDRHSLGE

SEQ ID NO: 131004 - protein, 320 aa, Triticum aestivum
  Clone ID: PAT_TA_25422.pep
EESLCNAVGRGRDPPAPWLYVHLQTDYKPDDRRFFCDDGQETLRGVRWLVLRSDNYFVPGLFFLPRYEEELVRLFPRRDTVFHHLGRYLFHPSNTVWGMATRYYSSYLAPAEERVGVQVREFKYARISADERYKQIISCASRESLLPAVENATLPSSASDHHQEQEQEQKKRKAVLIVSLNGDYYDKLSSLYYEHGAAAVTVSVFQPTHLGTQHSEKRQHNQKALAEIVLLSFSDVVVTSAQSTFGYVSQGLAGLRPWVLMLPVDGKVPDPPCRLASTIEPCFMKAPHYDCRTRGDSDNGKLVPYIRQCEDVSYGVQLVE

SEQ ID NO: 131005 - protein, 141 aa, Triticum aestivum
  unsure (1)..(141): unsure at all Xaa locations
  Clone ID: PAT_TA_25423.pep
RRAIWALLWRCPTPPKVRVFAWXLITDSLPTWVNKKRRNLEVSDVCPVCASEPEDTYHAFCRSPRAVGLWQAMASDWRLPDVRKLVNPGPEWLLHILGDSTETERLHLLMTLWRSWHVRNDIVHHKRPPTVESSKRFLHSY

SEQ ID NO: 131006 - protein, 195 aa, Triticum aestivum
  Clone ID: PAT_TA_25424.pep
MATMAGRYCCSYSSPSASAPPPHRQRGPPLQPRPTGGRGRGLRRPSLRAVASAAAEPVKAATDAEFFQPADSRPIMLFDGVCNLCNGGVRFVREHDPGRSIRYIPLQSDSGRKLLRRSGRSPDDISSVVLVEKDRSYIKSDAVLRIMEYLNLPFPQLAAFLKIAPLFVRDFAYDNVANNRYVVFGRSETESCEIL

SEQ ID NO: 131007 - protein, 311 aa, Triticum aestivum
  Clone ID: PAT_TA_25425.pep
MADSPAQPAPAAAAAAAGNPHKRKNKGKGNPNKKNKKLKGPDDTTRRRRKPSAKFLKLLEKRARDYNSDDDDDAAQVRPRRSQPRPPPKQRDAAPDVGDDLKEAPSSEEEASSSGGESDGEKAVTMFQEGCRAFQAAFTKIMEKKLADNPLGPILSADKKLVAAKLAEEADEHKSKGEARKEKRLAAQKGHKIPENAIDNKEKMLIKVATQGVVRLFNEVSKRQTRKGLNPSRSKDVKSLAKHSVPSNEGQQGQGSSKFSKNIGKGEDEPGWAPLRDTYMLGSKLKDWDKAQDSDVAKPSEVPLDNFSDDE

SEQ ID NO: 131008 - protein, 294 aa, Triticum aestivum
  Clone ID: PAT_TA_25426.pep
MHGGGSKMLGVVNFITFLASIPVLGGGIWLASRANSTDCIRFLQWPIIIIGLAVMVVSLMGFAGACYRQTWLLRIYLFAMFFIDVALLFFIDFAFADTDRGEGQVVMNRRLLEYQLYNYNGWLRNRMGDPECWDTMNACLQNGRACASMRRPARDPNTGMLVTEPPVMFYGRNLSPIQSGCCKPPTSCAFTYNNETYWSANPGVPTVVTDPDCLKWSNDQQTLCFQCDSCKAGVLAGIKKSWRKVAIINIVVLIILIIVYVAGCAAFRNAKRDDNDESYGMARMTKSRPSRFQF

SEQ ID NO: 131009 - protein, 362 aa, Triticum aestivum
  unsure (1)..(362): unsure at all Xaa locations
  Clone ID: PAT_TA_25427.pep
TVPPPAPPPHAVSPPTRPPTRLSAHASAHASTSRSSCRKASPTSRRPHQTAAPVAEPERERTRSRGPPRSRAEPKKLGVVNFITFLASIPVLGGGIWLASRANTTDCIRFLQWPIIIMGLAVMVVSLMGFAGACYRHXWVLRIYLFAMLFIVVALLFITVFAFAVTDRGEGQVVMNRRFLEYQLSDYNGWLRNRVADPEYWATISACLRDGRACASMRRPARDPNTGMLVTEPPVMFYGRNLSPIQSGCCKPPTSCAFTYNNETYWSANPGVPTVVTDPDCLKWSNDQQTLCFQCDSCKAGVLAGIKKSWRKVAIINIVVLIILIIVYVAGCAAFRNAKRDDNDESYGMARMTKSRPSRFQF

SEQ ID NO: 131010 - protein, 208 aa, Triticum aestivum
  unsure (1)..(208): unsure at all Xaa locations
  Clone ID: PAT_TA_25428.pep
SVAIGPDGTKVNAAEAFKIAGIHGGFFELQPKEGLAMVNGTAVGSALASTVLFEANILALLAEVISAVFCEVMNGKPEFTDHLTHKLKHHPGQIEAAAIMEHILEGSSYMKLAKKLGDLDPLMKXPKQDRYALRTSPQXWLXPQIEVIRAATKSXXREXNSVNDNPLIDXSRXXGIQRGXTXKGKTXLGXSKGQPPPNPNKLETQPAI

SEQ ID NO: 131011 - protein, 147 aa, Triticum aestivum
  unsure (1)..(147): unsure at all Xaa locations
  Clone ID: PAT_TA_25429.pep
STHHQLHLRRPLPRLAKSSNSRVMAQRLQRPPSPSGPGTTSTPACGDQAHQMNNGAVKGAAPTXTTGPSNLINSGVGIVQRCSSFKVSEQQPGWPACPLPAATQRAPKPAESMHEEDELDHLISSELAESGLFMGEQQGGGAYSWNM

SEQ ID NO: 131012 - protein, 278 aa, Triticum aestivum
  unsure (1)..(278): unsure at all Xaa locations
  Clone ID: PAT_TA_25430.pep
PRGPGRTQPWGEHYPRTDGGRPRAAAAAELAGAPRRRYRGVRQRPWGKWAAEIRDPHKAARVWLGTFETAEAAARAYDEAALRFRGSRAKLNFPEDARLPPATVTPTAAPARAPTAAPSASTPVTHAGYTQASVHLRYQMLLQGRGAAAGNRSTPLSSSFSGCSVAAAMSSSYGGGVMSSSYGGGGGGGRTMSGYLGSYYXFPSSSPSVATVPSSSSASSAPGHHYSSPHDPQQHQQQQGDAAAEWSWESALAPDPGTTTAASWSDSSQQPYHPPHTQ

SEQ ID NO: 131013 - protein, 63 aa, Triticum aestivum
  Clone ID: PAT_TA_25431.pep
AGRITLYLIKNNNAFNIKICGRRATSTNASMTILQDIKLSIHCRFAINRTTTIIQPSGLANEF

SEQ ID NO: 131014 - protein, 180 aa, Triticum aestivum
  unsure (1)..(180): unsure at all Xaa locations
  Clone ID: PAT_TA_25432.pep
GLVCLCVGGATGVVDRYTGMVKGYSGVFRLGEATSTWDADSPVIQRESWEHIXKDEDIRKAAASFMGEIWQVPPMFSAIKVGGEKMYDKARRGESIELSPRRISIYKFDIERSLEDRQNLIFRVTCSKGTYIRSLCADLGKALRSCAHLTALRRDSIGDYSVNDAWNFDELQEQITKGYL

SEQ ID NO: 131015 - protein, 226 aa, Triticum aestivum
  Clone ID: PAT_TA_25433.pep
QFHPHLLHSKFPIPDAQHSPPSQSPHMRKKKAAAAPAPVPAAAKTKSAAAVPAAAKKKPLAAKKKAAAAVPAAKKKAAAAAKKRASGGTAGCRPRKRARDDNGDGDLISNLPGRRPAPSSPSSPPRDGARTQPIAPPVAPSGAPPLSTSTPRTSAPMISSSRAAKGVDRRRNPSSPGSLPTILALPVSTSDYPAPQQKESPRIVAQIASWVPSGATLELHIFPIFN

SEQ ID NO: 131016 - protein, 89 aa, Triticum aestivum
  unsure (1)..(89): unsure at all Xaa locations
  Clone ID: PAT_TA_25434.pep
MAMERELMETFEAAKKAADAAAEEADGSSPEAERCLDALRRLREFRVNTDVLVSTQVGKRLRYLTKHPNSXDIQAVAADLFGYWKKGCY

SEQ ID NO: 131017 - protein, 88 aa, Triticum aestivum
  Clone ID: PAT_TA_25435.pep
GTQGAGQETAAPAPGTQRPPHGKIIEPDANTHGAGRHDVDEVKGGSPYGAGTFAGADGSRTPTDAELALAAHQGKYFAGIAKKLKAVV

SEQ ID NO: 131018 - protein, 182 aa, Triticum aestivum
  unsure (1)..(182): unsure at all Xaa locations
  Clone ID: PAT_TA_25436.pep
MANPASPRPPIRSVNLGNWLVTEGWILPSLFDGLPNKDLLXDGTQLQFKSVTQNRVRGCRENGGGAALVANRPSXASGWETFKALSGSTRTPSTSRVVNNQFVPPRPEWTGPRPTGLQSFKLGPHDKMKGKPGPFYRQKGFGNGLPGATTLRGRFFKKIKTGHKYRTFWQGGGNFNGETFGK

SEQ ID NO: 131019 - protein, 182 aa, Triticum aestivum
  unsure (1)..(182): unsure at all Xaa locations
  Clone ID: PAT_TA_25437.pep
MAVSARRVAFATAASLAVYWLLKSFLHAPHPALLPAAAALVAVAVAAGAGGGAGPGAPPGPAAVPVFGNWLQVGNDLNHRFLARLSARYGPXFRAAAGPCATWWGGVGPXGVATGGLPTHGVGFGSRPRNVVFDIFTXNGADMVFTEYGDHWRRMRRVMTLPFFTARVVQQYRSMWXXEMDD

SEQ ID NO: 131020 - protein, 148 aa, Triticum aestivum
  unsure (1)..(148): unsure at all Xaa locations
  Clone ID: PAT_TA_25438.pep
SVWNNLNLISHPSTYAVTDDTAFNNGTSVKIWKQDPAVVEAGIRKVYLPSRVKTGPKDNMVAIVGMPNPVQPDVNGDFLLDPKRNELEFDSVHTFSRXLRMVVNMFSKILWEKNSKWQWGDGCYQSGIPKSKASMQMPYYSRLPKKAX

SEQ ID NO: 131021 - protein, 112 aa, Triticum aestivum
  unsure (1)..(112): unsure at all Xaa locations
  Clone ID: PAT_TA_25439.pep
FKFXXGYPXXWCQXVXHXXRRXXWXXNPLTXXXDGXFEGLYSSIGALGRPREWSTLHASLAREDSVAFSFRHRRDYRDWRFLHFDKRISISLEISQPLNGLLNRFKGAFRAH

SEQ ID NO: 131022 - protein, 158 aa, Triticum aestivum
  Clone ID: PAT_TA_25440.pep
CTHRFAFGTKSYAHFWPLLDWAGNIGVVQTGKFEQLFYVVRRWPRPAAARVSTHSPGRGRAPGIHLRERASSDAPVSGEVHGMDRDAVVVLAWCLVAVDVVYVHGGVREGEALHAVHVHGGLPGERAPASASVFLSVALGIEDGGAWPPRWVRCVWVI

SEQ ID NO: 131023 - protein, 134 aa, Triticum aestivum
  unsure (1)..(134): unsure at all Xaa locations
  Clone ID: PAT_TA_25441.pep
MVSFALKLPYILAAIALVKASHIKGVAPEKQALYQSSSDGTWQCLDGSKVISYSAINDDYCDCPDGSDEPGTSACPNGYFYCENKGHIPSXIKSSAVNDGVCDEACCDGSDEESXQCPNRCQEGGEAYRKGPKK

SEQ ID NO: 131024 - protein, 139 aa, Triticum aestivum
  Clone ID: PAT_TA_25442.pep
VVEVCVEHLCCPWRRPVLEPDACCLAPCSPRRTTLSQDSTAALVALLGSEDLVDLIDIQVLSVVAWSWAWRRQRALIPIDQCSCCVRATWRVILDDGAGAEAACHPTGTLSRASKSTAAFACTLARVRRPARAVSLAIA

SEQ ID NO: 131025 - protein, 144 aa, Triticum aestivum
  unsure (1)..(144): unsure at all Xaa locations
  Clone ID: PAT_TA_25443.pep
MMSLKHLRAPTAGQRRPSPLLRLVPGLLLLLLISRPAQASASTVVTRLPGFDGPLPFHLETGYVGVEEETGTELFYYLVESERSPGADPVLLWLXPGGPRCSGFSAXAFQVRPVKFVLAPLQRDLPQLGKKPFSWDQNWKHSTS

SEQ ID NO: 131026 - protein, 148 aa, Triticum aestivum
  Clone ID: PAT_TA_25444.pep
APARALVVRTGLTLRGLEPGAGGAGRGGALGEPALSAPTGGGKRDVTAACSGLGGSHGRRLRELGRRGIHKKAVLGCWERRAGAGGGSEIERERRTVLAVGPTERKTKQNKIVARNNKLYFSKIRTLVITLLFLVPEKGLVVSVCQGP

SEQ ID NO: 131027 - protein, 142 aa, Triticum aestivum
  unsure (1)..(142): unsure at all Xaa locations
  Clone ID: PAT_TA_25445.pep
LTVKESAMDVPTNLDARRRISFFANSLFMDMPKAPKVRNMLPFSVLTPYYKEDVLFSSQALEEENEDGVSILFYLQKIYPXEWKNFLERVDCKNEEELRETEQTEXELRLWASYRGQTLTRTVRGMMYYRQALVLQVLVLIW

SEQ ID NO: 131028 - protein, 116 aa, Triticum aestivum
  Clone ID: PAT_TA_25446.pep
ISPCRLRAHNRGIARPNELRFVHLHGLSGVRLSNPKAINTLQGFRAEVLVVEVKIDNLDALLALELLDFLAIVGSQANDVAVSVWHSEQIANDGQSNVTASTSDENNRLVVHFESS

SEQ ID NO: 131029 - protein, 279 aa, Triticum aestivum
  unsure (1)..(279): unsure at all Xaa locations
  Clone ID: PAT_TA_25447.pep
MIPRIDLSDLRIITNHFSDTHKIGRGGXGEVYKAVYKKEEIAVKLLDSAKEIDDKQFMNELSNHMKVQHPNIVRLVGYCNEVTSXILKQKDGPPVFGKHIYKVLCFEYMHGTSLDKHLYGNSLGHDWPTHYQIIKGTCEGLCYPHCGCERPILPLDLRPANILLAKRKNPKIADFGLSRIYTTSRTHVKVIGSVSGTTNYMAPEVRKEGVVSDKADVFSLGVTIIDVIGGSRGLETYHEHGAKKXVEYVCTYWRERDNTADLYQVETCTKIAICCVHTD

SEQ ID NO: 131030 - protein, 111 aa, Triticum aestivum
  unsure (1)..(111): unsure at all Xaa locations
  Clone ID: PAT_TA_25448.pep
SELESDRDIKRVITSSYDGLPYHLKCCFLYLSIFPENHEIRLTRLLRRWIAEGYITKPRDMSVEELGRRYYNEXISRSMIQPSEKARASMAVERCXVHGVVLQIILSQVLI

SEQ ID NO: 131031 - protein, 95 aa, Triticum aestivum
  Clone ID: PAT_TA_25449.pep
VLLIVHFSTPESQLAAGFGRDSSVVPSSAILVPDSDCDAAAGFARRALGWTKTHSALLARHLLAWDFFRAATFEFLLSASETCPQLIWSPRWLDP

SEQ ID NO: 131032 - protein, 146 aa, Triticum aestivum
  unsure (1)..(146): unsure at all Xaa locations
  Clone ID: PAT_TA_25450.pep
MSTTAAATSQTLKMPAARALENAKQSSEAVLSDASSAMSKAAENPKKVTADFLHTPFMRAALPFINGGLAGMTATTVIQPVDMVKVRLQLAGEGVKTGPKPTPVTVFKDIIAQGKVLDLYTGXLSAGILRQAVYTTARLGFFDTFM

SEQ ID NO: 131033 - protein, 132 aa, Triticum aestivum
  unsure (1)..(132): unsure at all Xaa locations
  Clone ID: PAT_TA_25451.pep
RRIPTLANCQSKSCVARRRAYWQPLATPPTAFPPCWPTRSAAWQLMFPKQAHTGCSNSQASCVARSSLPMPPTPPPPSHVLTRLPSLPLARMPPRRRETKPTANREEDGQGPKLPRSPAPKEGCXPPRKPSC

SEQ ID NO: 131034 - protein, 147 aa, Triticum aestivum
  unsure (1)..(147): unsure at all Xaa locations
  Clone ID: PAT_TA_25452.pep
DHSTDDKLAFETSETVQVVPTFDSIGLKEDLLRGIYAYNFEKPSAIQQRAIVPIIKGRDVIAQAQSGTGKTATFSISXLQTIDTTIRETQALILSPTRELATQIQSVXLALGDYMNVQCHACIGGTKCWVKDIRKVGKGGVHNRVRG

SEQ ID NO: 131035 - protein, 111 aa, Triticum aestivum
  unsure (1)..(111): unsure at all Xaa locations
  Clone ID: PAT_TA_25453.pep
MQIFVKTLTGKTITLEVESSDTIDNVKSKIQDKEGXIPPDQXTLXFFAGKHLEDGPTLSDYNIQXXSTLHLVLRLRGGMQIFRKTPTRETLSPLVAPSAAIDNVKSKIKTK

SEQ ID NO: 131036 - protein, 119 aa, Triticum aestivum
  unsure (1)..(119): unsure at all Xaa locations
  Clone ID: PAT_TA_25454.pep
MREVISLNVGQAGCQIANSCWELYCLEHGIQXPDGFLTEERKALNDDHGFSTFFSETGQGKYVPRTIYADLEXPNVVDEVRTGPYRSLFHPEQMITGKEXDASNNYARWSLTTVGKGRL

SEQ ID NO: 131037 - protein, 138 aa, Triticum aestivum
  Clone ID: PAT_TA_25455.pep
TNCCCTGPGVPSQHQTANMIEEVLKKTSEMFPLPTATASLLPSVAPIPTVAPGPEPTYEVAGDAGMKTLWVVFVLMLIASAGFTVMSWKVPLNKRLYHVITTIITLTAALSYFAMASGAGVSLKKEVEREQHDHVPDN

SEQ ID NO: 131038 - protein, 156 aa, Triticum aestivum
  unsure (1)..(156): unsure at all Xaa locations
  Clone ID: PAT_TA_25456.pep
ICSXSPSTCRXALAWXIHPSSFAEARKDGLKHPSNHRLHRTGVVYRLHSVGRSRWQRTAREEDEGERGEHLARLYGRRSLSGGASYSSTVAVVVVAARGRGRERGGPGGGHGRRGAPREGGGGHDLEGRRWRLRCGRDERGSDRGRGKEGEGRGCP

SEQ ID NO: 131039 - protein, 141 aa, Triticum aestivum
  unsure (1)..(141): unsure at all Xaa locations
  Clone ID: PAT_TA_25457.pep
MLDINDFIKERGGDPEKIRESQKKRCAPVEIVDEXVIADFEDHRRTQYDATQMGSKINAVQKQIGAKKKAKESADDLLEEKXKLEESKKKQEAEAAAKLLKLQAKAKTGGNYVYKGVPVSDNEDNNXVLKTLAPETPESLV

SEQ ID NO: 131040 - protein, 144 aa, Triticum aestivum
  unsure (1)..(144): unsure at all Xaa locations
  Clone ID: PAT_TA_25458.pep
MLTRRVCASVRGILSPPCATAVRSQAFSAGAPTQSPARAPTLADITPDSAASFNEKQKSFRDGLVAAQKRKEQEEKDARAREQENGKKKGGALSSLIYGTPEGRELDKDIERSFSQVLARGKYVHSIVFHXVLQDXVXEYTELG

SEQ ID NO: 131041 - protein, 174 aa, Triticum aestivum
  unsure (1)..(174): unsure at all Xaa locations
  Clone ID: PAT_TA_25459.pep
MSEDVQALVIDNGSGMVKAGFAGDDAPRAVFPSIVGRPRHTGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVVSLYASGRTTGIVLDSGDGVTHTVPIYEXYAXPHA

SEQ ID NO: 131042 - protein, 189 aa, Triticum aestivum
  unsure (1)..(189): unsure at all Xaa locations
  Clone ID: PAT_TA_25460.pep
MTIPDEVDIIVCGGGSCGCVVAGRLANLDHNLQVLLIEGGENNLNNPWVFRPGIYPRNMKLDSKTATFYYSRPSEWXLDGRRAVVPVANILGGGXSSINFMMYTXRASASDYDDFQAKGLXTNQGTQSPLMKESXETYQTVPAXKPRQSTXLREPTKVXXGNYTYPXXGGLLRAXDXXGIPTXVSRTGA

SEQ ID NO: 131043 - protein, 153 aa, Triticum aestivum
  unsure (1)..(153): unsure at all Xaa locations
  Clone ID: PAT_TA_25461.pep
MASTQDVNMDGSLTGYAPFGSSTTTLSVHNEEETAITVAVGGNEPSGRYILVXAGRAVEKDGVRLPIPVXSSKPGITYRVGGWIXSLGAARGTNXPVRIHLXLDDNGNEDPGWSAAPFAPKEGRRGPGDLGRPPPRRAPTAPTPLFYIQRPLA

SEQ ID NO: 131044 - protein, 171 aa, Triticum aestivum
  unsure (1)..(171): unsure at all Xaa locations
  Clone ID: PAT_TA_25462.pep
MRAPMGRSPSSPVLSLVWAAAALLLNAALLVQSVPYDYSSSSECLAEPLEAHYGGGVIVNSDFSAGLQGWSAFGYGSVTEGASPTGNKYPVPAKPGXRPXTRASSQKGFLQNDNALQPSQTWLQVSEPERRPVCPLLKXAXQXYQXPGGXKPNPGCXXXPKGGLXPSRPGE

SEQ ID NO: 131045 - protein, 135 aa, Triticum aestivum
  Clone ID: PAT_TA_25463.pep
PPAAAMMAAESPATANHPADQHLETLALDSPSAASAAASTDPLLHPPPSPSPPSARAAAANGDPFVEENGEDESPPILPTPRLPGRFPRAVNVVLPRLPSPNPRSTIRAANRSRGALSLGSGELIPNLVNNPGPQ

SEQ ID NO: 131046 - protein, 137 aa, Triticum aestivum
  unsure (1)..(137): unsure at all Xaa locations
  Clone ID: PAT_TA_25464.pep
MPCLPSRLQKHGEMASSAPAAERAHAVCLPAAAQGHIIPMLDVAKMLHARGFHVTFVNTEYNHARLVRSRGPAAVAGAPGXFRFATIPXDGLPPSERTPTSTQGHQRCLWQSPTTGRTWPPGPFPPPIRRTFKEGRP

SEQ ID NO: 131047 - protein, 149 aa, Triticum aestivum
  Clone ID: PAT_TA_25465.pep
LLMVYQTLFVREHNRMCGVLRGKYPEWNVEQLFQTARIVMGAKMNMIGAAYFKAYFIDVPWPDDPTAIMRSWTGKTVLEINPLTMSYPWKMLLNPKTGDPYSLPNEVQRGLTLARPHPGRRSKIYEQRRTTPNERLGQTWPRERAFKRR

SEQ ID NO: 131048 - protein, 129 aa, Triticum aestivum
  unsure (1)..(129): unsure at all Xaa locations
  Clone ID: PAT_TA_25466.pep
MASPLSAPSLIMEEEGRFEAEVAEVGAWWNTERFRLTKRPYTVRDVVLLRGTLRQSYASGEMAKKLWRTLKAHXAAGTASRTFGVAXTPVQVDHEWPXHLDTIXVSGGAGSLPTHTSTNEPGGRLRRTP

SEQ ID NO: 131049 - protein, 149 aa, Triticum aestivum
  Clone ID: PAT_TA_25467.pep
EPVNQRGERVASRRAHEQAPETWPRRRTRDGWGPRATIRRPPRRRGGPSSTSRRGRPPPWCSSPSSSASSCSAPTAAALGSAPWRPRAAAAPCATASRAPSSARPTARRSPWCAMPNAGAPAPKKGQATPRGDWPPSAPEAPRGRTNDG

SEQ ID NO: 131050 - protein, 147 aa, Triticum aestivum
  Clone ID: PAT_TA_25468.pep
AWIDPTQSRRAASCPLPQLRCRRRRRAAARPRPPSSSIAAASSCSAAAASSRPAAPSRSAPTPGRRCRSTGRSPSAATPPAPPAATPPPTRPCGTKLRSRQRLRRRNAPARPQVPPLAAKWQSPILAELFQRRGRKSRPSRPLQTQF

SEQ ID NO: 131051 - protein, 115 aa, Triticum aestivum
  unsure (1)..(115): unsure at all Xaa locations
  Clone ID: PAT_TA_25469.pep
MVQASEVLKGKTGVIYGDDVYNLFKHAQSEGYAIPAINVTSSSTVVASLEAARDAKSPIILQMSQGGAAYFAGKGVDNKDQEALPSREAIXAGAHYIPRNLRPHTGIPVGSPKPT

SEQ ID NO: 131052 - protein, 72 aa, Triticum aestivum
  unsure (1)..(72): unsure at all Xaa locations
  Clone ID: PAT_TA_25470.pep
FGHSTTRYIIILDMSVDTKLPDHSGQQYHXTKLHGNXLMLLGVAXTNEEKKTPRKTRSSSASPVKIHLKQAI

SEQ ID NO: 131053 - protein, 111 aa, Triticum aestivum
  unsure (1)..(111): unsure at all Xaa locations
  Clone ID: PAT_TA_25471.pep
GWRRHSWQSAASRAAAAPQEHARERPSTTAFTRPLTAALPAARPRIERPDPVTQPPSSPRXQPSTSTPATAGGASRAPASASVSRXPLQAQAKIRRRDSSAPHPPTPRRAP

SEQ ID NO: 131054 - protein, 147 aa, Triticum aestivum
  Clone ID: PAT_TA_25472.pep
KWQEKWRWRSVGVATRHRRSPPPLRPPPRPPATRRPLRRTSSRTSPVASPPWRTSFPSAPPAATTAPSSRRPAPTSPPRPRSSSSPSTPPFARGRSSNPRPPPPPTASGLPWGATNLPPLPASTLPLRPKGFLRAQRGPKPPQRLLP

SEQ ID NO: 131055 - protein, 94 aa, Triticum aestivum
  Clone ID: PAT_TA_25473.pep
MSDLFVELTAPNGRKYQQPRGLFINNEFVKSKSGETITSINPSDESEIVSVYAAGPEDVDDAVAAARKAFKEPGLARHGHQCSKLTFSYKVCTS

SEQ ID NO: 131056 - protein, 76 aa, Triticum aestivum
  unsure (1)..(76): unsure at all Xaa locations
  Clone ID: PAT_TA_25474.pep
CWASXFPPGPPRPPGGRQHMGRGARSFSWIVWRQEEGACRQPRAMEDGERERRRLRITEKMSNLNNPLLPTVQAST

SEQ ID NO: 131057 - protein, 96 aa, Triticum aestivum
  unsure (1)..(96): unsure at all Xaa locations
  Clone ID: PAT_TA_25475.pep
RPPLRXLSRRRTCSGXKLRRFTICPPAAAPQXPIWQLPGSEGGGGPPQFTAKPSSQRACPSPGAPRNHTRSNVSRCLIQSFPAPGAGIGNSPDSGD

SEQ ID NO: 131058 - protein, 140 aa, Triticum aestivum
  Clone ID: PAT_TA_25476.pep
LASGVVDAPPRARAASMGPAAVIVLIILCAAAAAEARVPAGHLATRRRDSVPAGVGACALAVAPFGYPCEEHTVTTVDGYILSLQRIPRGRRPKRRARGNRLLSATMAFSRDGMKWAAEAPPEGNRLALSSPGSRALLWG

SEQ ID NO: 131059 - protein, 108 aa, Triticum aestivum
  unsure (1)..(108): unsure at all Xaa locations
  Clone ID: PAT_TA_25477.pep
RPPXIPAISSFHPRDDPPTTAEMSTSTSQLGPPRPLALAPLPSLATAPRTTSSSRNAAAAATMSVATSSSSNKRSTERLLSINGDAAVPLALRVSGHEQGRMATPQLG

SEQ ID NO: 131060 - protein, 141 aa, Triticum aestivum
  unsure (1)..(141): unsure at all Xaa locations
  Clone ID: PAT_TA_25478.pep
MQKFSRLGRLGQSLASRRQLATVSDAPLSRKVEMTNWEKGHYINYKKMSENLGIVRSRLNRPLTFAEKILYSHLGDPHGQXEIERGXXYLKLRPDRVACQGCXPAQMAILQFNVRWAGPPVATPTTVQCGTIFSRVKGWGN

SEQ ID NO: 131061 - protein, 126 aa, Triticum aestivum
  Clone ID: PAT_TA_25479.pep
PPELPSPAHRGSMVITWEYDPLFVVVSDDNQSLRGYYLHRAHLACAGLSYIILRTSKPVSRLIKASCNLLSADEILSITVFISTRCSSEMAARPTNSLRTSDRTPNGVGLFCPLSSAAGHWELRGS

SEQ ID NO: 131062 - protein, 129 aa, Triticum aestivum
  unsure (1)..(129): unsure at all Xaa locations
  Clone ID: PAT_TA_25480.pep
MLSLFVPSIAFSIIGAILVFAVRLLRNDPKKGNYKPLPGPKGLPWIGPIHKFPSQAXYKKFAEWHEQYGPIYQVXLFGVTHIXLTSEKMAQDILAKRGAHYPNRAPTPNIPSAKVHAGYLXLLGNNEYE

SEQ ID NO: 131063 - protein, 153 aa, Triticum aestivum
  Clone ID: PAT_TA_25481.pep
TDDDAMSDASSDLFDLESFAASSSYPTTYRGRSSRRNSGDDDLAYAAAAAEEPALSECMYAPSEASVVWSVATAEGVAYDAGSVANFSSAVPQPPRPHAGAGRDRCAPSPVWRLLLLTYTKSTSTVHNSLVCSKLRSKVSVWQRTCAPGVHDY

SEQ ID NO: 131064 - protein, 149 aa, Triticum aestivum
  Clone ID: PAT_TA_25482.pep
GVGNLNWHRNQTVTAQPAFQEPLYDPQELSGIVGTNLRRQIPIHEIIARIVDGSSFDEFKPLYGSTLVTGFAKIYGHPVGIVANNGILFSEELAQGARTLYKLCGKATHPPSIFLQKHLKGFMGPAKNARKKGRQLQRNGRKARRYRSR

SEQ ID NO: 131065 - protein, 139 aa, Triticum aestivum
  Clone ID: PAT_TA_25483.pep
MGFMLKPPPDTAGKAWPAIVIGLFVAFGGVLFGYDTGTISGIIAMDYWKKEFSTEPDLSITAAQDSLIVSILSAGTFFGALTAAPFGDLLGRRLGLMVSAGVVFKPRVSFCRTGRKQAQPIGSIAGPILPPVMGWVATL

SEQ ID NO: 131066 - protein, 57 aa, Triticum aestivum
  Clone ID: PAT_TA_25484.pep
MAAPSTGAKFIRMIVKNDSIKSDPHEIYGWRAFAMAGSACFGGMLFGFDIGTIGRCA

SEQ ID NO: 131067 - protein, 129 aa, Triticum aestivum
  unsure (1)..(129): unsure at all Xaa locations
  Clone ID: PAT_TA_25485.pep
AGVHKVVEQTVCVLLEGDIETSYTKADNSVVVATDTQKQTTYILAKQNPIDPPEQFAAIIGDHFVKTYPHIHAAHVKIVXHRWTRMTIDGKDHPHSFFRDGEETRVVQSVTRQNEGISIRSKDREAAPG

SEQ ID NO: 131068 - protein, 77 aa, Triticum aestivum
  Clone ID: PAT_TA_25486.pep
LLFMLITNSLIVLISGAIQVYAATTTKGNYLAQVSPTFPKMKAATGVVSSYSSGPYDTKLLFIYCPIEGIPRALVIP

SEQ ID NO: 131069 - protein, 103 aa, Triticum aestivum
  Clone ID: PAT_TA_25487.pep
EGPTTIHPPAPRPRQPSVSCLCTAHILELRVWACIGFGFCSTIIRAGVASTRYSPWFLFDAYRRGAVAASTTATPTNGKTSRDKRIMTGTFPIHPLSSMQGAL

SEQ ID NO: 131070 - protein, 147 aa, Triticum aestivum
  unsure (1)..(147): unsure at all Xaa locations
  Clone ID: PAT_TA_25488.pep
SVVAAEVLVLEIITRRRNCSSDYGDTVNLISDVWNYWTKGTISQMMDESLNGYPRSHALRCVHIGLLCVQPDPDDRPQISTVIFMLTRDTMELQPPAQPAFFFGTEXTISRVLXRDGQRRYMHGRPDLVPEDDVSWNEVTITGPYPR

SEQ ID NO: 131071 - protein, 280 aa, Triticum aestivum
  unsure (1)..(280): unsure at all Xaa locations
  Clone ID: PAT_TA_25489.pep
LKHRKTVTKPHLCTWRLVRATSTEKQKHLVHGACVGGWAWFKVATRLREAGHRVSTPDLAASGVDPRPLREVPTFCDYTKPLLDLLXSLPPGEKVVLVGHSLGGVNIALACELFPEKVAAAVFLSAFMPDHRSPPAYVLEKFVEGGTLDWMDTEFKPQDPEGKLPTAMQFGPLVTRAKFFQLCSPEDLMLGRSLMRVGSMFVDDLRLQPPYTEARYGSVRRVFIVLKDDNAIVEGFQRWMVQNYPVDEVKEIDGADHMALFSTPAEVAHCLADIAVKYAA

SEQ ID NO: 131072 - protein, 112 aa, Triticum aestivum
  unsure (1)..(112): unsure at all Xaa locations
  Clone ID: PAT_TA_25490.pep
EVPGRKGAHSGSDMRAMAPSMASSRRRLSAPAPSVAAGDAPXRPAPAPSRPPRPGAACGWRGGPRPPRAGPPAAGTGSPPPGRRAPAPCLPRHAAVVGGELAVRRDRWRRAR

SEQ ID NO: 131073 - protein, 113 aa, Triticum aestivum
  Clone ID: PAT_TA_25491.pep
TIRKATTYVLTRPGRELLFTVVSQDEKYTAKVCIDVIVQRLGDATAAGIYTLLFSSFEKKISIVNLYALPLCFGWLLIAFHLGTAPDKSCQASGSVLDPSLSSLPNLCLPPKP

SEQ ID NO: 131074 - protein, 84 aa, Triticum aestivum
  Clone ID: PAT_TA_25492.pep
LLPEDCFRESNGPEAISASGCTLTEPVSTCHVENFSCGWDGLQELLQLIDTKLNGQQTVVQRSYGPFDRKWRPSSMDDEKAAEQ

SEQ ID NO: 131075 - protein, 81 aa, Triticum aestivum
  unsure (1)..(81): unsure at all Xaa locations
  Clone ID: PAT_TA_25493.pep
LVGPSLLLSPSXGGYQTGKLMYLSSSSQLLYLSQPSPIPLLDRPRSRRACCQDPVGELAGQLACELVKEAIMIEVYPSVDR

SEQ ID NO: 131076 - protein, 253 aa, Triticum aestivum
  Clone ID: PAT_TA_25494.pep
KAAGSHPPAPHVGGGAARRVLEAWKLGVVKYGDALRLQERLVADRRAGRVPDLVLSLQHPPTYTLGKRRTDHNLLVPESSLAGIGAELYRTERGGDVTFHGPRQAVLYPILSLRDIGLGARRYVEGLESAMIEVASLYGVKARPGGACETGVWVGDRKIGTIGVRISSGFTCHGLAFNIDPDLGYFKHIVPCGIADKEVTSLRREAAVELPPDEVIHEQLVQSLATTFRFSDVKVKDDSECADMISSAATGQH

SEQ ID NO: 131077 - protein, 92 aa, Triticum aestivum
  unsure (1)..(92): unsure at all Xaa locations
  Clone ID: PAT_TA_25495.pep
FLHCTFGLSFPWWIFRETHNSHSCVSDHITNFLVETKVIPSKSKMFAARSAKPKLSLSISGCDKHRPVQAPVLGDQPGPKPRDNWFPVXSQX

SEQ ID NO: 131078 - protein, 106 aa, Triticum aestivum
  unsure (1)..(106): unsure at all Xaa locations
  Clone ID: PAT_TA_25496.pep
MPGPESNCPVSVPIISEPTASTDGTKPTSCPMKAWPRAIHHIDRKDLYTNLEDRIHYLHTFLDFSSNDIEALXSSGSRYIKALIPAVVNIVYRKLLQYDITXXSVP

SEQ ID NO: 131079 - protein, 629 aa, Triticum aestivum
  Clone ID: PAT_TA_25497.pep
MTEEVADVMGAFQVIAELPGDNFGAYVISMATSPSDVLAVELLQRECHIKTPLRVVPLFEKLAVLPPAPPALPWLLSFGSLCAWGDRVIADGTLLDFLRQVSTFGLSLVKLDIRQESDRHTDALDAITSYLGIGSYREWSEERRQEWLLSELNGKRPLFGADLPMTEEVADVMGAFQVIAELPGDNFGAYVISMATSPSDVLAVELLQRECHIKTPLRVVPLFEKLADLEAAPAALARLFSIDWYRERINGKQEVMIGYSDSGKDAGRLSAAWQMYKAQEDLVKVAKQFGVKLTMFHGRGGTVGRGGGPTHLAILSQPPDTINGSLRVTVQGEVIEQSFGEEHLCFRTLQRFTAATLEHGMRPPISPKPEWRALLDEMAVVATEEYRSIVFQEPRFVEYFRLATPETEYGRMNIGSRPSKRKPSGGIESLRAIPWIFAWTQTRFHLPVWLGFGGAFKHILKKDIRNFHMLQEMYNEWPFFRVTIDLVEMVFAKGNPGIAALYDRLLVSEGLQPLGEKLRANYEETQKLLLQVAGHKDLLEGDPYLKQRLRLRDAYITTMNVCQAYTLKRIRDPDYHVALRPHLSKEVMDTSKPAAELVTLNPASEYAPGLEDTLILTMKGIAAGLQNTG

SEQ ID NO: 131080 - protein, 923 aa, Triticum aestivum
  Clone ID: PAT_TA_25498.pep
RPRRSRPPLSCPETHTSQRSRALTSPPQRLTRGGTAGGSRAAPAPPGPTATKPRLGRPEGPCRGPAAVPSAGAAPVTGPRAVGRRAVSAQARWPCRSKAITDQGRWSSRRCYTRHRVPKNAKAYEAATLSSCKAKADDAPRKNVYFSTHYYASEKHLHPEETDVNIVLPEWQDERSLLEETPDEKQTEKTTEKPVDQIIERSIEQPDEKITETPSEEPAERISEKPVEEPAEKDVEELDEKPDESFSVSPTEVKQDETASLVDRSVPDPEEDHVESASVVIQSGIRTYSARQELSNHKDLVKLQAVIRGHIVRRQAAESLQCLLAIVKTQGLVRTHQAQQSSGRFQDTLVRSSSEKLLHNGFALKLMDNMSTSKSMNIRCDASETDATWKWMERWTTLILPTTEGHLLENAENSGLVVEKMEEDAHHEEKVVPLDSDISFPKLVPDDVEETLRPSESSAFVEETPRSFDLSGLEAPECVPEETSMLETKGDPAPELIEKVDDDAEQLTDSKTENVVEQSLDFSGRQSTQTGPSREPSPVPEKSEHPSEDTMDAYNLEQSPEMEARSAARKACNPAFAAAQMKFEELTSAVSRSNSSSFLDAPSKSKVHTPRSLGGTSPKQNIETVAPGSTVGHDAKIIPAASECGTEISISSTLDSPDRSEADGGEIVMEMGALGGRNYASENAEKDTHVLHSEVKDTSEEVVQPEKEEELNGDVANPPIATDPVLEQAHVESGKPDLHDQIEESIGSYAKSPEGTPMSRTTFAESQCTPSSEISVNTNKSKSKSKKSKSHASRRSLTSPSSNSVGRSSTDNLSKDYKHAKRESSGKVAKSDNADQEPRMSNSTPLPSYMQFTESARAKAAALSPKLSPDVQDNNPRKRHSLPITNGKNETSPRMQRSSSQAQQNVKSSVAVPHNPSDKRWNI

SEQ ID NO: 131081 - protein, 177 aa, Triticum aestivum
  unsure (1)..(177): unsure at all Xaa locations
  Clone ID: PAT_TA_25499.pep
MTATIFYLLAAILAATTGTLAAGAGDDGMTHLRLYIHETFSGANATAVHVTASPLGGNSTYGTLSVFDDELRQGSNAASQLVGRAQGISMQADLQDSGVFSTLLTVVFTNGGYKGSTLVLGGRVDFGPDGKAAAERAVVGGTGRFRXXRGYSLMSKLGRPRRAPPVFXLDLYVKTDV

SEQ ID NO: 131082 - protein, 67 aa, Triticum aestivum
  Clone ID: PAT_TA_25500.pep
NFAMKSKIARACPIMRRSAKSIANPVIRRKGCTPCIVFDQYPSVIGSRSSSVSRDSAGEHRSISWKP

SEQ ID NO: 131083 - protein, 178 aa, Triticum aestivum
  Clone ID: PAT_TA_25501.pep
GKAPSAPSSRRGVAGAGGKGGGGGGGGGEAARRSPWMKEAAIEEEGLLMEADDDADGRAGGFSALPRKVRYGLGFVAAFLVLFTFFALILWGASRNQKPVVSVNSVTFHNFVIQAGTDASLVPTEMSTINATVRLTFRNTGSFFGVHVTAQPVTLYYSHLSFFFLSLLAAYVMLCNVM

SEQ ID NO: 131084 - protein, 300 aa, Triticum aestivum
  Clone ID: PAT_TA_25502.pep
MATARTAPASPLASAFSPEETRRAVSRVAQAIADRRADLARVQGFFADNAALVNLVQRLPDELSHQIMVPFGGAAFFPGSLIHTNELLVLLGDGYYADRSAKQTTEILHRRGMELEAQMEAIKATISDLEAEAKFFESTAAEASEGLVEIREEYDEEDTEIISSKTEASSSSGGISDEEHARMMARFDELEMLEKEAGSTSEDEGDDDDDDGDDEDAGTSEDGEENGETLSYGNEHDNVSFGASVSGSGGNGQSQGNAQLKSALKKLGEKETLQGSSLAPSGSTSITNSEVQASLRKAVS

SEQ ID NO: 131085 - protein, 102 aa, Triticum aestivum
  unsure (1)..(102): unsure at all Xaa locations
  Clone ID: PAT_TA_25503.pep
MSVLVPPRRRARPTSPPPSSPPRPAAVPAGPRAPTPVIFASAGYDARFPYQNQTKHCWQNYVDYHKCISRQGXKDFRPCKQFFLAYRSLCPKSWTDRWDDQA

SEQ ID NO: 131086 - protein, 191 aa, Triticum aestivum
  unsure (1)..(191): unsure at all Xaa locations
  Clone ID: PAT_TA_25504.pep
MSTASEQPPPPHRGLWSLGGTVELVAAFTAVCLALYGAVLYLNYLYVRWSGRDGVRRTGPGPEAGPATGKRDGGGGLDEAALAAMPVFRFKAEPRGGGGGGGEECAVCLGAMQDGDAVRALPGCSHAFHAGCVDVWLGAHATCPVCRARPAPAAXTAPRRQRPPDGGRTWRARYSMLEVLILWGLSTECLC

SEQ ID NO: 131087 - protein, 175 aa, Triticum aestivum
  unsure (1)..(175): unsure at all Xaa locations
  Clone ID: PAT_TA_25505.pep
MVTKVGINGFGRIGRIVFRNIIEHEDAEVVAXNDPFIETKYAAYMLKYDTQHGQFKGTIEVDGTDLVVNGKRVKFYXERDPANIKWSETGWPLTLSESNRCLQPPSKKASAQLEGXGPRRVVISAPSADAPMYVMGVNHKDYXSENTIISNASCTNNCLAPIAXVVNDNWGLVEG

SEQ ID NO: 131088 - protein, 215 aa, Triticum aestivum
  unsure (1)..(215): unsure at all Xaa locations
  Clone ID: PAT_TA_25506.pep
SISAVMDAHLRYFKQGFELLSQMEPFIHQVLTYAQQSKEMAMNEQDKLAKRIQEFRTQEEIANLRMASNVNTSXVVNGIHVVGLQSYKKIEALMQSTANGQVEXLKQGYLFKRSENLRGEWKRRYFVLDSHGTLYYYGNKGNKQLXEWHHSKLLNRLGVFSRFRFLNPKSFILKGDDXPSXRTINPRXSTXXMXAEXNDLRFCXRVIXPMRNFGR

SEQ ID NO: 131089 - protein, 107 aa, Triticum aestivum
  Clone ID: PAT_TA_25507.pep
NPSRQTPSAAPSNSQMNKQKTTHSDSSRIHIQPSIPSRYHRDRCLTKEKRSAIRRLSRKSERCHLVAAASAGAGVAVAFAAVAGARRHFDWFAGGFEIKFLVKKLGC

SEQ ID NO: 131090 - protein, 86 aa, Triticum aestivum
  Clone ID: PAT_TA_25508.pep
SLIPLCVCVLLACRSNPIGDVISLLQIEVVGVGRRRDAGWCRSELQCVSVEQIHHGCRGMEMLLRRRRELGLAIWKQSEECATVKP

SEQ ID NO: 131091 - protein, 123 aa, Triticum aestivum
  Clone ID: PAT_TA_25509.pep
DSHTSFALSSFAFSAVSSSAAPTSRSQSSWLTSCSSLPPLIYYDFSGHHLYLLFLDLCWLQIERLRQWEEDKLQVWLFGEEWRCVKSWQWLALLSLLLISENHLPWLVWLPIPFSIVLTGASL

SEQ ID NO: 131092 - protein, 104 aa, Triticum aestivum
  Clone ID: PAT_TA_25510.pep
EQQRRQKKKGSEDDQEKETRQKQIEFGSEYDNSEQSLYENPTGPSEESNGDGYNYTGDLDVDPSSAMYDLDATYGGWDEEVPVGCLDLEQRYDSPRRATPASQN

SEQ ID NO: 131093 - protein, 52 aa, Triticum aestivum
  Clone ID: PAT_TA_25511.pep
LNTATIRDIFYPNINKLHLSKWAPTIPAAVALPANAPLVPASALNKCLPRSI

SEQ ID NO: 131094 - protein, 121 aa, Triticum aestivum
  Clone ID: PAT_TA_25512.pep
SELSGLCILRLRVDHLQDNQLDVSIIFNNLEVDSFEKIKIFEIACSSSSHVTFGEKTMKKLEQLKVDCCSGSSLLGLKHLPELKQILLTGSSGEELKISTQNLQTTQSRSVKLDELRSLSS

SEQ ID NO: 131095 - protein, 331 aa, Triticum aestivum
  Clone ID: PAT_TA_25513.pep
MAASALAASAAASQSMKNREILDAVGTTAAALSLAGSSFIVLCYLLFRELRKFSFKLVYFLAVADMLCSLFTIMGGPANAFYCFAHDYSAHFFCVASFLWTTTIAFTLHRTVVKHKTDVEEFGFIFHLYVWGTSLVTTVLRSIGGDYGRPGTWCWIQQGSTGKILHLITFYLPLWGAILYNGFTYYQVNRMLNNATRMAVGMSDRSSQSDVRADKKAFNRWGYYPLILIGSWAFATINRLHDFANPGHKIFWLSILDIGFAGLMGLFNSIAYGLNSSVRRAIAERIDMYLPERIKRSLPTLSRLRSQQENELTSLIGESNNTITNNNASNT

SEQ ID NO: 131096 - protein, 79 aa, Triticum aestivum
  Clone ID: PAT_TA_25514.pep
ACNFLRGTNLWDRNEGRKADTITLMTDLATLFYTYSHFHLLLLPNLVPLPMGIDSQYIHACTSVNTMHQSVKRLYRTLI

SEQ ID NO: 131097 - protein, 158 aa, Triticum aestivum
  Clone ID: PAT_TA_25515.pep
MASEKLVARKGRLRQRYDNEYRLVAGCVPYRVDKDGQLEVLMVSTANRDDLVFPRARSEVDQVAAVPASRLPLVQPRARRSAPRNPLGLWGVQEQEQDRAWAKSSDSPRGACKGHVFALEVTEELKQWPEQETHGRRWALPSGRRTGSGRYDWDCAEA

SEQ ID NO: 131098 - protein, 130 aa, Triticum aestivum
  Clone ID: PAT_TA_25516.pep
QNLGVGSTKNRSLLGIVMEDPSSPIWAATPSARDMEEPSNHHARWIRSSKSASPQRSRESEVRWAWMARPAGLPVPRPTVWWACSAAAPSPAPSARCPPGRPGWYDLTTTGPKDCSSRSRVIFQKCSIQI

SEQ ID NO: 131099 - protein, 323 aa, Triticum aestivum
  Clone ID: PAT_TA_25517.pep
MASGGNPQFRYTQPPSKVIHVRNLPWECTDEELTELGSLFGKVVNTKCNVGANRNQAFIEFADQNQAIAMISYYASSAEPAQVRGKNVYLQYSNRQEIVNSKNTGDAAGNVLLVTMEGVLPDAVSIDVLHLVFSAFGYVHKIATFEKASGYQALIQFSDAETASSAKAALDGRCIPSYLLPELDGSCTLRINYSAHSVLNVKFQSHRSRDYTNPYLPLAPSAIDGSGVAQDGKKEEPESNVLLASVENMQYIVTIDALHEVFSAFGFVQKIAIFEKNSGFHALIQYPDIQTAVKAREALEGHSIYEGGYCKLHLAFSRHTDLN

SEQ ID NO: 131100 - protein, 144 aa, Triticum aestivum
  Clone ID: PAT_TA_25518.pep
PRLARGRCRASTARPAASVSLLERIRDVVLRLIMLTAVSKASVQRSSSSRTSSPRAGAAGAVTCRRDDSIRNEAVEECIEFLKRSSAEGEAVKLSSVTAEAVAAAVASENDPEPKRLSSSSVVAVDAVVAGVKDTTRSASPSIV

SEQ ID NO: 131101 - protein, 146 aa, Triticum aestivum
  Clone ID: PAT_TA_25519.pep
ALVSVAAAAAAVALLLVLAAEPSRAERFVVGDAARWTWGYNYTDWVIRKGPFFQNDTLVFMYDPPNATVHAHSVYLMRTAADYQSCNLKAAKLVASVTQGAGSGFEFVLRKRKQHYFVCGERGGIHCTMGQMKFVVKPKSSACRDD

SEQ ID NO: 131102 - protein, 168 aa, Triticum aestivum
  Clone ID: PAT_TA_25520.pep
MAGAGAAAAISSEQMSEFREAFAFFDKDGDGCITAEELSTVIRSLGQSPTPEELRDMVRDVDADGNGTIEFAEFLALMSRKADADADAADPEEELREAFRVFDKDHDGHISKAELRHVMISLGEKLTDEEVDGMIQEADLDGDGLVNFDEFVRMMMLSDADQQQQQQH

SEQ ID NO: 131103 - protein, 220 aa, Triticum aestivum
  Clone ID: PAT_TA_25521.pep
EEFGTRILWDACPVDPSPASGAPALAALISGSALLLAVAGVCRAAVAPPGLAAPRPRVQRPSSAGGLRRLQASRGCVADGHPWRRRPGAAAVGPWLLGRPWACGGLGPLSAAPVVVMRNLTEEDEFLIIGCDGIWDVFRSQNAVDFARRRLQEHNDPVACCKELVDEAIKRKSGDNLSVVVVCFNSIAPPVLTAPRPRVQRSISAEGLRELQGFLDSLAD

SEQ ID NO: 131104 - protein, 147 aa, Triticum aestivum
  Clone ID: PAT_TA_25522.pep
DDHVILVAEDPAAAPERRILSTGCLFVERKFLRGGGKVGHVEDVVVDAAARGRGLGLRVVRRLVETAKDAGCYKVILDCTPELRAYYAKCGFVEKGVRVAAAVGLLIHPWGNAQQRLHFFVPSHLQYPFVCGNLLSYHYSELVCVSD

SEQ ID NO: 131105 - protein, 88 aa, Triticum aestivum
  unsure (1)..(88): unsure at all Xaa locations
  Clone ID: PAT_TA_25523.pep
AWSRPRYLAAELLELAXNAAKDNKKSRIIPRHLLLAIRNDQELGKLLAGVTIAHGGVLPNINPVLLPKKTAEKEPKSPKKAAKSPKKA

SEQ ID NO: 131106 - protein, 162 aa, Triticum aestivum
  Clone ID: PAT_TA_25524.pep
MSAAEGAVVFSEEKEALVLKSWAIMKKDSANLGLRFFLKIFEIAPSARQMFPFLRDSDVPLETNPKLKTHAVSVFVMTCEAAAQLRKAGKITVRETTLKRLGGTHLKYGVADGHFEVTRFALLETIKEALPADMWGPEMRNAWGEAYDQLVAAIKQEMKPSE

SEQ ID NO: 131107 - protein, 162 aa, Triticum aestivum; identical to SEQ ID NO: 131106
  Clone ID: PAT_TA_25525.pep

SEQ ID NO: 131108 - protein, 211 aa, Triticum aestivum
  unsure (1)..(211): unsure at all Xaa locations
  Clone ID: PAT_TA_25526.pep
KXVARTDLYYDMSYTVAYSTFANIPSDTTENSGISTDADSENGAPVKTASLLDLYSGCGGMSTGLCLGSALAGLKLETKWAVDLNSFACKSLKYNHPKTEVRNEKAEDFLALLKEWAILCDKYVHSNDSDAAEPVEEEEADEPLGKDEFVVEKLLEICYGGTGRKNGIHFKVQWKGYGPEEDTWEPIENLSDCPLKIKEFVQEGYRGRDHA

SEQ ID NO: 131109 - protein, 104 aa, Triticum aestivum
  Clone ID: PAT_TA_25527.pep
MGPSNSSKGEVSVDASLSTWLVSSDNSTVDKAQSKSPRSVSSVCRQERPVLGALTVDDLKQSSATSSPRRSPSHNREEVPILGSGPGGRSSTKQGNEYLGRDHA

SEQ ID NO: 131110 - protein, 365 aa, Triticum aestivum
  Clone ID: PAT_TA_25528.pep
IGRYLKAATPSASAPAPPSTSPPPSSTPRPRYFTSKSMYDVRELKENHPEFALLLETSGDESAHFSNLNYAKVPVHDLEVGSHILVRAGEAVPVDGEVYQGSSTITIEHLTGETKPVERTVGDAIPGGARNLEGMMIVKVTKSWEDSTLNRIVQLTEEGQLNKPKLQRWLDEFGEHYSKVVVALSLAVALLGPFLFNWPFFGNSVCRGSIYRGLGLMVAASPCALAVAPLAYATAISSLASKGILLKGGHVLDALSSCQSIAFDKTGTLTTGKLMCKAIEPIHGHLDASNGVDPSCCTSRRSSWPSSSPSCRRPPWTPAPSSPPWASCPRGSSPQASSQQPWVPWMLRRRLLLLRRRERSLAGVE

SEQ ID NO: 131111 - protein, 122 aa, Triticum aestivum
  Clone ID: PAT_TA_25529.pep
ARGSFHLLFFWILFENVMSLHRSKATLIGLLEAGRANEWVVTEKLGSAMKMKSANKASARKSFMRMWERLNVPELGVGAFLFSCGWYDVAFGKDNFFIYLFFQSMAFFVVGVGYVGTIVPQS

SEQ ID NO: 131112 - protein, 199 aa, Triticum aestivum
  Clone ID: PAT_TA_25530.pep
MEGVGARLGRSSARYGPAMTFTGPVRKWRKEWVTISAATATATSAAASSTGTGSRGNNLILFKWTPLNGANEGDEEQTAPAKTATRRRRYVPVSVVQDQRQESAKSDDENKANDGEPSSTETEQSIGKTNMDDILMDESQASDEVRDSGNFVGGTDINLNLGPKDPDREDEGDTGEQHEVRTEHRLKRKSVTPDLEMRM

SEQ ID NO: 131113 - protein, 68 aa, Triticum aestivum
  Clone ID: PAT_TA_25531.pep
RACMPPPTSAPQDGNFSIFIIVSGRRRKNWSSGFALLKSLPIEIQVCKISGDQHIIIDLVILITDKHN

SEQ ID NO: 131114 - protein, 175 aa, Triticum aestivum
  Clone ID: PAT_TA_25532.pep
TEAAYWCCKSLINGVNKTRHQASSSFGKQQTTCDTPCSWDMGPTEYSRSCAKPGALTIDDGIFLALIGDASAVGRCCRIAIDLGRVRLVGVAGWERQQPRISLVSSINLTPECGKPASPHCCSPNHSVIPRRSGWAPPRQTRRRPKIISACLSTTKLQLHFGLPNWLSMIAVSIP

SEQ ID NO: 131115 - protein, 95 aa, Triticum aestivum
  Clone ID: PAT_TA_25533.pep
MGGQKGPAAIMVGVLLILGLATAAMSSSEKVATGEKTSWPEVVGLCAEEAKKIILKDKPDANIVVLPAGSMVTMDYDPLRVRIFVDTVAEAPHTG

SEQ ID NO: 131116 - protein, 118 aa, Triticum aestivum
  Clone ID: PAT_TA_25534.pep
PRVRPASAPRPLLPVELPEISSLIVSRGIEKLAWDAAGERLAVSFKDGNETYQGLVAVYDVRRSPLVSVSLVGFIRGPGEGVKALAFAFHNKFKQGPLLSVCWSSGWCCTYPLILRSH

SEQ ID NO: 131117 - protein, 157 aa, Triticum aestivum
  Clone ID: PAT_TA_25535.pep
LPANDKIPEITEARNIELGLGLQLCFMHPSKYKFEHPRFCFERLEYVGQKIQDLVLAERLLMKHLDAPGRWLSEKHRRLLMNKYCGRYLRDKHLHHYIIYGETVQDRFEHNRRLRNPSTTAVQQAIHGLSYCVYGKPDVRRLMFEVFDFEQVQPKAV

SEQ ID NO: 131118 - protein, 377 aa, Triticum aestivum
  Clone ID: PAT_TA_25536.pep
MKRKQLKKKKDRVLDAAVESEGAAGHAIAEDIGSKKIVLVKQKKKIKHAKVTSCCTKAHNLVTLNEDEGTPKLKKKKSKKQLKESKSPVEVQSPLDSNDAGTLKLKKKKRKVKEGKSSVEPNDADDILHENLDEETLNADVNQLPAESEVMDIGEPEKAKKRKKNKTADVKQVAEESEVMDIGEPEKAKKRKKNKTKKVKQSGEVNRTDMQVSVREDNLEEHEVDTADVDEIASVDEDCSRGIKKWILEYRQKRPGLKVLQQNIDVFITAHEEQQEREKKEREAAAAEDGWTVVMHHKGRKKTTDVETGTAVGSVSLAAMQEKMAQKKPKEVGRNFYRHQKREAQMSELAMLQSKFEQDKKRIQQLRAQRRFKPYGF

SEQ ID NO: 131119 - protein, 274 aa, Triticum aestivum
  Clone ID: PAT_TA_25537.pep
MARVSANAVALVALVSVLLTYGCCAQSPLNYTGSLAKSSKASWSWLPAKATWYGAPTGAGPDDNGGACGYKHTNQYPFMSMTSCGNEPLFKDGMGCGACYQIRCVNNKACSGKPETVMITDMNYYPVAKYHFDLSGTAFGAMAKPGQNDKLRHAGIIDIQFQRVPCNHPGLNVNFHVERGSNPNYLAVLVEFANREGTVVQMDLMESRNGRPTGYWTAMRHSWGAIWRMDSRRRLQGPFSLRIRSESGKTLVAKQVIPANWKPDTNYRSNVQFR

SEQ ID NO: 131120 - protein, 313 aa, Triticum aestivum
  Clone ID: PAT_TA_25538.pep
MAALPPVVSLLLVLVVAAPAALAPVASAVPFIVLHGIGDQCGNDGIASFTDELAEWSGSKGYCMEIGRGSWDSWLMPLQDQANVVCKKVKEMEELREGYSIIGLSQGNLIGRAVIEYCDGGPPVKNFISIGGPHAGTASVPLCGSGFLCVLVDALIQLEIYSNYVQAHLAPSGYLKIPTDMTAYLQGCKFLPKLNNEIPSERNITYKERFSSLENLVLIMFEDDAVLIPRETAWFGYYPDGAFNPVLSPQETKLYTEDWIGLRTLDEAGRVKFVSVPGGHLRISRSDMKKYIVPYLTPSCGSSKQSIRRILSY

SEQ ID NO: 131121 - protein, 183 aa, Triticum aestivum
  unsure (1)..(183): unsure at all Xaa locations
  Clone ID: PAT_TA_25539.pep
MSTTTKGTAGYDRRRELQAFDDTNAGVKGLVDAGITTIPLIFRHPPDSLASSSTATIPVIDLSGRRSEVVXKVRAATETVGFFQVVNHGVPADLLAEMLASVRRFHESPAEGKDPALHPLTSPRRSGFNSNFXTCSKSPAAHWRGALPPPALPRPPGPHPRPPAGPLPPQYGDAVRRLAVRVL

SEQ ID NO: 131122 - protein, 99 aa, Triticum aestivum
  Clone ID: PAT_TA_25540.pep
VGGRSGGTGIHQAPQPQQELLSLPSGRSPEPPPAATASLTLCPLSSFLPISLMPWSLSISRTPSPPEQYAAPAARSIDAAPGWPARHQIERLAVGIGRR

SEQ ID NO: 131123 - protein, 117 aa, Triticum aestivum
  Clone ID: PAT_TA_25541.pep
AVTFFSPLHSSAASWGRRRGVGGDLERSRGWPDGELEEGLQPGRGRIGRGNAILLIGAVAGSLKKTFNRRGCRARRPVQEKASAVGARAVRGEGGRWRRGRTGAGGRGRRRNGRRRE

SEQ ID NO: 131124 - protein, 86 aa, Triticum aestivum
  Clone ID: PAT_TA_25542.pep
LESDVIFFLCCTSQKRLVKGNTIMVFYRATNESLPMFFCRQLFALLETVRRVCWSAVHLGLRICHLLLGTYIVLLHIASICVHLKR

SEQ ID NO: 131125 - protein, 149 aa, Triticum aestivum
  unsure (1)..(149): unsure at all Xaa locations
  Clone ID: PAT_TA_25543.pep
DPPGCRQQSIHPDIHLFLLPPLKSQEAEIQQSTEKKKMFADAGFSFSAYSSALSGYSYSYSSVFSHPHPRLLLLLLSLILCCTGHNRPLPTPGLSGNQTNNQSQLVGCRQPKXTSPPATMLQQPGGKLGEANXLDKQKLGLGNXKGGTC

SEQ ID NO: 131126 - protein, 90 aa, Triticum aestivum
  Clone ID: PAT_TA_25544.pep
ISQSSHSRSLTQHRPRTCLCSPIMCVCRLALTPPPRLPPRFCRPAPPPSTTHLPQPRRLQRRRKRKGRIAEKWRRHRSLGLGLSEEVAQG

SEQ ID NO: 131127 - protein, 144 aa, Triticum aestivum
  unsure (1)..(144): unsure at all Xaa locations
  Clone ID: PAT_TA_25545.pep
AAAWTRQLRARRPVMVVKSPDPGSPRHLRASPSSHQPSLDLPASLSSHQPSLDIRARSLRHINKWHVTGRKTWAPLRLTKGVSSKPMFLQFGLKACSIQXRCXRCSPTKXSPKNKGGWSSXKKGLXPSPSQRGFKSRVDCXXFG

SEQ ID NO: 131128 - protein, 154 aa, Triticum aestivum
  unsure (1)..(154): unsure at all Xaa locations
  Clone ID: PAT_TA_25546.pep
MMNDGRVHPAATSSDFSGEYAYSSSDPSSSPLYSFHFEKPVPPPPQHQNKPQPGTYVVQVPKDKVFRVPPPENARLFQHYTRRAKRRAGCSCLRACLYLAVALLSLAVLLAGGVGAVYXAFKPRQPXYTGVSLGASGPLPVGPAYALGALSSGF

SEQ ID NO: 131129 - protein, 238 aa, Triticum aestivum
  Clone ID: PAT_TA_25547.pep
HGDLNLELHCDITPRTCENFLTHCENGYYNGLIFHRSIKNFMIQGGDPTGTGSGGESIWGQPFKDELNSKLLHSGRGVVSMANSGPHTNGSQFFILYKSAAHLNFKHTVFGMVVGGLHNLSAMEKVPVDDDDRPLEEIKLLKVNVFVNPYTEPDEEEEKAKEEEKNKDEDHDKVGSWYSNPGTGVSASASAGGGVGKYLKARTAGSADATGNAAAADDSSKKRKASAPSVEFKDFSGW

SEQ ID NO: 131130 - protein, 125 aa, Triticum aestivum
  unsure (1)..(125): unsure at all Xaa locations
  Clone ID: PAT_TA_25548.pep
IQQKIVKXKMKLPTYLSSEVHSLLKGLLHKEAGRRLGSGPGGSDEIKNHKWFKAVNWKKLEARQIKPSFCPNVAGQTCIANFDECWTSMPVLDSPVASPVAADSNFVGFSYVRPEPFLQKPSPLG

SEQ ID NO: 131131 - protein, 484 aa, Triticum aestivum
  unsure (1)..(484): unsure at all Xaa locations
  Clone ID: PAT_TA_25549.pep
RWFPLGNTSVTTTHTQRPKLFTGMILLPKGLSDAIVPENGEFDFNDVFGATAVQTPTEVSILNSGSPAPLAESNEEVNNDPVLFTKLSHSLVXPLHLFANCCYLRKLTLNETESSLELLECLSXKEKKSGQGSLSDEESXNDTTKENEAVGLDDFELLKLVGQGAFGKVYQVRRKCTSDIYAMKVMRKDKILEKNHAEYMKAERDILTKVDHPFVVQLRYSFQTKYRLYLVLDFVNGGHLFFQLYQQGLFREELARIYTAEIVSAVAHLHANGIMHRDLKPENILLDAHGHAMLTDFGLAKEFDENTRSNSMCGTVEYMAPEIVQGRGHDKAADWWSVGILLFEMLTGKPPFFGGNRDKIQQNIVKEKMKLPTYLSSEVHSLLKGLLHKEAGRRLGSGPGGSDEIKNHKWFKAVNWKKLEARQIKPSFCPNVAGQTCIANFDECWTSMPVLDSPVASPVAADSNFVGFSYVRPEPFLQKPSPLG

SEQ ID NO: 131132 - protein, 197 aa, Triticum aestivum
  unsure (1)..(197): unsure at all Xaa locations
  Clone ID: PAT_TA_25550.pep
QAPARGLGVPGTTGPLRGPEGQAAEWFAIAEADAFXALAAVNVCAAPGGTPPPFLDLSXNFYTGLDEDEEEWVREIFSGSKKEYAVEKEWELLVLRMGDTPLFFQRRGQPFLDKDDSWPSLTYPPGCGAERLHHRQHPLDNTESENSVQNTQIIIFFGRNAYFIVNANEMTSQTKHVTYLLDMRREIKTEKQSVPPR

SEQ ID NO: 131133 - protein, 455 aa, Triticum aestivum
  Clone ID: PAT_TA_25551.pep
GYQLSSGCSEAPIAKALRDGVRVIELDLWPNAAKDDVEVLHGRTWTSPVDLMKCLETVKEHAFVSSPYPVILTLEDHLTPHLQAKVAKMIKETFGDLLHLSESEAMPVFPSPEDLRGKIIISTKPPKEYLETKSSKEEAQNGSAEESVWGDEIPDNKAQVATARQVSEKDTERYVEEDEEMEKKVQQGVNGEYKSLISISLTRRKHDMDQDLKVDPEKVSRMSLGEAAYEKATITHGSEIIKFTQRNLLRIFPKTTRITSSNYNPLMGWRYGAQMVAANMQGHGRKLWLTQGMFRANGGCGYVKKPDFLMNTDKMFDPRSKLPVKTRLKVTVYMGDGWRFDFRKTHFDKCSPPDFYARVGIAGVVADTMMKETKVIMDNWIPTWDHEFEFPLSVPELALLRVEVHESDNHQKDDFAGQTCLPVWELRSGIRSVRLYARDGEALRSVKLLMRFEFS

SEQ ID NO: 131134 - protein, 163 aa, Triticum aestivum
  Clone ID: PAT_TA_25552.pep
PRGPCRGLPAAAASRPAPAGTSSRSSPPSAPRPLALAPRPGARLSLLGPQIDEAEARAASLGVGSELATSLFSAGAAELPCTVKLRVWRHDIKDPRVALATEAWRWTLQHTVACGASGGLISFSEEFMVACQGYALERSVSIRVMSLYVYLHSELLSASSIFV

SEQ ID NO: 131135 - protein, 110 aa, Triticum aestivum
  Clone ID: PAT_TA_25553.pep
TNTLKQPLSRILRKTELPDVLPKLDNVSLVTVPVDTSDADAEKSHSDSTSQAAMPSKESLNHPANIHIVLKYVASLLEMPEAELAEASYRNATKLFSYPGSKVHPEAETA

SEQ ID NO: 131136 - protein, 69 aa, Triticum aestivum
  Clone ID: PAT_TA_25554.pep
MSTPGDGPKTEWPELVGRTIKEAKEKIKADRPDLKVRIVPVGSTIVTADFDLNRVRVWVDTVAEVPKIG

SEQ ID NO: 131137 - protein, 68 aa, Triticum aestivum
  Clone ID: PAT_TA_25555.pep
MSKQGDGPKTEWPELVGRTIKEAKEKIKADRPDLKVRIVPVGSIVTADLDLNRVRVWVDTVAEVPKIG

SEQ ID NO: 131138 - protein, 186 aa, Triticum aestivum
  Clone ID: PAT_TA_25556.pep
MADSGDSSPHSAADDAHHHHLPDPTTNASPETIASQAAAAPAVSAPPPVPAVPAKVRLMVSYGGRIQPRPHDNQLSYVNGDTKILSIDRPLRYPDFYARLAGLAAARADLCVKYQLPGEDLDALVSVTNDEDLDHLVIEYDRLHLFRAPAAPIWRVLPGSTPRLRVFLFPVAPPPRPASPPKQQHQ

SEQ ID NO: 131139 - protein, 144 aa, Triticum aestivum
  unsure (1)..(144): unsure at all Xaa locations
  Clone ID: PAT_TA_25557.pep
PXVXPRWGXRXLPGKRGGXRGGPXXXXGXXWFGGPPXEXILLKXXRXIVGGRKEPACHPRWDLGDHHECREDLLFLLPHPLFLPPHLPLCLLLFLPDLGGGGRRHTRSTGGAALSASSSMSSATGIWRRQGVEHWPPPSGGVRR

SEQ ID NO: 131140 - protein, 65 aa, Triticum aestivum
  unsure (1)..(65): unsure at all Xaa locations
  Clone ID: PAT_TA_25558.pep
IDEPIITVTSTPSWTLSIFNQRQGATKRIKQFIFVPQNRKGLHLTLSKWKDFXNWLLSYQCNGHL

SEQ ID NO: 131141 - protein, 414 aa, Triticum aestivum
  unsure (1)..(414): unsure at all Xaa locations
  Clone ID: PAT_TA_25559.pep
VAREMVAYARSLGCPDVEFTPEDAGRSNREFLYHILXGRTNLNIPDTVGYTLPHEFGKLIADIKANTPGIENAIISTHCQNDLGLASANTLAGAYAGARQLEVTINGIGERAGNASLEEVVMAIKCRRELLGGLYTGINSQHITMTSKMVQEHSGLHVQPHKAIVGANAFAHESGIHQDGMLKFKGTYEIISPDDIGLTRANEFGIVLGKLSGRHAVRTKLVELGYEINDKEFEDFFKRYKEVAEKKKRVTDEDIEALLSDEIFQPKVIWSLGDVQATCGTLGLSTATVKLITIDGEEKIGCSVGTGPVDAAYKAVDQIIQIPTVLREYSMTSVTEGIDAIATTRVVITGDVSADKPALTSNSNRSFSGSGAAMDVVVSSVRAYLSALNKMSSYVGAVKASSEAPETISVQTTE

SEQ ID NO: 131142 - protein, 203 aa, Triticum aestivum
  unsure (1)..(203): unsure at all Xaa locations
  Clone ID: PAT_TA_25560.pep
KXXXXXXXXXXMPPPXXGXXXXXTGGGATGPARCRSLPARGGRARPPGGGPGRASWGPPSPCQPHTYASTPARDRRIQRKPGPAGGAREGRRRARRGGTRKGCPGRTRTRTAHPSLRVLAQEEEEGESTVSTAPARGVDWKQELGRTGEKSEIDGWMRVAGGRTERSKQAHAIKYGGARPPTPPTRGRGGGRGGGREALLLLL

SEQ ID NO: 131143 - protein, 143 aa, Triticum aestivum
  unsure (1)..(143): unsure at all Xaa locations
  Clone ID: PAT_TA_25561.pep
XXXXXXXAVAPGRRRRRRGGRRLLVGEEDVGAGQARQPGGGAGAVALPRHFPPREGTTCXEAWTGTTPLPEYYRRGARARDGGQKSPLGGRDNYAQHVRGGDGCLSCHLMLLTPHKLCLSPLSLSPDGRRADGRGRKAAGWRR

SEQ ID NO: 131144 - protein, 49 aa, Triticum aestivum
  Clone ID: PAT_TA_25562.pep
QSSTSETRSTPTCFLATRRHSSMLGTNSCAVVIPCWRKILSMSVSRRLP

SEQ ID NO: 131145 - protein, 190 aa, Triticum aestivum
  Clone ID: PAT_TA_25563.pep
HEGTLPLFTKVALVKTNEAEAHALMKMLLNHGADVNILDQGFLEEPALIIAAKNEWNLVIDLLFHRTKQIAGIEDWTIANLLIHVQTEEFLHQDRLRKANKIQQLRPRIIVELEARNVVVAIYLCKALKSDMDEWDWSNISSLCDLCVHFGMTSSEYEVTVESISTYTSAYFLYKQYDKALLAVKACLAL

SEQ ID NO: 131146 - protein, 175 aa, Triticum aestivum
  unsure (1)..(175): unsure at all Xaa locations
  Clone ID: PAT_TA_25564.pep
PGRRSWRAEPKLLRDGTGQIWVLIWARGVGLLRGCPLERVTAVTVALVLARGGWRLLLLAWVAGGVWAVFSQLCEVLAIHGGAASTTRCYGGGGARLHGRAASNLGGVEMCGHTDENPVRFLSXLRRWHLWVPFPSLXXSSSYVAISLARLVWVGVSGRKPXXXAGXXRWRXXRR

SEQ ID NO: 131147 - protein, 121 aa, Triticum aestivum
  Clone ID: PAT_TA_25565.pep
RRFGATGRSHRCPSPTSRRGLPRRRLTQSARRRAAAGGLRAGPICSKSLGDMTVYFGMLDGLLAAEELPEEYRNRCQDILCDDCGRKGLSRFHWLYHKCAACGSYNTRVIKTEAPDCSTSN

SEQ ID NO: 131148 - protein, 136 aa, Triticum aestivum
  unsure (1)..(136): unsure at all Xaa locations
  Clone ID: PAT_TA_25566.pep
SCSSCSSPAPQGQGQPPEAPEEAWAERQPPEASEDALTLLLSEGGCGAFAGLVAAMAGVGDAFREQIGSDLGLTILCPDDEAVWPFIPRFHSLTVDEQVAVLLYHGLTMAYSXXLLSQVHWEWXXLTFDGEQLTIR

SEQ ID NO: 131149 - protein, 299 aa, Triticum aestivum
  Clone ID: PAT_TA_25567.pep
MDRTAYQGTRDWGIVNKEKVKLPADDRAMDTAAYQGTGDWGIVNKDKVKLPEDDRAMDTAAYQGTGDWGIVSKEKYTLPARRYPQKPRKLNCPSYMSKGTCTYGPSCHFNHPPQLKSRSDESWRPSERRNHGAAEILELNRLGLPIREGARNCDYYMRTGACRYGKNCHFNHPDHVIDAQFNPPTGWEDNALQQMEKSSDRTLDETSHMKKSSDDATLDNRSHMKSSDDATFDDRSHLKKPDGATLDRSHLKKPFDGAIVDTYSKKSSDHDNSCFWCPAPLEFSSQVAPEGKKKGHTPL

SEQ ID NO: 131150 - protein, 216 aa, Triticum aestivum
  unsure (1)..(216): unsure at all Xaa locations
  Clone ID: PAT_TA_25568.pep
MAYRADDDYDYLFKVVLIGDSGVGKSNLLTRFTRNEFSLESKSTIGVECATRSIXVDDKVVKAQIWDTAGQERYRAITSAYYRGAVGALVVYDVTRHVTFENVERWLKELKDHTDANIVIMLVGNKADLRHLRAVSVEDAKAFAEREYTFFMETSALESMNVEDAFTEVLTQIYRVVSKKALDIGDDPAAPPRGQTINVGSKDDVSAVKKAGCCSS

SEQ ID NO: 131151 - protein, 161 aa, Triticum aestivum
  Clone ID: PAT_TA_25569.pep
MVSGSISEEIAVAVPAERMWKVAFAETKSALLPKACAGYVDAVEVDGDGGPGSVTTMKLNPSLGENKTLKSRVVALDAAARVVRTEVLQGGTVSAQLRTHFAEIRVEAAGEGACVAKVKVDYERLDGAPLAPEDEARLAQGYVRLVRMVEAYLVAHPDEFA

SEQ ID NO: 131152 - protein, 176 aa, Triticum aestivum
  unsure (1)..(176): unsure at all Xaa locations
  Clone ID: PAT_TA_25570.pep
SGNXPPDAPLPLPAAASPRAPPPAGAVRIGVPPTRACPPRPRAAASRPASGSPSRPRWGSAPAALLVRRPHRPRRGAEPAGGASRPRRLVPALPSWSPPPAAARSSSPAGSLSRPAGLPWRGLARLPFGLLRLGRTSAALWMLVAGLATQLVLYSRLAVLLGSDVDGNIENVATIR

SEQ ID NO: 131153 - protein, 167 aa, Triticum aestivum
  Clone ID: PAT_TA_25571.pep
ARGLVPNLELATTRCCLFLFLATPKPPTPSLPTTSACLLRPRGRLLLGSSRCRAATKYQSAESPDASSLRLASVAAPSPPASVRPPDGGGLLLLLSVAASAVAISASFIFFSAMPSMLDCKRAAESLEKSFDLTREKLPESMASVRLVAKEIGALSVDLSDLSQELT

SEQ ID NO: 131154 - protein, 112 aa, Triticum aestivum
  unsure (1)..(112): unsure at all Xaa locations
  Clone ID: PAT_TA_25572.pep
MAAAEEGAVIACHTKQEFDTXGKLVIIDFTASWCGPCRVIAPVFAEYAKKFPGAIFLKVDVDELKDVAEAYNVEAMPTFLFIKDGAKVDTVVGGRKDDIHTKIVALMGSASA

SEQ ID NO: 131155 - protein, 118 aa, Triticum aestivum
  Clone ID: PAT_TA_25573.pep
MAAEEGAVIACHTKQEFDTHMANGKETGKLVIIDFTASWCGPCRVIAPVFAEYAKKFPGAIFLKVDVDELKDVAEAYNVEAMPTFLFIKDGAKVDTVVGGRKDDIHTKIVALMGSASA

SEQ ID NO: 131156 - protein, 174 aa, Triticum aestivum
  unsure (1)..(174): unsure at all Xaa locations
  Clone ID: PAT_TA_25574.pep
PWGSAGPSASMVHRNAAAPAPPXGSPPPPPPPPAAWIPPSTPTPDAMVAGSSRGPPGYAPVPMCSVVNEEEALAFVSVPTGASGVVRLGVGMEGADATAPPPLVTTAGSSSRVERRFGRLFGRAVSAVDRRPGHRAGSWAPATLGLASAAPEGARHQPVVASSSDEECSTGLRR

SEQ ID NO: 131157 - protein, 136 aa, Triticum aestivum; identical to SEQ ID NO: 106789
  Clone ID: PAT_TA_25575.pep

SEQ ID NO: 131158 - protein, 101 aa, Triticum aestivum
  unsure (1)..(101): unsure at all Xaa locations
  Clone ID: PAT_TA_25576.pep
RPVNSSKQKQXKKLSHSIISEKLAACVNIVPGIESVYWWEGKVQSDAEELLIIKTRESLLDALTAHVKANHEYDVPEVIALPITGGNTKYLEWIKNSTRDK

SEQ ID NO: 131159 - protein, 255 aa, Triticum aestivum
  Clone ID: PAT_TA_25577.pep
FFFFFLQWQVSIPQEFIALSSDWEQHEQDDRHQYSTLELTSTATIQQSHETKKPEPFYVVYKNNYHQPFHLVHVHSYQPTKKNTSPPHLAFLHNNASTSQHFDTLQLLGVTTSTSSISRCRAFAWLDDTRRARWLGLGVPVILLVHGAWLQLPKILTSYMVSELGSKQQPESVVQGRGTTRSSFPGRGTRSSVPGRGTQSSVPGRGTRLSSLSTTGRETIPAAGRPRSEMAEERRASCKKILVSQEGLGDTAYSV

SEQ ID NO: 131160 - protein, 143 aa, Triticum aestivum
  unsure (1)..(143): unsure at all Xaa locations
  Clone ID: PAT_TA_25578.pep
FVDARNEPVNVELSVDEXKGCTFNSRSRVAVFKDTEKDRSDPDYDRNYKRYVRPPVPDYGVSPGAFNFAVPQFVQYGVGYMQSPSMPRNQPSVYFGQPDLSMGSSGTAVYPQWPTPAMMYPHCYDNLGHVISQVPVYQSFNHG

SEQ ID NO: 131161 - protein, 386 aa, Triticum aestivum
  Clone ID: PAT_TA_25579.pep
MSSAPAPPPPPPPSSPPADEGRPREATEVDDRVASHVDPFLVEALDNPRHRLMILRMELDIQKFMQNHHLHEFEFQHFPTSYLRCAAHRVAQHYGLETTVADSLVDGSNSRIVARKTPESKYPAIALSEVPVKQARNDIEAAEKLKFVICQRPKASQNGAYGAGTNNGAAKTVEERIDDYNKARARIFNGSIPADVVGPSDFGALSVARNEPVNVEPSVDENKGCTFNSRSRVAVFKDTEKDRSDPDYDRNYKRYVRPPVPDYGVSPGAFNFAVPQFVQYGVGYMQSPSMPRNQPSVYFGQPDLSMGSSGTAVYPQWPTPAIMYPHCYDNLRHVISQVPVYQSFYHHWEMLLLGMLEQNYLLPPVMSCVPVYRVFQLWFWSCQTSV

SEQ ID NO: 131162 - protein, 203 aa, Triticum aestivum
  Clone ID: PAT_TA_25580.pep
SSAPGSSGALVPAAPPAPLLSPPLSITSPLRFDSPCPSLLGASASGAGLQWFRPAPPGSVGAPGPTDPARRGFIRAGRGCVWESVSLCPFLFPSVGPVCLVFLFASACGGLSLAFSCGALSTGAGGWARLSVPCEFRLLPRFPHLRSSARSLCVHIIGTCPAGPPGSLPALDYSGYDPAWCGGSPTAPLDSAECFIGTHGFSD

SEQ ID NO: 131163 - protein, 209 aa, Triticum aestivum
  Clone ID: PAT_TA_25581.pep
AAASTETPIQPEAAKPTGKGTKPENVRDDKVDNLYNDGHQYFADIVEMGATDPDAMEYVLSVMKEAKEKVRKFEESRKEKRPGESPVSASKKGAKSSKPSAEDVGNSTSAPTMMVAAASATLAASTPMPVPSCTQMSVPPTMMAMATTSAAVPPGMFLVPMHPHMVFPPFTPGLPAAVPPVAPPPAPTANAVGVVSNPTKKRKKRKGNS

SEQ ID NO: 131164 - protein, 172 aa, Triticum aestivum
  unsure (1)..(172): unsure at all Xaa locations
  Clone ID: PAT_TA_25582.pep
DYTFPLCLTNPITRPLSNGHQDIVFVSSAQWFAITIPNAIRNMAMHLVVCKFKLYCKPTVGRNCIAELXHLPTLFKIVETGGISNYSVTHVDWSEGKWHPCSYVAAELTYETIRNITYFNEIVHIASDETRTVTSTPCILNGRKRPCFLFARKFYPDAVNNLLKLFPSYTSA

SEQ ID NO: 131165 - protein, 64 aa, Triticum aestivum
  Clone ID: PAT_TA_25583.pep
ECSVLSSSNFMSTNRQAAMYEVKYRANYLISPWSSFPPFMVNLTPIKPSGSLGYLPSHSYPVMI

SEQ ID NO: 131166 - protein, 220 aa, Triticum aestivum
  Clone ID: PAT_TA_25584.pep
DPGSTMTLYFPAEAETAILPHDIAGKVPFENLSDVLSTFHISPGSAEAAQVEDTLRKCQQPPIAGEIKACTMSLESTVKAAMEMLGTTIQQGGGGGDVWAATSTLPRGGLLPHREYIVQEVTKLEGTGYVACHKVPFPYAVFHCHIAHTGYIGYKVTLHGRGDNEGPVVSLLAFCHFDTSHWNPAHPAFQILKTHPGASTSVCHFMSYGNLAFIKKARTA

SEQ ID NO: 131167 - protein, 144 aa, Triticum aestivum
  unsure (1)..(144): unsure at all Xaa locations
  Clone ID: PAT_TA_25585.pep
RSVYFSKNAIWVRYQSRTVYRDMYKEYRVATPVKGMYXMASRHCARSPCIQIIKTATVHFSICKRDNTKQFHKSDIXVPLVYQKVRQPTRFLQGPSRGEQVPSIPSPGAGDVNIRDGSTTSASAGMSADKNMNYAVLTSASAVV

SEQ ID NO: 131168 - protein, 123 aa, Triticum aestivum
  unsure (1)..(123): unsure at all Xaa locations
  Clone ID: PAT_TA_25586.pep
PPGGILTALYIFHGHDISRGLLAATFLLVVFNCLSSFQIYSMPVFDSFEAFYTGRTNRPCSVWVRSGFRIFYGFISLFIGIALPFLSSLAGLLGGLTLPVTFAYPCXMWICIKKPERFSYSWS

SEQ ID NO: 131169 - protein, 136 aa, Triticum aestivum
  unsure (1)..(136): unsure at all Xaa locations
  Clone ID: PAT_TA_25587.pep
HEGHVLSPPLPPDTATRLSSGSDPTPPPISSSASPLRRPPLPIHAAPATSLSSPLSAWSGRDPSPMPWRPWQQEEPGHGGXPLPAALPHLTFSSLLSSSLPXXERRGGKGRPSPASFQGGEERPDPDPRRIVPSST

SEQ ID NO: 131170 - protein, 442 aa, Triticum aestivum
  Clone ID: PAT_TA_25588.pep
MEAKGAGERDALIDLESGNSVVISEHGHGMDANFAVSPPRTPPNGGLNRVMHTKDDGNQHMDCSSPAMETASKNGDDRKSEGEEKLGLLDSSGGEKAKKKRSSSKKPPRPPRPPTHLPLDASDQKLLNELNELALLKRARIVRARSGRPCTQTQQVEGGDRGNGPPAMSSSWNSVGLEVLYQVIGWIAFVAWSFSFYPQVVLNYRRKSVVGLNFDFLVLNFTKHSSYLIYNAALFFSPFIQQQYHDKFGDKEMIPVAANDVAFSLHAVALTSFTLYQVFIYERGNQKVSKVCISISAVVWSAAIVCLIVAWPKSNWLWLIDVFNSIQVAMTTVKYIPQAVMNFRRKSTVGWSIGNILLDLTGGVLNFGQMGVQSIDQHTLVNFYGNIGKTLLSLETVFFDVLFIIQHYVLYPVKRDENGKAIISERVAPLIRPSDKPEEDSV

SEQ ID NO: 131171 - protein, 341 aa, Triticum aestivum
  unsure (1)..(341): unsure at all Xaa locations
  Clone ID: PAT_TA_25589.pep
MMSPAPAAAILGSLGGWLSRAADPPAPRLCGSPGPPPGTPAPATLPGGPHQSSAASAAPTARARLRCGSTAVFXALSYSEVVRSSLSSDGVIGEYGGVTSSVFSWWKSRTQDVRAKYVIEXGTEKVVELRPKFHLIGPSLGGRPAWAALXYIPERIAGAAMMAPVVNYWWPGFPADLAAEVYNKQEVGDQWALRVSHYAPGILHWWMDQSWLPTSTVVAGTTPLPNKRDAEIRAKLKADGTFQQKMELATQQGIHESYYRDMMVMFGKWEFDPMSLPKPACPVHIWQGDEDDLVPVVLQRHIASRLSWVNYHELPATGHFLSPVPGLGDTVLQTLFGNAKQ

SEQ ID NO: 131172 - protein, 133 aa, Triticum aestivum
  Clone ID: PAT_TA_25590.pep
PSVRQASAQASGTTPLPNKRDAEIRAKLKADGTFQQKMELATQQGIHESYYRDMMVMFGKWEFDPMSLPKPACPVHIWQGDEDGLVPVVLQRHIASRLSWVNYHELPATGHFLSPVPGLGDTVLQTLFGNAKQ

SEQ ID NO: 131173 - protein, 126 aa, Triticum aestivum
  Clone ID: PAT_TA_25591.pep
IWQQIYLRKEYEHHFCRCTPGLSWISGNEHFLFKIHLQNQLIEGPYVELLFKNLLMTVCRTAASLQGLLAVTLLAILLKIGSPVCRYFICGAVRLGTEAGAFPQGKSSFIGRSYVVDVTISCIFLR

SEQ ID NO: 131174 - protein, 68 aa, Triticum aestivum
  Clone ID: PAT_TA_25592.pep
MSYPPPGTAYPPPGQEAYPPPVYGAPPPVAASYQQQQAPPPEPEDSGDGFWKGCCAAICCCCLLDTCC

SEQ ID NO: 131175 - protein, 141 aa, Triticum aestivum
  unsure (1)..(141): unsure at all Xaa locations
  Clone ID: PAT_TA_25593.pep
MGSLPVLSPAECAPPPTEGTRATVAASDLAALFDAQRRHLDHFFDRLDMPQAAALAQALLDAPGAVFFTGVGKSGIVARKLAQTLASLGFARAGFLSPVDALHGDIGSXSPGDVLVLLSKSGASDELLALAPCARAXXAQL

SEQ ID NO: 131176 - protein, 157 aa, Triticum aestivum
  Clone ID: PAT_TA_25594.pep
MRRHRLLLPLLMLAGAAAVVAARPPFACAPGGPATSMAFCRRSLPLRARARDLVARLTRAEKVRLLVNNAAGVPRLGIAGYEWWSEALPRGSNTGPGVRFGGAFPGATAFPQVIGTAASFNASLWELIGRVRTCVLALVPAPALPMPFCRLSCLSAL

SEQ ID NO: 131177 - protein, 87 aa, Triticum aestivum
  Clone ID: PAT_TA_25595.pep
CGREGRKRHNHRVTTMPTLACAFYHELLLKKQPWNTSFVLRCSQDGNGLQPYCNCQQKATVALSPHPPRCPSRHSLSRPGRVAERVG

SEQ ID NO: 131178 - protein, 341 aa, Triticum aestivum
  unsure (1)..(341): unsure at all Xaa locations
  Clone ID: PAT_TA_25596.pep
MDSEGVVAAKVADETTKPAIQEDGAESKAGMTDLLMLTDKSQLQALAMLLRNNEELMMSQAIKSETERIEYLKTVSDCYTRTMKLLDDSMAAKTTYERSGGTRSLVARDMDDYVVYGLNACLQNLRNCCVRLDPIDKLRAHYDALADALADPAANVEALAAEASDYNPAGCPDRRTPRGAPPPGAPRAXSPARTPVGIDXAELVRRHQLRLGYGSKGEEFEDLDDTQKLEGHHSSLVSPGXGRGLPVRMFSSGRSAGGPKIAATXXAEAVSVFIMXAGNLAWDVFTTEHEVEAILKGSLNLLAGLGXFAVXAVSXAAVTKAVANFXXGVXACSLAXFSWAP

SEQ ID NO: 131179 - protein, 640 aa, Triticum aestivum
  unsure (1)..(640): unsure at all Xaa locations
  Clone ID: PAT_TA_25597.pep
MSSPRRPEMSPAARNSDNGYVETDPTGRYGRFDELLGKGAMKSVYRGFDEVRGVEVAWNQANLAATAXSPDAGGDEGRPRRQQGRMTRNRSMVDVRSQLLHRTLVEXSTSACSSTPSARSRTSASAASPATAAGRRPRRRRCRPRAGAGEVARTSTSSSCSEQITLLRSLVCTVDNVFVNGHQGTVKIGDLGLAAVLRGAQAAHSVIGTPEFMAPEMYDEDYDELVDVYSFGMCMLEMLTVEYPYAECSNPAQIYKKVTSGKLPDAFYRVDDADARRFIGRCLVPASHRPSAQELLLDRFLSTQDTTMTLSPPPLLPALPTSGDRKDNPEEAEPVAARTDMTITGKLNTDDDTIFLKVQIVDEAGHSRNIYFPFDIAGDTATEVAREMVKELDITDRDPSEIAAMIEQEITRLVPDWVGGGCDDQQEYYTYADNDDNEEQPPFYYLSSSPTSSNGSHCGTGPTTSGGGYAGWFQDYAVSSDDDETSSTRSALHYSSEEAQPEEKPGVSKTGQVKATRFGPGDSGTAGHDVSSSRAGRPRHHRGSPDAGGDEGRPRRQQGRMTRNRSMVDVRSQLLHRTLVEELNKRMFFNTVGAVENIGFRRIPGYGGGPSSSSATVTSSRGGDQRGRRSGKDKHQFFMF

SEQ ID NO: 131180 - protein, 124 aa, Triticum aestivum
  Clone ID: PAT_TA_25598.pep
VTGVTRFLFFGPALSSRGCAVAAFAVSWLTFLVAEACLVGGSAKNAYHTKYLGYYTKHDLVSCAALRKGVFAAAAAMMLINLAASLVYYWSYSKAADDGYIKHQNEAGVGMTDYGLDRGGGPGL

SEQ ID NO: 131181 - protein, 135 aa, Triticum aestivum
  unsure (1)..(135): unsure at all Xaa locations
  Clone ID: PAT_TA_25599.pep
MAGFATSRPASLALCGFLIFLNVFAFLLAVGAEQRRSTGKVVPDEYDERSYCLYDTDASTVYGVCAFFVLLLAQLLVTGVTRCLCFGPALSSRGCAVAAFAVSWXTFLVAEACLVGXGSAKNAYYERVPWGLLTA

SEQ ID NO: 131182 - protein, 85 aa, Triticum aestivum
  Clone ID: PAT_TA_25600.pep
PRVRRAMRGDGDNEYHDEGSESDGEYPFARQLTITKAKKLLRRKFRPRGQKIIGPAMQDSLPSSPRETTPYQSDSSESSYEDFHE

SEQ ID NO: 131183 - protein, 132 aa, Triticum aestivum
  unsure (1)..(132): unsure at all Xaa locations
  Clone ID: PAT_TA_25601.pep
MAAAREASRAASPVAAAAGVLLVLAVLLTEHVIVANALSIGVNYGQIANNLPAPGRVSTLLRSIKISKVKLYDADPHVLRAFLGTGVEFVIGIGNEHVPAMVSPPXWRXXGSXQHVVXXLHAGARITCITVG

SEQ ID NO: 131184 - protein, 193 aa, Triticum aestivum
  unsure (1)..(193): unsure at all Xaa locations
  Clone ID: PAT_TA_25602.pep
MQLTNPGRRNMPFLVGVAVLVLAAAAARADGALCDKSDKAALLAVKAALGNHPDLSGWNSTAPCCAWPGISCDAATGRVTELTVFALNISAPVPAAIANLTALQTVNLAYNRLYGRIPDFLGPRALPGLAFLRLDGNRLDGPIPPTXXVYDLSVAGNRLAXXLPAAFAGAEFGSVDVADNQLTGDAXXXXGAG

SEQ ID NO: 131185 - protein, 66 aa, Triticum aestivum
  Clone ID: PAT_TA_25603.pep
ATFGAWVDAVCKMKGVEEGDKLVRSFQDRNFAIDEKSIREHLDKKGPFSPIVWEVIFGKKKTSRPF

SEQ ID NO: 131186 - protein, 125 aa, Triticum aestivum
  Clone ID: PAT_TA_25604.pep
WAEAVSVFIMAAGNLAWDVFTTEHEVEAILKGSLNLLAGLGGFAVEAVVGAAVTKAVANVGAGVFACSLAGFVVGAIAGLIFVGVSGLLINLIIGSPRKVPDMSKLMFHTAVMPDGMALAYAVSH

SEQ ID NO: 131187 - protein, 147 aa, Triticum aestivum
  unsure (1)..(147): unsure at all Xaa locations
  Clone ID: PAT_TA_25605.pep
EEAGPVRGHVEIPPPSFGVEVKRFARALSGNAGPELRFTRLVAATFAEPDPFRAXPESPLLGPGEPALVGAGRGRGGRAPGGPGGPGGRKPPLGGAGSAERGEPEGEARVSGRAGEPGGVGRGGRGVGRGRARGSWCGRRGRAGGPW

SEQ ID NO: 131188 - protein, 291 aa, Triticum aestivum
  unsure (1)..(291): unsure at all Xaa locations
  Clone ID: PAT_TA_25606.pep
GDAGMRELWATGWLHDRIRVVVSSFFVKVLQLPWRWGMKYFWDTLLDADLESDALGWQYISGSLPDGRELDRIDNPQFEGYKFDPYGEYVRRWLPELARLPTEWIHHPWDAPESVLQAAGIELGSNYPLPIVELDEAKSRLQDALSEMWELEAASRAEIENGMEEGLGDSSDEPPIAFPQELQHMEVDLDRATIHTPAMAGRRRADQMVPSITSSFFRAETETELSAAFESQVTRPEVPSQVHXQPQTRTEIRDEVASYGTAARYNGVQQQQQQYTLHHHRVQVRIAPSTS

SEQ ID NO: 131189 - protein, 81 aa, Triticum aestivum
  Clone ID: PAT_TA_25607.pep
MASVKVAIAAMLVLVMLSSSPLQAAAQMQCSRCTQDCNSSCDGSSSGVRCSRTCATPTLQCANCQRCMNSCLSYCQSTCIN

SEQ ID NO: 131190 - protein, 83 aa, Triticum aestivum
  Clone ID: PAT_TA_25608.pep
MASTLKAAAITAVLVLVMLSSSPWKAAAQMQCSRCTEDCNSSCDGSSSSVRCSRTCATPTLQCANCQRCMNSCLSYCQSTCVN

SEQ ID NO: 131191 - protein, 82 aa, Triticum aestivum
  Clone ID: PAT_TA_25609.pep
MASVKVVAIAAMLVLVVLSSSPLQAAAQMQCSGCTQDCNSSCDGSSSSVRCSRTCATPTFECANCQRCMNSCLSYCQSTCVN

SEQ ID NO: 131192 - protein, 216 aa, Triticum aestivum
  Clone ID: PAT_TA_25610.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHARREERLAHGPRDHAPAPAAAAPAPALRQQRHQRSQGQEVKV

SEQ ID NO: 131193 - protein, 247 aa, Triticum aestivum
  unsure (1)..(247): unsure at all Xaa locations
  Clone ID: PAT_TA_25611.pep
MRRMRVLRRLRRSGGGGAHAYQTAGKGGGGGAAAKMVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHARREERLAQGPRDHAPAPAAAAPAXQPAAAPKKAKAKK

SEQ ID NO: 131194 - protein, 123 aa, Triticum aestivum
  unsure (1)..(123): unsure at all Xaa locations
  Clone ID: PAT_TA_25612.pep
LLLLRVCEISCECSCCTFLRKYREAKXKIDKHMYHDMYLKVKGNMFKNKRVLMESIHKSKAEKAREKTLSDQFEAKRAKSKASRERKIARREERLAQGPRDHAPAPAAAAPAQAAAAPKKAKK

SEQ ID NO: 131195 - protein, 65 aa, Triticum aestivum
  Clone ID: PAT_TA_25613.pep
QTKILKKYWICIFYFLSSGPKRSQSDPEESTHTVHWITTPHNLTGHKQAQGFYFQVLLIKARKVA

SEQ ID NO: 131196 - protein, 101 aa, Triticum aestivum
  Clone ID: PAT_TA_25614.pep
GARWLEDLHYSTVSKRNRVRLPITVICRLRSISKLVNISRSRKDGTTPSYLRGLGPRCPRSSRPWAMPPAGTAVGSCLLTHPSTHAHMLAHQLCLFGDTLQ

SEQ ID NO: 131197 - protein, 210 aa, Triticum aestivum
  Clone ID: PAT_TA_25615.pep
ARGSCLHFRCPPSLPTPPSVPARSIHGVDARPAGSRGPRPRRRLPGDLPCGPPRHAPRLRQPGSPAALRALARHLRRHPAPSAPASSPTSTTTTAPASSASSRTGSPSSSSRPSPPALSSCSCSSAPPPPTSSASPPSTPPGATSAPPIAPSGGSPRSRSRGSSARSSSPRSPSSSCSAPPSSSPPCSIPRSCSALRTSCCRCSCWDGPR

SEQ ID NO: 131198 - protein, 101 aa, Triticum aestivum
  Clone ID: PAT_TA_25616.pep
FVELSTPKSSLFTHFFKVGGLMAEDQALRPLPGRRRCSGRRRAHGSVSRWQTRSSPCGALVSSLSSSSSLLPATPSCLLCTSLLLHIIYKRKWFGVKKLKA

SEQ ID NO: 131199 - protein, 178 aa, Triticum aestivum
  unsure (1)..(178): unsure at all Xaa locations
  Clone ID: PAT_TA_25617.pep
MATMTAPKKLQHSSFHGSTTRREAPTTLHCSSGWRSIAITDGAPLQPLTSFNGPGGARRPLGRAAEAPWRRPTSPAGRPRAASRRGRAPPRARRGSTPRGERRAGPREAPQEPAAAXRGGPRRAPRPRGGGRPGGAGGEAGGGRRAGRGRGGRRARGPPAGSAATRRGGGGSEVRAAR

SEQ ID NO: 131200 - protein, 165 aa, Triticum aestivum
  unsure (1)..(165): unsure at all Xaa locations
  Clone ID: PAT_TA_25618.pep
MENGEETFASPTAAAADFGFGFGPALTNGEGGHAKAYDPEEMDALRAAKRDLEEQLAAVRHENAFLSAEAARLDALVAGAREDIAAADRAAAKAEGEAAGLRAEVKRLQGLLDCTDRGADGPGGAGGDPATAHQEKLALXXEIKALXXSAAAAAADXXXXAAAPS

SEQ ID NO: 131201 - protein, 201 aa, Triticum aestivum
  Clone ID: PAT_TA_25619.pep
CCWSCCGSMGCWYKLEEYRNSCRSLGAAAGDGSYANGSICRVDDTWGGKDVAGGERGLETEEESGEAGADDSEDTERRRRQSGLRIFFSGGSNAAAGASSKTGASCCCCCFSAAELAAFPFHLRSRPRTPPPLSATSIPTTRSTARTLRLSSTRPPPPAADETKPSNSRTNCTKLRGERERLRGARARGEEGGGGANGARG

SEQ ID NO: 131202 - protein, 127 aa, Triticum aestivum
  unsure (1)..(127): unsure at all Xaa locations
  Clone ID: PAT_TA_25620.pep
SHRGCDTRALHYNSDNLADASPQLRRAPSASLAVAARRPAFNTSPLHHQWSTDVPMRCRRSSGGPMQHQQSSTPPDXDATIXXQLXXDDKPRTXXLHCGAKKNSDAAPWTSPAXXHCSRDGAPTTPX

SEQ ID NO: 131203 - protein, 559 aa, Triticum aestivum
  unsure (1)..(559): unsure at all Xaa locations
  Clone ID: PAT_TA_25621.pep
ARTRVRTQPELYTGGPANAGGTWSVVVSPVSAXMAWFWRRSRGLRGPRVSPGLRGVPGLVQHAEDMDEWLAGNRPRAGGTYQTGIFALPAGARRGALVTVASGPRNLEHVLKPRLGTCAKRVSSQWIGRRTFNVAIWQPGKSVSNTEDRTSSQQSTPCSPRTSVPRWRSRATLHSPPQDLASRASXQGRVRSVLAGAADHGGQHDLPDLLRGLSVVLTWGVGDGKDLETLAQHLPEDEFPSVSDRAIEVKLIRFILPEFLWRCKKWLGLGVHTTRPRSVAHVDRHLPALIKKRKLELAXLLSRFMRKGSYSDESLQHVALNFILPTSHSSTWRSTSSSPLVSTHPAVERKIVRELCSVLAASRGAHDPALWLAEPFTFEELDRLVYLKAALSETLRLYPSVPEDSKHPSGCTRPCRGTFVPAGSSVTYSIYSAGRMKGVWGEDCLEFRPERWLSADGTECEQHDSYKFVAFNAGPRVCLGKDLAYLQMKNIAGSVLLRHRLTVAPGHRVEQKMSLTLFMKGGLRMEVRPRDLAPVLDEPCGLDAGAATAAAASATAPCA

SEQ ID NO: 131204 - protein, 244 aa, Triticum aestivum
  Clone ID: PAT_TA_25622.pep
DAWVVAIRDIIPPAQRTAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPRHARQSLSEKFPHVHPSAIDLVEKMLTFDPRQRITVEGALAHPYLASLHDISDEPVCTM

SEQ ID NO: 131205 - protein, 403 aa, Triticum aestivum
  Clone ID: PAT_TA_25623.pep
MDAGGAQPPDSEMAEAGAGAAAAAGTAPGGAMDNIQATLTHGGRFIQYNIFGNVFEVTAKYKPPILPIGKGAYGIVCSALNSETGEQVAIKKIANAFDNKIDAKRTLREIKLLRHMDHENIVAIRDIIPPAQRTAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMEVFPCGISSLQLIGTPNEADLDFVNENARRYIRQLPRHARQSLSEKFPHVHPSAIDLVEKMLTFDPRQRITVEGALAHPYLASLHDISDEPVCTMPFSFDFEQHALSEEQMKDLIHQEGITFNPDYQ

SEQ ID NO: 131206 - protein, 179 aa, Triticum aestivum
  Clone ID: PAT_TA_25624.pep
MPTATPTATGLATAPGSRVTRYAKSTAASVTPVRPGKTHELSALDNAMGRHAVHLVLYCRAAPGVDRDPLKESLSEALSLYPAMVGRLTRPEGEGGPAAGSGWIVKCNDAGVRTVDARASVTLDEWLATASGDDEMDLAYFEPMGSEAYIWSPFYVQLTEFADKSYALGLSCTHYHHDP

SEQ ID NO: 131207 - protein, 67 aa, Triticum aestivum
  Clone ID: PAT_TA_25625.pep
IKRNSKAENTKLARIFVTQGIIFSCKRYKGPMSNNNSTLFIFQNPLIHTISCRTKSLSMHSWHKKLI

SEQ ID NO: 131208 - protein, 120 aa, Triticum aestivum
  unsure (1)..(120): unsure at all Xaa locations
  Clone ID: PAT_TA_25626.pep
XGQVHGASXRPRVXLGKCXRXTTNAGXSQPXTWTSQRAPRAYLIRSCTSASRRSTYTYPYLPMRAYVSTEETMWSCGLSWIKTCMRLSLSTLQNNGAVVLVCVMTSYVTIKDLCELIEKK

SEQ ID NO: 131209 - protein, 68 aa, Triticum aestivum
  Clone ID: PAT_TA_25627.pep
PARLSGSTPINSTKGACNRTEYSRLIATTIPAAACYSWPWSLLDIILWTPMTSDCSGFDLGKSNGSMG

SEQ ID NO: 131210 - protein, 177 aa, Triticum aestivum
  unsure (1)..(177): unsure at all Xaa locations
  Clone ID: PAT_TA_25628.pep
MFQFQVLVVLGCPRWPYLGARPQKARLGSILLIMISIRKLRDEDARGRPRRGTRAGRGRGSTEQRGQGGRRGRQGAGPARPPASEGXRTRLGRAGTSTREVGGPGGGERVAEQAARSSCSSGGPRRGGGGRRGARAAAXRRGVHGPGPNRRWRRGRLCCVRRTEPMASGAVAGGNGV

SEQ ID NO: 131211 - protein, 96 aa, Triticum aestivum
  unsure (1)..(96): unsure at all Xaa locations
  Clone ID: PAT_TA_25629.pep
KMRVMRFNRDHSVRYSGIKRKWDRPKGNESRVRRQFKAXSFMPFAGCGYAERTRRCLSIKFRKFVAINVCQLQWLIMHPRSRCTQIAPLVARRKIK

SEQ ID NO: 131212 - protein, 170 aa, Triticum aestivum
  unsure (1)..(170): unsure at all Xaa locations
  Clone ID: PAT_TA_25630.pep
ARGRDEKKCPPSLDPAPSPISHIPHLPHPTATRPPPRPQPAAPPPPTPQPETRPSXAPPRPNRRYRRPKIPPPPPPAHIAGVVVPGFPHRRAQPPTRSPPASAHRRPTSRALQPATAHHRPPSSHPTRCFTSVRFCLLPLRGCPPSPRRCWKNTGDRLLCDRPHQCDFYC

SEQ ID NO: 131213 - protein, 175 aa, Triticum aestivum
  Clone ID: PAT_TA_25631.pep
MAYLQQAPAWFLWLASLGALYVAAFLPRLLVYLTHCLRRPEDLRLRYGTWAVVTGPTSGIGRSVALELARRGLNLVLVDLDAANLHEVSGTIMSRHAVQTMAVVFDLSLVSTPKGDEALRRLRDAVKKLDVGILVNNAGIAKPGAVFLHEADVEAWVRMIRVNLWAVTEVTAAVL

SEQ ID NO: 131214 - protein, 85 aa, Triticum aestivum
  Clone ID: PAT_TA_25632.pep
MDFPGGSGRPPPPPQQHQHQLLPPMTPLPLTRQGSSVYSLTFDEFQSAIGGPGKDFGSMNMDELLRNIWTAEESQAIGAGPNAAA

SEQ ID NO: 131215 - protein, 191 aa, Triticum aestivum
  unsure (1)..(191): unsure at all Xaa locations
  Clone ID: PAT_TA_25633.pep
ASGLLMKDLGTGLSQIQLHASGYPINPDLFLVLEQRKSGWTSKPEGXHQSRRSDDPKRAHRXKLMFDAVEXLLLDKFEKETSVHAASSLTGAREVSSGQQLVKAICSEIEYLKTERSRMCQEKSSSVIPDAEILHRLEGWTTSFGQQQLPGMILEIERSIFKELVDEVVRGEAADGPQARAGRRGRRRLFT

SEQ ID NO: 131216 - protein, 508 aa, Triticum aestivum
  Clone ID: PAT_TA_25634.pep
YFPSDENKRNEFLQQQLNELKVDKEMVATTMEELHKELSEKKAELRCLQDELSTRDNERASDGSLQSLRSMVMALQKENSDLKIAKGSLYKELVNMESTTQKVDNSTSDVDNFSDVEKVKDEMASLKKALQGAFHERDRALQNLSRLKQHLLDKDLEDQEMLDELANGMDALRAIGQQLRALLGPLGRASAVGVTKQEESKKTINDEHSRSNEQIEDLQYKLANCMNALESKDQELLNLQSALGQYYAESEAKERLGDDLAMAREALAKLSESLKVANQGIEISRREKDEVVAKLTQAEKMLADGKRSLQKLEDDNSRLRHALEQSMTTVNRMSLDSDNSVDRRIVIKLLVTYFQRNHSKEVLDLMVRMLGFSEEDKQRIGSAQSNVGKVVVRGVLGLPGRLVGGFVGGNSAGKSTHAPQDNQSFADLWVDFLLKETEEREKQKASEAAARLSHEENQTTSRSASNLQASQHIANPGLSTKPHQFDRPDSDEFRMVPLAPMYHPCRRL

SEQ ID NO: 131217 - protein, 102 aa, Triticum aestivum
  Clone ID: PAT_TA_25635.pep
SRVHGQVFNVKDMSTKPRKRKDKEANASYDEPKRHIVLSGKRNIVGVDDKTDMSGDYEKFDEIAPFTVNIDPSIQLNDEDFPWLRRKGTHAKKKFHTQRSGM

SEQ ID NO: 131218 - protein, 172 aa, Triticum aestivum
  unsure (1)..(172): unsure at all Xaa locations
  Clone ID: PAT_TA_25636.pep
MDLEFGRGMRSPQRDSWKTTMVLAYQSLGVVYGDLSISPLYVFKSTFAEDIQHSDTNEEIFGVLSFVFWTLTLIPLIKYVSIVLRAHDNGEGGTFALYSLICRHANVSLLPNRQIADEELSTYKLERNPETVDKXRVKVWLEKHKNLHTALLIMVLIGTCMVIGXXVLTPAI

SEQ ID NO: 131219 - protein, 221 aa, Triticum aestivum
  Clone ID: PAT_TA_25637.pep
MSISLRLVIPIAAPCPVPPPRTARNAGCSPLSAAAVPVRTTGALRGCAALPLRPQSLVRPCRSRGSGIVCNASAYLSPPTTQWVSVAAAAVLLLAKGTGIHKSFLVPLFVLQAPTAVISWIKSEYGLWTAFLALVVRLFLPFPGELELPLSTMLAVSVAPYQVMNVRGTQGGAIVSLALAAYLAFQHFTRTGGIGKAFDQGSIVATMAIICIAVINVILLF

SEQ ID NO: 131220 - protein, 138 aa, Triticum aestivum
  unsure (1)..(138): unsure at all Xaa locations
  Clone ID: PAT_TA_25638.pep
WSTSSQKGFKPVNIESYDGTTDPVVWTEYFLLHIHMARGDDLHSIKYLPXKLKGPARHWLNSLPENSIGSWEDLEDAFRENFQGTYIRPPDADDLSHIVQQPGESARKFWTRFLIKKNQIVDCPDAEALTAFKHSIRD

SEQ ID NO: 131221 - protein, 142 aa, Triticum aestivum
  Clone ID: PAT_TA_25639.pep
PPARASPAMDCAAALLPTAVVAPFPIRRRRPPRPASVASHRLHRHHEPSLSLVVSLGPARGGGFFRWRVATRPVEGTGVRQTASRSSICPHLMFLLSIEFHVPSYCDTGRSPLFDNNGARPVVPLHTYHRGAKIFGERSRSL

SEQ ID NO: 131222 - protein, 71 aa, Triticum aestivum
  Clone ID: PAT_TA_25640.pep
LHHLQINPLEYMLIPLNRVTFWNQMLMAGQLNCRLCRLSSRTWILQMHYLTWIHELLFKMGVGHIIKNCYS

SEQ ID NO: 131223 - protein, 199 aa, Triticum aestivum
  unsure (1)..(199): unsure at all Xaa locations
  Clone ID: PAT_TA_25641.pep
RAPRDDHRPLHPPPAXTAFPPSSVFANPSSFPGVSATLFRAFSCRLNAWSWGWAAASSLVRWRRSADVAAAWAAGGGAPETLPPLCRRVAFPLTERCRSFPERGNLFLLFWRLPLPXIPVLVASLNLARISSPYPWTSLPAXRSFAPLPAQSWLCFFKPLLQXETXRFCRXCWAKKIXSGKRMGPNSXPNXLXAPPXGX

SEQ ID NO: 131224 - protein, 267 aa, Triticum aestivum
  Clone ID: PAT_TA_25642.pep
RHEAVLTPRVDGIDTTASHRGNHFYITRRSEEFYNSELVACPLNNVAETTVLLPHRESVKIQDVQLFENHIAVYERENGLPKATVYRLPGTGEAVGQLQGGRAIDFIDPAYAVEPEPSQFHSNVVRWADGWVRTPPSIFDYDMDTGVSVLKKIDTVLGGFDVSNYVTERKWAAASDGTQIPMSILYRKDMVKLDGSDPMLLYGYGSYEICIDPTFRGSRFSLVDRGFIYVIAHIRGGGEMGRNWYEDGKLLKKENTFTDFIACAEHL

SEQ ID NO: 131225 - protein, 93 aa, Triticum aestivum
  unsure (1)..(93): unsure at all Xaa locations
  Clone ID: PAT_TA_25643.pep
MRRRDREAAGSREQGPRARGGTGAKRSVYLXGVAFAAVGAAPPRPAAPPPPGTRAPPPRPPLPPPRPCPRAPGSGSGPRATPLTWDREFGGWK

SEQ ID NO: 131226 - protein, 79 aa, Triticum aestivum
  unsure (1)..(79): unsure at all Xaa locations
  Clone ID: PAT_TA_25644.pep
QGAEPACPLLLWAERATPKKRAEAVEGARARQGXGHGDQAPPVRPAPAPPPPPAXPPAPTPAPRTGTXPXRRRRCRPAR

SEQ ID NO: 131227 - protein, 120 aa, Triticum aestivum
  Clone ID: PAT_TA_25645.pep
PASPPRPLFLLPPPPPLPTMEPTPTPLSLDSSPLLARFLVSPRSSPLSLPFLTPPPSPSSEGSVDVVFLDADFAQPAGTLPPATRAPLMSPTLPSKAFHHVVSLRRYEPEGVFPVQGVNG

SEQ ID NO: 131228 - protein, 183 aa, Triticum aestivum
  unsure (1)..(183): unsure at all Xaa locations
  Clone ID: PAT_TA_25646.pep
TRVVSPSRQRQPNLRFPKLSPPSLPPSLPHHACSTRRPRLSPPPPPPPSARRHGRRRQQRRAAAWAAAGWGPRAGAGAGAEGGEGGGRGRXRRRPCPELQAQRPVAPLQVTTQAPPPPNVGXSGGEDPPPRGRPNPPLNAADPPTATGGGGLAPARLPHPAVPLPPPPXCGRARGRGLPLPLF

SEQ ID NO: 131229 - protein, 89 aa, Triticum aestivum
  unsure (1)..(89): unsure at all Xaa locations
  Clone ID: PAT_TA_25647.pep
MAVTATTAAAAATMLAAVMAIFLSFVLCFYIFLCAKRSRGXAPPPPGSGVMAHLRFLFCRGDRRARAGDRVPPVASPINQGGPSIEIFT

SEQ ID NO: 131230 - protein, 259 aa, Triticum aestivum
  Clone ID: PAT_TA_25648.pep
MTSCGGATAACPDGRVITAPLLAKPGEVVVQVCGDEAAAPVLTCKPPGRLARAVKEAWSVSLGIALPMMPPVSATAARDEARSILGLAFPMILTGLLLYLRSMISMLFLGRLGGLALAGGSLAIGFANITGYSVLSGLAMGMEPICGQAFGAGNYSLIGVTVQRTVLLLIAAAVPIGGLWMHMRPLLLLCGQDAAIAAVAETYILASLPDLLLQAFLHPVRVYLRMQSINLPLTVCATLAIAIHLPINYVLVTVLGLGV

SEQ ID NO: 131231 - protein, 172 aa, Triticum aestivum
  Clone ID: PAT_TA_25649.pep
RRPPSRPLPTAASMCQFPQRSNRSRQGADPRPSLSTSVTESAVRQQQSAAPSTPTASGRSHSPRSWPIDEISEISECGSHSPCAGKGKLRQISLEVQRGDSLTVRYGRTTIQRKYGNGDRIIKVHSQMRRMASGASADSATSMLSYVASFLGSTGMVVSFSSWVVSTQIHDQ

SEQ ID NO: 131232 - protein, 325 aa, Triticum aestivum
  unsure (1)..(325): unsure at all Xaa locations
  Clone ID: PAT_TA_25650.pep
WTCVMQLTAVGETWGPRVLKGWPSCLTAPEEAAAVRPAVVDRAALLPPKRLDGNNGYLMVSCNGGLNQMRAAICDMVVIARYLNVTLVVPELDKTSFWNDPSEFQDIFDVEHFITSLRDEVRILRELPPRVKRRVELGMFHSMPPISWSDISYYHNQILPFIRKHKVLHLNRTDARLANNGLPMEIQKLRCRVNYASLRFTAEIEDLGKRVIRILRQNGPFLVLHLRYEMDMLAFSGCTQGCSNEEAEELTRMRYAYPWWKEKIIDSDLKRKDGFCPLTPXXTALVLRALDIDRSMQIYIAAGEIYGGKRXXAALTSAYPNVVRK

SEQ ID NO: 131233 - protein, 65 aa, Triticum aestivum
  Clone ID: PAT_TA_25651.pep
KRKRDSTRHPRRQVVKHPDFLSYICYLQFHFCRRSRVLQIMKQLVQRSLARWLQRRTATQVFFKL

SEQ ID NO: 131234 - protein, 143 aa, Triticum aestivum
  Clone ID: PAT_TA_25652.pep
MKRTIFDEQTSKALKKWHKTVKKKQQQQQQQKGSSHASSETPTTDTPEAGRLSQCQFVAEAAPVANRHLHRYKTIAHVGATRALSDSDCSDTDAEAQTRYLIPPTKQRSLDSEVRVDVDAATPDHRDSFSFQKPPPAQNAMEK

SEQ ID NO: 131235 - protein, 162 aa, Triticum aestivum
  Clone ID: PAT_TA_25653.pep
NSAPGSLGGVDLCRGILLCNVLDDNPNPVLRFIPLPKEAAINRDIKNCPWLYRDVTYINGLIKFVAMETWESSTLTSKRTCGSSDDITDMQFDSDSELDDDNMYVMDDTFSWNAVAWVKTSQEAWTCNCDVSVDDIAIDNIKHLPPLNKLRISAPTLSIHGD

SEQ ID NO: 131236 - protein, 197 aa, Triticum aestivum
  unsure (1)..(197): unsure at all Xaa locations
  Clone ID: PAT_TA_25654.pep
APXXARARERXXRLDPFGIERRVDLRRRGGGLLVGGMGKTRRRQGHSAGPTVLCSESSKRRSSGQVLASPVADAAGTARLSLAYGPWVAGWSMERSDDRGGVTRTTMVKLLSGGRTARAEQGGGAATQVGGRGNLKEARVEGGLGRSLVGSGGRGAHELLSLARDGGSQIAEGLEAARGLGARGSRCGRRQVWRRGV

SEQ ID NO: 131237 - protein, 188 aa, Triticum aestivum
  Clone ID: PAT_TA_25655.pep
TRGRYPAMARTQLANFAALLLANAAVFAALLAAFNAAEALRLGSDGRAVLALSAAGVIVYSVALANAAAVCNLATVVAAAEGRGGCHAVLKALLLVRGDAATAVAVALPASLATTAVEGLFQLRVMKLYMIDGRISSAMVCEGLLIAYIHSMICVLDTVITYMVYQTCKATHYSRDLLELEEKGDFIA

SEQ ID NO: 131238 - protein, 204 aa, Triticum aestivum
  Clone ID: PAT_TA_25656.pep
MFWTTPKAVRFLVFLAIFLFVEPTTDGREAQPAVPGVMLFGDSLVGVGNNDYLATLVKANMAPYGRDFKDHIATGRFGNGKLLSDIIGEKLGFNGSPPAYLSPQASGQNLLIGANFASAGSGYYDPTARIYHVIPLSRQLEYLKEYQSKLRVVAGNDHAQSIISDSLYIISAGSNDFGFNYYINPLLFLTQNADQFSDRLVGIF

SEQ ID NO: 131239 - protein, 180 aa, Triticum aestivum
  Clone ID: PAT_TA_25657.pep
MEAAAGQGERPTPPPLPLGVRLQLAGLTAAIDAVERSDGTVNRCLYSVIDRLLSARANPRPDGSGVRSYDFTVDASRGIWARVFAPVSSAVPLPVVVYYHGGGFALFSPAIGPFNGVCRRLCSDVGAVVVSVNYRLAPEHRYPAAYDDGVDALRFLDDAGGVPGLGDGVPVDLASCFLTG

SEQ ID NO: 131240 - protein, 300 aa, Triticum aestivum
  unsure (1)..(300): unsure at all Xaa locations
  Clone ID: PAT_TA_25658.pep
RPSPTPPPSQPRPSPLPPYLPRALPPXPPSQPRPNPLPPHLPRALPPPPHGTSPAAGGLRAPYRADLACPATGGLPPWPPHPPTRARALPWEARLLPSAAPRGATRRCSCAAPCVPPFPSPDPPPRRPDPPEWRAARPLPTPSATFSLLTSSTPPQIILCGSLPCMAFLGSRRTSSLAQGRVQFCPRGRAVHLARPYETVVTSSLPGGEEIRRSPTVVEVVATTRVNNSEIPPLGCTAVQFWWAPLSSGRRVCSAVRWRGSHHWTPAVLFPSRTKSHAQVQFFRCCYPLTASSATCYHCR

SEQ ID NO: 131241 - protein, 66 aa, Triticum aestivum
  Clone ID: PAT_TA_25659.pep
MAKGKDVRIRVILECISCVRKGANEESTGISRYSTQKNRRRSPGRLEFKKFCRYCRKHTTHHEIKK

SEQ ID NO: 131242 - protein, 157 aa, Triticum aestivum
  Clone ID: PAT_TA_25660.pep
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRRDGGYGGGGGYGGRREGGGGGYGGGGGYGGRREGGGGGYGGGGGGWRD

SEQ ID NO: 131243 - protein, 228 aa, Triticum aestivum
  unsure (1)..(228): unsure at all Xaa locations
  Clone ID: PAT_TA_25661.pep
AAAYSHELPRYGLEVGLTNYAAAYCTGLLLARRVLKNRDLDEEYEGNVEATGEDFSVEPSDERRPFRALLDVGLIRTTTGNRVFGALKGALDGGLDIPHSDKRFAGFKKDEKSLDAEIHRKYIFGGHVADYMRSLADEEPEXSKLHFXSEYIKEGNSSWMTWEAXYKKVMLPSRADPTMANQPKGLPKTPQEIQPQELTYEQRKXPXLKGQPLNNSAGAADDDEDDDE

SEQ ID NO: 131244 - protein, 162 aa, Triticum aestivum
  unsure (1)..(162): unsure at all Xaa locations
  Clone ID: PAT_TA_25662.pep
LDVGLIRTTTGNRVFGALKGALDGGLDIPHSDKRFAGFKKDEKSLDAEIHRKYIXGGHVADYMRSLADEEPREIQTHFXSEYIKRGISAXDDMEAFYKKXHAAIPADPTMGNQTKAPPKDSTKRYNXKELTYEQEEGNLXQKVKRPQTICPGAADDDEEDDD

SEQ ID NO: 131245 - protein, 61 aa, Triticum aestivum
  Clone ID: PAT_TA_25663.pep
AWSRPRYHLQVALEHFKGWKVPETMTSVHAYTEALFSRESFVKTKATKENLIAGWAPKVHA

SEQ ID NO: 131246 - protein, 119 aa, Triticum aestivum
  unsure (1)..(119): unsure at all Xaa locations
  Clone ID: PAT_TA_25664.pep
MAPKAAEKKPVAVAAEKTAAGKKXPKAEKRAAATKEAGGEGKTRGRKKGSKAKKGVETYKIYIFKVLKQVHPDVGISSKAMSIMNSFINDIFEKLAGESAKLARYNKKPTKAVTKFTSS

SEQ ID NO: 131247 - protein, 145 aa, Triticum aestivum
  unsure (1)..(145): unsure at all Xaa locations
  Clone ID: PAT_TA_25665.pep
MAPKAAEKKPVAAVAEKTTTGKKPXAEKRAPASKEAGGEGKVRGRKKGSKAKKGVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 131248 - protein, 216 aa, Triticum aestivum
  unsure (1)..(216): unsure at all Xaa locations
  Clone ID: PAT_TA_25666.pep
MAGGFVKTQKTNAYFKRFQVKFKRRRAGKTDYRARIRLINQDKNKYNTPKYRFVVRFTNKDITAQIVSASIAGDMVLAAAYSHELPRYGLEVGLTNYAAAYCTGLLLARRVLKIRDLDQEYEGNVEATGEDFSVEPAEGRRPFRALLDVGLIRTTTGNRVFGALKGALDGXLDIPHSDKRFAGFKKDDKQLDADIHRKYIYGLHVAEYMKNLADEE

SEQ ID NO: 131249 - protein, 212 aa, Triticum aestivum
  Clone ID: PAT_TA_25667.pep
MTEVCASVAMGHPDTLGDCALSHTVLLTLLDLKAPYHLKLIDVSNKPDWFLKINPEGKAPVYNGGDGKWIADSDVITQVIEEKYPTPSLVTPPEYASVGSKIFSTFVTFLKSKDASDGSEKALVDELQALEEHLKAHGPYINGANISAVDLSLAPKLYHLQVALEHFKGWKVPETLTSVHAYTEALFSRESFVKTKATKENLIAGWAPKVNP

SEQ ID NO: 131250 - protein, 193 aa, Triticum aestivum
  Clone ID: PAT_TA_25668.pep
ATVGIDSDFAYVKIISAETMIGFSESSKCAQICKVFEDAYKSQFSIIILDDIERLLEFVAIGPRFSNLISQTLMVLLKRVPPKGKNLLVIGTTSETTFLDSIGMSGVFSVTYEVPKLTKEDAAKVLRHLNVFDEGDVETAAEALDDMPIKKLYTLVEMAAQGPQGGSAEAIYAGEEKIDLNHFFSILSDIIRY

SEQ ID NO: 131251 - protein, 253 aa, Triticum aestivum
  unsure (1)..(253): unsure at all Xaa locations
  Clone ID: PAT_TA_25669.pep
MVYIKNQKTRAYSKRFQVKFKRRRQGKTDYRARLRLTNQDKNKYNTPKYRFVVRFTNKDVTAQIVYATIAGDIVMAAGYSHELPRYGLEVGLTNYAAAYCTGLLLARRVLKNRDLDEEYEGNVEATGEDFSVEPSDERRPFRALLDVGLIRTTLXRXVGALKGALDGGLDIPHSDKRFAGFKKDEKALDAEIHRKYIFGGHVADYMKSLAEEETEKIQTHFKENIKKGNFGDDLEQVTRKVMAASRLIHQGPT

SEQ ID NO: 131252 - protein, 193 aa, Triticum aestivum
  Clone ID: PAT_TA_25670.pep
MTEVCVKAAVGHPDTLGDCPFSQRVLLTLEEKKVPYQMKLIDVSNKPDWFLKINPEGKVPVYNGGDGKWIADSDVITQVIEEKYPTPSLVTPPEYASVGSKIFSTFVTFLKSKDASDGSEKALVDELQALEEHLKAHGPYINGANISAVDLSLAPSSQARWCTSRTRRQGRTPSVSKSSSREGARARLTTGPG

SEQ ID NO: 131253 - protein, 161 aa, Triticum aestivum
  Clone ID: PAT_TA_25671.pep
GGLDIPHSDKRFAGFKKDEKSLDAEIHRKYIFGGHVADYMRSLADEEPEKFQTHFSEYIKRGISADDMEAVYKKVHAAIRADPTMAKSTKAPPKTHKRYNPKKLTYEQEEGTSVEKVQRPQTICPVPPMTNEGRRRVKTCQPNVSCNCFLLNPGLCTMTVL

SEQ ID NO: 131254 - protein, 141 aa, Triticum aestivum
  Clone ID: PAT_TA_25672.pep
MAPKAAEKKPAEKTTAGKKPKAEKRAPASKEAGGEGKTRGRKKGSKAKKSVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 131255 - protein, 212 aa, Triticum aestivum
  Clone ID: PAT_TA_25673.pep
MTEVCVKAAVGHPDTLGDCPFSQRVLLTLEEKKVPYQMKLIDVSNKPDWFLKINPEGKVPVYNGGDGKWIADSDVITQVIEEKYPTPSLVTPAEYASVGSKIFSTFVTFLKSKDASDGSEKALVDELQALEEHLKAHGPYINGANISAVDLSLAPKLYHLQVALEHFKGWKVPETLTSVHAYTEALFSRESFVKTKATKENLIAGWAPKVNP

SEQ ID NO: 131256 - protein, 396 aa, Triticum aestivum
  Clone ID: PAT_TA_25674.pep
MAGRGYQGRGAGAGAGVSLAVVSTPSQELALTNCAYVSPADIRRFPTALALVGDVLVFALRAHDAVATGSIALNAIQRRQVKVSAGDSITVSSFAPPDDFKLALLTLELEYTKARSNRAEDLDAVLLAQQLRKRFLDQVMTSGQRVPFEFYGTNYIFSVNQALLEGQESSTPLDRGFLSSDTYIIFEAAPNSGIKVINQKEAASSKLFKDKEFNLEKLGIGGLSSEFTDIFRRAFASRVFPPHVVSKLGIKHVKGMLLYGPPGTGKTLMARQIGKLLNGKDPKIVNGPEVLSKFVGETEKNVRDLFLDAENDQKAQGDHSDLHVIIFDEIDAICKSRGSSRDGTGVHDSIVNQLLTKIDGVEALNNVLLIGMTNRKDLLDEALLRPGRLEVHIEIN

SEQ ID NO: 131257 - protein, 145 aa, Triticum aestivum
  Clone ID: PAT_TA_25675.pep
MAPKAAEKKPAAVAAEKTTAGKKPKAEKRAPASKEAGGEAKQRGRKKGSKAKKSVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 131258 - protein, 144 aa, Triticum aestivum
  Clone ID: PAT_TA_25676.pep
MAPKAAEKKPVAAAEKTPAGKKPKAEKRAPASKEAGGEGKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 131259 - protein, 227 aa, Triticum aestivum
  Clone ID: PAT_TA_25677.pep
MKRAHKVVLAQPAAAAAMTPRPLPRAPRPVRGDGGEAFRASQRYQSLLQDYKELLKETAAKKNRLHLEKLKKQRLSAEVKFLRRRYTSMSENPSQTAVYRLKNPAMAPTSRTAVWVDHHRSVQAVGSSSKGHQPAQQQRQHPVPRASPVIDLNEACELSSSEETEEFHGYQETARADKVNKYMLEGNVVAGPSDSKMPAFWDARNSAAARAAGKRKISWQDQLALRV

SEQ ID NO: 131260 - protein, 309 aa, Triticum aestivum
  unsure (1)..(309): unsure at all Xaa locations
  Clone ID: PAT_TA_25678.pep
MVFVKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKCRDLDQEYEGNVEATGEDFSVEPADERRPFRALLDVGLIRTTTGNRVFGALKGALDGGLDIPHSDKRFAGFKKDEKQLDAEIHRKYIYGGHVADYMKSXADEEPEKYQSHFXSEYIKKGIEXDDMEALVQEGHAAIRADPTRGKSTKELQXTHKSTIPRTDYEQRKASXGRSTPQSSAGADMTTTNCIDLSPICSMLK

SEQ ID NO: 131261 - protein, 144 aa, Triticum aestivum
  Clone ID: PAT_TA_25679.pep
MAPKAAEKKPVATAEKTTAGKKPKAEKRAPASKEAGGEGKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 131262 - protein, 144 aa, Triticum aestivum
  Clone ID: PAT_TA_25680.pep
MAPKAAEKKPVVAAEKTPAGKKPKAEKRAPASKEAGGEGKTRGRKKGSKAKKGVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 131263 - protein, 302 aa, Triticum aestivum
  unsure (1)..(302): unsure at all Xaa locations
  Clone ID: PAT_TA_25681.pep
MVFVKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKCRDLDQEYEGNVEATGEDFSVEPADERRPFRALLDVGLIRTTTGNRVXFGALKGALDGGLDIPHSDKRFAGFKKDEKQLDAEIHRKYIYGGHVADYMKSLADEEPEKYQSHFSEYIKKGIEIDDMEALYKKVHAAIRADPTVAKSTKEPPKTHKRYNPKKLTYEQRKASLVERLNALNSSAGADVDEDDDE

SEQ ID NO: 131264 - protein, 144 aa, Triticum aestivum
  Clone ID: PAT_TA_25682.pep
MAPKAAEKKPVATAEKTTAGKKPKAEKRAPASKEAGGEGKQRGRKKGSKAKKGVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 131265 - protein, 144 aa, Triticum aestivum; identical to SEQ ID NO: 120234
  Clone ID: PAT_TA_25683.pep

SEQ ID NO: 131266 - protein, 301 aa, Triticum aestivum
  Clone ID: PAT_TA_25684.pep
MVFVKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKCRDLDQEYEGNVEATGEDFSVEPADERRPFRALLDVGLIRTTTGNRVFGALKGALDGGLDIPHSDKRFAGFKKDEKQLDAEIHRKYIYGGHVADYMKSLADEEPEKYQSHFSEYIKKGIEADNMESLYKKVHAAIRADPTMAKSTKEPPKTHKRYNPKKLTYEQRKANLVERLNALNSSAGADDDEDDDE

SEQ ID NO: 131267 - protein, 170 aa, Triticum aestivum
  Clone ID: PAT_TA_25685.pep
FGTRLSPLTSHTSTRSNHHHQKQHPWHPRRQQKKLAPATAEKTTAGKKPKAEKRAPATKEAGGEGKTRGRKKGSKAKKGVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 131268 - protein, 301 aa, Triticum aestivum
  Clone ID: PAT_TA_25686.pep
MVFVKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKCRDLDQEYEGNVEATGEDFSVEPADERRPFRALLDVGLIRTTTGNRVFGALKGALDGGLDIPHSDKRFAGFKKDEKQLDAEIHRKYIYGGHVADYMKSLADEEPEKYQSHFSEYIKKGIEADNMEALYKKVHAAIRADPTMAKSTKEPPKTHKRYNPKKLTYEQRKASLVERLNALNSSAGADVDEDDDE

SEQ ID NO: 131269 - protein, 301 aa, Triticum aestivum; identical to SEQ ID NO: 131268
  Clone ID: PAT_TA_25687.pep

SEQ ID NO: 131270 - protein, 402 aa, Triticum aestivum
  unsure (1)..(402): unsure at all Xaa locations
  Clone ID: PAT_TA_25688.pep
LAAVHDSIVNQLLTKIDGVEALNNVLLIGMTNRKDLLDEALLRPGRLEVHIEINLPDENGRLQILQIHTSKMRESSFLSPDVNLQELAARTKNYSGAELEGVVKSAVSFALNRQISMDDLTKPLDEESIKVTMDDFVNGLHEITPAFGXASTDDLERCRLHGIVDCGKAHQHIFQRAMLLVEQVKVSRGSPLVTCLLQGSAGSGKSALAATVGIDSDFAYVKIISAETMIGFSESSKCAQICKVFEDAYKSQFSIIILDDIERLLEFVAIGPRFSNLISQTLMVLLKRVPPKGKNLLVIGTTSETTFLDSIGMSGVFSVTYEVPKLTKEDAAKVLRHLNVFDEGDVETAAEALDDMPIKKLYTLVEMAAQGPQGGSAEAIYAGXEKIDLNHFFSILSDIIRY

SEQ ID NO: 131271 - protein, 145 aa, Triticum aestivum
  Clone ID: PAT_TA_25689.pep
MAPKAAEKKPVAVAAEKTAAGKKPKAEKRAAATKEAGGEGKTRGRKKGSKAKKGVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 131272 - protein, 302 aa, Triticum aestivum
  Clone ID: PAT_TA_25690.pep
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKNRDLDEEYEGNVEATGEDFSVEPSDERRPFRALLDVGLIRTTTGNRVFGALKGALDGGLDIPHSDKRFAGFKKDEKSLDAEIHRKYIFGGHVADYMRSLADEEPEKFQTHFSEYIKRGISADDMEAVYKKVHAAIRADPTMAKSTKAPPKTHKRYNPKKLTYEQRKASLVERLNALNNSAGAADDDEDDDE

SEQ ID NO: 131273 - protein, 302 aa, Triticum aestivum; identical to SEQ ID NO: 131272
  Clone ID: PAT_TA_25691.pep

SEQ ID NO: 131274 - protein, 212 aa, Triticum aestivum; identical to SEQ ID NO: 131255
  Clone ID: PAT_TA_25692.pep

SEQ ID NO: 131275 - protein, 354 aa, Triticum aestivum
  unsure (1)..(354): unsure at all Xaa locations
  Clone ID: PAT_TA_25693.pep
KLINQVILFLQRLQQQLKTQPGSLPFDEILYCNIGNPQSLGQQPVTFFREVLALCDHPDLLKKEEIKTLFSADSISRAKQILALIPGRATGAYSHSQGIKGLRDAIASGIASRDGFPANADDIFLTDGASPGVHLMMQLLIRNEKDGILVPIPQYPLYSASIALHGGSLVPYYLNESTGWGLEISDVKKQLEDARSRGIDVRALVVINPGNPTGQVLAEENQYDIVKFCKNEGLVLLADEVYQENIYXDNKKFHSFKXKIVRSLXGYGEEDLPLVSYQSVSKGILWVSVGKRGGYXEITGFSAPXREQIYKIASVNLCSNITGQILASLVMNPPKASDESYAXKAEKDGILIVP

SEQ ID NO: 131276 - protein, 312 aa, Triticum aestivum
  unsure (1)..(312): unsure at all Xaa locations
  Clone ID: PAT_TA_25694.pep
MLTLPCVTTPPHHAPPTRPVRSGPVPAPEVSRTRTTTATRARMAGSRPPRAAASGETSSFLPLINIGTPKPRRRSTALALSGLLLLVLIGLPDAAVAANMTEVCVKAAVGHPDTLGDCPFSQRVLLTLEEKKVPYQMKLIDVSNKPDWFLKINPEGKVPVYNGGDGKWIADSDVITQVIEEKYPTPSLVTPPEYASVGSKIFSTFVTFLKSKDASDGSEKALVDELQALEEHLKAHGPYINGANISAVDLSXLAPKLYHLQVALEHFKGWKVPETLTSVHAYTEALFSRESFVKTKATKENLIAGWAPKVNP

SEQ ID NO: 131277 - protein, 302 aa, Triticum aestivum
  Clone ID: PAT_TA_25695.pep
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKNRDLDEEYEGNVEATGEDFSVEPSDERRPFRALLDVGLIRTTTGNRVFGALKGALDGGLDIPHSDKRFAGFKKDEKSLDAEIHRKYIFGGHVADYMRSLADEEPEKFQTHFSEYIKRGISADDMEAVYKKVHAAIRADPTMAKSTKAPPKTHKRYNPKKLTYEQRKASLVERLNALNNSAGAADDDEEDDE

SEQ ID NO: 131278 - protein, 302 aa, Triticum aestivum; identical to SEQ ID NO: 131272
  Clone ID: PAT_TA_25696.pep

SEQ ID NO: 131279 - protein, 302 aa, Triticum aestivum; identical to SEQ ID NO: 131272
  Clone ID: PAT_TA_25697.pep

SEQ ID NO: 131280 - protein, 269 aa, Triticum aestivum
  unsure (1)..(269): unsure at all Xaa locations
  Clone ID: PAT_TA_25698.pep
MAGSRPPRAYAFGETSFLPLINTAPKPRRSTALALSGLLLLVLLIGLPAAPAVAANMTEVCVKAAVGHPDTLGDCPFSQRVLLTLEEKKVPYQMKLIDVSNKPDWFLKINPEGKVPVYNGGDGKWIADSDVITQVIEEKYPTPSLVTPPEYASVGSKIFSTFVTFLKSKDASDGSEKALVDELQALEEHLKAHGPYINGANISAVDLSLAPKLYHLQVALXEHFKGWKVPETLTSVHAYTEALFSRESFVKTKATKENLIAGWAPKVNP

SEQ ID NO: 131281 - protein, 77 aa, Triticum aestivum
  Clone ID: PAT_TA_25699.pep
KFLIQFLAINALHGNYHLGQLGKATSRINISMLIWLCLRVMNILGKVPKESCLYPVQIRQGACFWVGLNFKKKSQLI

SEQ ID NO: 131282 - protein, 221 aa, Triticum aestivum
  Clone ID: PAT_TA_25700.pep
DAWADAWVRHHWRKHGISSDYVKPSLVKRYLNLRFFPHGARNCYTLRSLVMGNKYLVRAAFYYGNYDGLGKPPVFDLYLGTNYWHEVSLSDAGAFNWMDIIVVAPDDYLQVCLVNKGMGNPFISGLDLRPMKNTLYPEVNATRSLVLVNSNRFHMGPTDGSVIRYPSDSHDRIWTTYNAIPNCIQISATSVIQNNLRDVYDVPSSVMQNAVTANSSRIVFH

SEQ ID NO: 131283 - protein, 187 aa, Triticum aestivum
  unsure (1)..(187): unsure at all Xaa locations
  Clone ID: PAT_TA_25701.pep
RGRASSTAPSGSTATSCCGWPPAPAATRRPRRWSSPAWRTPGRRPSRPTRPGTRAGAAGPAAPAATRTPPPRPGTRPRAPTSCAPPTSPSTTASSPGASSTALGTLRLAPAACPTTRAPPPPPCSPTSPAATAGTPRTRTTTTRTXTTAPTFXAPXXGSPTCTTSSPASRPARPLRRXXXXXATXYQ

SEQ ID NO: 131284 - protein, 200 aa, Triticum aestivum
  Clone ID: PAT_TA_25702.pep
ASRRGAGVFARFERPHHVDRLSSTSAREICSCHDEVVQPAKQRRSSSAAGPVAPKPSRDTEAQDLQGGRRWTPLGTRHWPSCSLELGVTPLARPARSAVSPPCSGQPGVSGGDHLAGKARLAVHLEGAVEWTVPRQGVVWACGIGVGDYGEAALGPGSCFHEFGFLYANGVGVIDCVHGKRKQRAIGCPSVTIYLYYEKK

SEQ ID NO: 131285 - protein, 203 aa, Triticum aestivum
  Clone ID: PAT_TA_25703.pep
ASPSLASSQNGEAPRLGATGQHRCHCKTLPGTNAASGLPRPTYLAPMCLESRRVKAGPDWNWCSIHWGAPAQANVATCSLCSSLRQSDASPTTICRIENSSCRQSSDIKTGAALRRRRCPVRAAGPRTAPGRRGGRRDWVVPTHATRSQHPQPSPETAQVVAARGFRPDPDSKTPAVVAARAWRSLGRVPLHAWADRPTSHPR

SEQ ID NO: 131286 - protein, 121 aa, Triticum aestivum
  Clone ID: PAT_TA_25704.pep
MNFMLLSLMYAYYCFEYKWRTRGVSLNHRLDFFESNWAFFAGFGSPCVLPIFFFSPLTSYGVMAILYPLFVMTAAGTQEEQTIDELKSLHGGKLNRIPLFFVAKRLTTQALQLFPEAQKEQ

SEQ ID NO: 131287 - protein, 94 aa, Triticum aestivum
  Clone ID: PAT_TA_25705.pep
HASGTKGVFGRRQTSIPHWSERKEGLASVMIHALHIRIVIGSRSKMNASCIHGVRPSKTNPEKGALRSIHRLSLWTSRDLRFVLVVIGFHNGDS

SEQ ID NO: 131288 - protein, 161 aa, Triticum aestivum
  Clone ID: PAT_TA_25706.pep
MSSGGIARGRLAEERKAWRKNHPHGFVAKPETLGDGTVNLMVWHCTIPGKQGTDWEGGYFPLTLHFSEDYPSKPPKCKFPTNFFHPNVYPSGTVCLSILNEDSGWRPAITVKQILVGIQDLLDQPNPADPAQTDGYHLFIQDPAEYKRRVRVQAKQYPALV

SEQ ID NO: 131289 - protein, 140 aa, Triticum aestivum
  Clone ID: PAT_TA_25707.pep
MASLMTKKEIGQTHDVLRFGVNDSVRGDLAPPHPVQATIHKETKFWDDKKRFGTEAIYGSAFNIRKDLDAQILSRFQRPPGALPSSMLGYEAMTGSLDDFGFEDYLNLPQDSDSLRIPDMHHGMEVRLGLSKGPVCPSFS

SEQ ID NO: 131290 - protein, 145 aa, Triticum aestivum
  unsure (1)..(145): unsure at all Xaa locations
  Clone ID: PAT_TA_25708.pep
MASGGGPMTKKELGEHPRTSSASASTTGVRGDLAPAHPVQATIHKENKFWEEKKKFGTEAIYGSAFNIRRDLDAQILSRFQRPPGALPSSMLGYEAMTGSLDDFGFEDYLNLPQDSDSLRIPDMHHGXMEVRLGLSKGPICPSFN

SEQ ID NO: 131291 - protein, 167 aa, Triticum aestivum
  Clone ID: PAT_TA_25709.pep
IPWDECRANKNIVLATTQNGGHLAFFQGLTAGKLWWVGAVSEFLCALHDSSYMHQQKAEEHVLHSSLESSIDKSPYVNILGDGMIAPVGNDGPPSSQISDDLKPNATVNSTQEDEEAKERSVNKLARYQGRSVWLLAYVALVTSWPLLGSLAFMLFRKKSRHPLSAK

SEQ ID NO: 131292 - protein, 177 aa, Triticum aestivum
  unsure (1)..(177): unsure at all Xaa locations
  Clone ID: PAT_TA_25710.pep
GTRNIDRDSNTNIHQDSPVAASVLPRPIGTPERAYGVNSSPAKKIKVPGAATSYTVASLQVATNSFCQDTLLGEGSLGRVYRADFPNGKVLAVKKIDSASLSLYEEDHFLEVVSNISRLRHPNIVSLTGYCADHGQRLLVYEHIGNGTLHEXXHFSDEANKXXXWNTRVXXALGTAR

SEQ ID NO: 131293 - protein, 171 aa, Triticum aestivum
  unsure (1)..(171): unsure at all Xaa locations
  Clone ID: PAT_TA_25711.pep
MAILKSCSVDSDASARGFAPEEIDLGDDVLAEIILRLPLDSVARSRCVSKNWCAAIADGYLRRRLPLHMSMICFPDDDGALGGGGRPVYACAGEGRRLEVRDLSFFALHDSVIFCDGCNGLLLCRAPGSPEFYVVSPVTRSWVALPXXAKDARLSVLAFDPLGGQHYHVIN

SEQ ID NO: 131294 - protein, 119 aa, Triticum aestivum
  Clone ID: PAT_TA_25712.pep
TRERSLHPHLDRDTRPEFIKRRIAKWIPKGRTLFIASNERTPGFFSPLSDRYKLAYSSNFSSILEPIIENNYQLFMVERLIMQGAKTFVKTMKELDSDLALCDDPKKNTKNWEVPVYTR

SEQ ID NO: 131295 - protein, 77 aa, Triticum aestivum
  Clone ID: PAT_TA_25713.pep
KVLVTKSKRKPNVLTILASQEIMDLSLLNLEEFAMFAVSSEISGRSIFHRDFSLKTSNANDKSRHHGRQSGYRSNTA

SEQ ID NO: 131296 - protein, 117 aa, Triticum aestivum
  Clone ID: PAT_TA_25714.pep
QLASAKSSMPTGDLQWYFFCTRGRKYSVGHRANRSTEGGYWKATGKDRQVVYENRTVGMKRTLVFHAGKAPKGTRTDWVMYEYRLVQGEIPDAGVRLVCFFAISFFPTSLFHYLFYI

SEQ ID NO: 131297 - protein, 149 aa, Triticum aestivum
  unsure (1)..(149): unsure at all Xaa locations
  Clone ID: PAT_TA_25715.pep
MEMVECSLAASRAARPVPGRVPRSPAPVLGVGAGRARLRVRSERREQPPPVIRASAPPEHDGGALAKAAAGLAAAAVVSLTGFAGDLAPPPALAESLTVAFPVSKAREVNRTMVEMFPLKSADARXYARISGMVSTLGDPFTRIITPXX

SEQ ID NO: 131298 - protein, 103 aa, Triticum aestivum
  unsure (1)..(103): unsure at all Xaa locations
  Clone ID: PAT_TA_25716.pep
MPPTTPQRRRQDESGGGDNWREEAVSAGSLRQVDLDRGXNGWAAPPGDLFQLRARGYFSGGGGKRGKSAASADWLLRPAGVDWLRSHARLVHLLARDDVPVAA

SEQ ID NO: 131299 - protein, 169 aa, Triticum aestivum
  unsure (1)..(169): unsure at all Xaa locations
  Clone ID: PAT_TA_25717.pep
MCFYVKLKKNMLSASTVICPSINHYFVEIQASVSGYYKLGSIVAVIENFYTTHRPRVHAPDLXNFVVPLLDSKQAIHDQPCASYGVSINRLTGRVTAGVINEETMKSLDNKTDYLFPMSLLLQNCRPIGYVVVMLVLSSGWLLVPYKSCHNMKRLQKVSRSGIFFPGIP

SEQ ID NO: 131300 - protein, 143 aa, Triticum aestivum
  unsure (1)..(143): unsure at all Xaa locations
  Clone ID: PAT_TA_25718.pep
LDTLALVEAAGVKRLLFCGVGCQVQALRSVEKYLGLEKLYVLGTNCVDNGTREGLDKFLNAASSEPETVLHYEFMQDYKVHLKHLDGHIQEVPYFSLPANDLVDVIAPSCYSCFDYTNGLAXDLVVGYMGVPQPPALXMTXXX

SEQ ID NO: 131301 - protein, 150 aa, Triticum aestivum
  unsure (1)..(150): unsure at all Xaa locations
  Clone ID: PAT_TA_25719.pep
MEPPRSRRTRNAAVPTACFLLLLLTLPLSARHHDSTAVPTLRHAVHRAALSSPFYAARPRGDCQELQSLDGAEARCAYLLSHTPCAPAGYVDYLRLFYCGFAGAGHPAAGYAASLLWLVVLFYLLGDTASEYFCASLXXLSAXLRLPPAV

SEQ ID NO: 131302 - protein, 126 aa, Triticum aestivum
  Clone ID: PAT_TA_25720.pep
LPTAALTPATAYAAYLVFATEDAHRGLSFPDQETTVSVGGSAPSRHAVCLRPDPTDARRFRDDKVMDGVHVRGPVLRGDGWWEVEMGLLRTRDKATAGEEVAVSFEILGWYPKRGLIVEGIEFRPI

SEQ ID NO: 131303 - protein, 201 aa, Triticum aestivum
  unsure (1)..(201): unsure at all Xaa locations
  Clone ID: PAT_TA_25721.pep
HEAAPQVLEDLPGVLKLLSDGSVVRGDEAVLWPEDPLPDVPGVQWKDAQYHAPRGLSVRVYRPSSSVTEAGGPKLPVLVSFHGGGYCLGSFAQPHFHTYCLRAAAELPAVVLSVQYRLAPEHRLPAAIEDGAAFLSWLRDQAELGVGADPWLAETADFXRTFISGASAGANLAHHVTVQAASAQRDVHPVRVAGYVLISAF

SEQ ID NO: 131304 - protein, 70 aa, Triticum aestivum
  Clone ID: PAT_TA_25722.pep
PSTRMQMSLVSEKDLIRELLIKKTGNEPVNMRWSRLNQPRRWRFSSLDSLLAEVIWIPMSHIVQEEFVGL

SEQ ID NO: 131305 - protein, 113 aa, Triticum aestivum
  Clone ID: PAT_TA_25723.pep
HVLNSKFLFISTILQVMYAHKQVFAVIWCPGSDQRRFTKKLKIQRNFKKFQKQMIENLLREVLIKKTGNEPVNMRWSRLNQPRRWRFSSLDSLLAEVIWIPMSHIVQEEFVGL

SEQ ID NO: 131306 - protein, 106 aa, Triticum aestivum
  Clone ID: PAT_TA_25724.pep
MAACAFFFDAEPLGEPGLQLHGPELELDACALCTKPLQGNSDIFMYKGDTPFCSEDCRYEQMHFDAAMARQQASARRKQQQQQAQAQPSVPAPAPVSAKADVSVAS

SEQ ID NO: 131307 - protein, 235 aa, Triticum aestivum
  unsure (1)..(235): unsure at all Xaa locations
  Clone ID: PAT_TA_25725.pep
SVVAAEVXXQDLSVWRCHALLHWPEKEFEGLVSLRKLVIHQCENLTGYAQASTEPSTSSEKSQLLPRLELLVIRKCESLVEVFNVPASLRVMEILYCKKLESISGRRLLQGQSASSIHQGPSSIAEVSSSPSSGVGVENLETLKLVECHSLTGVLRLPSSLKVLDIDSCSGLTSLESHSGELPSLEYLPGRPRNKLSSLLDGPRAYSYLQSLYIKNXXGIXXFPTSLQXXXGSIQ

SEQ ID NO: 131308 - protein, 184 aa, Triticum aestivum
  Clone ID: PAT_TA_25726.pep
MATASSMQQPALLLLRQLTQDPVTASLLAVALATAVLMIAALSRGGGRKPRLPPSPRGFPVIGHLHLVRPPVHRTFHDLAARLGPLMHIRLGSTHCVVASSAGVAAELIRTHEGKISERPLTAVARQFAYGDDGFAFAPYGPHWRSMKRLCMSELLGPRTVEQLRPVRRAGLVSLLQSVLHSGA

SEQ ID NO: 131309 - protein, 518 aa, Triticum aestivum
  unsure (1)..(518): unsure at all Xaa locations
  Clone ID: PAT_TA_25727.pep
DPGPAPPPGRGRRPGARASPPPPPPKPAPRQSRSSPAPSGGPRPPPVPRAARGAPSHPPPPGRGRPGRAARGGVGHLLPQPPPPPPHLPPLPRRGRGNRRCRVQVARYAIDAAWFLPWPTNGLGTCPVRQIGGCSFLYMRINNVYIVIVVSSNANVSCAFKFVVEAVALFKSYFGGTFDEDAIRNNFVLIYELLDEIMDFGYPQNLSPEILKLYITQEGVRSPFSSKPSDKPVPNATLQVTGAVGWRREGLVYKKNEVFLDIVESVNLLMSSKGSVLRCDVTGKILMKCFLSGMPDLKLRQYDKIGLEKEAELDDVTFHQCVNLTRFNLENTVSFVPPDGEFEXDEICFVPPCNEFVLMKYRITEGVNLPFRVLPTIKELGRTRMEINVKVKSVFGAKTFRIGVLVNVTVPKQIASSSFLTTSGEAKYNASIGSLVWKSRKFHGYTEATMXAKVELIXSTMGEMKLANSLAYLLEFQVPMFTASGLRVRFLKVWEKSGYNTVEWVRYITRAGSYEIRC

SEQ ID NO: 131310 - protein, 272 aa, Triticum aestivum
  Clone ID: PAT_TA_25728.pep
QESLYTSVAEKHETRSNQHCETPEVKEMEKWGKEMRARNIGHHTLGSRGYPGKKPKWDKQDAEFAAAGIPNPFKEFENPRENDYIRGRCKYDEETKTWVLDEKTAKVKELLRQYHVESQSSQESESSARWDDPLNRSINVVLGKDPKTRPAYGRVNGVGLKEKWDTHYPEDRELARQRRRAGRASFESRLAGMREELKEEMREEVEVKAKAMATAQVMEMWPDLIEAVKRSLASGQTAAPSSSVTLAPANVILEKEPRPGAHHSSRSVPFMG

SEQ ID NO: 131311 - protein, 184 aa, Triticum aestivum
  unsure (1)..(184): unsure at all Xaa locations
  Clone ID: PAT_TA_25729.pep
MGSRVFLVAAVVAVAVAAAGADVAADRAECSDKLVALATCLTFVQGQGQAPTPDCCGGLKTVLQTXPKCLCVLVXDRDDPGLDLKLNVTRALGLPAACSAPANISDCPRLLNLPPNSKDAEVFEQFAKQQAAQSSPSGASSAPSTGAQKNAAARMRWLGVGGVGVAARAAPLLFFAVPFLLLLR

SEQ ID NO: 131312 - protein, 156 aa, Triticum aestivum
  Clone ID: PAT_TA_25730.pep
MGDFTIRLSTSLIEQLARDAEKQVKRRARKPKPRKVVEQPEEPQDNGRELTTEPNQRPAPFLPFPSPIHVPVTPPPAPPPPVIQAGEGIPAVVGGREEELDELQAKEGRMREELTKQEGQLHDKECNLAYQTPAPCTDQRAGRAERYRNDVQGRLK

SEQ ID NO: 131313 - protein, 254 aa, Triticum aestivum
  unsure (1)..(254): unsure at all Xaa locations
  Clone ID: PAT_TA_25731.pep
ANGGTKEIVVRAPPLQLVTGKPHLHKDTYRSIQALHLLHYLRANKATSASGLRXRLFSTSDRNVIHSSNWSSIPGMFKFLRRVPGRIEKWVLPXAFDDDXNPYLPKHILYRQKEQFSHGVGYSWIDGLKDHANAHVSDSMMTNASFVYPDNTPTTKEAYYYRTVFEKFYPKNAARLTVPGGPSVACSTAKAVEWDAAWSKLLDPSGRAALGVHDAAYEEEKAPASVDPVLENAFHPPAHGESTLVKSAVPAAAV

SEQ ID NO: 131314 - protein, 199 aa, Triticum aestivum
  Clone ID: PAT_TA_25732.pep
KLSTVEGSIMRAVSELQALQDERKKVDPQKAEAIEQFLVKLRSLGSGEAAFTFILDDASGNSFIENPNAPSSDPLLSLRFYERTYEQQAALGFLAEPTKESGDSSQDASTVEGNSGGPQRIPHGSVGAVAGRRAIAQGNSDEITTALCRYSAPEEVDTLPSTCAACATECVTRFFSTKIPYFREVIVMATSCDACGYRN

SEQ ID NO: 131315 - protein, 198 aa, Triticum aestivum
  unsure (1)..(198): unsure at all Xaa locations
  Clone ID: PAT_TA_25733.pep
VHEXAHGLERSGHRFLWVLRGLPVDTTMGAREPTDANLAELLPEGFLEKTKGRGLVWPTRAPQKEILAHAAVGGFVTHCGWNSILESLWFGVPMLPWPLAADQHLNAFAVVHGIGAAVPLEMDRERGNYVEAAQLERAVRSLMGGGGGEEGVNKAREKAMEMKRACRHAVEQSGSSHASLQRLSEELVGGAVLPKRGT

SEQ ID NO: 131316 - protein, 168 aa, Triticum aestivum
  Clone ID: PAT_TA_25734.pep
AQREAHREAHRGQIASRGRRSATFTPRSAASFFTARTPPPTVDWRAHGAVTPVMDQGVLGSCWAISTAGAIEGLHKIRSGRLVRLSSQQIYDCSNKSMIESHLRAYDWVLRNGGVASEETYPYVDRVQDCKREKLAYDLLRPSQAFSGPYEPSKSFWFAVTTRWAVKM

SEQ ID NO: 131317 - protein, 204 aa, Triticum aestivum
  unsure (1)..(204): unsure at all Xaa locations
  Clone ID: PAT_TA_25735.pep
SYGLVQIXVENKKNFDLTKALTLVAEVQPIRIDSDVINEVVQFVTRRLEQLLVDEGINYEIVRSVLMERANCPYLASQTAAEMEAFSRTQDFPKIVEAYSRPVRIIRGKQIESAWEVDASVFEKEEEKALWSAYLEAADKIHPGVDVKTFAEASLLLIHPLEDFFNNVFVMAEDERIRNNRLALLQKVASLTKGIADLSVLPGF

SEQ ID NO: 131318 - protein, 176 aa, Triticum aestivum
  unsure (1)..(176): unsure at all Xaa locations
  Clone ID: PAT_TA_25736.pep
AGRTRGWPRPSSPWPPARRRAPPRSRSRXPRERQQRARPVPRPRRRVAAHELQRRDGGXPRRGSRTPPTRRARPGPARRAPWRWRRPAPTCRAPRRGPPRRGGARGGPPWRRPARWTAAPRRRRRSPRSRGSRCTSPPPCRRPARRRRERLGRPALAQGRGGMSSGSSWFTGGGGW

SEQ ID NO: 131319 - protein, 211 aa, Triticum aestivum
  unsure (1)..(211): unsure at all Xaa locations
  Clone ID: PAT_TA_25737.pep
MPVTQAPGRSTGPVSVARRELSSRAWSLSSPASPQPRYGSIRPVLSIDGGGVRGIIPGTILAFLEEKLQELDGPDVRIADYFDVVAGTSTGGLVAAMLTAPNTEGRPLFAAKDVNKFYLEHCPNIFPAVCKGPLGWLKSMMGPKYSGHHLHSVVKELLGATRVNETLKNIVIPTFDIKLLQPSLFAADDPSAAAPGHAPRSGVPASPSXVP

SEQ ID NO: 131320 - protein, 354 aa, Triticum aestivum
  unsure (1)..(354): unsure at all Xaa locations
  Clone ID: PAT_TA_25738.pep
MESGSTFYAGEGLHIDPSWLIDPKLLFVGPRIGEGGHAKVYEGKXVTKYKNQNVAIKIVHKGDTPEEVIKRQGRFLREVTMLSRVQHKNLVKFIGACLEPVMVVVTELLVGGSLRKYLVSLRPRNLEPRVAVGFALDIARAMECLHAHGIIHRDLKPENLLLTADQRTVKLVDLGLAREETLTEMMTAETGTYRWMAPELYSTVTLRHGEKKHYNHKVDVYSFAIVLWELLHNRLPFEGMSNLQAAYAAAFKNIRPSADNLPEELSEILTSCWKEDPSDRPNFTQIVQMLLHYLSTLSPPEHMAPARTFSSENAILPPESPGTSSLMASRGDITPKGNIEDKPRGFFFCFSQCY

SEQ ID NO: 131321 - protein, 94 aa, Triticum aestivum
  Clone ID: PAT_TA_25739.pep
AFVVDPTNQSDPTSLESRRTTEPNKHSVRLAVVFGLISSEARTPILVKKNVRICNDCHHALKLISKYSGRRIVVGDTNIYHQFSDGSCCCGDYW

SEQ ID NO: 131322 - protein, 78 aa, Triticum aestivum
  Clone ID: PAT_TA_25740.pep
FERPAGQVLVLQFIGPLIRKAVFDQLKKRNSVERTVKMTISYGYTDDSYGSSLQKDHRPKSLLLVADEAHTSLMIMSP

SEQ ID NO: 131323 - protein, 110 aa, Triticum aestivum
  Clone ID: PAT_TA_25741.pep
MGVILLLGKKALGSPSQRRKEEKNSHQDQEEIDGTKEYHKNLYIMLNSDVQPGLRSEEGWVMRLTRGPWTDTHCQWSPKGDWIVFPSSRGRELDSSLDQGHYSLYLPGRP

SEQ ID NO: 131324 - protein, 132 aa, Triticum aestivum
  Clone ID: PAT_TA_25742.pep
AAWAGPRCEISLVVFGRGPPELWHWLRPWAVVGDKRGRAWFVGSCEWWVDSCWFYKAEKFSSKLDHRVFLCSMGLHRNLQGEACIVAGRVYLQDDHRQSIPEEVSNLCSMLWIIVSIKSNPYCLWYLPGRPL

SEQ ID NO: 131325 - protein, 122 aa, Triticum aestivum
  Clone ID: PAT_TA_25743.pep
AYPASMAALKGDGGRVQLLLDLGASVSEVTIEDGTTIDLIGSGSTPLHYAACGGNAVCCQLLIARGANLAAKDASGSTPLMVAQSWHRTSIEEILSNEPGGQIRTLPSPYLCLPLMSIMNIA

SEQ ID NO: 131326 - protein, 57 aa, Triticum aestivum
  Clone ID: PAT_TA_25744.pep
RAAARAGTSGWFLVVLHLLMMHKVGSNFVYVSNLFVLNVNMFHAEQKITFNNFPFLL

SEQ ID NO: 131327 - protein, 128 aa, Triticum aestivum
  Clone ID: PAT_TA_25745.pep
SVVAAEVPRRPVLRTETQGSVASAAPSYASNAPLMSNTGFADNDYNHYDGPLPPPPHMRSESQSTLNSQRSYRPGGLPGGPPGPGPRMPPQRSNTGFSFEQIQQATPTTTRLSSRSAPSRVPARAAAR

SEQ ID NO: 131328 - protein, 63 aa, Triticum aestivum
  unsure (1)..(63): unsure at all Xaa locations
  Clone ID: PAT_TA_25746.pep
LSKAFGNLKCKSRRNNKIVQKQCKSNPHIASMHFYETQMHPGKTVICSPXXAYVSEYAHNLIR

SEQ ID NO: 131329 - protein, 76 aa, Triticum aestivum
  Clone ID: PAT_TA_25747.pep
RRSPQPVDPISHQSPDGASSSPDRDLTPARPPEVSTCTSRSAWSSFRLVGKCLVHRSRIQPSVVSLRSLLVPDCGW

SEQ ID NO: 131330 - protein, 78 aa, Triticum aestivum
  Clone ID: PAT_TA_25748.pep
YDWHPGLNQMAYMKATNLVDLLDLGASTAAGTRLALQWILVKGFRLYSFQLPDTNAPGIVIYCHYLPVSGLGNLRACS

SEQ ID NO: 131331 - protein, 92 aa, Triticum aestivum
  Clone ID: PAT_TA_25749.pep
VHQESVRARERCSRLPANPKESRGGDDQGRGCVAAGRHHGQLPGHQGNRTTPSYVAFTDTERLTSDAAKNQVAMNPTNTVFGSPRLSTGDGV

SEQ ID NO: 131332 - protein, 131 aa, Triticum aestivum
  Clone ID: PAT_TA_25750.pep
ILSKVAGLSVEIQKLEHDVLPQLMVQEAKLERDALEAFLLMKNSAVALLHMRKSFKEALGVLLREDYLVTAKVKKLSKMLKDIVVHVLKGKCNIVWLQERVPLLVQLVTDVLETPVHFCDSDESSDEYSDE

SEQ ID NO: 131333 - protein, 111 aa, Triticum aestivum
  unsure (1)..(111): unsure at all Xaa locations
  Clone ID: PAT_TA_25751.pep
MAPTKGEGPAIGIDLGTTYSCVGVWQHDRVEIIANDQGNRTTPSYVAFTDSERLIGDAAKNQVAMNPINTVFDAKRLIGRRFADAPVQSDIKMXPYKVFLPRRAMIVCSPR

SEQ ID NO: 131334 - protein, 169 aa, Triticum aestivum
  unsure (1)..(169): unsure at all Xaa locations
  Clone ID: PAT_TA_25752.pep
MAAMHESTPSLLVLFLSLMLFFTASSARHMTGDPPPVIPSPPPHMASPTMEEAWEGVMVAPRPVPSGPDPIHHRPHAPPPHRASPSTEEAREGVMVAPRPVPXCPNPIHXXSAPAPQTPPITDVMTYRPHSQKRRAKAIFCAEASSFDNTHTHPGQCLTQPERDAGPTV

SEQ ID NO: 131335 - protein, 148 aa, Triticum aestivum
  Clone ID: PAT_TA_25753.pep
AAAGGSSCAKAPQTLTLVLASLPSSRSSSSHGADQGRGAGHRHRPRHHLLVRRRVAARPRRDHRQRPGQPHHALVRRLHRLGASHRRCAKNQVAMNPINTVFDANVLSAEGLLMPCQSDIKMWPYKVIPGPARQPMIVVQYKGDNIFN

SEQ ID NO: 131336 - protein, 206 aa, Triticum aestivum
  Clone ID: PAT_TA_25754.pep
LRAFLPKFELMDRISTFTDLKNNVSRSICVCIIRLDEETNDLVVSEKKAWEMTYLKEGALLKGNVHKIFPYGAQVRITGTNRSGLLHISNISQGRVLSVSDILKVDDELKVLVIKSNVSDKIALSIADLESAPGLFLSDKAKVFSEAQEMAKRYREQLPVVSRNTKLDYDLRGETIPFDNEATLYANWKWFKFLRHAKSGDENDRT

SEQ ID NO: 131337 - protein, 228 aa, Triticum aestivum
  Clone ID: PAT_TA_25755.pep
RPGSRSPRRRSPQHPVDPISHPPLARPSLLRRQKEKMLYKIHSHAEIQALQARTDELGHSNEHMDVKLVSLESVRIARESYALLRPLIMESRSWECPQLDSLSDVAGLSLEIQKLEHDVLPQLKLQEGKLERGALEALLLIRNSASKLLHLRKCFEEALGVLLAKEDLVSAKVKRLSMMLNDTAVHVLKANNTRLFKECVLFLVQLVTDVLETPVRFCDTHKHKHSDE

SEQ ID NO: 131338 - protein, 249 aa, Triticum aestivum
  Clone ID: PAT_TA_25756.pep
GELIYAGPVGHHSCEVIQYFQAIPGVPRIKDKYNPSTWMLEVTSTSMELQLGVDFAQMYRESSMCKDKDMLVKRLSIPVPGTSDLHFPTQFPQKFREQFKACLWKQCLSYWRTPSYNLVRMVFITVACIFFGVLFWQKGNINHINDQQGLITILGCMYGTTLFSGINNCQSVMPFVSVERSVVYRERFAGMYSPWAYSFAQVAMEIPYVLVQVVIFMLIAYPMIGYEWTAAKFFWFMYTMLCTLFYFLY

SEQ ID NO: 131339 - protein, 156 aa, Triticum aestivum
  unsure (1)..(156): unsure at all Xaa locations
  Clone ID: PAT_TA_25757.pep
LIQVFEGERTRTRDNNLLGKFELSGIPPAPRGVPQITVCFDIDANGILNVSAEDKTTGQKNKITITNDKGRLSKDDIEKMVQXDAREVQSEDEEHKKKFDAKESLXENYAYNMXRNTIQDEKFPPKLPADDKKKSETRLTRDPVVDATRVGKDDWL

SEQ ID NO: 131340 - protein, 213 aa, Triticum aestivum
  Clone ID: PAT_TA_25758.pep
PLSLGLETAGGVMTVLITRNTTIPTKKEQVFSTYSDNQPGVLIQVFEGERTRTRDNNLLGKFELSGIPPAPRGVPQITVCFDIDANGILNVSAEDKTTGQKNKITITNDKGRLSKNYAYNMRNTIQDEKIASKLPADDKKKIEDAVDAAIQWLDANQLGEVDEFEDKMKELEGLCNPIIAKMYQGAGADMPGGMDEDAPAASGGAGPKIEEVD

SEQ ID NO: 131341 - protein, 254 aa, Triticum aestivum
  Clone ID: PAT_TA_25759.pep
GGGRHRRLLSATPLRPETDGGKPQEVKLREAGHGRRFWDVKVVLDADGHMYLERGWEQFARAHDLRLGYFLVFSYDGDAVLTVKVFDVSMCRRHYKHDGDTSSESSSDGDSGSSNTSDGGSGGNNRSLVEMDVEDGPTGQFSAMLRKCNLGMKQEQYLNVPVDFQLAHGYAERSKVELRMRGKSWLVHLKHNPKTGGRSRASFRYGWHQFCVDNALGEGDTCFFRALRQGSAGGGGEDHLLKVEVRRRDGSFLV

SEQ ID NO: 131342 - protein, 228 aa, Triticum aestivum
  Clone ID: PAT_TA_25760.pep
PHSIASPPFPATPCRPNLTSPDASSSPDLTPARPPARAGSSNCSAAVRQKEMVLYTINSHAQIQDLQAHSDELGHSNNPMLVKLVSLESVRIARESYALLRPLIMDVMFWPCPEMEILLVVAGLSLEIQMLERDVLPKLMVQEAKLERGALQALLLIKLALGVLAEEDLVSPRVEKLSIMLEDTAVHVLEGNCNMLQESVPLLVQQVTHVLETPVCFSDPDEWKSDDE

SEQ ID NO: 131343 - protein, 133 aa, Triticum aestivum
  Clone ID: PAT_TA_25761.pep
MAVPLLTRKIVKKRVKHFKRAHSDRYIGLKQSWRRPKGIDSRVRRKFKGCTLMPNIGYGSDKKTRHYLPNKFKKFVVHNVSELELLMMHNRTYCAEIAHNVSTKKRKDIVERAAQLDIVVTNKLARLRSQEDE

SEQ ID NO: 131344 - protein, 256 aa, Triticum aestivum
  Clone ID: PAT_TA_25762.pep
LISCIWDQENVTIFNRICIRNQQYEGERTRTRDNNLLGKFELSGIPPAPRGVPQITVCFDIDANGILNVSAEDKTTGQKNKITITNDKGRLSKEEIEKMVQEAEKSRTAADASRVVSSSPEKEQDGRKEGRRQEEGGDPLRKGRAPVPRRPHRALPQEGPLRPARRLRRPRLPRRRPRVLLQNVHEDLGQQLWPHQNRLLRCDHCILELNGKVHSVYWIFLLRSFLLFQPACQIQYGMRFHSKPVVGPLCTCPGGR

SEQ ID NO: 131345 - protein, 225 aa, Triticum aestivum
  unsure (1)..(225): unsure at all Xaa locations
  Clone ID: PAT_TA_25763.pep
RPIAGINVLRIINEPTAAAIAYGLDKKASSVGEKNVLIFDLGGGTFDVSLLTIEEGIFEVKATAGDTHLGGEDFDNRMVNHFVQEFKRKNKKDISGNPXALRRLRTSCERAKRTLSSTAQTTIEIDSLFEGIDFYFTPSPVPVLKEMNMVLFKKCMXPVENVLRDPKMDKTLCTCCPVGGSTRSQXAXLLQDSWQGLHNLIPMDNKRTLTENKRQDCLVHLFLPG

SEQ ID NO: 131346 - protein, 183 aa, Triticum aestivum
  Clone ID: PAT_TA_25764.pep
DAKMDKSTIHDVVLVGGSTRIPRVQQLLQDFFNGKELCKSINPDEAVAYGAAVQAAILSGEGNEKVQDLLLLDVTPLSLGLETAGGVMTVLITRNTTIPTKKEQVFSTYSDNQPGVLIQVFEGERTRTRDNNLLGKFELSGIPPAPRGVPQITVCFDIDANGILNVSAEDKTTGQKNKIEEVD

SEQ ID NO: 131347 - protein, 341 aa, Triticum aestivum
  unsure (1)..(341): unsure at all Xaa locations
  Clone ID: PAT_TA_25765.pep
REQKLELHRGGGRSRTSGSPGLQEFGTRRAKRTLSSTAQTTIEIDSLFEGIDFYSTITRARFEEMNMDLFRKCMEPVEKCLRDAKMDKSTVHDVVLVGGSTRIPKVQQLLQDFFNGKELCKSINPDEAVAYGAAVXAAILSGEGNEKVQDLLLLDVTPLSLGLETAGGVMTVLIPRNTTIPTKKEQVFSTYSDNQPGVLIQVFEGERTRTRDNNLLGKFELSGIPPAPRGVPQITVCFDIDANGILNVSAEDKTTGQKNKITITNDKKKIEDAVDPAIQWLDANQLGEVDEFEDKIKELEGLCNPIIAKMYQGAGADMPGGMDEDAPAANGGAGPKIEEVD

SEQ ID NO: 131348 - protein, 227 aa, Triticum aestivum
  Clone ID: PAT_TA_25766.pep
LPANRAKGLGESDGGRSDLVAGAGAGFLPRQQGVPGHPHPQPVRRVDGPPRAERFRLPRRSGHLPRPPRRAGRPGPETQQVQAQGPDSLQDAHGGQGQGQGGEGGGGGGRQGQGGEEGGARQGQGGEEGGGGERQGKDGDEGGGGGLQGQAGEGGGACWWCCCIPREVEAQPVRGVCDQGEEDGEDGPSEQLHQVAARVGQEASPSPAQPPRDAPLHGRHQGRASPP

SEQ ID NO: 131349 - protein, 315 aa, Triticum aestivum
  Clone ID: PAT_TA_25767.pep
LDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQDAEKYKSEDEEHKKKVEAKNSLENYSYNMRNTIKDEKIASKLPADDKKKIEDAIDAAISWLDANQLAEADEFEDKMKELESLCNPIIAKMYQGAGEDMGGAGGMDEDAPAGSGGPGPKIRGGGLSGLLSVLSVLQLLAGPSCCRELSSVGAVCPLKLYLWLVGTFVVVIFLDLVIVGRFNVIAATGKP

SEQ ID NO: 131350 - protein, 124 aa, Triticum aestivum
  Clone ID: PAT_TA_25768.pep
MPHHQPPTPSLPPPTSSPTWPCRAPPSSPPWPPCASWRLSGPWACTCCVSGPGRPARRGGRGRCPDRRGRRRRSARGGPSTRRAGWGWGWPGTPCWRGKKPAPATRSLLPPSLSPKPLALFAGS

SEQ ID NO: 131351 - protein, 175 aa, Triticum aestivum
  unsure (1)..(175): unsure at all Xaa locations
  Clone ID: PAT_TA_25769.pep
ISPPPGVKNAMEMQAEAERRKRAQILQSEGAMLDQANRAKGEAEAILSKSQATAEGIRMVSESMRAEGSAEAAKLRIAEQYITAFAALAKNTTTMLLPSDAXGNPSSMIAQSLQIYKHISQSSSPKGGNQQAEEVEEAGPQEEADTFGLPSVTSAMPPSTQTGHGSTFSLQKRKE

SEQ ID NO: 131352 - protein, 385 aa, Triticum aestivum
  unsure (1)..(385): unsure at all Xaa locations
  Clone ID: PAT_TA_25770.pep
LLSNAVVTVPAYFNDSQRQATKDAGVIAGLNVMRIINEPTAAAIAYGLDNRMVNHFVQEFKRKHKKDISGNPRSLRRLRTSCERXKRTLSSTAQTTIEIDSLFEGVDFYSTITRARFEELNMDLFRKCMEPVEKCLRDAKMDKSTIHDVXVLVGGSTRIPRVQQLLQDFFNGKELCKSINPDEAVAYGAAVQAAILSGEGNEKVQDLLLLDVTPLSLGLETVCFDIDANGILNVSAEDKTTGQKNKITITNDKGRLSKDDIEKMVQDAEKYKSEDEEHKKKVDAKNSLENYAYNMRNTIQDEKIASKLPADDKKKIEDAVXAAIHGLDANQLGEVDEFEDKMKGAGGLCNPSIXAKMYQGAGXADMPGGMDEDXPAANRGAGPKI

SEQ ID NO: 131353 - protein, 270 aa, Triticum aestivum
  Clone ID: PAT_TA_25771.pep
MDSVESFQFFQIILENSWTRLRLPDKFTRVLLELDGGKPQEVKLRNAGHGRRFWDVKVVLDADGHMYLGRGWEQFARAYDLRLGYFLVFSFDGDAVLTVKVFDVSMCRRHYQHDDDGSTSSGSSSDGDSGSEDGSSNGDGGGNSSSMAVMGIDDGPASLFTVMLRECNLGVRQKQYLNVPVEFQNAHGYAERSKVELRMRGKSWFVNLKHSPRSRGRPRASLRYGWHQFCVDNGLGVGDTCFFRALGEGSAGEVHLLKVEVRKRDGSFLV

SEQ ID NO: 131354 - protein, 217 aa, Triticum aestivum
  Clone ID: PAT_TA_25772.pep
GGGRHRRLLSATPLRPETGEMEGFEFFQIVLDNSSSRLRLPDKFTMVLLDGGKPQEVKLREAGHGRRFWDVKVVLDADGHMYLERGWEQFARAHDLRLGYFLVFSYDGDAVLTVKVFDVSMCRRHYKHDGDTSSESSSDGDSGSSNTSDGGSGGNNRSLVEMDVEDGPTGQFSAMLRKCNLMKQEQYPDVPGPARARVRREEQGWSCGCAASRGSCT

SEQ ID NO: 131355 - protein, 109 aa, Triticum aestivum
  Clone ID: PAT_TA_25773.pep
RRPRIRDSSVAGARGQQWTLQVLDSLFLGFLRPCLSTPIHAPAATGHRHPVYGNPGDSKLLQWPIPPAGPFWVAWEPRWVDSKFLQSLLLTAPRAGCRVKHAKLFNPYS

SEQ ID NO: 131356 - protein, 225 aa, Triticum aestivum
  Clone ID: PAT_TA_25774.pep
FGTRPQHPVDPISHPPLARPSLLRRQKEMMLYKIRSHAQIQDLQARSDELGLSNKSMLVSLVSLESVRIAWESYALLRPLIKESWIWVCPQLEILSDVAGLSLEIQKLEHDVLPQLKLQEAKLERGALEALLLMKNSAVALLHLRKCFKEDLGVLLAKEDLVSAKVKRLSKMLKYIAVRLLQERECNIVGLQERVRLLVQLVTEVLNTPVHFDDSDESSDESSDE

SEQ ID NO: 131357 - protein, 310 aa, Triticum aestivum
  Clone ID: PAT_TA_25775.pep
RTRPPTRPPSSIASSSLSTLAASRCRERGGRHRRLLSATPLRPGEMEGFEFFQIILDNSSSRLRLPDKFTRVLLDGGKPQEVKLREAGHRRRFWDVKVVLDADGHMYLGRGWEQFARAHGLRLGYFLVFSYDGDAVLTVKVFDVSMCRRHYQHDGDTSSGSSSDGDSGSSNTSDGGGGGNNWSLAEMDVEDGPTGQFSAMLRKCNLGMKQEQYLNVPVDFQLAHGYAERSKVELRMRGKSWLVHLKHNPKTGGRSRASFRYGWHQFCVDNALGVGDTCFFRALRQGSAGGGGEDHLLKVEVRKRDGSFLV

SEQ ID NO: 131358 - protein, 211 aa, Triticum aestivum
  unsure (1)..(211): unsure at all Xaa locations
  Clone ID: PAT_TA_25776.pep
MSSSSFSKARFEGKGVGGGGAGRSISLAASRAKLAAATASAKKAAATTASGRGKGKGKAAKKVFSLXGQKFDIPEEREPLRIFYESLSKQIPSSDMAEFWLMEHGLLSPERAKKAYDRKLKRQQQIKSGTPIKSSNSNTVSKHNNNKPAETWKKPAPVVSSSSTARHNTDHTAAKAKRRVEYSSDDDDKEFIVKLKRPNFNSNSNSSSRGG

SEQ ID NO: 131359 - protein, 149 aa, Triticum aestivum
  Clone ID: PAT_TA_25777.pep
LLQATAARSRGGEERERLLLLVLDGGVAVESRSRRRRRRRAQVVGTSIQKVAAPSVRAGKQGAARMARWRPCKIGLHIGPWLARGCVFGPGRIPNVSLRIPAYPSRFFFFFNSNFGDTPKFAYPAYPAVSPYPAVSGRQFGDSWRVRAF

SEQ ID NO: 131360 - protein, 221 aa, Triticum aestivum
  Clone ID: PAT_TA_25778.pep
ATPCRPNLTSSSRPPESSSPPKGNDALQKSTPMPKSKTCRPAPMSWASPNKSMLVSLVSLESVRIAWESYALLRPLIKESWIWVCPQLKILSDVAGLSLEIQKLEHDVLPQLKLQEAKLEMGALEAVLLMKNSAVALLHLRKCFKEDLGVLFCEDHLVSAKVKRLSKMLKDIAVRLLQERECNIVGLQERVRLLVQLVTEVLDTPVHFDDSDESSDESSDE

SEQ ID NO: 131361 - protein, 334 aa, Triticum aestivum
  Clone ID: PAT_TA_25779.pep
EEEEGCATWHGIHGIVGSFFFLFLPLPLALPSSQAPVSPPSQPAAAERGPGGRHRRLLSATPLRPETGEMEGFEFFQIILDNSSSRLRLPDKFTRVLLDGGKPQEVKLQEAGHGRRFWDVKVVLDADGHMYLGRGWEQFARAHDLRLGYFLVFSFDGDAVLTVKVFDVSMCRRHYQHDGDTSSGSSSDGDSGSSNASDGGSGGNNWSLAEMDVEDGPTGQFSAMLRKCNLGMKQEQYLNVPVDFQLAHGYAERSKVELRMRGKSWLVHLKHNPKTGGRPRASFRYGWHQFCVDNALGEGDTCFFRALRQGSAGGGGEDHLLKVEVRRRDGSFLV

SEQ ID NO: 131362 - protein, 230 aa, Triticum aestivum
  Clone ID: PAT_TA_25780.pep
PIHHRDITRRLVLLSRSDLTPARPSLLRRQKQMTMLYEIHSHAQIQDLQARPDELGHSNKRMDVKLVSLESVRIARESYALLCPLIMESRMWFCPELEILSEVASLSLEIQKLEHDVLPQLTVQEAKLETGALEALLLMKNSAVGLLHMRKCFKEALGVWLCEDYVVSAKFKKLSKMLKDIAVPLLQERECNIVWLQERVPLLLQLITDVLETPVHFCDSGESSDESSDE

SEQ ID NO: 131363 - protein, 212 aa, Triticum aestivum
  Clone ID: PAT_TA_25781.pep
MSSSSLSKARFEGKGGGGAGGSGRSISLAASRAKLAAATAAAKKAATTSTAGGGRGKAKAKAKKVFSLTGQKFDTPEEREPLRIFYESLSKQIPSSDMAEFWLMEHGLLSPERAKKAYDRKLKRQQQIKSGTPIKSPNSTTVTKHKPAESWKKPVPLVSSSSTAGHNTDHSAAKAKRRVEYSSDDDHDDKEFVVKLKRPNFNSNSNSNSRGG

SEQ ID NO: 131364 - protein, 141 aa, Triticum aestivum
  Clone ID: PAT_TA_25782.pep
ENTSKHKGGSKKYIATVDSKLFATPLRNTHHNSLELADKSTHQSSSGSQKRTGVSNTLVTSWTSNTTRSSSQAMLPLPLSTASAVSFSIMLSFLTRAKTRSSSASNTPKANIKRFLRSKRIIAEFFMSRRASRAPCSSLAS

SEQ ID NO: 131365 - protein, 247 aa, Triticum aestivum
  Clone ID: PAT_TA_25783.pep
LVPNSARAPPHSIASPPFPATPCRPNLTSPDASSSPDLTPARPPARAGSSNCSAAVRQKEKMVYKIHSHAQIQALQARSDELGHSNEHMLVKLVSLESVRIACESYELLCPLMMESSWKCPELEILSVVAGLSLEIQKLEHHLLPQLMVQEAKLERGALEAILLVKNSAIKLLHLNKCFKEALGISRFEEDPVTNHVDLLSILLKDMAVPVLENNCGGDWLKPRVPMLVQQVTHVLEIPVRFCYSDE

SEQ ID NO: 131366 - protein, 162 aa, Triticum aestivum
  Clone ID: PAT_TA_25784.pep
RRNPQARSGRGSPDLGFRRNRSTWRRRLRSRLTRRIRSRRRKRRRLLVGAATPDWLRLDLYLVDGYGFKEQRMVKMDHRNGYIKWLLEWDKKPRPPLPNLPEECREAMDAIKAQRDHDERVLARLQARRATPTSRSMSSTTTTQGPTSPTTTTTSSTTTATK

SEQ ID NO: 131367 - protein, 160 aa, Triticum aestivum
  unsure (1)..(160): unsure at all Xaa locations
  Clone ID: PAT_TA_25785.pep
DGGRSDLVAGAGAGFLPRQQGVPGHPHPQPVRRVDGPPRAERFRLPRRSGHLPRPPRRAGRPGPETQQVQAQGPDSLQDAHGGQGQGQGGEGGGGGARXGQGGEEGGARQGQGGEEGGGRQGQGGEGGGGGGRQGQGGERGGACWWCCNPRLVEARPVSG

SEQ ID NO: 131368 - protein, 242 aa, Triticum aestivum
  unsure (1)..(242): unsure at all Xaa locations
  Clone ID: PAT_TA_25786.pep
GITFVHCRRRRSEPEVVPSTTPPNNGVLLIANAYPVEYGHIFLVPNSTNQLSSFWDKRMFGLITKIASEVNSTAFRVFFDDGTSIVPKHMFFQACYFANPLPVESASTVALYDGATRSGICVSEIVDYPLKALVFTXTNVNALVDVVSEACLALHEKNTVHSLMMSNNGRNVFLFPQVKNLVTGCYLSAWECCGYFVYQTKVDFDRASETGISNRMASFSFQDGEFEDLKKLCCAIADDLVT

SEQ ID NO: 131369 - protein, 250 aa, Triticum aestivum
  Clone ID: PAT_TA_25787.pep
CSTNVNSHRITLTTRTKTPRNLSIDPISHHPTPRPLQILRRGARPPELVCSNQLFCCCSLLRRQKEKMLYEIHSHAQIQALQARSDELGHSNEDMVVNLVSLESVRIARESYSLLWPLTKEPMSLACPELDSLLVVATFVAGNPKGSSMMFYPSSWFRSPSWNGASWEALLVMQNSAIKLLHLAKCYKEAKGVLQDLVSGRAEDVSRMLNDIVVNVLRGNIFWLQVRLPVLARLVTIVLETPVRFCDSDE

SEQ ID NO: 131370 - protein, 334 aa, Triticum aestivum
  unsure (1)..(334): unsure at all Xaa locations
  Clone ID: PAT_TA_25788.pep
MAAMHESTPALLVLFLSLMLLSTPSSARHMTGDPAPVILPPPDMPGDPLPVIPSPPPHMAPPTKEGGWEGIMMAPRPVPSGPDPIHHCPPAPAPCRPPPSTEEARKGAMVAPRPVPSGPNPIHHRPPHRPPPSMEEMREGVMVAPMPIPSGPDPIHHCPPAPAPCMPPLSTDEARKGVMVAPKPVPSGPDPIHHRPPTPGSPXPPPSTEEAREGVMVAPRPVPSGPNPIHHFPAPAPQPHHHYRCHAPPPASTEEAREGDVMAPRPVPSGSNFIHNQPTLALQPNHHRRCKAPPPASMEEAREGDNMSPWRPLPVSGPNPNHNHHAKAPAPPHE

SEQ ID NO: 131371 - protein, 96 aa, Triticum aestivum
  Clone ID: PAT_TA_25789.pep
SWTIGTATSSGCSCGTRSLAVPCPTSQRGSARSRTPSRPSATRTRGSSPTSSATATPTSRSTSSTTTTRGPTFPTTTTTSSITTATTTKANKRSTF

SEQ ID NO: 131372 - protein, 326 aa, Triticum aestivum
  Clone ID: PAT_TA_25790.pep
MATLLRRSAAPARQLLLLPRQLGGARSMSRYYARDEVSRFDALSTPVNWGVSIVPEKKAFVIERFGKYLKTLDSGIHGLVPLVDRIAYVHSLKEEAIPIPDQSAITKDNVVIQIDGVLYVKIVDPYRASYGVENPIFAVIQLAQTTMRSELGKITLDKTFEERDTLNEKIVRSINEASTDWGLKCLRYEIRDISPPPGVKNAMEMQAEAERRKRAQILQSEGAMLDQANRAKGEAEAILSKSQATAEGIRMVSESMRAEGSAEAAKLRIAEQYITAFAALAKNTTTMLLPSDAGNPSSMIAQSLQIYKHISQSSSLKGGNQQAEED

SEQ ID NO: 131373 - protein, 241 aa, Triticum aestivum
  Clone ID: PAT_TA_25791.pep
ASPPFPATCRPNLTSITRRRLVLSRSGSYARPPARAGSSNSSAAVRQKEMMVYKIHSHAHILDLQASADQLGHPNKSMLVNLVSLESVRIACESYALLRQLINESWIWACSELKILLVVAGLSLEIQKLEHDVLPQLMVQEAKLEEGALEALLLMKNSAITLLDLRKCFQLSLGVLLAEEDLVLARVKELSIMLKDTADDVLKGNCDIVCLQERAQSLVKLVTDVLETPVRFCDPDEYSDE

SEQ ID NO: 131374 - protein, 208 aa, Triticum aestivum
  Clone ID: PAT_TA_25792.pep
MSSSSLSKARFEGKGGGAGRSISLAASRAKLAAATKKATTTSTAGGGRGKGKAAKKVFSLTGQKFETPEEREPLRIFYQSLSNQIPSSDMAEFWLMEHGLLSPERAKKAYDRKLKRQQQIKSGIPIKSSNSTTVNKHNNNNKPAESWKKPVPVVSSSSTARHNTDHSAGKAKRRVEYSSDDDDDDKEFIVKLKRPNFNSNSNSTSRGG

SEQ ID NO: 131375 - protein, 185 aa, Triticum aestivum
  unsure (1)..(185): unsure at all Xaa locations
  Clone ID: PAT_TA_25793.pep
LEPWRRPKGEGPAIGIDLGTTYSXVGVWQHDRVEIIANDQGQPAPRPPYVAFNRLRERLIRRCRQRTKVAMNPINTVFXDAKRLIGRRFADAPVQXDIKMWPXKVIPWAPQDKPMIVVQYKGEDKQFSTEEILQWXLIKMREXAEAYXGVTIKNALSRACYSMIPEQDAVYSGLSDSRPKNSMLW

SEQ ID NO: 131376 - protein, 456 aa, Triticum aestivum
  Clone ID: PAT_TA_25794.pep
RAAAVCEKNVLIFDLGGGTFDVSLLTIEEGIFEVKATAGDTHLGGEDFDNRMVNHFVQEFKRKNKKDISGNPRALRRLRTSCERAKRTLSSTAQTTIEIDSLFEGIDFYSTITRARFEEMNMDLFRKCMEPVEKCLRDAKMDKSTVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQEAEKYKSEDEEHKKKVESKNALENYSYNMRNTIKDEKIASKLPADDKKKIEDAIDAAIQWLDTNQLAEADEFEDKMKELEALCNPIIAKMYQGAGADMEGGMDDDTPAASGGPGPKIEEVD

SEQ ID NO: 131377 - protein, 133 aa, Triticum aestivum
  Clone ID: PAT_TA_25795.pep
MAVPLLKKAIVKKRVKHFKRAHSDRYIGLKQSWRRPKGIDSRVRRKFKGCTLMPNIGYGSDKKTRHYLPNKFKKFVVHNVSELELLMMHNRTYCAEIAHNVSTQKRKAIVERAAQLDVVVTNKLARLRSQEDE

SEQ ID NO: 131378 - protein, 133 aa, Triticum aestivum; identical to SEQ ID NO: 131377
  Clone ID: PAT_TA_25796.pep

SEQ ID NO: 131379 - protein, 133 aa, Triticum aestivum
  Clone ID: PAT_TA_25797.pep
MAVPILKTAIVKKRVKHFKRAHSDRYIGLKQSWRRPKGIDSRVRRKFKGCTLMPNIGYGSNKKTRHYLPNKFKKFVVHNVSELELLMMHNRTYCAEIAHNVSTQKRKAIVERAAQLDVVVTNKLARLRSQEDE

SEQ ID NO: 131380 - protein, 405 aa, Triticum aestivum
  Clone ID: PAT_TA_25798.pep
VNHFVQEFKRKNKKDISGNPRALRRLRTACERAKRTLSSTAQTTIEIDSLYEGIDFYTTITRARFEELNMDLFRKCMEPVEKCLRDAKMDKSTVHDVVLVGGSTRIPRVQQLLQDFFNGKELCKNINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKDEIEKMVQEAEKYKSEDEEHKKKVESKNALENYAYNMRNTIKDDKIASKLAADDKKKIEDAIDQAIQWLDGNQLAEADEFDDKMKELEGLCNPIIAKMYQGAGADMAGGMDEDDAPPAAGGAGPKIEEVD

SEQ ID NO: 131381 - protein, 202 aa, Triticum aestivum
  Clone ID: PAT_TA_25799.pep
MAAMHESTPSLLVLFLSLMLFFTASSARHMTGDPPPVIPSPPPHMASPTMEEAWEGVMVAPRPVPSGPDPIHHRPHAPPPHRPPPSTGGGEGRCHGGHRGRFLLGPNPIHHFPAPAPQPHHHHRCHDLPPASTEEACEGDIVAPRPVPFGSHPIHNHPAPVPQPNQASSTQGPTACIFGGGEGRRQHVTKEATSCFRTKPKP

SEQ ID NO: 131382 - protein, 167 aa, Triticum aestivum
  Clone ID: PAT_TA_25800.pep
TLSWGNTSCSSIWISSDKRATTERFFSCGHPPEHKLLDQRAEECIRLARYAHRLQRDKIHTHYAFGGGPAHRSGPAGLGFGHGSGFRRASFPFGGEEGCSSRTVGCCYQHNRNEQLRRRRETTLAGSETYEPAPRLPTNRNSKLIGMYKHVLTSGRDLIWRGGRGVG

SEQ ID NO: 131383 - protein, 254 aa, Triticum aestivum
  Clone ID: PAT_TA_25801.pep
SAGRGVHTTRALCAPTPERQASHPCAHWSGPAHQSGPAGLGFGRGSGFGRASFPFGGSSNSSAAVRQKEMTKLYKIRSHAHIRALLARADELGRSHKFMLVNLVSLESVRMARESYALLCPLIMEAMFWSCGELDSLSVVAGLSLEIQKLEQDLLPQLMVHEAKLERGALEALVLMKNSAITLLHLSKCFKEALGVLLAKEDLVSDRVEQLSIMLKDTAVNVLEGKCNGVWLPGACPVAGPAGQPCVGDPGSFL

SEQ ID NO: 131384 - protein, 369 aa, Triticum aestivum
  Clone ID: PAT_TA_25802.pep
MVSATKLEGGYCFHSKNSPLDQPEGVKIHLYRLGIEQREHDALKSFAYAGQGSPSLLDTLILSQWENFAQKGHMGYDVTACELKVIEGQRDFVIQMNDKWNTFPLKKHDKFGHPFGCLKPNSARSYEELLLCIAEGENNEPEVVPSITPPNNGVLLIANAYPVEYGHIFLVPNATNQLSSFWDKRMFGLITKIASEVNSAAFRVFFDDGTSIVPKHMFFQACYFANPLPVESSSTVALYDGATRSGICVSEIVDYPLKALVFTSTNVNTLVDVVSEACLALHENNTVHSLMMSNNGRNVFLFPQVKNLVTGCCLSAWECCGYFVYHTKVDFDRASETGISNRMASFSFQDGDFEDLKKLCCAIADGLVT

SEQ ID NO: 131385 - protein, 133 aa, Triticum aestivum
  Clone ID: PAT_TA_25803.pep
MAVPLLTRKIVKKRVKHFKRAHSDRYIGLKTSWRRPKGIDSRVRRKFKGCTLMPNIGYGSDKKTRHYLPNKFKKFVVHNVSELELLMMHNRTYCAEIAHNVSTKKRKDIVERAAQLDIVVTNKLARLRSQEDE

SEQ ID NO: 131386 - protein, 133 aa, Triticum aestivum; identical to SEQ ID NO: 131343
  Clone ID: PAT_TA_25804.pep

SEQ ID NO: 131387 - protein, 352 aa, Triticum aestivum
  unsure (1)..(352): unsure at all Xaa locations
  Clone ID: PAT_TA_25805.pep
MSSRQDQREARAEADARRAADEIARARDERVMQAEMDARRAADEIARARADREHGALGGGAYAEHPSGGVGGILGSMQEGAKSLASAVGRTFGGAKDTAADKTYQAADATGNKLGEYKDYTAEKAKESNDSVAHKTSETAEATRNKLGEAKDYTVEKATEAKDTVAQKTSETAEATKNKLGEYKDXCAGKTQEAKDSTMQKAHQTKDAAAEKARQAKDVTQQKAGEYTDATKGTAQEARDRSMATTQTHDADRGQQGTGLFGALGNMTGAIKEKLTVGSGTQQHDAGGHGLRLGSEDERAVKERAAEKAASVYFEEKDRLAKERAAERVDKCVEKCVEGCVGSSCAHRKGKM

SEQ ID NO: 131388 - protein, 523 aa, Triticum aestivum
  Clone ID: PAT_TA_25806.pep
SMVLIKMREIAEAFLGTTVKNAVVTVPAYFNDSQRQATKDAGVIAGINVLRIINEPTAAAIAYGLDKKASSVGEKNVLIFDLGGGTFDVSLLTIEEGIFEVKATAGDTHLGGEDFDNRMVNHFVQEFKRKNKKDISGNPRALRRLRTSCERAKRTLSSTAQTTIEIDSLFEGIDFYSTITRARFEEMNMDLFRKCMEPVEKCLRDAKMDKSTVHDVVLVGGSTRIPRVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQEAEKYKSEDEEHKKKVESKNALENYSYNMRNTIKDEKIASKLPADDKKKIEDAIDAAIQWLDTNQLAEADEFEDKMKELEALCNPIIAKMYQGAGADMEGGMDDDTPAASGGAGPKIEEVD

SEQ ID NO: 131389 - protein, 444 aa, Triticum aestivum
  Clone ID: PAT_TA_25807.pep
RGRGRGTFDVSLLTIEEGIFEVKATAGDTHLGGEDFDNRMVNHFVQEFKRKNKKDISGNPRALRRLRTSCERAKRTLSSTAQTTIEIDSLFEGIDFYSTITRARFEEMNMDLFRKCMEPVEKCLRDAKMDKSTVHDVVLVGGSTRIPRVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQEAEKYKSEDEEHKKKVESKNALENYSYNMRNTIKDEKIASKLPADDKKKIEDAIDAAIQWLDTNQLAEADEFEDKMKELEALCNPIIAKMYQGAGADMEGGMDDDTPAASGGAGPKIEEVD

SEQ ID NO: 131390 - protein, 456 aa, Triticum aestivum
  unsure (1)..(456): unsure at all Xaa locations
  Clone ID: PAT_TA_25808.pep
VDQGTGTRCRNHETAAESAQRPGTSAEVEGIFEVKATAGDTHLGGEDFDNRMVNHFVQEFKRKNKKDISGDPRALRRLRTSCERAKRTLSSTAQTTIEIDSLFEGIDFYSTITRARFEEMNMDLFRKCMEPVEKCLRDAKMDKSTVHDVVLVGGSTRIPRVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMXQEAEKYKSEDEEHKKKVESKNALENYSYNMRNTIKDEKIASKLPADDKKKIEEAIDSAIQWLDTNQLAEADEFEDKMKELEALCNPIIAKMYQGAGADMEGGMDDDTPAASGGAGPKIEEVD

SEQ ID NO: 131391 - protein, 362 aa, Triticum aestivum
  Clone ID: PAT_TA_25809.pep
IIEIDSLFEGIDFYSTITRARFEEMNMDLFRKCMEPVEKCLRDAKMDKSTVHDVVLVGGSTRIPRVQQLLQDFFNGKELCKNINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKDEIEKMVQEAEKYKSEDEEHKKKVESKNALENYAYNMRNTIKDDKIASKLAADDKKKIEDAIDQAIQWLDGNQLAEADEFDDKMKELEGLCNPIIAKMYQGAGANMAGGMDEDDAPPAAGGAGPKIEEVD

SEQ ID NO: 131392 - protein, 133 aa, Triticum aestivum
  unsure (1)..(133): unsure at all Xaa locations
  Clone ID: PAT_TA_25810.pep
MAVPILKTAIVKKRVKHFKRAHSDRYIXLKQSWRRPKGIDSRVRRKFKGCTLMPNIGYGSNKKTRHYLPNKFKKFVVHNVSELELLMMHNRTYCAEIAHNVSTQKRKAIVERAAQLDVVVTNKLARLRSQEDE

SEQ ID NO: 131393 - protein, 649 aa, Triticum aestivum
  unsure (1)..(649): unsure at all Xaa locations
  Clone ID: PAT_TA_25811.pep
MAKGEGPAIGIDLGTTYSCVGVWQHDRVEIIANDQGNRTTPSYVAFTDTERLIGDAAKNQVAMNPTNTVFDAKRLIGRRFSDPSVQSDMKLWPFKVIPGPADKPMIVVNYKGEEKQFAAEEISSMVLIKMREIAEAFLGNSVKNAVVTVPAYFNDSQRQATKDAXGAIAGLNVLRIINEPTAAAIAYGLDKKATSTGEKNVLIFDLGGGTFDVSLLTIEEGIFEVKATAGDTHLGGEDFDNRMVNHFVQEFKRKHKKDITGNPRALRRLRTACERAKRTLSSTAQTTIEIDSLYEGVDFYTTITRARFEELNMDLFRKCMEPVEKCLRDAKMDKSTVHDVVLVGGSTRIPKVQQLLQDFFNGKELCKSINPDEAVAYGASVQAAILSGEGNEKVQDLLLLDVTPLSLGLETAGGVMTTLIPRNTTIPTKKEQVFSTYSDNQPGVLIQVYEGERARTKDNNLLGKFELSGIPPAPRGVPQITVCFDIDANGILNVSAEDKTTGQKNKITITNDKGRLSKEEIEKMVQEAERYKAEDEEHKKKVDAKNALENYAYNMRNTVKDDKIASKLGADDKKKVEDAIEGTISWLDANQLAEADEFEDKMKELEGICNPIIAKMYQGAAPDMGGGMGMDEDMPAGGGGAGPKIEEVD

SEQ ID NO: 131394 - protein, 684 aa, Triticum aestivum
  unsure (1)..(684): unsure at all Xaa locations
  Clone ID: PAT_TA_25812.pep
MAKGEGPAIGIDLGTTYSCVGVWQHDRVEIIANDQGNRTTPSYVAFTDTERLIGDAAKNQVAMNPTNTVFDAKRLIGRRFSDPSVQSDMKLWPFKVIPGPADKPMIVVNYKGEEKQFAAEEISSMVLIKMREIAEAFLGNSVKNAVVTVPAYFNDSQRQATKDAGAIAGLNVLRIINEPTAAAIAYGLDKKXTSTGEKNVLIFDLXGGGTFDVSLLTIEEGIFEVKATAGDTHLGGEDFDNXRMVNHFVQEFXASTKKDITGNPRALRRLRTACERAKRTLSSTAQTTIEIDSLYEGVDFYTTITRARFEELNMDLFRKCMEPVEKCLRDAKMDKSTVHDVVLVGGSTRIPKVQQLLQDFFNGKELCKSINPDEAVAYGASVQAAILSGEGNEKVQDLLLLDVTPLSLGLETAGGVMTTLIPRNTTIPTKKEQVFSTYSDNQPGVLIQVYEGERARTKDNNLLGKFELSGIPPAPRGVPQITVCFDIDANGILNVSAEDKTTGQKNKITITNDKGRLSKEEIEKMVQEAERYKAEDEEHKKKVDAKNALENYAYNMRNTVKDDKIASKLGADDKKKVEEAIEGTISWLDANQLAEADEFEDKMKELEGICNPIIAKMYQGAAPDMGGGMGMDEDMPAGAGGARPQDRGGGLSCSSNVCALLDGCSVSVSSGCRSVVSVVCRRVI

SEQ ID NO: 131395 - protein, 133 aa, Triticum aestivum; identical to SEQ ID NO: 131377
  Clone ID: PAT_TA_25813.pep

SEQ ID NO: 131396 - protein, 133 aa, Triticum aestivum
  Clone ID: PAT_TA_25814.pep
MAVPLLTKKIVKKRVKHFKRAHSDRYIGLKQSWRRPKGIDSRVRRKFKGCTLMPNIGYGSDKKTRHYLPNKFKKFVVHNVSELELLMMHNRTYCAEIAHNVSTKKRKDIVERAAQLDIVVTNKLARLRSQEDE

SEQ ID NO: 131397 - protein, 524 aa, Triticum aestivum
  Clone ID: PAT_TA_25815.pep
MSVRPSERADARRNRYKVTVDADEGRRRREDNMVEIRKNRREESLLKKRREGLQAQAPIPAAGVEKKLESLPAMVGGVYSEDNNLQLEATTQFRKLLSIERSPPIEEVIQSGVVPRFVQFLTREDFPQLQFEAAWALTNIASGTSENTKVVIDHGAVPIFVKLLASGSDDVREQAVWALGNVAGDSPKCRDLVLANGALMPLLAQLNEHAKLSMLRNATWTLSNFCRGKPQPAFDQTKPALPALARLIHSNDEEVLTDACWALSYLSDGTNDKIQSVIDAGVCPRLVELLLHPSPSVLIPALRTVGNIVTGDDSQTQCIIDHQALGCLLSLLTQNHKKSIKKEACWTVSNITAGNKDQIQAVITAGIIGPLVHLLQTAEFDIKKEAAWAISNATSGGSHDQIKYLVSEGCIKPLCDLLLCPDPRIVTVCLEGLENILKVGETDKNLGASGEGNVYAQMIDEAEGLEKIENLQSHDNNEIYEKAVKILEAYWMEEEDDAMGATMEAPTGVAFDFGQGGNPDLNLG

SEQ ID NO: 131398 - protein, 648 aa, Triticum aestivum
  Clone ID: PAT_TA_25816.pep
MAKGEGPAIGIDLGTTYSCVGVWQHDRVEIIANDQGNRTTPSYVAFTDTERLIGDAAKNQVAMNPTNTVFDAKRLIGRRFSDPSVQSDMKLWPFKVIPGPADKPMIVVNYKGEEKQFAAEEISSMVLIKMREIAEAFLGNSVKNAVVTVPAYFNDSQRQATKDAGAIAGLNVLRIINEPTAAAIAYGLDKKATSTGEKNVLIFDLGGGTFDVSLLTIEEGIFEVKATAGDTHLGGEDFDNRMVNHFVQEFKRKHKKDITGNPRALRRLRTACERAKRTLSSTAQTTIEIDSLYEGVDFYTTITRARFEELNMDLFRKCMEPVEKCLRDAKMDKSTVHDVVLVGGSTRIPKVQQLLQDFFNGKELCKSINPDEAVAYGASVQAAILSGEGNEKVQDLLLLDVTPLSLGLETAGGVMTTLIPRNTTIPTKKEQVFSTYSDNQPGVLIQVYEGERARTKDNNLLGKFELSGIPPAPRGVPQITVCFDIDANGILNVSAEDKTTGQKNKITITNDKGRLSKEEIEKMVQEAERYKAEDEEHKKKVDAKNALENYAYNMRNTVKDDKIASKLGADDKKKVEEAIEGTISWLDANQLAEADEFEDKMKELEGICNPIIAKMYQGAAPDMGGGMGMDEDMPAGGGGAGPKIEEVD

SEQ ID NO: 131399 - protein, 133 aa, Triticum aestivum; identical to SEQ ID NO: 131379
  Clone ID: PAT_TA_25817.pep

SEQ ID NO: 131400 - protein, 133 aa, Triticum aestivum; identical to SEQ ID NO: 131343
  Clone ID: PAT_TA_25818.pep

SEQ ID NO: 131401 - protein, 533 aa, Triticum aestivum
  unsure (1)..(533): unsure at all Xaa locations
  Clone ID: PAT_TA_25819.pep
KQFAAEEISSMVLIKMREIAEAFLGSTVKNAVVTVPAYFNDSQRQATKDAGVIAGINVLRIINEPTAAAIAYGLDKKASSVGEKNVLIFDLGGGTFDVSLLTIEEGIFEVKATAGDTHLGGEDFDNRMVNHFVLEFKRKNKKDISGNPRALRRLRTSCERAKRTLXPPLAQTTIEIDSLFEGIDFXSTITRARFEEMNMDLFRKCMEPVEKCLRDAKMDKSTVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQEAEKYKSEDEEHKKKVESKNALENYSYNMRNTIKDEKVASKLPADDKKKIEDAIDAAIQWLDTNQLAEADDFEDKMKELEALCNPIIAKMYQGAGADMEGGMDDDTPAASGGPGPKIEEVD

SEQ ID NO: 131402 - protein, 545 aa, Triticum aestivum
  Clone ID: PAT_TA_25820.pep
AKPMINVQYKGEEKQFAAEEISSMVLIKMREIAEAFLGTTVKNAVVTVPAYFNDSQRQATKDAGVIAGINVLRIINEPTAAAIAYGLDKKASSVGEKNVLIFDLGGGTFDVSLLTIEEGIFEVKATAGDTHLGGEDFDNRMVNHFVQEFKRKNKKDISGNPRALRRLRTSCERAKRTLSSTAQTTIEIDSLFEGIDFYSTITRARFEEMNMDLFRKCMEPVEKCLRDAKMDKSTVHDVVLVGGSTRIPRVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQEAEKYKSEDEEHKKKVESKNALENYSYNMRNTIKDEKIASKLPADDKKKIEDAIDAAIQWLDTNQLAEADEFEDKMKELEALCNPIIAKMYQGAGADMEGGMDDDTPAASGGAGPKIEEVD

SEQ ID NO: 131403 - protein, 517 aa, Triticum aestivum
  Clone ID: PAT_TA_25821.pep
MREIAEAFLCSTVKNAVVTVPAYFNDSQRQATKDAGVIAGINVLRIINEPTAAAIAYGLDKKASSVGEKNVLIFDLGGGTFDVSLLTIEEGIFEVKATAGDTHLGGEDFDNRMVNHFVQEFKRKNKKDISGNPRALRRLRTSCERAKRTLSSTAQTTIEIDSLFEGIDFYSTITRARFEEMNMDLFRKCMEPVEKCLRDAKMDKSTVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQEAEKYKSEDEEHKKKAESKNALENYSYNMRNTIKDEKIASKLPADDKKKIEDAIDAAIQWLDTNQLAEADEFEDKMKELEALCNPIIAKMYQGAGADMEGGMDDDTPAASGGPGPKIEEVD

SEQ ID NO: 131404 - protein, 648 aa, Triticum aestivum
  Clone ID: PAT_TA_25822.pep
MAPTKGEGPAIGIDLGTTYSCVGVWQHDRVEIIANDQGNRTTPSYVAFTDSERLIGDAAKNQVAMNPINTVFDAKRLIGRRFADAPVQSDIKMWPYKVIPGPADKPMIVVQYKGEDKQFSAEEISSMVLIKMREIAEAYLGVTIKNAVVTVPAYFNDSQRQATKDAGVIAGLNVMRIINEPTAAAIAYGLDKKATSVGEKNVLIFDLGGGTFDVSLLTIEEGIFEVKATAGDTHLGGEDFDNRMVNHFVQEFKRKHKKDISGNPRSLRRLRTSCERAKRTLSSTAQTTIEIDSLFEGVDFYSTITRARFEELNMDLFRKCMEPVEKCLRDAKMDKSTIHDVVLVGGSTRIPRVQQLLQDFFNGKELCKSINPDEAVAYGAAVQAAILSGEGNEKVQDLLLLDVTPLSLGLETAGGVMTVLITRNTTIPTKKEQVFSTYSDNQPGVLIQVFEGERTRTRDNNLLGKFELSGIPPAPRGVPQITVCFDIDANGILNVSAEDKTTGQKNKITITNDKGRLSKDDIEKMVQDAEKYKSEDEEHKKKVDAKNSLENYAYNMRNTIQDEKIASKLPADDKKKIEDAVDAAIQWLDANQLGEVDEFEDKMKELEGLCNPIIAKMYQGAGADMPGGMDEDAPAASGGAGPKIEEVD

SEQ ID NO: 131405 - protein, 648 aa, Triticum aestivum; identical to SEQ ID NO: 131404
  Clone ID: PAT_TA_25823.pep

SEQ ID NO: 131406 - protein, 110 aa, Triticum aestivum
  unsure (1)..(110): unsure at all Xaa locations
  Clone ID: PAT_TA_25824.pep
RGRGRGTKDADLWITQAPLINFPIVEMYLXPERVMRQFGLRQCIPPPFRPTLQTLHRISRRGRERENWEETHHEYIQEWEARRQRIFRETEQFDLSSYDEYLQWYLPGRP

SEQ ID NO: 131407 - protein, 69 aa, Triticum aestivum
  unsure (1)..(69): unsure at all Xaa locations
  Clone ID: PAT_TA_25825.pep
KHVNWPQLKIITRNLSFIPEFSNKQLLQGNSSXDKHLAKKQKHMLLNLICRDFTLFSKWGHPIFXQSNK

SEQ ID NO: 131408 - protein, 67 aa, Triticum aestivum
  unsure (1)..(67): unsure at all Xaa locations
  Clone ID: PAT_TA_25826.pep
PGLXIXXAPHCXPGGNWIWRRXARAGGGWHKIRFFGSPEWRFFRCPPGQEWSLVLVCSDEDMNCVRD

SEQ ID NO: 131409 - protein, 74 aa, Triticum aestivum
  Clone ID: PAT_TA_25827.pep
SVVAAEVQFRTRSTLVLLFLSIFSAVAEIPNKKHGLYIFMHIQTHSSHSFHSFVRRGHACLFESTVQQKVAAPL

SEQ ID NO: 131410 - protein, 158 aa, Triticum aestivum
  unsure (1)..(158): unsure at all Xaa locations
  Clone ID: PAT_TA_25828.pep
RGRGRGVAVNFTLXXHHTPDESVDVNNPRDGLLRMVKGLSPKVTTLVEQESHTNTTPFLMRFLETMDYYSAMFESIDANLPRDSKERISVEQHCLAKDIVNIIACEGKDRVERHELLGKWKSRLSMAGFKPYPLSSYVNSVIKKLLACYSDKYLPGRP

SEQ ID NO: 131411 - protein, 85 aa, Triticum aestivum
  Clone ID: PAT_TA_25829.pep
RLKVCQGGRGRGGPRSSWQRKGRGGQDRGQQRSRSGVKATSESGCRLMPGIYLVPCPQLFTCETCLSSDDQSPRKQQIGLRERCG

SEQ ID NO: 131412 - protein, 161 aa, Triticum aestivum
  Clone ID: PAT_TA_25830.pep
QALAKQGFSDLTGTDYSEGAIELARNLAARDGFTTIRRPPGQVLETKLDRKFKVITDKGTLDAIGLHPDGRAKRVMYWESISNLVEPGGLVVITSCNHTKDELLQEVEEFGMRKFGKEDADRGAGDSHQIFRYLDHVQTYPTIMFGGVEGSQVCTVAFQRA

SEQ ID NO: 131413 - protein, 70 aa, Triticum aestivum
  Clone ID: PAT_TA_25831.pep
NFSVCVGPDPFRRVPMIRSVVHKNTMLFMKKLSRYGFIITSILEIKVNGLCFEQLHFSGSNLSMVFVCKL

SEQ ID NO: 131414 - protein, 83 aa, Triticum aestivum
  unsure (1)..(83): unsure at all Xaa locations
  Clone ID: PAT_TA_25832.pep
ASKSNVHGSSFTVSVALGQAFFFFFFFFLVFFFFFFFFFCSSQKKHLFLAQKFYSPHPNIYWTGLFLPPXAVTXTTXNFNTTP

SEQ ID NO: 131415 - protein, 34 aa, Triticum aestivum
  unsure (1)..(34): unsure at all Xaa locations
  Clone ID: PAT_TA_25833.pep
MSNFVRYSSLVHHSMLSSVPCFRGLLLVPRPRPX

SEQ ID NO: 131416 - protein, 71 aa, Triticum aestivum
  Clone ID: PAT_TA_25834.pep
AWSRPRYCRRYSHTTSRKARVNNNPQRAAAGKPGRDNAPLPSRGVVVVSLSTIRHRTEGPLEPCTCPGGRS

SEQ ID NO: 131417 - protein, 95 aa, Triticum aestivum
  Clone ID: PAT_TA_25835.pep
ELCSKQLQSRNQQVLVHSVFQAPVCCFLITLIPKVFYSTSAPCSVQPHGFRVPEFVATISSETLPLRVSRPWPPASLRAPSTASRARKSNRSRAV

SEQ ID NO: 131418 - protein, 125 aa, Triticum aestivum
  Clone ID: PAT_TA_25836.pep
FERPPGQVANTVVCVLDNFDGNSMKVAELLFNNGFKEAYAIKGGLRGPDGWQAIQENYLPPSVHVFPREKKSKTLTHTDVSTEGTDDQPEGNGELLTSPSSTLVNTSNGTKHEEPNGSTSAATTL

SEQ ID NO: 131419 - protein, 84 aa, Triticum aestivum
  Clone ID: PAT_TA_25837.pep
SSGRPGRYPYITVKSRAHVAAKDGPKLGMTATLKKIYREEGVGGLYGGIGPKVTQSVITAAFLFAFKDALYDMTVKARRSVKKN

SEQ ID NO: 131420 - protein, 61 aa, Triticum aestivum
  Clone ID: PAT_TA_25838.pep
RAAARAGTSLGRRRSSSMPTSPLWSLIDALLVDVPIQKVRTSSLNYLFSRAANLFSDLCFY

SEQ ID NO: 131421 - protein, 121 aa, Triticum aestivum
  Clone ID: PAT_TA_25839.pep
KHADYGKFMILSLGTGTAKIEEKFEAAECGKWGTAGWAYKRGATPIIDSFSEASADLVDIQASVLFQTAKCLLKKQVCKHDVETGENEPDLERGSKKQELARFVRMLSQERQARKEAYKLV

SEQ ID NO: 131422 - protein, 102 aa, Triticum aestivum
  Clone ID: PAT_TA_25840.pep
SAGPPPRYLKRAAPMKQFLEMEIGITGGEEDGVNNEDVDNNSLYTQPEDIHNIYKTLAPISPYFSIAAGFGNVHGVYKPGNVKLRPELLQKHQKYLPRRPLE

SEQ ID NO: 131423 - protein, 106 aa, Triticum aestivum
  Clone ID: PAT_TA_25841.pep
RAAARAGFEKPFLECTSEFYATEGVKYLQQSDIPDYLRHAESRLQEEHDRCILYLEANTRKPLIATTEKQLLQRHTSAIIEKGFTVLMEANRVTDLSRMYLGRDHA

SEQ ID NO: 131424 - protein, 156 aa, Triticum aestivum
  unsure (1)..(156): unsure at all Xaa locations
  Clone ID: PAT_TA_25842.pep
XXEXXHXXXKGXXTDPGEAKRLKAIMLAAAELAAHXXRDLPASDHRGGECKNQAFCLIDKNGDGRISIEELTEVMEDLGAEGEDAMALMHLLDANSDGSLSFDEFESFQRQVELMRSLEDRDDHYTKILKDKLQTIDSAGLIHFYRKELGDKLLVS

SEQ ID NO: 131425 - protein, 187 aa, Triticum aestivum
  Clone ID: PAT_TA_25843.pep
VAVERPPGQVEEPETKGPLESLMIRNAGDGMSITTFGKRDQESGDADDANVASSFQLMSKNVEGFADEKYPAYKDRHKLATEREKAIKEKAEQARAQRFGGGYSSVLVPSPRAALPPKLAQIKEKKAPAVNSEPGEQSSDIPNNPLAVAQLKLAQIEKRAPRVPRPPPTASAAAASGATSTSAATTL

SEQ ID NO: 131426 - protein, 225 aa, Triticum aestivum
  unsure (1)..(225): unsure at all Xaa locations
  Clone ID: PAT_TA_25844.pep
NHVSKSIYAAFKITSPSSSGLLDEFLPNVCLAIWTTTPWTIPANAAVAVNPELSYAVVELQSVLESESTSGGKQQKLGSILSSGIEKPFIIVASDLVSVLESKWGVKLVIRKSFPGSVLEHCRYLHPVNGNECSVVIGGDYITTESGTGLVHTAPGHGQEDYLTGLKYGLPIVSPVDDEGNFTAEAGQFSGLSVXXAGNAAVVKYLDEHVSLIXXEPYKHKYXGL

SEQ ID NO: 131427 - protein, 112 aa, Triticum aestivum
  Clone ID: PAT_TA_25845.pep
RGRGRGVAELQSSLKGSKLVATLSCRGRDATLGVNLQQAALLNRAAFGRALDNAEAEKQWFQLGAEEVFYLYHGLKCISVSESKKLLSEGELWDHLCSASESFPEMYLPGRP

SEQ ID NO: 131428 - protein, 147 aa, Triticum aestivum
  Clone ID: PAT_TA_25846.pep
MILAVLFANSEGNILIERFHGVPAEERLHWRSFLVKLGAENLKGAKSEELLVASHKSVSIVYTMIGDVCLYIVGKDEYDELALSEVIFAVTSAVKDVCAKPPTERLFLDKYGRICLCLDEIVWQGLLENTEKDRVRRLIRLKPPVEP

SEQ ID NO: 131429 - protein, 192 aa, Triticum aestivum
  Clone ID: PAT_TA_25847.pep
MLSGRRALPILLAVFALLAAAVSVSARGGAERAPTLVFILAGQSNMGGRGGATVGNRWDGVVPPECAPSPRTLRLSPSLRWEEAREPLHAGVDAGNVVGVGPGMPFAHALLRSPACPRGAVVGLVPCAQGGTPIANWSRGTEMYERMVTRARVAGAGTGRVAALLWFQGEADTLRREDAPAYAGRMEAFVRD

SEQ ID NO: 131430 - protein, 130 aa, Triticum aestivum
  Clone ID: PAT_TA_25848.pep
MASSPSSLLHGVAILALICCSLSCSAAAGDVVALDGRRNQWKPPPTPLPGKQHTPVSPVPTPATPVPGRPVTPNPPVSVPPPPSTPVRRYPVTPSPSTPICVPRPPPVQREVSALSPHRKTLQKAVKNVL

SEQ ID NO: 131431 - protein, 114 aa, Triticum aestivum
  Clone ID: PAT_TA_25849.pep
RAAARAGTTPINLFVLSILHLQCPKIKRPIIVCPSHPFHTQQQTNFQNVSKRDRRGLFLHASRSRFGIRPVCHWSGWARPVSFKVCHRSRRHQCRRCFVSECHNCSYVPRPRPR

SEQ ID NO: 131432 - protein, 198 aa, Triticum aestivum
  unsure (1)..(198): unsure at all Xaa locations
  Clone ID: PAT_TA_25850.pep
MVASGMNLLIAALGFGMTAAFVAFVCARFICCRARDADDGAPSPVDFDVDFPAHLERPVEDANCGLEPLVIAAIPIMKYSEALYSKDDAQCALRLGEYXETELLRIIPTCQHNFHRTCLDLWLQKQTTCPICRVSLKELPSGKAAIAPSCSNPQVRPRTENSVNPAPDWLLPVHHSHRGQQNSSDTQASVEVVIEIRQ

SEQ ID NO: 131433 - protein, 161 aa, Triticum aestivum
  Clone ID: PAT_TA_25851.pep
AAARAGTLEEHDSLKIELENKDAQNRAREDELLSLQKELRAMASKCIYCTEQIQIIFDGLLDLGYAVDLATGNSSIVSKVGQTLSVLKNEESGDYIKVVDTLVSSVNKLKSESQKLSDIKGLVITLIEELKMRLKQAESAAETASNDHQLYLERVPRPRPR

SEQ ID NO: 131434 - protein, 145 aa, Triticum aestivum
  Clone ID: PAT_TA_25852.pep
RPPGQVAAPRPGTHIKLWDWDQNWKCRQTFEAQSTVNQVAFNPKDANSFASASDDHTVKIWSIDSSEPKYTLSGHLGGVNCLNFFTSNDQQYLITGSDDKTAKVWDFLERFCAAAPTALMSPVISSISHPCLPFLITGTSAATTL

SEQ ID NO: 131435 - protein, 76 aa, Triticum aestivum
  Clone ID: PAT_TA_25853.pep
LHEGSLGSAQITEIQPLTQNVQLKNQSLRLSLLPPRHLNSKILLLRKQVCQKNLMMMKRPHLRHPLMRKCRGVLLN

SEQ ID NO: 131436 - protein, 71 aa, Triticum aestivum
  Clone ID: PAT_TA_25854.pep
SVVAAEVPVRRLRGLWTGRHWVAIRSIDGIWFNLDSDLPSAKQFQCKEKLIAFLDSVLSQGGELMIVLQDE

SEQ ID NO: 131437 - protein, 245 aa, Triticum aestivum
  Clone ID: PAT_TA_25855.pep
MPWMLEAAGPAPALMGLPSRVPRLVARTGSLRVFLLLGWRCRTVGPVVAFGLPVPRTSCMCASTGCPVRKHVERASHDPKSVITTYEGKHNHEVPAARNAIHEMSAPPMKNVVHQINSNMPSSIGGMMRACEVRNFSNQYSQAAETDNVSLDLGVGISPNHSDATNQMQSTGPDQMQYQMQSMASMYSNMRHPSMAVPTVQGNSAGRMYGSREDKGSEGFTFRATPMDHSANLCYSGAGNLVMGP

SEQ ID NO: 131438 - protein, 209 aa, Triticum aestivum
  Clone ID: PAT_TA_25856.pep
MDFDPVDALQLIFPGADPQLLRGYFEASGNVLDAAIRGFKDYLASGSAPTNAHAASSGVASDVPVMKMNNLRNGTEWAELIVKEMSAASDLIDAKNRAFRILELFDKSAADCNTPDEKQKMREEHKILKQMLGGLLHQNGVLKRAFLIQHNRLKDYQDMVQERSQFKEIVDKYQQQIKALEDRNYVLSLHLAQSDHRSGISGHRNPDIF

SEQ ID NO: 131439 - protein, 169 aa, Triticum aestivum
  Clone ID: PAT_TA_25857.pep
RAAARAGLFGETFKAFECLETLSIWSCPKINWERLVGLPPSLQYLNMIDFGQLSDHFLSCLEHLASLLKLNLSSESLTSIPIQQWSSLLRLDVWNCSKLTTVDFTPPSLPAVKVITIPNCEALLALPGKTFVEFCCLEELMIRECPNIDWRGLTFPISLRELYLGRDHA

SEQ ID NO: 131440 - protein, 2312 aa, Triticum aestivum
  unsure (1)..(2312): unsure at all Xaa locations
  Clone ID: PAT_TA_25858.pep
MGSTHLPIVGLNASTTPSLSTIRPVNSAGAAFQPSAPSRTSKKKSRRVQSLRDGGDGGVSDPNQSIRQGLAGIIDLPKEGRSARKFGSSCETVHPGYCQHXILTGITDLMELLGREVYCSHMQLGGPKIIATNVDXPSNNFIGACRCIXIYWGRSSMYLRTLEDLSVLNYVWSRLPDQMCRSLRICGSLVQTSVGLMXPREINVRLVGQIAVXSDVSSVCHGWGHASRNTELPDALNANGIVFLGPPSSSMNALGDKVGSALIAQAAGVPTLPWSGXQVASTVEVRLXSIPAEMSRXVCGSTTWEALSCXKMIGDXAKIKASWGGRGKGIRWVNNDDYVRTLFGQVPXEVPGSPIIIMRLAHRSPEETVXCLCILKLRCGLLNCMXCSVQRRHQKIIEDGPVTVAPRETVKELEQAARRLAKAVGYVGAATVEYLYSMETGEYYFLELNPRLQVEHPVTEWIAEVNLPAAQVAVGMGIPLWQVPEIRRFSQLLSGCCRLQSRIXTPRHRVFLCDERRWIPQGEHSLLRKSRKSLNDXMIPTHPEQNVQDVCYSCRTFVEGYHSGCDXAIADLTDPLFGXIFFAVFSLIRRQNLFFGRLRIVANXELELLVPLLRRLDMYXASGFRANMIKTGWLQNLLSSRVQASTLWWYVSVVGGAIYNRMTRNTDSVXAYVIYLVKGQIPPKHISLVHSTVSLNIEESKYTIETIRSGQGSYRLRMNGSVIEANVQTLCDGGLLMQLDGNSHVIYAEEEAGGTRLLIDGKTCLLQNDHDPSRLLAETPCKLLRFLVADGAHVEADVPYAEVEVMKMCMPLLSPAAGVINVLLSEGQPMQAGDLIARLDLDDPSAVKRAEPFNGSFPEMSLPIAASGQVHKRCATSLNAARMVLAGYDHPINKVVQDLVSCLDAPELPFLQWEELMSVLATRLPRLLKSELEGKYSEYKLNVGHGKSKDFPSKMLREIIEENLAHGSEKEIATNERLVEPLMSLLKSYEGGRESHAHFIVKSLFEDYLSVEELFSDGIQSDVIERLRQQHSKDLQKVVDIVLSHQGVRNKTKLILTLMEKLVYPNPAVYKDQLTRFSSLNHKRYYKLALKASELLEQTKLSELRTSIARSLSELEMFTEERTAISEIMGDLVTAPLPVEDALVSLFDCSDQTLQQRVIETYISRLYQPHLVKDSIQLKYQESGVIALWEFAEAHSEKRLGAMVIVKSLESVSAAIGAALKGTSRYASSEGNIMHIALLGADNQMHGTEDSGDNDQAQVRIDKLSATLEQNTVTADLRAAGVKVISCIVQRDGALMPMRHTFLLSDEKLCYEEEPVLRHVEPPLSALLELGKLKVKGYNEVKYTPSRDRQWNIYTLRNTENPKMLHRVFFRTLVRQPGASNKFTSGNISDVEVGGAEESLSFTSSSILRSLMTAIEELELHAIRTGHSHMFLCILKEQKLLDLVPVSGNKVVDIGQDEATACLLLKEMALQIHELVGARMHHLSVCQWEVKLKLDSDGPASGTWRVVTTNVTSHTCTVDIYREVEDTESQKLVYHSAPSSSGPLHGVALNTPYQPLSVIDLKRCSARNNRTTYCYDFPLAFETAVQKSWSNISSDTNRCYVKATELVFAHKNGSWGTPVIPMERPAGLNDIGMVAWILDMSTPEYPNGRQIVVIANDITFRAGSFGPREDAFFETVTNLACERKLPLIYLAANSGARIGIADEVKSCFRVGWSDDGSPERGFQYIYLTEEDHARISASVIAHKMQLDNGEIRWVIDSVVGKEDGLGVENIHGSAAIASAYSRAYEETFTLTFVTGRTVGIGAYLARLGIRCIQRTDQPIILTGFSALNKLLGREVYSSHMQLGGPKIMATNGVVHLTVSDDLEGVSNILRWLSYVPANIGGPLPITKSLDPPDRPVAYIPENTCDPRAAISGIDDSQGKWLGGMFDKDSFVETFEGWAKSVVTGRAKLGGIPVGVIAVETQTMMQLIPADPGQLDSHERSVPRAGQVWFPDSATKTAQAMLDFNREGLPLFILANWRGFSGGQRDLFEGILQAGSTIVENLRTYNQPAFVYIPKAAELRGGAWVVIDSKINPDRIEFYAERTAKGNVLEPQGLIEIKFRSEELQECMGRLDPELINLKAKLLGAKHENGSLSESESLQKSIEARKKQLLPLYTQIAVRFAELHDTSLRMAAKGVIKKVVDWKDSRSFFYKRLRRRISEDVLAKEIRGVSGKQFSHQSAIELIQKWYLASKGAETGSTEWDDDDAFVAWRENPENYQEYIKELRAQRVSQLLSDVADSSPDLEALPQGLSMLLEKMDPSRRAQFVEEVKKVLK

SEQ ID NO: 131441 - protein, 220 aa, Triticum aestivum
  unsure (1)..(220): unsure at all Xaa locations
  Clone ID: PAT_TA_25859.pep
FTLTFLLTSTXETLPTFVTERPIVLAETAAGLYRLSSHATAATMVFLPYLLAVALLYSSCVYFLVGLCASPAAFAVFVLVVWAVVLTANSFVLFISSFAPDYIAGMSLVSVSLAGFFLFSGYFLSRESTPVYWVFMHYASPYKYALDAMLANEYSCAANRCFGVAGAGEECSETGRDVLAARGLTAEERWTGVQVLFGFFLLYRVLYWVVLSRRASRAKR

SEQ ID NO: 131442 - protein, 84 aa, Triticum aestivum
  Clone ID: PAT_TA_25860.pep
SKRSIFVMPLTIHEYKNRQIDQKIARSSSVQVLQQEPAYINITVVRRGGRSHLSPLSAVTTGHHSNPFVINIYHYFRYNPCSCF

SEQ ID NO: 131443 - protein, 131 aa, Triticum aestivum
  Clone ID: PAT_TA_25861.pep
ADCVEPPATAGGAPLPHRPYRSPLPHRGVDNPAAQEAHTSPLHPRREYISLCASSPLPMYTAALSSLATAPICPAPSPVQSRGIWTVEFMPSSSPRPSAPISTIVAGLPFSSSFLVHDNPAHMLLPSATPK

SEQ ID NO: 131444 - protein, 431 aa, Triticum aestivum
  Clone ID: PAT_TA_25862.pep
MVAPAGGGSPSRWPSEEELDIVRKNVVEISGRDAREVRVVACPYRICPLGAHIDHQGGIVTAMTINYGVLLGFVPSDDAEVVLQSGQFKGVTRFRVDDLQKPIENRGNITWESYARGAVYALQNSGYDLRKGIIGYISGVNGLDSSGLSSSAAVGIAYLLALENVNDLVLSPVDNIQLDKSIENKYLGLENGILDPSAILLSRYGYLTFMDCKTASPSYVYFSELSKSQQPQGRPPFKILLAFSGLQHNLPKSRGYNMRVFECKEAARALLCASGSEDAPILRKVDPGVYEAQKCILDENLAKRAEHYFSEMKRVVKGREAWARGDLQELGQLISASGRSSIVNYECGSKEMIQLYEILLKAPGVLGARFSGAGFRGCCLAIVESDRAEEAAAYVGAEYERSQPELVSKIPADRRVLVCEPGDSAQVILQS

SEQ ID NO: 131445 - protein, 336 aa, Triticum aestivum
  unsure (1)..(336): unsure at all Xaa locations
  Clone ID: PAT_TA_25863.pep
MAKYLYGSFAISVCLTLSFVAATTREPFRPEPSRKTSEPSVSYSPQPQHFPNERLYQAYLVIQRFKSSISSDPKNITTTWXGHDICGRKTYLGFHCGRTPELAKNLTIMAVAFNDFGLSAPMLRGFIDQLPDLVPFHXSSNKFGGGIPPLGSLQYQYKLSIHDDRHDSFSESNVSXSGTNLGLGPVNIGVKLAVVKTPRKGTNLNSGRALLLNSNSLSGTLPANLGFSKLSYLALANNKLTGAIPPSIAHMQDSLLEMLLLNNQLSGCLPDELGMLTKTAVIDAGMNQLTGPIPSSFSCLSSVQQLNLARNRLYGQVPDALCKLAGPAGRLSNLTL

SEQ ID NO: 131446 - protein, 164 aa, Triticum aestivum
  unsure (1)..(164): unsure at all Xaa locations
  Clone ID: PAT_TA_25864.pep
NYECXNMKLLLKQQQRVLLGKSDVSGWGAFLKNTVSKHEYLGEYTGELISHKEADKRGKIYDRENSSFLFNLNNEFVLDAFRMGDKLKFANHSPDPNCYAKVIMVAGDHRVGIFAKERIGSGEEIFYDYRYEPDRAPVWARKPDAPGAKDPGQPSSGRAKKLAH

SEQ ID NO: 131447 - protein, 213 aa, Triticum aestivum
  Clone ID: PAT_TA_25865.pep
GTRKLVNFQNRDIELEAAQLMDWVGLGNILHTISTAAKFRDNTASCSIIDHLASKLMALTSTNCLPSIKKDTLDDMFFWDTRRRTMFYIHEIPKALNDNDFVTRVKNHAWPLPWDSKHFGLVKAMNDYREEVAVRDKHKGVNPGPEVLKQYHCNGQRPPRQVQCMSGAYTHQDKIEKDIKDDKDKRMSVDVAVQKEQPELCLALRRLLAGEAF

SEQ ID NO: 131448 - protein, 470 aa, Triticum aestivum
  Clone ID: PAT_TA_25866.pep
VRGNYAAAGTELADAYSSFAARAGSYPGNVGVPKQWYNLIADLPVKPPPMLHPGTHQPLNPSDLAPLFPDELIRQELTEERFIDIPDEVRDVYELWRPTPLIRAKRLEKLLGTPAKIYYKYEGTSPAGSHKGNTAVPQAWYNAAAGVKNVVTETGAGQWGSALSFASTLFGLNCEVWQVRASYDQKPYRRLMMETWGAKVHPSPSDVTEAGRRLLAADPSSPGSLGMAISEAVEVAATNADTKYCLGSVLNHVLLHQTVIGEECLEQLAAIGDTPDVVIGCTGGGSNFGGLAFPFMREKLAGRMNPQFRAVEPAACPTLTKGVYAYDYGDTAGLTPLMKMHTLGHDFVPDPIHAGGLRYHGMAPLISHVYELGFMEAMSIQQTECFEAALQFARTEGIIPAPEPTHAIAAAIREALECKRTGEEKVILIAMCGHGHFDLAAYDRYLRGDMIDLSHSSEKLKESLGAIPKV

SEQ ID NO: 131449 - protein, 221 aa, Triticum aestivum
  unsure (1)..(221): unsure at all Xaa locations
  Clone ID: PAT_TA_25867.pep
MATALRPPRLPAVPEQASSLHRLPKHRVAVTGRRSFAARAGSYPGNVGVPKQWYNLIADLPVKPPPMLHPGTHQPLNPSDLAPLFPDELIRQELTEERFIDIPDEVRDVYELWRPXPLIRGKRLEKLLXAPGKIYYKYEGLAGGSHKGTPRVRPRLRSCIAICTDGGHHPSAGADARDRGGDQGSAGVQEDRGGEGHPHCHVRPRPLRPRRLRPVPERRHD

SEQ ID NO: 131450 - protein, 553 aa, Triticum aestivum
  unsure (1)..(553): unsure at all Xaa locations
  Clone ID: PAT_TA_25868.pep
AYQNAPQTPHSPPPGPRRRPPRRLRRGGGPAPPGPGETSHASGNPVYIWPLPKNFTSGTQTLAVDPDLALDPQGAGAGAAXVAEAFERYRHLIFSPWAHAARPASAGYDVARLTVVVASADETLELGXVDESYTIYIARRRAAPNSIVGGATIEANTIYGAIRGLETFSQLCVFNYDTKNVEVRYAPWYIQDEPRFAFRGLMLDTSRHYLPVDVIKQVIDSMSFSKLNVLHWHIIDEQSTVEEIPSYPNYAKKFIFKIRAVHSVQDARYIVSYAKKRRIHVMAEIDVPGHAESWGNGYPKLWPSLSCTEPLDVSSNFTFEVITGILSDMRKIFPFGLFHLGGDEVYTGCWNLTPHVKQWLDERNMTTKDAYKYFVLKAQEIAIDLNWIPVNWEETFNSFGGSLNPRTVVHNWLGPGVCPKVVAKGLRCIMSNQGVWYLDHLDVPWEQVYTAEPLAGIDDAAQQKLVLGGEVCMWGETADTSDVQQTIWPRAAAAAERMWSQLEAISAQDLETTVLARLHYFRCLLNHRGIAAAPVTNFYARRPPIGPGSCFIQ

SEQ ID NO: 131451 - protein, 323 aa, Triticum aestivum
  Clone ID: PAT_TA_25869.pep
MFLMLTRMENLSILLLASRPEPFAPPLQLAQPGARAFLLARGSWPSSAMATAFSTKQPLRVATPTNKWRPRLPLIKMQYSSNKRASASISLPSSAEGVERNEPIVKMCGITSARDAEFAAKAGAKLIGMILWPKSKRSVQRSEAKEISRVAKSYGAEAVGVFVDDDEETILRVADSCNLQLIQLHGDSSRALVPALAKNNRIVYVLNADADGKLINSPPSEEYDIDWFLVDSAEGGSGKGFNWDNFRMPSVKSKNGWLLAGGLHADNVCQAASALKPNGVDVSSGICSPDGISKDPKRISSFMRSVQSLSSRRGLYLDAPGLL

SEQ ID NO: 131452 - protein, 100 aa, Triticum aestivum
  Clone ID: PAT_TA_25870.pep
DIDWFLVDSAEGGSGKGFNWDNFRMPSVKSKNGWLLAGGLHADNVCQAASALKPNGVDVSSGICSPDGISKDPKRISSFMRSVQSLSSRRGLYLDAPGLL

SEQ ID NO: 131453 - protein, 159 aa, Triticum aestivum
  unsure (1)..(159): unsure at all Xaa locations
  Clone ID: PAT_TA_25871.pep
SVVAAEVPGFTKSKQKLKTSTPYLKFPAASSSSLSQNYLITKIFSGSSSFLPTCITKTLVADGLGWRYSGEGRHSGKEEARAASRRPVRPGRPLAQDSHACRRQDLPGVGRWPXXSRAPPAAAAATTTQGAGEREQPPHGSDHDEKHSFNARFCIMCIG

SEQ ID NO: 131454 - protein, 195 aa, Triticum aestivum
  Clone ID: PAT_TA_25872.pep
PDANCFLHWRFKDRMLEVMIKAGHAIKKGDEMTIDYMSAVNSTLMQRYGFSSPTNPWEHINFSSPAKIHLDSFLSVFNIAGLHDELYHNVALTSGESTFVDGGVVAAARTLPTWSDGDLPAIPSVERKSAQALHEECRKMAESFSTTIQQDEEILDSDEPMRKTREIAIKYRLHRKLLLQKIIDSLEIYQDRILF

SEQ ID NO: 131455 - protein, 129 aa, Triticum aestivum
  unsure (1)..(129): unsure at all Xaa locations
  Clone ID: PAT_TA_25873.pep
ELDFPRVKFYTQEIVFFRQDLLYRMRRXCLIPPTTEETSDPFEHLVATITHQSHLCPLPLTVQPIIWNYDHCLRLYPTPDMIVLADKSEQKAFKYTGITCFNPGSFANDSTFAAYRPCTKEVELSALES

SEQ ID NO: 131456 - protein, 109 aa, Triticum aestivum
  Clone ID: PAT_TA_25874.pep
RGRGRGCLWKDVPNQSVPEQFGTMCQQTRFAFYATIPSFIFQLSLLGMAVYGLFAARPQTSSGGFGAEKEHEMGGIAGQGRQDSWDEESRKERGSPELDGRERVRMGKE

SEQ ID NO: 131457 - protein, 100 aa, Triticum aestivum
  Clone ID: PAT_TA_25875.pep
REDALAYAGRMEAFVRDVRRDLALPNLLVIQVGIATAQWQGNKQGKWLDLVRKQQRAVRVPNLKYVDAMGLPLANDITHLTTQAQVRLGKMLADAYIATL

SEQ ID NO: 131458 - protein, 121 aa, Triticum aestivum
  Clone ID: PAT_TA_25876.pep
CDSYFGGINYPVGGVGGIAVSLANGLVEKGSAIRYKANVTNVILENGKAVGVRLARGPGQVARTVISNATRWDTFGKLVKAEELPEEEKNFQKNYVKAPSFLSIHLGVKASVLPAGTSAAT

SEQ ID NO: 131459 - protein, 119 aa, Triticum aestivum
  Clone ID: PAT_TA_25877.pep
WLELELSPRLTKQFMQTRKPNAGPRRNSRSPLSISLHTHERSRHSKSRRPAGARASEGARGDLYADQNRRAGFLGVGEGILVSSRWVESLCASFLPSWLLGSGSGSVWDGALLPHASAD

SEQ ID NO: 131460 - protein, 140 aa, Triticum aestivum
  unsure (1)..(140): unsure at all Xaa locations
  Clone ID: PAT_TA_25878.pep
IRAIQIPIPIQVEVIVKKENPISVVVIVKGKNRAQQMANNNSSYGENVSRKSHTPSAIVIGGGFAGIAAANALRNASFEVVLLESRDRIGGRVHTDYSFGFPVDLGASWLHGVCEENXLAPIIGRRGLPLCRTRGDESVL

SEQ ID NO: 131461 - protein, 488 aa, Triticum aestivum
  unsure (1)..(488): unsure at all Xaa locations
  Clone ID: PAT_TA_25879.pep
SLRGENRAQQIANSNSTYGENASSICRTSSAIVIGGGFAGIAAGNALRNASFEVVLLESRDRIXFGFPVDLGASWLHGVCEENPLAPIIGRLGLPLYRTSGDDSVLFXLHDLESYALYDTVXGNQVPQEFVEKIGKVFEAILEETGKLREEMKEDISIAKAIAIVLERNPHLRQEGIAHDVLQWYLCRMEGWFATDADAISLQCWEPRVLLPGKSGLMVRGYRPVINTLAKGLDIRLGHRVVEIVRHWNRVEVTVSNGKTFVADAAVITVPLGVLKSNTIKFEPRLPEWKEEAIRELSVGVENKIVLHFSEVFWPNVEFLGVVSSTTYGCSYFLNLHKATGHAVLVYMPAGRLACDIEKMSDEAAAQFAFSQLKKILPNAAEPLNYLVSHWGSDENTLGSYTFDGVGKPRDLYEKLRIPVDNLFFAGEATSVQYTGTVHGAFSTGEMAAEECRMRVLEKFRELDMLEMCHPMAEQTATVSVPLLISRL

SEQ ID NO: 131462 - protein, 240 aa, Triticum aestivum
  Clone ID: PAT_TA_25880.pep
RAAARAGTRHISHTKQESSGSKSNKWKYLFGKKTKEDHASPRTEESKSFRKQKSMVISEKSDFRHLNAMTREETISYFKSEISKLKRAHELALQEKTEELFKLKREKGSLALQNDVEFEPLRKKIPQIIARMDQIMSKNIKAPTLHTTHDELDERCRLASKIDSLYYDNQHLRGLLADNMKDVKELSSQLSEASKDISLQLSSEQELLRQIEKSREEQEDLRIEGDVRDGLYRTWAGGRL

SEQ ID NO: 131463 - protein, 120 aa, Triticum aestivum
  Clone ID: PAT_TA_25881.pep
FNSQGAFRRFVYNTLPEPELVKATVQDCPLLSVKQPTNHDHYDKQHPTRNHAILILSASSKHSLTTSHQSTRTEAIHRSWIWTHSQHGLPTSTTTADTGAQDFPGLRILRLILCGEPRRR

SEQ ID NO: 131464 - protein, 77 aa, Triticum aestivum
  Clone ID: PAT_TA_25882.pep
SSGRPGRYVRPEISSSATLMDLAWPRPRAAIEIQVYHSSLLNEGLSVEEWLIEIQHVSIKDQLTDMFESFCFGIKFL

SEQ ID NO: 131465 - protein, 596 aa, Triticum aestivum
  unsure (1)..(596): unsure at all Xaa locations
  Clone ID: PAT_TA_25883.pep
MAQAWAFLLPVLVLGSYVTSLFFPSYISNPLCGGDGGRSLFLCAQAPKDQDPSPAVSTMYKTAFHFQPAKNWMNDPSGPMYFNGIYHEFYQYNLNGPIFGDIVWGHSVSTDLVNWIGLEPALVRDTPSDIDGCWTGSVTILPGGKPIIIYTGGDIDQHQAQNIAFPKNRSDPYLREWIKAPNNPVLRPDEPGMNSIEFRDPTTGWIGPDGLWRMAVGGELNGYSAALLYKSEDFLNWTKVDHPLYSHNGSNMWECPDFFAVLPGNXGLDLSAAIPQGAKHVLKMSMNCTVDVYMIGVYDLKRDAFVPDTVLNDSRLWPRIDYGNFYASKSFFDSKHGRRIIWAWTSETDSSSDDVAKGWAGIHTIPRTIWLAGDGKQLLQWPVEEIESLRTNEISHQGIELNKGDLFEIKEVDAFQADVEIDFELASIDDADPFDPSWLLDPEKHCGEAGASVPGGIGPFGLVILASDNMDEHTEVYFRVYKSQEKYMVLMCSDLRRSSLRPDLEKPAYGGFFEFDLEKERKISLRTLIDRSAVESFGGGGRVCITSRVYPAVLADVGRAHIYAFNNGSATVRVPQLSAWTMRKAQVNVEKGWSAI

SEQ ID NO: 131466 - protein, 677 aa, Triticum aestivum
  unsure (1)..(677): unsure at all Xaa locations
  Clone ID: PAT_TA_25884.pep
HGTSLGLPPRPPVPSTAPLQDWLAGLACLFSTGIVFHTLVRPWSNGGRVLFCPQSPKACSTLRQRYRTDYHFQPAKNWINDPCGSMYYNGXYHEFYQYNPNGSYNPNISYNIVWGHSVSMDLINWXSILEPAIXRHAPSDINWLLALAQSPFCQGEQVIQCFYSGLVTILSAYTPVIIYISHSCFETKPVRNIALPKNRSXIRPDGPGMNSSEFRDPTTGGNFEVGIWXEAERVQVSTDLSRSSLRAXLYTQVDGGFFEFDFEKERKISLRTLIDRSAVESFXAAVAGSASWLEFTRSRLSMTLARLPTGRPSTREVPRPRVPQLREWSMLXDKCVINVDDLLYXAFVPDTVVDEPRLWLRIDYGTFKILKSVFDANNNWMITLGLTRETYSXSDDHEKGLEGFHSIPRTIXXANNGRELLQWPVEETESLRTNEISHQGIELNKGDLFEIKEVDAFQADVEIGFELASIDDADPFDPSWLLDPEKHCGEAGASVPGGIGQFAFVIDAYPYKDXRFWSLSRIYEKRVHHMVLRSCPLWTSSFMALPXTRKPIAAALILSLKRQRRNHSGTLCDGLAVAYFDGGAQSIHPNPGVFQFDVHRQRKISLRTLINRSAVDSFRGGGRVCITSRVVPAELADVGRAHIYAFNNGSATVRVPQLSAWTMRKAQVNVEKGWSAI

SEQ ID NO: 131467 - protein, 55 aa, Triticum aestivum
  Clone ID: PAT_TA_25885.pep
CIASLVSYMSARIALPPPRPGPRRLGRPPGQVHQLAPLQSSGLNKISLPWLTVLT

SEQ ID NO: 131468 - protein, 105 aa, Triticum aestivum
  unsure (1)..(105): unsure at all Xaa locations
  Clone ID: PAT_TA_25886.pep
NDKKKNAKSKAKGSSVSFESLLTLVLRFVVSWFKKGIFFGLLFDCFHAPTPAKAHFTSCIRTKKSFTSSERSCRKGAEVACPWTGRPVEEEQDGKETSAATTLIX

SEQ ID NO: 131469 - protein, 138 aa, Triticum aestivum
  Clone ID: PAT_TA_25887.pep
RPPINLRLLDDERLRRPPAEQPRHERPSSPFCLYHELLFHDSRVWSGYSGQLCNSHGVLLSAKTSRPDIHLFSCIQTNQSQIQNLQHPACVCLLSLFTRKGGCQTSMMSDVVFAHFSLGRPHSSLSKAVSLVCCFHPT

SEQ ID NO: 131470 - protein, 110 aa, Triticum aestivum
  Clone ID: PAT_TA_25888.pep
AGPPPRYLVVKFTLRKKVNQKFRKNRQCRKLIRAAAAAAAAAAFGVPSDEDEDAIGEDLFVLAFGQNAFAFFDDAVEEEAGVGAEEVADLFQDLLEEKTYSEAEDGKSDK

SEQ ID NO: 131471 - protein, 205 aa, Triticum aestivum
  Clone ID: PAT_TA_25889.pep
KGNKSRSNFHSELIATYPEPVQPGAGQISFLLARSFFVELCTAVLALLARVRVLTQQMLLDVVSVYSKVTDLTDKKQAVKISIDKVPARGAARPSSNDPSTILECVWVKDKFVLHEKTKASSQKTQDEDLKSCTPDSSIQYETLGLVSEETENLDGANTPAKQQHASLADQPDKATHCGDAGDSQSGRQLPNDENTLRSLLGTPA

SEQ ID NO: 131472 - protein, 84 aa, Triticum aestivum
  Clone ID: PAT_TA_25890.pep
LAWSRPRYQPLAGSGVVPLIYAGVNGHLDKIPVNKILKWESDYLSHLRSNESELLSTIDKEGALSKDLEGKLKSSITSFISSFS

SEQ ID NO: 131473 - protein, 52 aa, Triticum aestivum
  Clone ID: PAT_TA_25891.pep
AWSRPRFHIEPGGIFLTFHGDFNLSIQLEYPLNFPSLCSYCFGVALHVTIEC

SEQ ID NO: 131474 - protein, 58 aa, Triticum aestivum
  Clone ID: PAT_TA_25892.pep
SCGQEHPYLWSMYMKYYNLYLRYAYEMNVSPVVAKEKQHPCLWISFVTHVCNLGRDHA

SEQ ID NO: 131475 - protein, 72 aa, Triticum aestivum
  Clone ID: PAT_TA_25893.pep
DAVHISSRPLELISPWPPPPRPALEWLLYLREVGTPGYTNIHYFSNSCFTTDGPEAWTARNAKYLPGRPARN

SEQ ID NO: 131476 - protein, 82 aa, Triticum aestivum
  unsure (1)..(82): unsure at all Xaa locations
  Clone ID: PAT_TA_25894.pep
GEXGPRSLXLFPGPPLGGRGGIXIXSVVAAEVHNGLQIRLRNGLVHWQLDPSFRGYQVDDRFFSLHDPGIRARKELVQAWES

SEQ ID NO: 131477 - protein, 45 aa, Triticum aestivum
  Clone ID: PAT_TA_25895.pep
RAAARAGTMSTSSWWLRLRNACVYHLLHSKQYIVLLVLLDIIYLS

SEQ ID NO: 131478 - protein, 216 aa, Triticum aestivum
  Clone ID: PAT_TA_25896.pep
MSKLQSDALREAITNIINDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKKVLCMGVAVGHLGMEEKQIFQNVQMSVNFLVSLLKKNWQNVRCLYLKSTMGKVYRLF

SEQ ID NO: 131479 - protein, 143 aa, Triticum aestivum
  unsure (1)..(143): unsure at all Xaa locations
  Clone ID: PAT_TA_25897.pep
GRVWRQGFESGDISREVYFDVXHALSIQDANGIKSYSYSGASREAQGLEVAITVGPRDLRLHLHPFFDTNVCGKKNPRSYYQIWQTLGVDSPSQILFLPDVYQDSTAARDAGLEVLISIRPGNAPLPEDHGFQTITSFAQIAT

SEQ ID NO: 131480 - protein, 119 aa, Triticum aestivum
  Clone ID: PAT_TA_25898.pep
MALLSILRSSPLAVPAASSRRPPNHGVYLLRVSTRAAPSSLSVRCEQSSKPGGGSVVDVWASRLAMMSFAAAVVAEVSTGKGFVENFGVATPAPALALVVTALVIGLAVLFIVRSGAQD

SEQ ID NO: 131481 - protein, 61 aa, Triticum aestivum
  Clone ID: PAT_TA_25899.pep
PQHHPFKPASIARPWKWPHLYHVVADFLLIHPNRRIFEHRNSRCCCLGSILLLMVPRPRPR

SEQ ID NO: 131482 - protein, 64 aa, Triticum aestivum
  unsure (1)..(64): unsure at all Xaa locations
  Clone ID: PAT_TA_25900.pep
RXXFFFFFFFFFLHWNKASSFFPVTPYMTPFLVYHQHDTAAYQNCNHQMCTTNSTSSSLVQATN

SEQ ID NO: 131483 - protein, 141 aa, Triticum aestivum
  Clone ID: PAT_TA_25901.pep
RAAARAGTVGSIPTLVEFKLYSGCLGPIIISSGFEELERLELKFSFSQLTFEVGAMPNLKKLDLHVYLSKFKSVGAGFDFGIQHLSSLASVSIVIFCEGVSAAYVEAAEGAFKSMVNGHPNPNRPILEMTRESADFMSQDE

SEQ ID NO: 131484 - protein, 118 aa, Triticum aestivum
  Clone ID: PAT_TA_25902.pep
SVVAAEVPLPPISSIGFDLVDLPDSVQFHFDQARAKPKKIAIADAPSKKAGYSNAVFDISIAIARGGFTSDGWKLLRSDLMFPFVYEDAVLHGGRIFALTNGGSVFVWQLSYLPGRPL

SEQ ID NO: 131485 - protein, 30 aa, Triticum aestivum
  unsure (1)..(30): unsure at all Xaa locations
  Clone ID: PAT_TA_25903.pep
WGFSFFFFFFFFFFFFFFFFFFXFCLLHST

SEQ ID NO: 131486 - protein, 268 aa, Triticum aestivum
  Clone ID: PAT_TA_25904.pep
RHEGVEYHPDAGIDINMPSSSGHRNIEMNDAFDLNDSNQAQQSACAQPAAGSDGREIGGSSTNEGEEVLNAGTTPAFARDQLSLGISGGSVGMGASDEAEIHGIDVSVQRTESGVGDAEPITDLTETMGHTGESVPGPGLMDEFVPEEVDREEPHGDSQDIVFRSAGRADSGSKYFGSNKADSGESGKKIGHAIGHESSMHPSLSCNAGVYAGFDASKEEVTQAGKAVTTDDQGLQYDLQNGLRATHGENDYEPGLPRFDPCKHHNSY

SEQ ID NO: 131487 - protein, 196 aa, Triticum aestivum
  Clone ID: PAT_TA_25905.pep
RGRGRGTILTQGFATSGLLTEMHQSTILVPALQSQWLMMHVSMMLLSYATLLCGSLLSAAILIIRFRNNFHFFSKKKKNVLNKTFLFSDIKYFYAKRSALKRTSVPSFPNYYKYQLTERLDSWSYRVISLGFTLLTVGILCGAVWANEAWGSYWNWDPKETWAFITWTIFAIYLHSRTNPNWKGTCPGGRSIPNFF

SEQ ID NO: 131488 - protein, 51 aa, Triticum aestivum
  Clone ID: PAT_TA_25906.pep
TVVTFKIHKIHVLVMHAPSFPKRLGTNKVRNPSQNSSQNSSQIQDLGRDHA

SEQ ID NO: 131489 - protein, 54 aa, Triticum aestivum
  Clone ID: PAT_TA_25907.pep
RHIYFLCPKKFVLDFSRCSLRIFMYIWSDQCITDSLSSIMRFAAAPRLRAQPQC

SEQ ID NO: 131490 - protein, 52 aa, Triticum aestivum
  Clone ID: PAT_TA_25908.pep
KFLIFAEIHENKIHILQCSKSANEDYSLSCQQSKVSTRQLLNCYRLEHKILR

SEQ ID NO: 131491 - protein, 69 aa, Triticum aestivum
  Clone ID: PAT_TA_25909.pep
ISSYLNLQHLNLYMFLFSKQRLYVCFKYKLFFFFFFFFLDTPHKLIMPNQNRNTQSSPFFLATKLQLLN

SEQ ID NO: 131492 - protein, 76 aa, Triticum aestivum
  unsure (1)..(76): unsure at all Xaa locations
  Clone ID: PAT_TA_25910.pep
ANLMQQTKXREAGCEDCCYVARLFDGWRYSELTWAIGPGCSNPYVPWFPACNRGLSSHWILLMCYYFLVSRLFSHK

SEQ ID NO: 131493 - protein, 112 aa, Triticum aestivum
  Clone ID: PAT_TA_25911.pep
ISSGRPGRYLPLKLKGPARHWLKSLPENSIGSWEELEDAFRANFQGTYVRPPDVDDLSHITQHPGESARKLWNRFLTKKNQIVDCPDAEALAAFKHSIRDEWLARHLGRDHA

SEQ ID NO: 131494 - protein, 80 aa, Triticum aestivum
  Clone ID: PAT_TA_25912.pep
RGRGRGTYSVLGRLWWYTRGLCRLTLVKICFICCIPLWPLCIQFGCNVLFDLWSLLRSSDVHLLIRCAHRGLDCERTYFC

SEQ ID NO: 131495 - protein, 262 aa, Triticum aestivum
  Clone ID: PAT_TA_25913.pep
IRRFKQKKTMSYFQATTCKPHTGLIADRPITGLGKTCRLLPVPQYSLRPRPLGFRKLDKHIYPRLVLVAASHPRLTPVCASSGKGNPEIDNDPFMDHLKKAMADAKKPRPLQDALKEKFAKLREQASGGGGGNGNRRGGNGGSGGPEDESFKESLDEVVQVILATVAFILVYIHIIRGEELYRLARDYTRYLVTGKRTARLKRSMQQWRSFSEKFMQNEGSQEERYERPAATEPMWWQQPQKFVHLMEELCRGNWRPHAQKS

SEQ ID NO: 131496 - protein, 144 aa, Triticum aestivum
  Clone ID: PAT_TA_25914.pep
MKPKSNVHCVTCGEDGHRAKSCPTRVFICYKCNEEGHISRKCPQNQSSEMKPKSNVHCVRCGEEGHRVKSCPTWVFTCYKCNEEGHTSQNCPQNQSSEMKPKSNVHCVSCGQEGHMAKSCPTRVFTCFKCNEEGHIAKNCPQKR

SEQ ID NO: 131497 - protein, 66 aa, Triticum aestivum
  Clone ID: PAT_TA_25915.pep
SSGRPGRCDIQTKLVTKDQTVAQFIAEFYGFDRDLLWVVAVVHVAFTVAFAFMFSFAIMRFNFQRR

SEQ ID NO: 131498 - protein, 45 aa, Triticum aestivum
  Clone ID: PAT_TA_25916.pep
KPRIQNAYYALTLKRRAEMHSCDSTWSKPSGVTSIYHLICLVSPN

SEQ ID NO: 131499 - protein, 101 aa, Triticum aestivum
  Clone ID: PAT_TA_25917.pep
RGRGRGTAGGAGDFVAMQVQRGVVAAEGKRVVVTETGWPYQGDANGNAVASIENQAIALASIKSKFTEDCILFSSLSDHWKVNTPATFMCEQYWGIYDHGN

SEQ ID NO: 131500 - protein, 59 aa, Triticum aestivum
  Clone ID: PAT_TA_25918.pep
AWSRPRYYINMLLNILLLPSIHINFITPFDTYYLLLKLIYLNVFLQFTDESMKTNEKLN

SEQ ID NO: 131501 - protein, 82 aa, Triticum aestivum
  Clone ID: PAT_TA_25919.pep
HQHHCSNVTYYPVMSVIIYLRCHVLCVNLLITLLLILLLHFDHLSHVHHDMNLLFVESWQWLIHGAFLSSLQWQPVGIILFS

SEQ ID NO: 131502 - protein, 255 aa, Triticum aestivum
  Clone ID: PAT_TA_25920.pep
MLPVLIAGASAPPRPFSPRRRRELPIRLSSSKPPRALQNSEGGSRPLGRAWPAVSAALFGSGFLLGPLLDGIHSRVGLQVYGNGALDLGPLHTHILVPPLLGAFYCTVGLLRLFLDERAAPRSKATGSPRDTATSLIVLALFIELSAEMYRAGVPSNVEAYVLLAVAEFVWLFLDSSWLGFALACLVGVACPLAEVPLVRLLECWSYPNADVQLFGTGLMSWTTTCYFVYTPFLANLARLLKSRLADDNTEGKEE

SEQ ID NO: 131503 - protein, 98 aa, Triticum aestivum
  Clone ID: PAT_TA_25921.pep
KELNCPAERERYLYGGIKTILIYILKKVIGDCRAYYWRKDPKLERSPRRKTLSKGPKNLFYDFYFLKKRTVLPFAFLLPSPRWIHILRRSCLTFAWLF

SEQ ID NO: 131504 - protein, 72 aa, Triticum aestivum
  Clone ID: PAT_TA_25922.pep
VYTYLLISNQSNGLRKINPNSGLFIIYSNGVTKKRQPTKEAEADADRDDRPKSGKDDSRIDVSSLLLLISVY

SEQ ID NO: 131505 - protein, 124 aa, Triticum aestivum
  Clone ID: PAT_TA_25923.pep
SVVAAEVSEETIRSSYIRLALKWHPDKKQGEEKATSRFQDINEAYQVLSNPVKRQEYDKKGVLYVQDQNAADYLNRHKGLILTCNGLGVRYLPGRPLFRGTRVCVYVLSWLMCVVVKSHLLHKV

SEQ ID NO: 131506 - protein, 268 aa, Triticum aestivum
  Clone ID: PAT_TA_25924.pep
ISTRSCRCRRRWPPPTTTARIPGSLHRSLTLADVHRDRPPDLAVRLSSKGRFAGFRRAVRCTSPPLVTHPPPSQWSSATTVAVSMRRDAEASAARAWRSPLLPRGAPCPAPPLPTFSQCGPPHRAATSPPDPSDLSCSGPAATAMSAAPWERIWPPVQQIWPAPGKSLLPTLQQHVALPRPPLTVEMEQAERRGHGHMASFTSSHPLATYNRARGVAMHFSAAQRPWKCSSKARVMRFSAPQTPLTSSPTSVWACGLPARCSVLHWFW

SEQ ID NO: 131507 - protein, 94 aa, Triticum aestivum
  Clone ID: PAT_TA_25925.pep
IRARAGTSRKLVCENGQEFGKRLRHRCFVVTARAQSFLYHQVRLMVGLLKAVGIGDLTTADVERILDAKTMTAAPPMAPAYGLYLDNVKYDPIV

SEQ ID NO: 131508 - protein, 93 aa, Triticum aestivum
  Clone ID: PAT_TA_25926.pep
RSKRARETKKDDAMEGSIVSQSVVVAVVADVVVAVAHPILLIEGVAVVHRLDLHHAPLAVHLLDRAEHHLVRRLAALLVEGLRPGGVPRPRPR

SEQ ID NO: 131509 - protein, 97 aa, Triticum aestivum
  Clone ID: PAT_TA_25927.pep
KMRQLPPHQTSKISSTACDLKYILSCPALEPLQQTTATENCFFPWKGCTKQTSYSVTVHPGSQHCPFHTSILGTPDLNVKITAAINISKQYLPGRPL

SEQ ID NO: 131510 - protein, 59 aa, Triticum aestivum
  Clone ID: PAT_TA_25928.pep
RAAARAGTKSPAGAHQWMAKTDDEIIPDAYDSTKKHKPTMLTSDLALRFDPEYLGRDHA

SEQ ID NO: 131511 - protein, 83 aa, Triticum aestivum
  Clone ID: PAT_TA_25929.pep
CGTSWCGWPNHSGELRRSAALRASACGCLLQVGGKDPLVDHAAGRHFRLKPLIQARDGWTPGSTHARPIWSGVLLTSIRGRRP

SEQ ID NO: 131512 - protein, 47 aa, Triticum aestivum
  Clone ID: PAT_TA_25930.pep
ALYDIKVKNNIYTKISYLGVIVDIVTSLKLQDLVPADASLPARAAAR

SEQ ID NO: 131513 - protein, 87 aa, Triticum aestivum
  Clone ID: PAT_TA_25931.pep
QVRHQRRAQCCTSTEAVLTVFILSPSMKSTVLHFLVAVPTVFITCIAWSVCVVGVFCGSTACCSWHLGRCLLLFVEQLFQYLGRDHA

SEQ ID NO: 131514 - protein, 145 aa, Triticum aestivum
  Clone ID: PAT_TA_25932.pep
RGNSIRAAARAGVARPPDLLQVLTTDDQGLHYDLQNGLGATNGENDYEPGLPDFDPVKHHNSCCPWVNGIVAAACCYDTSSSSGSPARGGRGLAVDALDAFQSLGQSQNQTMRSESAASLNMDDQAASNRKLARRTSVNKSHGKC

SEQ ID NO: 131515 - protein, 116 aa, Triticum aestivum
  unsure (1)..(116): unsure at all Xaa locations
  Clone ID: PAT_TA_25933.pep
IIKKEKEEQEKADKEFEDLENWDKGSFGKPVEDSELMLINKIKKQVKKSTTKGASSNDTFTLGASVHVLSGPFAGFTGXSLLEVNRKNKKVTVQMTLFGKESFVDLDFDQIEALNT

SEQ ID NO: 131516 - protein, 198 aa, Triticum aestivum
  Clone ID: PAT_TA_25934.pep
KKTEWTREEDEKLLHLAKLMPTQWRTIAPIVGRTPSQCLERYEKLLDAACAKDENYEPNDDPRKLRLERPPGQVESKPARPDPVDMDEDEKEMLFEARARLANTRGKKAKRKAREKQLEEARRLASLQKRRELKAAGIDNRHKKRKRKGIDYNAEIPFEKRPPPGFYDTVGEDRPLEHVQFPTTIEELEGRRRGRRGR

SEQ ID NO: 131517 - protein, 72 aa, Triticum aestivum
  Clone ID: PAT_TA_25935.pep
ERPPGQVAVRRDEITGVLRRGRQVHDSEIGVVVACLGILTAALIRLVTMLRRACVWHEIFGHYMNCFRAFSS

SEQ ID NO: 131518 - protein, 73 aa, Triticum aestivum
  Clone ID: PAT_TA_25936.pep
RAAARAGRAQSAGFLFVSREASHRSGVPRNQPKVSILVQRDQDRQDGGTEVITEPTAASRPEAFHRQRIILSG

SEQ ID NO: 131519 - protein, 111 aa, Triticum aestivum
  Clone ID: PAT_TA_25937.pep
KKIRAAARAGRKTIKVNTLHNTLHQSPTKQTNHHHGWLRILQERQLRLRSRQLQLLNATPRATNQRTTKGCHVNVRFIPRRPWLRANERRGWMMGDLARVEDMGLVGGGES

SEQ ID NO: 131520 - protein, 45 aa, Triticum aestivum
  Clone ID: PAT_TA_25938.pep
SGSLISYQIASHPAARHRHRSRRGRRRWSGRRSRRWPRTCPGGRS

SEQ ID NO: 131521 - protein, 138 aa, Triticum aestivum
  Clone ID: PAT_TA_25939.pep
LVSQRGQLSKHGAGNCNEESDTRIPAVIFTATLLVCSRKNLVHREKHLFGKLLRQYRSPVPASSQVASSIAILHFLFHKLMQTAKSTKDLPSIPTDIAPVFFSGFVRFREQMIQKTCRASARAYPACFSGSRVLCGSA

SEQ ID NO: 131522 - protein, 81 aa, Triticum aestivum
  Clone ID: PAT_TA_25940.pep
FKVPTVNQENGMLGTEPTETMLTFRSGEVLRPSHENKHKVYFGQNLVCKESVSAKGKGRVVKVGDPVYVLQTYPSCDEVPA

SEQ ID NO: 131523 - protein, 291 aa, Triticum aestivum
  unsure (1)..(291): unsure at all Xaa locations
  Clone ID: PAT_TA_25941.pep
SILQGVSVPQAPVTSTGFRWDRQWVVVNAKGRALTQRVEPKMALVETELPPAAFDEDWQPTPDSYLVIRAPGMDTLKVPLAAEHVTLDDVSVWEWSGSAYDEGAEAAEWXFSSYFGKPSRLVRFKEESEIRPTNPEYAQGYKLTFTDVFPFLIASQGSLDALNELLKEPVPINRFRPNILVDGCHPYSEDLWKTIKINKLTFDGVKLCDRCKVPTVNQENGILGTEPAETMLTFRSGEVIRPSHKNKHKVYFGQYLVCKEAVSAKGKGRIVKVGDPVHVLQTYPSSDEVPA

SEQ ID NO: 131524 - protein, 120 aa, Triticum aestivum
  unsure (1)..(120): unsure at all Xaa locations
  Clone ID: PAT_TA_25942.pep
MLFIESEIRPTNPEYAQGXLTFTDCFPFLIASQGSLNALNEVLKEPVPINRSRPNILVDGCHPHGXDMWKPIKINKLSFDRVKLCDRCKLAAMEKVRISTKNLLDDMMQQLGLPNAAYST

SEQ ID NO: 131525 - protein, 171 aa, Triticum aestivum
  unsure (1)..(171): unsure at all Xaa locations
  Clone ID: PAT_TA_25943.pep
RRVRKSEQLILSKFYATSSPFTDCLPFLIASQGSLDALNELLKEPVPINRFRPMILVDGCHPYAEDLWKTMKINKLTFDGVKLCDRCKVPTLNQEHGIPGGTAPTETMLTLADVPVRRPGQNEPQELXKVYFGQNLVCKESVSAKGKGRIVKVGDPVYVLQTHPCSDEVPA

SEQ ID NO: 131526 - protein, 111 aa, Triticum aestivum
  Clone ID: PAT_TA_25944.pep
SVCILLRLICEDETTHHLLYIALLLGTPRPRPRYEQERLSEHLEKIAGVAKRAIPPSCLHLLNPIHPLPLYRSPPYPHHSPLYRLHFLNLIHPRPLHHSPPCPNHASSSSC

SEQ ID NO: 131527 - protein, 66 aa, Triticum aestivum
  Clone ID: PAT_TA_25945.pep
SKRSYINLQREYVCVQICSCFPVYNWIHRMHPFPTIVVYPPIHWTAPGVGYFSGIIQRKYLPGRPL

SEQ ID NO: 131528 - protein, 185 aa, Triticum aestivum
  unsure (1)..(185): unsure at all Xaa locations
  Clone ID: PAT_TA_25946.pep
VTAGTSSVLAIDPKHLRXENEMRRIFGSKVVDSXENQRNMPGTSRQVRGVRRAGLNPRRTLLVSPPGFWPAWDKSMSMDLVETKGSLNYFRYVYDPSVSHVQELFEAAKSANDLNAIAAILAKYPYHPDSLLTFADLFKYSGEHQSSADAVEKCLFALECAWHPLFNPLQGNYQLKYSHDLNKPF

SEQ ID NO: 131529 - protein, 105 aa, Triticum aestivum
  Clone ID: PAT_TA_25947.pep
TNRSGMAGGDEGSLVPREVPGSYGMPFVSAIRDRLDFYYFQGQDKYFESRVDKYGSTVVRINVPPGPFMARDPRVVAVLDAKSFPVLFDVDKVEKKNLFTGTYMP

SEQ ID NO: 131530 - protein, 159 aa, Triticum aestivum
  Clone ID: PAT_TA_25948.pep
VREKMELTKSAVWEALRLDPPVKFQYGRAKADMNIESHDAVFAVKKGEMLFGYQPCATRDPRVFGPTAREFVGDRFVGEEPTRPPTRPYWSNGRETESPSVDNKQCPGKNLVVLVGRLLVVELFLRYDTFTADVGVDLLGTKVEFTGVTKATSGPDSAV

SEQ ID NO: 131531 - protein, 450 aa, Triticum aestivum
  unsure (1)..(450): unsure at all Xaa locations
  Clone ID: PAT_TA_25949.pep
MAGGDEGSLVPREVPGSYGMPFXSAIRDRLDFYYFQGQDQYFESRVERHGSTVVRTNVPPGPFIARDPRVVAVLAAXSFPVLFDVDKVEKKNLFTGTYLPSPSLTGGXFRVCSYLXPSEPTHAKVKQPLFSLLASRXDAFIPAFRSHFSSPPATVESPPALGGKSSSNTLTSAPSSPXSATPTFGVAPLLLTYVRTIGPGEPRQVAQILPPLLLRGESHALSKNFDAPLTHALDLPHILVLNGDEALHKLLYAAAAKRRGGPKVMVPGSLGRIAEPREEFHLRGWAGEVRTAPGDPGGNVRVEALENMELAKPTWSSGGAALRLDRPVKLQYGRAKPDMHMARRGAVLAVGRGAVLVGSERYASSDRRGFGSTAGEFVGDRFVGGEGRKLLQYVYWSNGRETEXSPSVDNKQCPGKNLVVLVGRLLVVELFXPVRHLHRRRRGRPAGHQG

SEQ ID NO: 131532 - protein, 122 aa, Triticum aestivum
  Clone ID: PAT_TA_25950.pep
KQTECGGAIISKLTNSRWPKGSFIESSDLWQREWFYITEPRGKKWVATPAFHYVPPLQLASWINKGPDWVSVDKVQTLQSRIRSLIEKDTGLINIIQVMLVRRVLPCQRRPLCMWEFNPEGP

SEQ ID NO: 131533 - protein, 62 aa, Triticum aestivum
  Clone ID: PAT_TA_25951.pep
AFFLVKSIVSTALFVLAMMGLIYLSFLAMNPKEASGSRLDEAMGNPSEDPVEEARRIMEKYK

SEQ ID NO: 131534 - protein, 67 aa, Triticum aestivum
  Clone ID: PAT_TA_25952.pep
GTPSPSGLSDLLCVPIINQSMRSIKISSRCSRNSRHVVALLYIKLLHQLPLPWCQLRWDSDVDVNIM

SEQ ID NO: 131535 - protein, 229 aa, Triticum aestivum
  unsure (1)..(229): unsure at all Xaa locations
  Clone ID: PAT_TA_25953.pep
MAALAASMATPTASAAKRASSAPPPRLSASPARPCAPSSASTGDATTPSLSASMALSSVLPSSAAPTPPAGXPRPRPKALPKREKQSVKKLNSSLKKYAPDSAPALAIQATSEKAKRRFEXNYGKFGLXSGSDGLPHLIVSGDPAATGRASSSPLGVLFPLHRQAWIXGWVGRSYLIAVSGEKKPAMREIIIDVELAARIIPRGFIWPVAAYRELINGDLVVDDADIGY

SEQ ID NO: 131536 - protein, 141 aa, Triticum aestivum
  Clone ID: PAT_TA_25954.pep
MASAKILARAGSSLLGRLLASPPPSLLRTGPPLPSLLHRIQPHVPPPPASVDAHDAEVVARLTSLPGEISFPCGLPSLRFLIDDGIDPVANEPLELLPKRTYQPSTIKRKRTHGFRARKSTTGGRKVIARRIAKGRHKISW

SEQ ID NO: 131537 - protein, 142 aa, Triticum aestivum
  Clone ID: PAT_TA_25955.pep
MAAPTGTSMLRALLQLPLAPFSGKSSAPSAVHMTARRAPTPVLAAKGYNVQIVVDENEGEDSIFRRFRREVMKAGLLQEIKRRRRHENTKDKKIRKAREAGRRNRRRRMMDDRRFPEDEGDSEAVRTRRDEDNDNWEVSGIL

SEQ ID NO: 131538 - protein, 194 aa, Triticum aestivum
  Clone ID: PAT_TA_25956.pep
AATVVINLRYHSIHIIPLTSKAVVVLGCRGFSQPLGLPHLLGPHEHPSYACGRCGGRPPPALRIVWSCVSSRRRLRLISLGGPAFVTSPREGRQMSSSPPLWSTMMCTSSSLSRPARTSARCGRSTGPPTARGGWSGERGQGQLAQGGQQGRAGRGGQHGSASRGGHAWGWRSTSWGRTVGALSLSSGFWMRRR

SEQ ID NO: 131539 - protein, 83 aa, Triticum aestivum
  Clone ID: PAT_TA_25957.pep
AWSRPRYDREFTLGDSSNAESKKEDEKDGWRCLNCASSSHALKDCPNPHDHVSISMAREQVKLKRKISKVIRQQNRPLKRRYL

SEQ ID NO: 131540 - protein, 199 aa, Triticum aestivum
  Clone ID: PAT_TA_25958.pep
SSSPLPLRLPHLAPGALARLIIGRRAASPLLARPFAAKARAPQRAPEPEPLSEEDDDFTSGGEAAPIPTEGISKPLAGILKELGKRVPESLLKIRLEDNGFALKYIPWHLANKILNMHAPEWSGEVRNIVYSSDGKSVSVVYRVTLYGTDAEIYREATGTASVEEKGFGDPVQKAEGMAFRRACARLGLGLHLYHEDMS

SEQ ID NO: 131541 - protein, 150 aa, Triticum aestivum
  Clone ID: PAT_TA_25959.pep
QEAGTVDKRAATGGEEELQGGEQLLVVEMTPSGAATHGYFCWNRGSKKATSNTAGDEDDDLRCCIQRVVCWNRPTKKLHPHRPVLEFDDQASRFAGTGLLFCYNRQIFCCFGKVFHCDSLRRSILAGTGDVFCWNCIPFLLLPVTVPFCC

SEQ ID NO: 131542 - protein, 56 aa, Triticum aestivum
  Clone ID: PAT_TA_25960.pep
SCPCYCKSDRRRRLLLSVPSPSFEFASAMGKEKTHINIVVIGHVDSGKSTTTGHLI

SEQ ID NO: 131543 - protein, 84 aa, Triticum aestivum
  Clone ID: PAT_TA_25961.pep
IFPFLWNYHNTLAKTQCLCYHDSWALTLLFTLSPFSGAPPKIQTFLDLPNPHFLFKSFEFNSNEFEFKPCIRANFYFLGLSIFL

SEQ ID NO: 131544 - protein, 463 aa, Triticum aestivum
  unsure (1)..(463): unsure at all Xaa locations
  Clone ID: PAT_TA_25962.pep
MLRQMRWLTDREGRWELDVESPATMEGTARPVPGDPLPLGLSRGPRVTRTKQLDFFHRFMASPLVPSFSASRAGLSLHHAHLLHLAHNWSFTILEQLHVQQLVAVVKEKLSNRQEGVPWSNDLKRHLRDVISLGVGTELLITPDTALLLELYNINKGDRGKAIIHHKLPQQNITLAASWPGLFVDKQGVYWDVPLSLSPALASARPSSGLSYHLLLQQNSGEPKCFGGXETNDVPLALWAGLCAKAAISIKRSIDAWRKKEDKLKMVQPYDAFLSDPHVSFTGIVGAVASGSLGDCSKRITVPDEMRKSNAFRVFHERNKFAACADLFASVTFTAQHGNFQRLFLDLTRVSARLDISSGSLFLRGASRLAQDFFFSRRPDLETFCDVCPDVIVSLQQQIVGPFSFRVESSVAIDPRSQDHFVRVDDSVFAIDWALKVLGSAKATAWYSPKHQEAMVELRFFEV

SEQ ID NO: 131545 - protein, 84 aa, Triticum aestivum
  unsure (1)..(84): unsure at all Xaa locations
  Clone ID: PAT_TA_25963.pep
RPGGITKXQREPLGKIVAALATQLEANNQDLQDLETKKNATEFSIARLEEDNRRLHEAYNEEMRKLHRKARDNALRIFQDNENL

SEQ ID NO: 131546 - protein, 77 aa, Triticum aestivum
  Clone ID: PAT_TA_25964.pep
TGSKVLFLHRTSKQPYVSACPRPHTAQIRSDSECTLPKVFFFFFFFFFFLAKRYRFLFSRQHLRQTILICWYCSSIV

SEQ ID NO: 131547 - protein, 75 aa, Triticum aestivum
  Clone ID: PAT_TA_25965.pep
MILISNSLNMTQIDSAPDSLRTWDTQQGTQVAPCCLFAYDCNNILYHETHGVTYKYNRAFRYLYIGSERSVLSDK

SEQ ID NO: 131548 - protein, 113 aa, Triticum aestivum
  Clone ID: PAT_TA_25966.pep
LSVPLMLYLEGIKFSPSYLQSTGVNLQELCVKAAIAGTCFHFYQQVSYSLLARISPVTHSVANSVKRVVVIVSSVIFFRTPISPINALGTGLALLGVFLYSRFKKAKPKAKAA

SEQ ID NO: 131549 - protein, 139 aa, Triticum aestivum
  unsure (1)..(139): unsure at all Xaa locations
  Clone ID: PAT_TA_25967.pep
MATSIMASMALKSSPSPFSGQSQLQRIQPSARSSSFRVMSKKAKKVQTSQPFGPGGGLELKDGVDASGRLAKGKGVYQFASKYGANVDGXSPIYNPEEWSPSGDYYAGGKTWLLLWVATLAGILLGGALLVYNTSALAS

SEQ ID NO: 131550 - protein, 86 aa, Triticum aestivum
  Clone ID: PAT_TA_25968.pep
ERPPGQVQVYKCNHNMHAEPPILLSSLTVETREKGRKNHQPKTISHGELTSSENLCVPDPSPLPRNHRGKKRKRTKSFPANKTDTN

SEQ ID NO: 131551 - protein, 213 aa, Triticum aestivum
  Clone ID: PAT_TA_25969.pep
SSGRPGRYPGPQGPYYCAVGSDKSFGRDISDAHYRAYLAKADKVVGIQIRIFEKKGILQRNGPFPHVLEQILSCVQGEKLLPQIGVTDGAAAGNNRTIAVLATSLSSWYSDQIRERYSEHHTVYGTTVKVYQPSHEEYQKKKNRKHNMKALAEIYLLSMSDVLITSGFSTFGYVAHGLACLTPWIMYRPENHVVPEPPCGRAMSIEPCFHQAP

SEQ ID NO: 131552 - protein, 154 aa, Triticum aestivum
  Clone ID: PAT_TA_25970.pep
MLAIFQKQVAHAPQELNSPRGSTAKPKNPDEILRDFHAAHPSDAFSTSFGGGAALACVAAQPRNLAAAGYQRMFCGLDDIYCVFMGTLDNLSSLMRQYGLTGRSTNEALLVIEAYRTLRDRGPYPADQVVKDLSGSFAFVVFDNRGRSGSGAAV

SEQ ID NO: 131553 - protein, 106 aa, Triticum aestivum
  unsure (1)..(106): unsure at all Xaa locations
  Clone ID: PAT_TA_25971.pep
LGXGWGCNQNYKPLSDLTXPLVYRFISNWKLCRADRTVKELSSRAKQQRGHQLIALREERQGRSSCNATWFSNTGHPAARETTSIPPLLLVHGWASLHPIPACSWL

SEQ ID NO: 131554 - protein, 135 aa, Triticum aestivum
  unsure (1)..(135): unsure at all Xaa locations
  Clone ID: PAT_TA_25972.pep
GLLPEAKRASKLLVIFPVSXRKXLPLDGVHLRAIRCFDTVSLSQKLSLHRHALRPILLHVLMWDFGTDAPNRPQGAPCPTPQPSPAFAELLRQNSFSWVDQPPQPDGEPGMVQGRDTAGDASFRFHNFSLPNNWV

SEQ ID NO: 131555 - protein, 60 aa, Triticum aestivum
  Clone ID: PAT_TA_25973.pep
AWSRPRYRVVSKIDRRNLVMSTKLNEDTSIGLDYRNSHSDHRRQTNESPSHQINRRSVCT

SEQ ID NO: 131556 - protein, 97 aa, Triticum aestivum
  Clone ID: PAT_TA_25974.pep
SVVAAEVQVKTRKPKPAVSVSKNKYLQNSEIVHGVQLSWHLIRFLLRCSPIYTPEEWSPSGDVYVGGKTGLFLWAVTLAGILLGGALLVYNTSALAS

SEQ ID NO: 131557 - protein, 101 aa, Triticum aestivum
  Clone ID: PAT_TA_25975.pep
MGYQVVAAQLARLSGALGTSDHASVVSITLFVALLCACIVLGHLLEENRWLNESITALIIGLCTGVVILMTTKGKSSHVLVFSEDLFFIYLLPPIIFNAGF

SEQ ID NO: 131558 - protein, 200 aa, Triticum aestivum
  unsure (1)..(200): unsure at all Xaa locations
  Clone ID: PAT_TA_25976.pep
AHYKACLYAXXLKSVXTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 131559 - protein, 88 aa, Triticum aestivum
  unsure (1)..(88): unsure at all Xaa locations
  Clone ID: PAT_TA_25977.pep
MLAIFQKQVAHAPQELNSPRGSTAKPKNPDEILRDFHAAHPSDAFSTSFGXGAALACNRSLCVRRMFCGLDDIYCVFMGTLDNLSALM

SEQ ID NO: 131560 - protein, 38 aa, Triticum aestivum
  Clone ID: PAT_TA_25978.pep
YQVNKKLLDLSGIVTVFFCGIVMSHYTWHNMTERVTTK

SEQ ID NO: 131561 - protein, 144 aa, Triticum aestivum
  Clone ID: PAT_TA_25979.pep
MPRAGLSAGSSKVDVAIDLGNPLLNRTVDGFLKIGAVGACRVAAEDAFDCLQSGSVSKRKLEKTLEKMCKEGAYWGAVAGVYVGMEYGVERVRGEYDWKNALIGGIASGALISAASNNKGNKIAKDAITGGAIATAVEFINYLT

SEQ ID NO: 131562 - protein, 114 aa, Triticum aestivum
  Clone ID: PAT_TA_25980.pep
EGAAAAAKPGARARAERPSVQILVICDDRAVAKAGCGRSYAPFPPGTPGCMFHSEGGLKSFEHPMNRLRAFPRVDSEGVMCGANFKVDAFTKINSMPRVGSATNWAATWDDAAI

SEQ ID NO: 131563 - protein, 144 aa, Triticum aestivum
  Clone ID: PAT_TA_25981.pep
WKETMDSWGSKMISAIEVVAEMAAIGFGLSKDAFTSLMKVPVGCLLIQSGKQLEWLTGGECLAGMHEVVVTKRTLEAIELAKEQNRSLWRISSTLFSHIASDATLKPLGHFAEAPNAHSYPPICAGEYVEQELSAINLKGKVAL

SEQ ID NO: 131564 - protein, 40 aa, Triticum aestivum
  Clone ID: PAT_TA_25982.pep
HFSFLVTYTGKTGLFLWAITLAGILLGGALLVYNTSALAS

SEQ ID NO: 131565 - protein, 242 aa, Triticum aestivum
  Clone ID: PAT_TA_25983.pep
MEYVNPLTGFRVDGRRPNEMRQLKGEVGVVSRADGSALFEMGNTRVIAAVYGPREIQNRSQQQNRKEALVRCEYRMAEFSTGDRRRKPKGDRRSTEISLVIRQTMEASILTHLMPHSQIDIFVQVLQADGGTRSACINAATLALADAGIPMRDIVTSCSAGYLCSTPLLDLNYIEDSAGGADVTVGILAKMDKVTLLQMDAKLPMDTFETVMDLATEGCKAIATYIREVLLENTKQLECQRG

SEQ ID NO: 131566 - protein, 144 aa, Triticum aestivum
  Clone ID: PAT_TA_25984.pep
MPSAGLEAGSNKVDVAIDLGNPLLNRTVDGFLKIGAVGACRVVAEDAFDCIHRGDISKRQLEETLKKMCKEGAYWGAVAGVYVGMEYGVERARGDRDWKNALIGGIATGALVSAATNNKGSKIAQDAITGGAIATAVEFINYLT

SEQ ID NO: 131567 - protein, 427 aa, Triticum aestivum
  Clone ID: PAT_TA_25985.pep
MAQAVVPAMQCQVGARGRSAVPARQPAGRVWGVRRTARAASGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICDTYTPQGEPIPTNKRHMAAQIFSDPKVTSQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 131568 - protein, 163 aa, Triticum aestivum
  unsure (1)..(163): unsure at all Xaa locations
  Clone ID: PAT_TA_25986.pep
MPSAGVSAGSNKVDVAIDLGNPLLNRTVDGFLKIGAVGACRVVAEDAFDCIHRGDISKRQLEETLKKMCKEGAYWGAVAGVYVGMEYGVERARGDRDWKNALLGGIATGXALVSAATNNKGNKIAQDAITGGAIATAVEFINYLHLGVRPSIFAATFLSGKTE

SEQ ID NO: 131569 - protein, 192 aa, Triticum aestivum
  unsure (1)..(192): unsure at all Xaa locations
  Clone ID: PAT_TA_25987.pep
MLAIFQKQVAHAPQELNSPRGSTAKPRNPDEILRDFHAAHPADAFSTSFGGGAALACVAAQPRSLAAGGYQRMFCGLDDIYCVFMGTLDNLSSLMRQYGLTGRSTNEALLVIEAYRTLRDRGPYPADQVVKDLSGSFAFVVFDNRGRSGSGAAVFAAXSTDGGVPLHXGVAADGSVVICDDRGVAKAGCGRS

SEQ ID NO: 131570 - protein, 144 aa, Triticum aestivum
  Clone ID: PAT_TA_25988.pep
MPRAGLSAGSNKLDIAIDLGNPLLNRTVDGLLKIGAVGACRVAAEDAFDCLQSGSVSKRKLEQTLKKMCKEGAYWGAVAGVYVGMEYGVERVRGQYDWKNALIGGITSGALISAVSNNKGNKIAQDAITGGAIATAVEFINYLT

SEQ ID NO: 131571 - protein, 242 aa, Triticum aestivum
  unsure (1)..(242): unsure at all Xaa locations
  Clone ID: PAT_TA_25989.pep
MEYVNPLTGFRVDGRRPNEMRQLKGEVGVVSRADGSALFEMGNTRVIAAVYGPREIQNRSQQQNSKEALVRCEYRMAEFSTGDRRRKPKGDRRSTEISLVIRQTMEASILTHLMPHSQIDIFVQVLQADGGTXSACINAATLALADAGIPMRDIVTSCSAGYLCSTPLLDLNYIEDSAGGADVTVGILAKMDKVTLLQMDAKLPMDTFETVMDLASEGCKAIATYIREVLLENTKQLECQRG

SEQ ID NO: 131572 - protein, 119 aa, Triticum aestivum
  unsure (1)..(119): unsure at all Xaa locations
  Clone ID: PAT_TA_25990.pep
TLRMREDGGFDVIKKXILNLSLRHDLXIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 131573 - protein, 128 aa, Triticum aestivum
  unsure (1)..(128): unsure at all Xaa locations
  Clone ID: PAT_TA_25991.pep
MLAIFQKQVAHAPQELNSPRGSTAKPKNPDEILRDFHAAHPSDAFSTSFXAGAALACVAAQPRNLAAAGYQRMFCGLDDIYCVFMGTLDNLSALMRQYGLTGRSTXEALLVIEXYRTCATGPYPADKW

SEQ ID NO: 131574 - protein, 362 aa, Triticum aestivum
  unsure (1)..(362): unsure at all Xaa locations
  Clone ID: PAT_TA_25992.pep
MDLPVVDLAPFLQAAAGDAAAAPAEAEEALRALCATVSASLRDTGALLVKDPRCTAADNDRFLDVVERYFARSDDSKRLQERPHLHYQVGVTPEGVEVPRSLVDKXMQDTIKSMPEEFQPATPKGPDPKWRYMWRVGPRPSNTRFKELNAEPVIPDGLPEWKETMDSWGSKMISAIEVVAEMAAIGFGLSKDAFTSLMKEGPHLLAPTGSNLMRHGFEGTXFAGFHYDLNFLTIHGRSRFPGLNIWLSNGKKMEVKVPVGCLLIQSGKQLEWLTGGECLAGMHEVVVTKRTLEAIELAKEQNRSLWRISSTLFSHIASDATLKPLGHFXAETPNAHSYPPICAGEYVEQELSAINLKGKVAL

SEQ ID NO: 131575 - protein, 238 aa, Triticum aestivum
  Clone ID: PAT_TA_25993.pep
RKAIVDATRIILQQCERSKTVRRVIHTASVTAASPLKEDGDGYKDAMNESCWSPLHLSYGYSNVHLDAYVSSKRLSEEELLRYNESEGRAFEVVTLACGLVGGDTIQPILWSSIPVVVAPLTGNEIHHNSLKFMQALCGSVPLVHIDDVCEAHLFCMDQPSMAGRFLCAVGYPNMEDYVARFAAKYPEHKILLKKVAGEGVRVKGDSTKLVDLGFRFKYGVEETLDCSVECAKRMGEL

SEQ ID NO: 131576 - protein, 145 aa, Triticum aestivum
  unsure (1)..(145): unsure at all Xaa locations
  Clone ID: PAT_TA_25994.pep
MPSAGLEAGSNKVDVAVDLGNPLLNRTVDGFLKIGAVGACRVVAEDAFDCIHRGDISKRQLEETLKKMCKEGAYWGAVAGVYVGMEYGVERARGDRDWKNALIGGIATGALVSAATNNKGNKIAQDAITXGGAIATAVEFINYLT

SEQ ID NO: 131577 - protein, 538 aa, Triticum aestivum
  Clone ID: PAT_TA_25995.pep
MGYQVVAAQLARLSGALGTSDHASVVSITLFVALLCACIVLGHLLEENRWLNESITALIIGLCTGVVILMTTKGKSSHVLVFSEDLFFIYLLPPIIFNAGFQVKKKQFFRNFMAITLFGAVGTMMSFFTISLAAIAIFSRMNIGTLDVSDFLAIGAIFSATDSVCTLQVLNQDETPFLYSLVFGEGVVNDATSVVLFNALQNFDPNQIDAIVILKFLGNFCYLFVSSTFLGVFTGLLSAYVIKKLYIGRHSTDREVALVMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGAASDPASPKSLHSPLLTSQLGSDLEAPLPIVRPSSLRMLITKPTHTIHYYWRKFDDALMRPMFGGRGFVPYSPGSPTDPNVLVE

SEQ ID NO: 131578 - protein, 144 aa, Triticum aestivum
  Clone ID: PAT_TA_25996.pep
MPSAGLEAGSNKVDVAIDLGNPLLNRTVDGFLKIGAVGACRVVAEDAFDCIHRGDISKRQLEETLKKMCKEGAYWGAVAGVYVGMEYGVERARGDRDWKNALIGGIATGALVSAVSNNKGNKIAQDAITGGAIATAVEFINYLT

SEQ ID NO: 131579 - protein, 264 aa, Triticum aestivum
  unsure (1)..(264): unsure at all Xaa locations
  Clone ID: PAT_TA_25997.pep
MLAIFQKQVAHAPQELNSPRGSTAKPKNPDEILRDFHAAHPSDAFSTSFGGGAALACVAAQPRNLAAAGYQRMFCGLDDIYCVFMGTLDNLSALMRQYGLTGRSTNEALLVIEAYRTLRDRGPYPADQVVKDLSGSFAFVVFDNRGRSGSGAAVFAAQSTDGGVPLHWGVAADGSVVICDDRGVAKXGCGRSYAPFPPGCMFHSEGGLKSFEHPMNRLKALPRVDSEGVMCGANFKVDAFTKINSMPRVGSATNWAAAWDDAAI

SEQ ID NO: 131580 - protein, 58 aa, Triticum aestivum
  Clone ID: PAT_TA_25998.pep
ERPPGQVGYSPIYTPEEWSPSGDVYVGGKTGLFLWAVTLSGILLGGALLVYNTSALAS

SEQ ID NO: 131581 - protein, 244 aa, Triticum aestivum
  Clone ID: PAT_TA_25999.pep
HTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDTSYNRIKSLVTEELKQYFRPEFLNRLDEMIVFRQLTKLEVKEIADIMLKEVFDRLKAKEIDLQVTEKFRDRVVDEGYNPSYGARPLRRAIMRLLEDSLAEKMLAGEVKEGDSAIVDVDSDGKVVVLNSGGGIAEPLEPALSA

SEQ ID NO: 131582 - protein, 336 aa, Triticum aestivum
  unsure (1)..(336): unsure at all Xaa locations
  Clone ID: PAT_TA_26000.pep
MSRVCVTGAAGYIASWLVKKLLDRGCTVHGTVRNLGDEKKTELLRGLPGAAERLVLFEADIYDAASFEPAIQGCEFVFLVATPLQHNSGSSKYKDTTEATLDATRTILQQCERSKTVKRVIHTGSVVTASPLREDGDGYKEFVNESCWTPLGLSCDHSNEYMDAYVSSKTISEEELLKYNDDFFEGRAFDVVVLVCGLVGGDTILPYISDSLHVMLSPLTGIEIYHNSLKFLQALLGSVPLVHVDDVCEAHVFCMEKSSDVVGGRYLCTTAHTNMHDILEHYARMHPELEXSKMVGEGLRVQANTNKLVELGFKYKYGAEEVLDGSVDCGKRLGLL

SEQ ID NO: 131583 - protein, 53 aa, Triticum aestivum
  Clone ID: PAT_TA_26001.pep
ASGYSPIYTPEEWSPSGDVYVGGKTGLFLWAITLAGILLGGALLVYNTSALAS

SEQ ID NO: 131584 - protein, 277 aa, Triticum aestivum
  Clone ID: PAT_TA_26002.pep
GVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDTSYNRIKSLVTEELKQYFRPEFLNRLDEMIVFRQLTKLEVKEIADIMLKEVFDRLKAKEIDLQVTEKFRDRVVDEGYNPSYGARPLRRAIMRLLEDSLAEKMLAGEVKEGDSAIVDVDSDGKVVVLNSGGGIAEPLEPALSA

SEQ ID NO: 131585 - protein, 359 aa, Triticum aestivum
  Clone ID: PAT_TA_26003.pep
MDLPVVDLAPFLQAAAGDAAPAEAEEALRALCATVSASLRDTGALLVKDPRCTAADNDRFLDVVERYFARSDDSKRLQERPHLHYQVGVTPEGVEVPRSLVDKEMQDRIKSMPEEFQPATPKGPDPKWRYMWRVGPRPSNTRFKELNAEPVIPDGLPEWKETMDSWGAKMISAIEVVAEMAAIGFGLSKDAFTSLMKEGPHLLAPTGSNLMRHGSEGTVFAGFHYDLNFLTIHGRSRFPGLNIWLSNGKKMEVKVPVGCLLIQSGKQLEWLTGGECLAGMHEVVVTKRTLEAIELAKEQNRSLWRISSTLFSHIASDATLKPLGHFAEAPNAHSYPPICAGEYVEQELSAINLKGKVAL

SEQ ID NO: 131586 - protein, 164 aa, Triticum aestivum
  unsure (1)..(164): unsure at all Xaa locations
  Clone ID: PAT_TA_26004.pep
MLAIFQKQVAHAPQELNSPRGSTAKPKNPDEILRDFHAAHPSDAFSTSFXAGAALACGRRAAPQPPPPAGYQXRMFCGLDDIYCVFMGDAXDTLSALMRQYGLNGXRPTNEALLVIKAXRNLRERGPXPADKLVKDLSGSFASSLTTRRSVRAAFPGKHDARAL

SEQ ID NO: 131587 - protein, 243 aa, Triticum aestivum
  Clone ID: PAT_TA_26005.pep
MLAIFQKQVAHAPQELNSPRGSTAKPKNPDEILRDFHAAHPSDAFSAGYQRMFCGLDDIYCVFMGTLDNLSALMRQYGLTGRSTNEALLVIEAYRTLRDRGPYPADQVVKDLSGSFAFVVFDNRGRSGSGAAVFAAQSTDGGVPLHWGVAADGSVVICDDRGVAKAGCGRSYAPFPPGCMFHSEGGLKSFEHPMNRLKAFPRVDSEGVMCGANFKVDAFTKINSMPRVGSATNWAATWDDAAI

SEQ ID NO: 131588 - protein, 108 aa, Triticum aestivum
  Clone ID: PAT_TA_26006.pep
MSASVMASMVLTKPSPSPLLERAKLRGLRPSARPSLLIVASKKAKKVQTAQPYGPGGGVEFKEGVDASGRVAKGKGVYQFADKYGANVDGSVCFRGRFHIVYWPEYHL

SEQ ID NO: 131589 - protein, 144 aa, Triticum aestivum
  unsure (1)..(144): unsure at all Xaa locations
  Clone ID: PAT_TA_26007.pep
MPRAGLSAGSSKVDVAIDLGNPLLNRTVDGFLKIGAVGAFRVAAEDAFDCLQSGSVSXRKLEKTLEKMCKEGAYWGAVAGVYVGMEYGVERVRGEYDWKNALIGGIASGALISAASNNKGNKIAKDAITGGAIATAIEFINYLT

SEQ ID NO: 131590 - protein, 125 aa, Triticum aestivum
  unsure (1)..(125): unsure at all Xaa locations
  Clone ID: PAT_TA_26008.pep
TSELRVWAIGEPSLFIVASKKAKKVQTAQXPYGPCCWSGVQRKGVDASWKGXPKGKGVYPVFPTSIGANVDGYSPNIYXPEEWSPSGDVYVGGKTGLXFLWAITLAXEFLLGGALLVYNTSALAS

SEQ ID NO: 131591 - protein, 144 aa, Triticum aestivum
  Clone ID: PAT_TA_26009.pep
MPRAGLSAGSSKVDVAIDLGNPLLNRTVDGFLKIGAVGACRVAAEDAFDCLQSGSVSKHKLEKTLEKMCKEGAYWGAVAGVYVGMEYGVERVRGEYDWKNALIGGIASGALISAASNNKGNKIAKDAITGGAIATAIEFINYLT

SEQ ID NO: 131592 - protein, 634 aa, Triticum aestivum
  unsure (1)..(634): unsure at all Xaa locations
  Clone ID: PAT_TA_26010.pep
RRXKVTTPCLIGEPGVGKTAIAEGLAQRICNGDVPETIEGKKVITLDMGLLVAGTKYRGEFEERLKKLMEEIKQSDDIILFIDEVHTLIGAGAAEGAIDAANILKPALARGELQCIGATTLDEYRKHIEKDPALERRFQPVKVPEPTVEESIQILRGLRERYELHHKLQYTDDALVAAAQLSYQYISDRFLPDKAIDLIDEAGSRVRLRHAQLPDEAKELDKKLRQITKDKNEAVRGQDFEKAGELRDEEMELKAQITAIIDKSKEMVKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDTSYNRIKSLVTEELKQYFRPEFLNRLDEMIVFRQLTKLEVKEIADIMLKEVFDRLKAKEIDLQVTEKFRDRVVDEGYNPSYGARPLRRAIMRLLEDSLAEKMLAGEVKEGDSAIVDVDSDGKVVVLNSGGGIAEPLEPALSA

SEQ ID NO: 131593 - protein, 264 aa, Triticum aestivum
  Clone ID: PAT_TA_26011.pep
MLAIFQKQVAHAPQELNSPRGSTAKPKNPDEILRDFHAAHPSDAFSTSFGGGAALACVAAQPRNLAAGGYQRMFCGLDDIYCVFMGTLDNLSALMRQYGLTGRSTNEALLVIEAYRTLRDRGPYPADQVVKDLSGSFAFVVFDNRGRSGSGAAVFAAQSTDGGVPLHWGVAADGSVVICDDRAVAKAGCGRSYAPFPPGCMFHSEGGLKSFEHPMNRLKALPRVDSEGVMCGANFKVDAFTKINSMPRVGSATNWAATWDEAAI

SEQ ID NO: 131594 - protein, 430 aa, Triticum aestivum
  unsure (1)..(430): unsure at all Xaa locations
  Clone ID: PAT_TA_26012.pep
MAQAVVPAMQCQVGVRGRSAVPARQPAGRVWGVRRTARATSGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICDTYTPQGEPIPTNKRHMAAQIFSDPKVTSQVPWFGIEQEYTLMQRDVNWPLGWPVGGYPGPQXGPYYCAVGSDKSFGRDISDAHYKXACLYAGIEISGTNGEVMPGQWEYQVGPSVGIDAGDHIWASRYILERITEQAGVVLTLDPKPIQGDWNGAGCHTXNYSTLSMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 131595 - protein, 139 aa, Triticum aestivum
  Clone ID: PAT_TA_26013.pep
MSASVMASLVLKPSPSPLLERAKLRGARPSARPSLLIVASKKAKKVQTAQPYGPGGGVVFKEGVDASGRVAKGKGVYQFADKYGANVDGYSPIYTPEEWSPSGDVYVGGKTGLFLWAVTLAGILLGGALLVYNTSALAS

SEQ ID NO: 131596 - protein, 140 aa, Triticum aestivum
  Clone ID: PAT_TA_26014.pep
MSASVMASLVLLKPSPSPLLGRAKLRGVRPSARPSLLIVASKKAKKVQTAQPYGPGGGVVFKEGVDASGRAAKGKGVYQFADKYGANVDGYSPIYTPEEWSPSGDVYVGGKTGLFLWAVTLSGILLGGALLVYNTSALAS

SEQ ID NO: 131597 - protein, 359 aa, Triticum aestivum
  Clone ID: PAT_TA_26015.pep
MDLPVVDLAPFLQAAAGDAAPAEAEEALRALCATVSASLRDTGALLVKDPRCTAADNDRFLDVVERYFARSDDSKRLQERPHLHYQVGVTPEGVEVPRSLVDKEMQDRIKSMPEEFQPATPKGPDPKWRYMWRVGPRPSNTRFKELNAEPVIPDGLPEWKETMDSWGAKMISAIEVVAEMAAIGFGLSKDAFTSLMKEGPHLLAPTGSNLLRHGSEGTVFAGFHYDLNFLTIHGRSRFPGLNIWLRNGKKMEVKVPVGCLLIQSGKQLEWLTGGECLAGMHEVVVTKRTLEAIELAKEQNRSLWRISSTLFSHIASDATLKPLGHFAEAPNAHSYPPICAGEYVEQELSAINLKGKVAL

SEQ ID NO: 131598 - protein, 106 aa, Triticum aestivum
  Clone ID: PAT_TA_26016.pep
TEISASLKNARNMRLGKKARNLHTHSYNLQAVCSRATYLLNQSKEKKEDSTVPDPFHSLVDRSNACWFFQVYDYEHQFQQPSEGGILPVLLMCSACSAVLAALRSP

SEQ ID NO: 131599 - protein, 63 aa, Triticum aestivum
  Clone ID: PAT_TA_26017.pep
SCSRPPDPPCCGYKLVGAGGGGFALLLARSPGHAVDLRRALRDSAAGLDVTVYDWNVAVPLPR

SEQ ID NO: 131600 - protein, 61 aa, Triticum aestivum
  Clone ID: PAT_TA_26018.pep
VDWLKMEKHDCIKHLSSKQFRMSMSWGSLAIFQRTIFFQTFYIASRCLGDLIRYCFSIKKK

SEQ ID NO: 131601 - protein, 526 aa, Triticum aestivum
  unsure (1)..(526): unsure at all Xaa locations
  Clone ID: PAT_TA_26019.pep
MPPTPPPETDAEPEFAEVDPTGRYGRYTEVLGKGAFKTVYKAFDQLEGLEVAWNQIKVGDILRNNDDLERLRSEVRLLKTLKHKNIIKFYNSWLDKXKNNNINFITEVFTSXGTLRQYRIKHKKVDIRALKKWSRQILSGLVYLHGHDPPIIHRDLKCDNIFVNGNQGEVKIGDLGLATILDNARSAHSIIGNRFSTPEFMAPELYDEEYNELVDIYAFGMCLLELVTFEYPYCECSNAAQIYXGERPGSLAKIEDPEVKFFIEKCIAQASQRLSAEELLVDPFLLDVDDERIFYPVQSNTNASDAGGSSNPSANYRTASSVGSRGRTGSTGESHPSDSYIHGNRNRQAATSRMITVESQRKDLNTIFLKLRIADSTGHAQNIHFPFDIEADTSISVATEMVVQLDLTDQDVTAIAEMIDAEIQAHIPEWAFDESVDNQGDEGAHSETDDSESDNDETSGLRNEVDATNNGFTQEQLPSGRKYWSDSPRRDIEISQSVEDQQIYDNMPNGILKNDNVGGICERISS

SEQ ID NO: 131602 - protein, 142 aa, Triticum aestivum
  Clone ID: PAT_TA_26020.pep
YKHIHSKHHTLVVPYAFGALYNHPLEGLILDTIGGALSFLVAGMTPRTSIFFFSFATIKTVDDHCGLWLPGNILHMLFSNNSAYHDIHHQLYGNKYNFSQPFFVMWDKILGTYMPYTLEERKGGGLEARPVNLGLAAQSKSD

SEQ ID NO: 131603 - protein, 172 aa, Triticum aestivum
  Clone ID: PAT_TA_26021.pep
MSDPEHFARNYLPLEVRRALAKGKKVGGRLCLKVWTLPKGVRIPVSLNTSGLPIGENAIMLINFLGALARDAVLAPLTYVSWKTFPKENKDVMPRRVPLGAAVDPPRELSVLSSIRNKWKFWKCHLKLKHHDPHITEEERLADRDPRVPKEQWRALIAYWNTEKAKARSAAG

SEQ ID NO: 131604 - protein, 104 aa, Triticum aestivum
  Clone ID: PAT_TA_26022.pep
PKLASAFRHFFQWKDCCRYIWVSQPSPKHDMMLLVQDQWRFLKSTESFFLSAKSNPRIPSASQTMQTPSLQRNCSLVVHTSFFFVPLCIVDILSYMTVFELLLT

SEQ ID NO: 131605 - protein, 131 aa, Triticum aestivum
  Clone ID: PAT_TA_26023.pep
MSWQTYVDEQLLCDIDGQRLTAAAILGHDGAVWAQSEPFPEVKPEEITAVLNDFDEPGSLAPTGLFLGGTKYMVIQGEPGAVIRGKKGSGGVTIKKTSLAIIIGIYEEPMTPGQCNMVVERLGDYLLEQGF

SEQ ID NO: 131606 - protein, 91 aa, Triticum aestivum
  Clone ID: PAT_TA_26024.pep
MAAAGPAKTEVLSLFRAFLRTARQFSDYNIREYTRRRAADAFRENRALADAPAAAAAFADGKQQLEVAKRQVLVYSLYAPKAKSVVEMKIQ

SEQ ID NO: 131607 - protein, 92 aa, Triticum aestivum
  unsure (1)..(92): unsure at all Xaa locations
  Clone ID: PAT_TA_26025.pep
CKRLMXQALDPPVLLTMTPDELKAGLTPAEIASESEESRQLQMTEARCRRCTEKKVGILDIIHASRGDRYQVECISCGYTSFASRDDILRNG

SEQ ID NO: 131608 - protein, 102 aa, Triticum aestivum
  Clone ID: PAT_TA_26026.pep
MPDTRVAVDFSGGPGASSENQVATPATTTTEVVIPCKYIGFVCGANDSDLAEIKKISGAEITVHDPKPGDTNSTVIICGDPEQTKRAQSLIHAFIFCGLYQK

SEQ ID NO: 131609 - protein, 88 aa, Triticum aestivum
  unsure (1)..(88): unsure at all Xaa locations
  Clone ID: PAT_TA_26027.pep
ALGRRPAAMRXRRRLPRRAMGRAPHSXAATPRCRSPPASTDTATVLPMPTPGQEQRQDVGMGTLLQARAVPLVAPXPHGALLLSFLLG

SEQ ID NO: 131610 - protein, 220 aa, Triticum aestivum
  unsure (1)..(220): unsure at all Xaa locations
  Clone ID: PAT_TA_26028.pep
VREKAVSSEKVAVDDEKKETKQSLFESTIDTADKHVTLFEKIISIPQKGETFGKTITENAEVILKKLKVLKEKRIPRSITSSGVAGIYFFKEEMKEWTGMRVGESNGESNAVLNVGNGKVTANGFHNREWTLFPQPGXTLFPQRGXPCFLNRRRPCFLNRRRPCFLNRRRPCFLNRRRPCFLNRRRPCFLNRRRPCFLNRRRPCFPNRRRPWCDWSSGWR

SEQ ID NO: 131611 - protein, 266 aa, Triticum aestivum
  Clone ID: PAT_TA_26029.pep
MAWGAPARAQSSRVQALYDLCRRTFPSPSPSSAAAPAAPPPASAVRAISSLMDTISPADVGLRDDSLGDGGGGHGFFDSTFVKGAARAARWAQPITYLHVYECDAFSIGIFCLPTSAVIPLHDHPGMTVLSKILYGSMHVKSYDWVEPTVVASNRQVRLAKLHADDVLTAPCPTTVLYPQSGGNLHSFTSVASCAVLDVLAPPYAEDAGRICTYFNDYPFSSFSSGRAKTVDSPDNYAWIEAINSPVYINMRPGMYTGPTVQDCLS

SEQ ID NO: 131612 - protein, 204 aa, Triticum aestivum
  Clone ID: PAT_TA_26030.pep
SLVGAGHGAGKKQGGSRAGQEEEGSNPTHHPLLLPPPSTPPRARAAAMADSNPDSIKRYTPPVHRNRANNRRKAGDRAEKANYSYNNDGEKSHVPSLKNLPPIIHHDAFVSNAQNDYSHARLIPLEGCSASEASQLLSERWAAAMNMYNDPNDSPDKPVMYAGSGGSSWGQGHMKLPHQMNFLEDLRRAVDAQTGLAAALSTWN

SEQ ID NO: 131613 - protein, 169 aa, Triticum aestivum
  unsure (1)..(169): unsure at all Xaa locations
  Clone ID: PAT_TA_26031.pep
LPLRQDPGTGLLLPYAPRRXFSLSQRAHHHSMADPPPAPGHLAKFHAFAHCLTLASDSXGQRRGDKDRRVPDPVMERTRGAQRLDPSWSGGEGARLVDPRRGGSNDRAQVSSRGWQSTSWTAISSSEQAPSSKSTDLDRPDSDLFLAMPEMTGEEGGAERSGQKVEWAV

SEQ ID NO: 131614 - protein, 438 aa, Triticum aestivum
  unsure (1)..(438): unsure at all Xaa locations
  Clone ID: PAT_TA_26032.pep
PRLNERRIRGEDEALPETEAEPQKQRSNPEPDDKLATENEMSKGTHDNESSRDHTGIHQNDDTNHSNLPTNVDTADKSQQVAETKTVENSGTDASVSSRLEDLLDKSLGLGPAKGSGKSSLLASSLSSLGEDTDDLDVKKSIVREKPYVSKAERRKLKKGENACESTSRSSXKLSKSQITHSKKRAXDNTKAANPKTSRGQKGKLKKIKEKYAEQDEEEREIRMALLASSGKASQKDNPSQDGEDTTAKQSKPSTGEDDSLKVCYKCKKSGHLSRDCPDSTSAVDPTDVNVGRSRDGMDRSATPVDGSIVMDEDDINELGDEEKEKLIDLDYLTGIPVASDILLYAVPVCAPYNALQTYKYRVKITPGTAKKGKAAKTAMSLFMHIPDATNREKELMKACTDPELVAAIVGNAKITAPGLTQLKQKQKQKGKKAAKSN

SEQ ID NO: 131615 - protein, 327 aa, Triticum aestivum
  Clone ID: PAT_TA_26033.pep
MTGWGPRLPPPCPLHPLFPVLPQVALQSKSRGGASEHRDRRSSSERQDRRSSSERRDRRSSERKDRRSMERKDRSSSDLRDSGHDKEVTKSKGRGSASGDSSTSDRTSAEPSQKQLSDKQGEGKFQLVTGGAKKELPRTVTADEAAAIVMAATRGLGPANPQPNTLKDTVDIRHIQGSGAVSKPASNSEPGISVTSSDQLKKEGIGIIDDDWITNTIAKAVAVAASKEADSSEASMTNEQKLKAERLRRAKMFTSIIKGGGNKNDLVTQEISNESARAAPANSNLPVPPEPLASEREGSSVHFEREGSSLRFDRKVALCVSNGKVRI

SEQ ID NO: 131616 - protein, 114 aa, Triticum aestivum
  unsure (1)..(114): unsure at all Xaa locations
  Clone ID: PAT_TA_26034.pep
YANAAKKVLFFRLHQXKNCFHGFLGLPVVLEMEMPPCFTTTRYLFFLSFVLLLAVDAAGPSPQAPHPRHGLSGRSVCSESLRVLVLHLLLNQRADLCRRRGDITRTAASSSGLL

SEQ ID NO: 131617 - protein, 59 aa, Triticum aestivum
  Clone ID: PAT_TA_26035.pep
TRLWATLSVCMHACSNRSSPTRRSAEPPSIALAWPSLKQHHQERLTMNVGVHVYIDRPA

SEQ ID NO: 131618 - protein, 118 aa, Triticum aestivum
  unsure (1)..(118): unsure at all Xaa locations
  Clone ID: PAT_TA_26036.pep
MGTEVLRPHDCLSRVRHHAHAHAHAGSRRSPRPAARTRRGTARRAQAASPLPQEVRVKVSVSPATADAAYAGPAFGVMSPSPRALPLPRFSXXKTAAXXXVEDSATRELRRLLGLERA

SEQ ID NO: 131619 - protein, 168 aa, Triticum aestivum
  Clone ID: PAT_TA_26037.pep
MAVPAKCLLLFSLSAALLSLLGTGASAMGLPQPHVPVNFTIGVQGMVWCKTCRYIGYNANMDASPLKGVEVYLQCRHGPRRLKKLPGTSGQGGYFVIQSAHMASFTNDECKVYVESSASTACGLVDEPAAGEGLPLKFDSFVKHGDGLQALYSVGNIFFRPSNPNKCY

SEQ ID NO: 131620 - protein, 171 aa, Triticum aestivum
  Clone ID: PAT_TA_26038.pep
SSAAYLGTAATDTDPLSYLPDGFVERMNGTGLLVPLWAPQVEILNHVAMGGFMSHGGWNSTLETVAAGVPMVAWPLYAEQRMNAVMLSSDRVGLALWERPPLGKDGAVVPREEVAALVRELMEGEKGAAARKKAGHLRDEAEIASAPGGPQDRALAVVAGMVSLHRRSHGE

SEQ ID NO: 131621 - protein, 121 aa, Triticum aestivum
  Clone ID: PAT_TA_26039.pep
MEAAKERREQQERKAAGAGEGADSVQLPTETSPYVQYNKDDGLEDYKMRAYGAQGHLPVSDVPHGSGTDAPTIPGTALPTEHLNLHGRQQPQRGAQGGGAGVRRTDDDEAGTDAINRHGVP

SEQ ID NO: 131622 - protein, 202 aa, Triticum aestivum
  unsure (1)..(202): unsure at all Xaa locations
  Clone ID: PAT_TA_26040.pep
XXXXFFFFFFHDVFDSIFLDENYYIMLKRCFAMALLEYQLYSFFHTRTEHYVDNLLELARQPSHELRHAVAVDGVGGSLVVVGAANASASSLGTPLRLLAPVQVQVLSRERGAGDGGRVGAGAVGDVGDGEVALRAVGPHLVVLQAVVLFVLHVRARLRRQLHRVAALAGAGGLPLPPLLRRLHCSHADSSGFSGLDARSDE

SEQ ID NO: 131623 - protein, 165 aa, Triticum aestivum
  unsure (1)..(165): unsure at all Xaa locations
  Clone ID: PAT_TA_26041.pep
MAAAVQNEVVARQGREDEVHGVDEERPLLARPPAVRDDPAGDGLSPMQRAISQTYQSTAHLATLLPTGTVMAFQLLSPIVTDXGHCVRANRAMAAALVALCALSCFALSFTDSFRDAKGAVRYGFATRRGLWVIDGGAPLDPQAAAAYRLRFLDLVHAVVTVMVF

SEQ ID NO: 131624 - protein, 117 aa, Triticum aestivum
  Clone ID: PAT_TA_26042.pep
MEILQQGTMLMFPGMDLTKMDPPTLTLLGAACCVMLSMHFTVQLVSQHLFYWKNPKEQKAILIIVLMPPLYAITSFAGLLDIKGSKTFFTCLESVKECYEALVIAKLLALMYSYLNI

SEQ ID NO: 131625 - protein, 162 aa, Triticum aestivum
  Clone ID: PAT_TA_26043.pep
PRVRLVRQTDRQRPNLQISRRLRSEQPPFPPACRRKLQPAGTMSMFPGMDLTKMDAPTLTLLGAACCVMLSMHFTVQLVSQHLFYWKNAKEQKAILIIVLMPPLYAITSFVGLLDIKGSKAFFTCLESVKECYEALVIAKFLALMYSYLNISISKNIVPDEI

SEQ ID NO: 131626 - protein, 118 aa, Triticum aestivum
  Clone ID: PAT_TA_26044.pep
MAMRPLVVLALAVALAGVALGGGAAEGAGECGRSSPDRMALRMAPCISAADEPDSAPSSSCCSAVHTIGKSPSCLCAVMLSGTAKMAGIKPEVAITIPKRCNMADRPVGYKCGDYTLP

SEQ ID NO: 131627 - protein, 136 aa, Triticum aestivum
  unsure (1)..(136): unsure at all Xaa locations
  Clone ID: PAT_TA_26045.pep
RKPTDSAPXXYMCETNPCPSTKYSTMPGSRSISEERQSYLKRLGYPELHSSNFLDLDLLSSSGNSCDEEAFERSSIIHSPLDGISVGSTTTYSEPGHNDEGRDDTDLSRSSSQLSDSRDYSDRFAQWVANGGMLCY

SEQ ID NO: 131628 - protein, 171 aa, Triticum aestivum
  Clone ID: PAT_TA_26046.pep
MALTGRVATTAACILVLLALADAAGAATRAPAPAPAQDCTEALTSLADCLDYVLPDSKSARPTKACCTEVKTAVGTPATVKCLCAAMDAKTTPIPINMTRVLALPTACGQSASVLSKCHAAAPAEAPAPSASSGGATASPPKANAPARSPGGPATIILATVATSLLAFYYV

SEQ ID NO: 131629 - protein, 307 aa, Triticum aestivum
  Clone ID: PAT_TA_26047.pep
MEILQQGTMSMFPGMDLTKMDPPTLTLLGAACCVMLSMHFTVQLVSQHLFYWKNPKEQKAILIIVLMPPLYAITSFAGLLDIKGSKTFFTCLESVKECYEALVIAKFLALMYSYLNISISKNIVPDEIKGRVLHHSFPVSLFLPRNVRLEHKTLKLLKYWTWQFVVVRPVCSILIIALQLLGLYPSWVSWTFTIILNFSVSMALYALVIFYHLFAKELAPHKPLAKFLCIKGIVFFSFWQGCALDILAAVGVIQSHHFWLDVEHIQEAIQNILIILEMVIFSVLQQYAYHVAPYSGADKAKSVKKNE

SEQ ID NO: 131630 - protein, 175 aa, Triticum aestivum
  Clone ID: PAT_TA_26048.pep
MALTGGATTAACILVLLALADAAGAATRAPAPAPAPDCMEALISLADCLDYVTPSTKSARPSKACCTEVKTAVGTPATVKCLCAAMDAKTTPIPINMTRVLALPTACGQSASVLNKCHAAHGPGGAPAEAPSPSASSGGATASPPKANVAARSPGGSATVLLATVVTSLLAFYYL

SEQ ID NO: 131631 - protein, 158 aa, Triticum aestivum
  Clone ID: PAT_TA_26049.pep
CLVAPDVLELTDLLHCEITIASKPLDASSGQGSCDIKINDDFCAATMVPLLLQKGVLRTNCIDCLDRTNVAQFAYGLAALGRQLHVLKLTEEPKIDLHDPLADDLMDFYERMGDTLAIQYGGSAAHNKIFCEQRGQWKAATQSQEFLRTLQRFYKWLH

SEQ ID NO: 131632 - protein, 159 aa, Triticum aestivum
  unsure (1)..(159): unsure at all Xaa locations
  Clone ID: PAT_TA_26050.pep
MAAMNVSRAIGAALRTPASSPVAEAAAAAKAKDAEKLRFIDEMTCNVDSVQERVLAEILARNVDTEYLKNCGLDGAADRDAFRAKVPVVSYDALQPYIQRIVNGDRSPILSTHPVSEFLTSSGTXSAGERKLMPTIKDELDRRQLLYSLLMPVMNLYLS

SEQ ID NO: 131633 - protein, 65 aa, Triticum aestivum
  Clone ID: PAT_TA_26051.pep
KRTQLPAISSHQLTVHILVPYKNMITFHLIMPNAFSADEGQHNHKQKQFSLTTNTSETMTTCWRL

SEQ ID NO: 131634 - protein, 95 aa, Triticum aestivum
  Clone ID: PAT_TA_26052.pep
AGGHDPSDRTKGGASGIMKDVKATLLKKLEGLSTSHTDGQAKGIVNEAPAGVVKVGSVHIKLNVAGGSSSEIIGDGSLELKGAEHIEQGISTKLS

SEQ ID NO: 131635 - protein, 246 aa, Triticum aestivum
  unsure (1)..(246): unsure at all Xaa locations
  Clone ID: PAT_TA_26053.pep
HSLTDPMAMWHVRAEIAPAILLVVDFGGWYKLDSKSAGGNSSKMIQHTQVARRKDVIVPYTHLLPTLHLSENMDRPTLLYFKGAKHRHRGGLVREKLWDLMVNEPDVVMEEGFPNATGREQSIKGMRTSEFCLHPAGDTPSSCRLFDAIASLCIPVIVSDDIELPFEGMIDYTEFSIFVSVGNAMRPKWLTNYLXNISKQQXDEFRRNLAGVQHIXEYENTHQSSXSLPXXXXAVNHIWKXXXXKL

SEQ ID NO: 131636 - protein, 228 aa, Triticum aestivum
  Clone ID: PAT_TA_26054.pep
MEKAMETEAGRQSEVTCVDFWCNEFGMRVRIALREARRAFEYMEEDLRVRERSELVRRMNPVHRSIPILIHHGRPVCGSVNIVEYIDEVWGEETRLLPGDPADRADARFWADFIDHKVFSTQTKFFTSKGEEKEAAKEELVEHLKRLEEVLGDKCFFSGDEFGFLDVVFIPFSSMFYGYEQHGGIDLEAECPKLTRWEKRCRERESVSEVLPDGKVQYELHKKFYGIE

SEQ ID NO: 131637 - protein, 92 aa, Triticum aestivum
  unsure (1)..(92): unsure at all Xaa locations
  Clone ID: PAT_TA_26055.pep
LRGRCADDHHYTEDDEGRRHRRSHXRGSKRKHKDDSWFNEQTQGRPEASQNTPEHRQSLEQPPSDTAWIRQAAXRHSDELKASNWAMLLETL

SEQ ID NO: 131638 - protein, 45 aa, Triticum aestivum
  unsure (1)..(45): unsure at all Xaa locations
  Clone ID: PAT_TA_26056.pep
ISSPCPFTASPRMKFRVAQLSVIIPAIAAQYSRRLRRPVMNCREX

SEQ ID NO: 131639 - protein, 69 aa, Triticum aestivum
  Clone ID: PAT_TA_26057.pep
VPLHSLKLLATMQHVLCTSIENSPQTNPIVGRIDRKSGHGAGRPTKKLIDEAADRYSFMSKMLGATWTE

SEQ ID NO: 131640 - protein, 396 aa, Triticum aestivum
  unsure (1)..(396): unsure at all Xaa locations
  Clone ID: PAT_TA_26058.pep
RAEDGAGLESADAVNGNQLVVCYMSXDVKHTLQIRDLITGNLLHQLPLKIGSVSEISCRREDKEVFIGFTSFLSPGIIYRCNLASTIPEMKTFREISXVPGFDRTSFEVKQIFVPSKDGTKIPMFIMSKKDIELDGSHPTLLYGYGGFNISITPSFSVSRPVLCKNMGSVVCIANIRGGGEYGEEWHKAGALAKKQNCFDDFIACAEQLISSGYTSNKKICIEGGSNGGLLIAACINQRPDLFGCALAHVGVMDMLRFHKFTIGHAWTTDYGCSDKEEEFGWLIKYSPLHNVKRPWEQSFGDNCQYPATMLLTADHDDRVVPLHSLKLLATMQHVLCTXAFEXPARTANPIVGRIGLQVEGIRAGRLTKKLIDVAADPSSFMCLDDWARMCCACLN

SEQ ID NO: 131641 - protein, 78 aa, Triticum aestivum
  Clone ID: PAT_TA_26059.pep
SKQPMRLGSCTSTTLYGGEASSHPLTRRCMLCSLKVPAVCVWMLLLAYVKVCSSSFCYPFHTSECQNLSCGQFFLTVV

SEQ ID NO: 131642 - protein, 318 aa, Triticum aestivum
  Clone ID: PAT_TA_26060.pep
KEKDEIITQVMAEGEELSRKQAAQESTIRKLRAQIREFEEEKQRLNSKIQVEETKVESIKRDKAATEKLLQETIERNQTELAAQKEFYTNALNAAKEAEALAESRVNTEAKVELESRLREACEKENMLINTIEELRNALTRQEQEAAFREERLKRDHDDLQKRYQASELRYNELVTQVPESTRPLLRQIEAMQESAARREEAWAGVERTLNSRLQEAEAKAAASEEKERSINERLSQNLSRITVLETQITILRTEQTQLSRSLEKERQRASESRQEYLANKEEAALQEGRAKQLEEEEEEEEAEEEEELQEAAEHMGL

SEQ ID NO: 131643 - protein, 236 aa, Triticum aestivum
  Clone ID: PAT_TA_26061.pep
GGERPSLSPPGYLANKEEAALQEGRAKQLEEEIKELRARHKKELQEAAEHRALLETDLERERAARAELEKASPRDLPKIPLPDRPTNQLEGKLSRLSTRHRKELPEAGMSAHSNMSYYLRSMTPSAFESALRQKDGELASYMSRLASLESIRNSLAEELVKLTEQCEKLRNEAAALPGLKAELEALKQRHFHALELMGERDEELEELRNDIVDLKDMYREQVDLLVSQLQTLGARV

SEQ ID NO: 131644 - protein, 62 aa, Triticum aestivum
  Clone ID: PAT_TA_26062.pep
KTSMKLEALCALVHEERYSLIAPACLSMLLLKPNYRTFICRQPVQRHWLITFKPSSSVFSST

SEQ ID NO: 131645 - protein, 118 aa, Triticum aestivum
  Clone ID: PAT_TA_26063.pep
ERPPGQVRENWRTKVEATVSPHASEQVRTCIEIALKCVEDDRTRRPTIAHIVNELSNIGVAKGSPIRQWADKLTALKTLLLSTHFKHWLFLFVAAISMFFAWAKFCPDSWWQGITRRT

SEQ ID NO: 131646 - protein, 134 aa, Triticum aestivum
  Clone ID: PAT_TA_26064.pep
RAAARAGTSMASPHIAGLLAYLLSLQPSKDSAYAVAEISPKKLKKHLISFATEGVLSDVPSNTKNILAWNGGGEGNFSAIVEKGGYKGKNESPAPVDLKEDLKEKAGDFADKIAELEKKLEKDVQDFIGQLKSE

SEQ ID NO: 131647 - protein, 131 aa, Triticum aestivum
  unsure (1)..(131): unsure at all Xaa locations
  Clone ID: PAT_TA_26065.pep
KRXXLXXRNIXXTDIASMKTLTILIAAISAATVSVAAERCPPGNKFDWAPISCLNVNRGDFGDGGACINAQYDWDFDYQPDCIADIYLSQRWKGICCLPWKGGEEVHKYYVANCQALGGDPHDESPNVWPC

SEQ ID NO: 131648 - protein, 95 aa, Triticum aestivum
  Clone ID: PAT_TA_26066.pep
RHLYCRQIGIHIVGNYLSVDVHACVGGQSIREDTGKLEEAGVQVVSGTLARVCHVIKRRTLRTRAIKLLVLDESDEMLSRGINDQICIPPPRTLG

SEQ ID NO: 131649 - protein, 139 aa, Triticum aestivum
  Clone ID: PAT_TA_26067.pep
LGGPPGRYGYLDGDKHARDEVPDVGVNKVFASLQLTTSIRPMMTMLFAYRRRGGMQLSWWLPVELALYSVVLDGFFYAYHRACHELDYLWQYHRTHHLTKHPNPMLSSYADHEQEFLEIALIPFLTWAVLKYLGRDHAK

SEQ ID NO: 131650 - protein, 203 aa, Triticum aestivum
  Clone ID: PAT_TA_26068.pep
MNLISIPQEPELEEFDDDYLNHRQDAVKMMRAATKHSQAASNAFFRGDHAAAKELSLRAQEEWLAAEKLNNKAAEEIFHLRNSNNNIWKIDMHGLHASEAVTALERHLHMLEFQPPGNNPTSTDELDKSEPTIAVPNEVAAEKVVVFLRPRQSVLEVITGIGRHSKGQASLPAAVRGFLIENGYRFEELRPGVFSVRPKFRRG

SEQ ID NO: 131651 - protein, 144 aa, Triticum aestivum
  Clone ID: PAT_TA_26069.pep
RGRGRGTGDGVAQEVSVKNSSHKLTTDAYPAFGGKDAAPSPLHFNLTSLSSCTQVTGSLVAKDLGINLGKWDVEVAGHLDPSVLTQGVEGNANWKAISLKVRVDAEASKVDFEKFASETERRCPITQLFKRSGVEWGSDWQNGS

SEQ ID NO: 131652 - protein, 116 aa, Triticum aestivum
  Clone ID: PAT_TA_26070.pep
SGGRPPRYCFSSNSHILFPSSASNRPSISLINLLLLLPNTLLQINTSLLLRARRININKSRISTLILIFILHPLQPLPLVNLLRQINTRLLRRHGREDVRPHAIRALILVPRPPPR

SEQ ID NO: 131653 - protein, 61 aa, Triticum aestivum
  Clone ID: PAT_TA_26071.pep
RAAARGRYQSSAMSQSNAAQGACGNDINNFRQCMDQNQGSLTICGWYLDQLKACQQAASQY

SEQ ID NO: 131654 - protein, 55 aa, Triticum aestivum
  Clone ID: PAT_TA_26072.pep
AWSRPRYSRGGQGAKVERLYRDVRAYAIPGGSEEIMLDLSIRQSLKVHQVLGMKL

SEQ ID NO: 131655 - protein, 83 aa, Triticum aestivum
  unsure (1)..(83): unsure at all Xaa locations
  Clone ID: PAT_TA_26073.pep
SHXAKTLAASVKHSGMPFFNCALICTLLSTYNRLEWCNFLQANSYLAASSCRRITNQPQIQSFTGQASGSLPTEFYSACVQRS

SEQ ID NO: 131656 - protein, 177 aa, Triticum aestivum
  Clone ID: PAT_TA_26074.pep
SAGPPPRYPEEMISTGISAIDTMNSIARGQKIPIFSAAGLPHNEIAAQICRQAGLVQPTKGVHDGHSDNFSIVFGAMGVNLETSRFFTKDFEENGSMERVTLFLNLANDPTIERIITPRLALTTAEYYAYQLEKHVLVILTDLTSYCDALREVSAAREEVPGRRGYPGYMYLGRDHA

SEQ ID NO: 131657 - protein, 123 aa, Triticum aestivum
  Clone ID: PAT_TA_26075.pep
SAGPPPRYVDASWTLGADATAQMMTRMITRMKKEGVVEVTPHQSAKEKKEMKESSLLRLNSTYVKKGMSELPKSGDRGQWTPRSYYFKDIIMAWFGDIKTGSSAASARGACIASFKAHDFVTG

SEQ ID NO: 131658 - protein, 108 aa, Triticum aestivum
  unsure (1)..(108): unsure at all Xaa locations
  Clone ID: PAT_TA_26076.pep
LAWSRPRYGALFTIVLAVVFTLFQYVEYSVSSFTITDGAYGSCFYFGTGFHGLHVIIGTMFIAVGFXRLVAYHLTENHHLGMEGAILYXHFVDVVXLFLFLSVYYWGS

SEQ ID NO: 131659 - protein, 208 aa, Triticum aestivum
  Clone ID: PAT_TA_26077.pep
AWSRPRYLWPEESHDSGHHGDHDGHGDDHAEKADEGEEEAPAEEEKSEEKGDESEKSEENSEDKEEKSEEKSEEKEEKSEEKEEKSEDKKEDKSSDDKSDEKSDEKKDQKDKIAEKDEVKTAEKKQGDDSTTSDKAMKLGEGAIAATSASKPKGKSQGDITVKQGGMSNTDTKHSTKIGAGSEKSTKGDGNPETAKSKGTVDPNAPVK

SEQ ID NO: 131660 - protein, 140 aa, Triticum aestivum
  Clone ID: PAT_TA_26078.pep
RAAARAGTESIQSYIFYILQYSVSNLNAFIILVTMGFSFYLYVNKEESKEDLYNIVATEKNNSPIQLISQIKGYFYINPYLAISLAITLFSFVGIPPIIGFFAKQMILSAALDSGYVFMALVAILTSVIGAAYLGRDHAT

SEQ ID NO: 131661 - protein, 597 aa, Triticum aestivum
  unsure (1)..(597): unsure at all Xaa locations
  Clone ID: PAT_TA_26079.pep
NMGXPNXGNXALXXDKSSXRNMGWGDLKDAVEEAKTLAGDRLFELHETQEDNLILSKQLEDLQGQLSPGCGTPSAQPDARLGDLXRLRDAALDRLVGGRVVPLDASIHLLPGLVAWCAEGESVDNIKQSITAYEAKIEELEHXILKSMAEKNDLEIKVEESLQDSGKKDFKDEIHVMAAALSKEMEMMENQLNRSKDAASEALALREEAESLRTLLAKKISEQKEISDRYNAQVSEIKSLKELIETLEKENQELEFIVDMYGKECSESRTITEIKESENRARKQAEYLRTSLEEHSLELRVKAANEAETACQRRLCIAEAELEELRTDVDASERDVPELKEAIRIKEAEGDAYISEIETIGQAYEDMQTQNQHLLQQVADRDDFNIKLVSDSVKTKQASASLLSEKHLLQKQLHQVNSSLESSKQKLSRGEEQMKAYVAQAIKASSENRHHAITIEKTLLEVSEAEKELKWLRSAVGSSEKEYEQNQKKIAELRTELERESEKRKLEEEYEEVKNEVTELTSENEEATIQKLQDEIKECKAILKCGVCFDRPKEVVITKCFHLFCSTCIQRNLELRHRKCPGCGTPFGQNDVREVKI

SEQ ID NO: 131662 - protein, 263 aa, Triticum aestivum
  unsure (1)..(263): unsure at all Xaa locations
  Clone ID: PAT_TA_26080.pep
AWSRPRYLDRHLDTGFXXFXXRLLLMAXXXLTEILKTAYRYYQKEKTPSIRRALKLVLAYNLTMHVTMIEGLTEQEQFXXRXXDPXAKWSGFTVAPXXINXXVKCALAYMWRVERPPGQVELSSLYQSVYSGEKLKHWPTIFMLAAILLAIWEEMQFDCHYRVPDEQAVNKFCDDMETTPVGVIVGLFQAISTKLPALQEWDTKKHHHLLNSNVAVCDALTEVKGHVNKYETYLKDRSNAKFNPDDFDCLTNKFLSKLVIRAN

SEQ ID NO: 131663 - protein, 93 aa, Triticum aestivum
  Clone ID: PAT_TA_26081.pep
LFERPPGQVPPRCTPTSVASGPTVSTARVPSASVTMMRALKRITSLRSQLLCRWTNPPRRESSTSQNNVKEECNKTDEVRRAFTITHELHTST

SEQ ID NO: 131664 - protein, 114 aa, Triticum aestivum
  Clone ID: PAT_TA_26082.pep
RAAARAGTLRLLFRRLCQHQHLSRPRPSTTTTLRPLSRPSTHMRPPPSPKARMVSSTSTPKGTSTTPTVTLNSDFRPKSSRLQFLLARLVRFTLSRKDSRCPNLFSYCTCFIVD

SEQ ID NO: 131665 - protein, 103 aa, Triticum aestivum
  Clone ID: PAT_TA_26083.pep
MRSTLIATAFAALSAAAPTKRQATKGGPSDGVILNYALTLEHLENTFYKEVLQKFTLADFQAVGLDNVFYKNLQTISSDEQTHVEFLTTALTAAGVTPVVANE

SEQ ID NO: 131666 - protein, 214 aa, Triticum aestivum
  Clone ID: PAT_TA_26084.pep
SVVAAEVIGVTKGRTKALLIFWTVCMTAFTGAISVATTKNLTPTVYPLVTLASIAVGAVIIPCSIIAQVICPTEFIGTVTAITLAIRYVGGAIGFTVYYNVFFSKLKHNYLPKLAPSVLTMGLSVKIVSIDQVTAELTRYFTMAAQGQFKALETAIRTEDFINPSSKDTAYDIIIGVTQEAFAKAYRWPYWISIAFGGACIILALFMRDIRQHL

SEQ ID NO: 131667 - protein, 94 aa, Triticum aestivum
  Clone ID: PAT_TA_26085.pep
FFFFFERTNKASWSVHVQVRKYTAPTHTTHDTSASPTATQHATHKHTTEQPVYTRSQRRRATKQLQISGNSVTTLLLHVFFFLLGYSTDGVGSG

SEQ ID NO: 131668 - protein, 95 aa, Triticum aestivum
  Clone ID: PAT_TA_26086.pep
TVPLTKYCTFPHRAEANYGAAKVMLRPACPGSGVTAGGAVRVVLEMAGVENALGKQLRSKNPLNNARATVKATQMMRQFSDVAAERGLPMEELWK

SEQ ID NO: 131669 - protein, 227 aa, Triticum aestivum
  unsure (1)..(227): unsure at all Xaa locations
  Clone ID: PAT_TA_26087.pep
PGRPTLRPHFSAPPLPRGLASPRRSITPRTCQKAATATAMAMATTSTAAHVVPALFSFLQQRLRLCPKARISTSRRLLLPVSKFSTRDGSASYQEEDEEGEAEDSAEAAFGDEDDEKPQPEAVSSTEFQFAAPPEGYIEPAPFDELPPESPEDVAAAYESLYGPAFSGESLMGNNVFEVKVVDPVDMDREQRPNDEFSERVVQVSRVTKVVKGGXRQLSYRALVVVG

SEQ ID NO: 131670 - protein, 296 aa, Triticum aestivum
  Clone ID: PAT_TA_26088.pep
AQIAARAPPPMPPAAAPAGGEELDLFMTHYVLLLCSFKEQLQQHVRVHAMEAVMACWELEQTLQSLTGASPGEGTGATMSDDEDNPVDSESNMFDGNDVSDGMGFGMLTEGERSLVERVRQELKHELKQGYREKLVDIREEILRKRRAGKLPGDTASTLKAWWQAHAKWPYPTEEDKARLVQETGLQLKQINNWFINQRKRNWHSNPTSSSSDKSKRKRNNAGDGNAEQSWCAGAAGERRTNAPYMYIAYMSWRFHDGEGFDTAIYCSGDDVGRYSRASPGGPHHLCSPNKPPQGG

SEQ ID NO: 131671 - protein, 149 aa, Triticum aestivum
  Clone ID: PAT_TA_26089.pep
MTQVTIASRNPNDRVGIYYKTLHAFTTYRDEPVTVPVSLPAIYQGHKDQSVWSPVMSGDSVPVAPYVADAMKQDIAAGYVLLHVKVDGRVKWKVGSWVSGGYHIFVNCPALLSASGGSVGGAFAMSATVGGKQTVSLKFTQPSYCTVDV

SEQ ID NO: 131672 - protein, 344 aa, Triticum aestivum
  Clone ID: PAT_TA_26090.pep
LEPAANVLFLESPAGVGYSYSNTTADYGRSGDNKTAEDAYLFLANWLERFPEYKGREFYITGESYAGHYVPQLAHDILRHASPAINLKGIMIGNAVINDWTDNKGMYDFFWTHALISDETAEGIDKNCNFTAAGAGAAPSALCDDASDEASESLRDIDIYNIYAPNCQSEKLVTPPIAPSIENFDPCTDYYVEAYLNRPDVQKAMHANVTRLDHPWSACSDVLTRWVDSAKTVLPIIRELMKNNIRVWVYSGDTDGRVPVTSSRLSVNQLQLPVAAKWRPWFSSTKGAGEVGGYIVQYKGDLSLVTVRGAGHEVPSYQPRQALVLVQNFLAGKALPDCKECEQN

SEQ ID NO: 131673 - protein, 357 aa, Triticum aestivum
  unsure (1)..(357): unsure at all Xaa locations
  Clone ID: PAT_TA_26091.pep
FPPYLPTTSLLLPSAPARPRPRPPVPQTTHQETVAAPATAKAMAITSTSAHALPVLVPFSHQRLRLCPSARTPTSRCRLLPVSKFSSPDRSASYQEEDEEGEGEDSGEAAHADVGDENMQTMPXSLRSFXLASPPEGYTGTAPXSPRLTPXHQKDIAXAAYESHVGPAFSRESLMGNNVFEVKVVDPVDMDRDQRPNDEFSERVVQVXRVTKVVKGGRQLSYRALVVVGDMEGXTLGVGVGKAKEVSEAITKAAMNGRRNLXVTVPLTKYCTFPHRAEANYGAAXRVMLRPACPGSGVTAGGAVRVVXLEMAGVENALGKQLRSKNPLNNARATVKATQMMRQFSDVAAERGLPMEE

SEQ ID NO: 131674 - protein, 216 aa, Triticum aestivum
  unsure (1)..(216): unsure at all Xaa locations
  Clone ID: PAT_TA_26092.pep
MSKGKVHHDWILRRCCGSIAACILTLAVLVGFVALVIYLALHPSKPSFYLQDIQLRSIDLADPALSLDVQVTIASRNPNDRVGIYYKTLHAFTTYRDEPVTVPVSLPAIYQGHKDQSVWSPVMSGDSVPVAPYVADAMKQDIAAGYVLLHVKVDGRVKWKVGSWVSGGYHIFVNCPALLSASGGSVGGAFAMSATVGGKQTVSLXFTQPSYCTVDV

SEQ ID NO: 131675 - protein, 69 aa, Triticum aestivum
  Clone ID: PAT_TA_26093.pep
MADNEPVDPKNYLEERCKPQCVKSLYDYERCVKRVENDETGQKHCTGQFFDYWSCVDKCVAPKLFEKLK

SEQ ID NO: 131676 - protein, 286 aa, Triticum aestivum
  Clone ID: PAT_TA_26094.pep
MAFQSPVGSPFDCLLIDLDDTLYPGNTGIGPALRRNIDEFLVARFGLAADKAAALRADLFRSHGSTLAGLIALGHDVHPDEYHSYVHGRLPYDVITADPQLAAALQSMPQRKILFTNSDRAHMKRALERLGVDEACFDGVVCFETLKLLIDADMNPHLFGEELEGEDDEAAAADVDRPAVVLKPSVHAFVAALRVAGTNPGRTLFLDDSERNIAAGKALGLRTALVGKRARSKEADYALESIGGLRRAIPEIWGGDGELQPDHNVEKNKSMRADLDAVIQPTSIQA

SEQ ID NO: 131677 - protein, 154 aa, Triticum aestivum
  Clone ID: PAT_TA_26095.pep
FFFCWFVVFPSCLCRLQDYMGRLGPKENIVELFTFKFFRSSWTFRATRRHRKDLQTKSNERSKNRRCQRTAHQCRCLLRGLNYSSVGFAHSFLLSLFVCLSHLRPFGVQNYVGRPCAPGKAVNLFTIKFFRYSLTLGETPVPKAMPKDFKQMRV

SEQ ID NO: 131678 - protein, 158 aa, Triticum aestivum
  unsure (1)..(158): unsure at all Xaa locations
  Clone ID: PAT_TA_26096.pep
RAAARAGNLFNNFTISLDAPQPXGVYFQDSASPQMEALIELHDNIMFYLVIILFGVAXIMVSIIRNYISTKSPISNKYLNHGTLIELIXTITPALILILIAFPSFKLLYLMDEVTDPSLTVFVEGHQXYXSYQYPDFLNNDDEEVEFDSYLVPRPRPR

SEQ ID NO: 131679 - protein, 182 aa, Triticum aestivum
  unsure (1)..(182): unsure at all Xaa locations
  Clone ID: PAT_TA_26097.pep
RTMHSREADADDCGYTRKHPSSISGSVTRQGFRLLISANEPLSPFQSDWEVHDDGAGFTCRSWRGLLDLSDHPNDRLNFVLLFADFPCHLRRPQHALHRNNPYMINNNFPPTSYTSTNPSHALCNTSSTQSHHPYPDLDFPNSTLPSTISRGLSKRTGCFSTNIEPGNQHITTAEYLGRDHX

SEQ ID NO: 131680 - protein, 117 aa, Triticum aestivum
  Clone ID: PAT_TA_26098.pep
IPSQLPRRDVLRKALSRASPPQCAPVLSSPFPKASTMKPRTPMQQLRKTRITEEEGRSLLLATAAPQCPCLSCSSHPSSSIPRAAKIKSVLREFRSDRKRRKCGGCCVSDCGMTCVW

SEQ ID NO: 131681 - protein, 144 aa, Triticum aestivum
  Clone ID: PAT_TA_26099.pep
PSRVPADGRRIAPANIRRDRHDELGALVALFSAGVPLRSGPPQGRTALHMASANGHLAVVEYLIQNGANVNSANLEKNTPLHWACLNGHTEVIKALICAGAIVSALNSHEKTPMDEALTLGKMEVVDAIGAAVAQAELNGVTVS

SEQ ID NO: 131682 - protein, 81 aa, Triticum aestivum
  Clone ID: PAT_TA_26100.pep
YNPILGSLNICHLNIYWLFPCAAPSKALLAPVCPETYEDDAPLEVHDEDLIVDATGKKITSSHLLLIGTCRPILLVFFLIL

SEQ ID NO: 131683 - protein, 165 aa, Triticum aestivum
  Clone ID: PAT_TA_26101.pep
AIELIRSGHRSGCRYDAQLREPTRRMHHRAQTSDIKGIADSLTRDCQLLLHPPSLLPTKSWLLLPSLAGPSLPFFDATTILMTTTGPCRPFFLFLFDQEGFTNEGTTWGHRRFWRKRETGVTRMAFIDAYLPWHAFGFPPRLEQWKGRTFVDLSCRELYLGRGPL

SEQ ID NO: 131684 - protein, 138 aa, Triticum aestivum
  Clone ID: PAT_TA_26102.pep
ERPPGQVAGTEGLAEYVEIPREDHWQQGEQEASSDQWPLRGVQDVKKTVSPQGASISSSNNGVLYKLNNLDIFDRKAHRNHVRYGGPTLENVNFVKLFKKKELSPILKNKNLIRRDSFGVVYMGLVDSVPVTIRKLFW

SEQ ID NO: 131685 - protein, 84 aa, Triticum aestivum
  Clone ID: PAT_TA_26103.pep
RAAARAGDKCKPPTFFICPMTQEIMRDPHIAADGFTYEGEAIKDWLQRGHKMSPMTYLSFTHHELMPNNALRFAIQEWQMHQQP

SEQ ID NO: 131686 - protein, 78 aa, Triticum aestivum
  Clone ID: PAT_TA_26104.pep
RPPAQVPFILGVILIISFFVWELKFARFPMCPKGLFRKDKQSMIVIFLITFLSGANFFVLLLFWPTQVYNMYLPRRPP

SEQ ID NO: 131687 - protein, 69 aa, Triticum aestivum
  Clone ID: PAT_TA_26105.pep
WSRPRCEIAQAAAPARRFQSSAIGALQESVEAYLVSLFEDTNLCAIHAKRVTIQSKDIQLARRLRGERS

SEQ ID NO: 131688 - protein, 83 aa, Triticum aestivum
  Clone ID: PAT_TA_26106.pep
AWSRPRYLMGWFIFTFLLLMLTVRSTVAFFLLFLSLDLAFLMLGIAYLDFTAEGAPNPTILKAGGGFGMIAAFMAWYLPGRPL

SEQ ID NO: 131689 - protein, 145 aa, Triticum aestivum
  Clone ID: PAT_TA_26107.pep
FSRFVGEAGSSTHPAEARRKEEAAPTNCVMGYWGAHTPTSCRYTAALLWKRILLRPTADPTGARRNAEAFSVSRNPSTPFSADLPCATSRVHRQGVRQGQGLLLSDKFVIGKCDLPCTRVSTFKVYLTITMYHCTIYLVKGVISP

SEQ ID NO: 131690 - protein, 110 aa, Triticum aestivum
  Clone ID: PAT_TA_26108.pep
PRGWPLLVTSQLSQSFESLALPTRRILQRLSFLRRARRRSKCWLRLARIITTSIPDTTLIHIIRTHSRTRRRRRGSRRRNCRVGAWRRSVGWPRLAVVVAAAVPRPRPRQ

SEQ ID NO: 131691 - protein, 52 aa, Triticum aestivum
  Clone ID: PAT_TA_26109.pep
SVVAAEVPSEELASAFADPLIIRHPQGHTVPRLDEASVKQLSEWSASILDEY

SEQ ID NO: 131692 - protein, 163 aa, Triticum aestivum
  Clone ID: PAT_TA_26110.pep
MNQPVQKNTLYVGGLAEEVDEKILHAAFVPFGEVKDVKTPLDQATQKHRSFGFVTFLEREDAAAAMDNMDGAELFGRVLTVNYAFPEKIKGGEQGWAAQPVWADADTWFERQQQEEEMKRLQTEQNAAMKEAERLHREKIAAEKNGETDEADPMAVAEAQAVN

SEQ ID NO: 131693 - protein, 115 aa, Triticum aestivum
  Clone ID: PAT_TA_26111.pep
RGLAWSRPRYAFQLPMGFHDWWICHEYVIFSEAFGHSGLRIYSTTTSAASPFLKAFGCELAVEDHNLHHRRGWKKSSNYGKQTRLWDVLFGTTGQRIEITPETIDHSATFNMPLL

SEQ ID NO: 131694 - protein, 192 aa, Triticum aestivum
  unsure (1)..(192): unsure at all Xaa locations
  Clone ID: PAT_TA_26112.pep
MSQVPNAERDGFTCGTLFTCLCLPGLSXKKPEETGESRQPAAPEQDRRTEQEPPQVLLTRAASLEKLECSSLYSGSNIVFDFLVEPGGRDDRGAVHGYCPSPCFDLPVELIGAGERCGVVANDAPVTSAFVFDGHRDGAALKRMASCLASSVPTGGEARPTHLVRFLSASGCAVPVRPPVTSFGGPAKGGGG

SEQ ID NO: 131695 - protein, 193 aa, Triticum aestivum
  unsure (1)..(193): unsure at all Xaa locations
  Clone ID: PAT_TA_26113.pep
MLRLGLHPCPHFSPPPSHPTLPRRLAASPLPRPPFPSAVTAPRARNPPLQAAVSGAASGEERRGADEDEEGADLHEALTKTRRLVECAMFASVAGLAYFLSNSLAIENYFSCFFPLPIVISSLRWGLEAGRKTMVATVLLLFTLSGPVKXALTYLLIMGVIGPSKGYXWSXGDNWDCSNIICAIILQWELLGC

SEQ ID NO: 131696 - protein, 142 aa, Triticum aestivum
  unsure (1)..(142): unsure at all Xaa locations
  Clone ID: PAT_TA_26114.pep
XXQMHRXXHCRRRCVLMQGHRAAARAGTPPAEMPTCTPREETPSKISPALSCRIHESLFSHRLHHPIYLPQPKRAAHDEQVNRLASDEDELSAAFVVSEGFASEWGATRLLYEASLPAPPDGPSSAFSSCTMKRVYLRRGPP

SEQ ID NO: 131697 - protein, 336 aa, Triticum aestivum
  unsure (1)..(336): unsure at all Xaa locations
  Clone ID: PAT_TA_26115.pep
MLLVDGEPVPCSSPEGSSGRELVAALMGNPGLRAASERLRAAPETPVPSGPEGPRHVYVFQREYATVDPARVXYVGTDEMTTCVGVAIRNNKXGMTSITHMDFPKIVEGGFKQMLELLGDDDEPFDVHLIGGFDDASTKVVYSAGGKHSIQEGYSHPLCCKIVEVLHKSQQRFHLRSFCVLGINTMTDSYGNARPIVGGFVMQTSSGVVTPASFDITSRCPDEIVRRIRVSVSSYDPNWRGKLLETYDTHADIFQIAPACWMPDWAEMASSLNQLSDSEVLLQCSTSPAAEPPHFVETERRIWKYLIENPDWEDIFPKYKPRVFHWTNDGRWSRHS

SEQ ID NO: 131698 - protein, 79 aa, Triticum aestivum
  Clone ID: PAT_TA_26116.pep
RMKGGVCLNKGAWMRPFWAQHEGGRAFSIMRSWDGFAFFSRVISTQQHCCAHNTIVARCRRRRARSELHMTAVPRPRPR

SEQ ID NO: 131699 - protein, 355 aa, Triticum aestivum
  Clone ID: PAT_TA_26117.pep
MAAGAGATSPKRLRVYSSAAGDADSSNGAGNGRRVGTHNGSFHCDEALGCFLIRLTSQFAGADVVRTRDSQILDSLEAVLDVGGVYDPSRHRYDHHQKGFNEVFGHGFNTKLSSAGLVYKHFGKEIIAKELQLNEEHEDVHRVYLAIYKSFVEALDAIDNGINQYDTEQTPKYVNNTHLSSRVGRLNPDWTDPDQSPEKENAAFQKAMALAGSEFMESVRFHVKSWLPARSIVMECLLSRGNVDPSGEIMVLDRFCPWKLHLFELEQELKTDPLTKYVLYEDERSKGWRVQAVSVAPDRFESRKALPEKWRGMRDDELSKETGIPGCVFIHMSGFIGGNKTYEGALEMARAALKC

SEQ ID NO: 131700 - protein, 91 aa, Triticum aestivum
  Clone ID: PAT_TA_26118.pep
RAAARAGTRGATKTNASPWLNHVLQIYALFMLLGCFTTLLIPETKRKTLEQLAGEVPGTPEYDPVLAGRQHIQYDSDPSNEVAHEKGGSSV

SEQ ID NO: 131701 - protein, 105 aa, Triticum aestivum
  Clone ID: PAT_TA_26119.pep
RAAARAGPGPGARRGARPRPRRQQGADLEHEGVKMCIELAMSCVVIERVKRPSIEMIIDELQKLDTQIEKMSMKDSHSISGQSLPAPTKRGPRGGRRGTWAGGRS

SEQ ID NO: 131702 - protein, 75 aa, Triticum aestivum
  Clone ID: PAT_TA_26120.pep
SSGRPGRYFSNCLAVATQPQQCYQVTKALASLDASLQFKSVSLACPRCPRSSFLYEAPAPVMVGGPSLYLGRDHA

SEQ ID NO: 131703 - protein, 126 aa, Triticum aestivum
  unsure (1)..(126): unsure at all Xaa locations
  Clone ID: PAT_TA_26121.pep
XSSVAAAEVRQDTGRRRTLSFPVNTTHETCDPDHTRRLALYYLTSIFRFKLVTPNLSTVEGGSWLAIGSTLALRNRLLLPHGHFCPLPLATALWSLSLSALRNYATVGSLRSISKYTVSSLLYVVS

SEQ ID NO: 131704 - protein, 89 aa, Triticum aestivum
  unsure (1)..(89): unsure at all Xaa locations
  Clone ID: PAT_TA_26122.pep
XXXAXXGPSWSLSVVVNLCGRPGWYQQRKGGSHLYRAIVSASQSSIGKHKASHAIKQGYMHHSRGHPFPPPPRPRCICSKAVIKWSQDA

SEQ ID NO: 131705 - protein, 101 aa, Triticum aestivum
  Clone ID: PAT_TA_26123.pep
GRPGRYQEDILDERAPGEAETMPDIQSIEIQTEIQWFMRPYLLDFLLEAHHAFQLLPETLHLGGDQADRYCSRRVVYKRHYQLVGCAALLIAAKYLGRDHA

SEQ ID NO: 131706 - protein, 86 aa, Triticum aestivum
  Clone ID: PAT_TA_26124.pep
SRRPPGQVQKNQYRLPLTNTSGSTLKQGKYHDSFINMILDKSGIILFSSLTSYMEYLIQQSKVEITTGIIKGITTQVDRPKANSNM

SEQ ID NO: 131707 - protein, 117 aa, Triticum aestivum
  Clone ID: PAT_TA_26125.pep
RAAARAGVEQKAKQKMVFVMNKLMWLACLCISAAFIALTYVVVGRNDEWLAWCTMAIGTVIMLTTIGSMCYCIISHRMEAQSMRRIRRSSMSQSWSISVDSDTELDMTSRNKTMYAL

SEQ ID NO: 131708 - protein, 219 aa, Triticum aestivum
  Clone ID: PAT_TA_26126.pep
KDMLFDNEANMEAYKFWRKKVLARVKDEEKQKILAPEVPPHPWGTKRPSLEQRFYEVVDADNVTIIDVNENPIEDVKAEGLVTPKGLQEIDILILATGFDSVTGSLGQLNIQDNKGQTIADHWKDGCKTSMGIAIPGFPNMFFCYGPQAPTAFSNGPSCTQFQAEWIEELMKRVQKDGITRVEATDEAEADWCKRMNEKWDASLFPQAKSWYLGRDHAK

SEQ ID NO: 131709 - protein, 78 aa, Triticum aestivum
  Clone ID: PAT_TA_26127.pep
DINVGRHQLFPPCSLPWRPLLCWTLSEERRLVTGGSRWVGLLTVVGDGYLAILGFVHWLRTAGGGGWLRGGVPRPRPR

SEQ ID NO: 131710 - protein, 92 aa, Triticum aestivum
  Clone ID: PAT_TA_26128.pep
SSGRPGRYVVVPVRAEQQTSPDSMDLRARIEISSSTGETRMEMWYCLLAHSAFSSSFLAIMRRSPTRSSACQQARCISAGRHPRSYLGRDHA

SEQ ID NO: 131711 - protein, 73 aa, Triticum aestivum
  Clone ID: PAT_TA_26129.pep
MAFAWKAAGITYNRYLAVASRVVRRSLKEEQRLKAEKRGEIDLRFAKWENGKQQELRSVETANAEAAQQNASQ

SEQ ID NO: 131712 - protein, 112 aa, Triticum aestivum
  Clone ID: PAT_TA_26130.pep
RAAARAASSRPRHPARSPYREKFPCVSLRPPYVFPAISQSVPLLQCIPSALVLLPIPRLPLLSPRIAPRLIVVCARKLLSRTSGLRRGHANLVSWSIAESRSDWRYLPGRPL

SEQ ID NO: 131713 - protein, 357 aa, Triticum aestivum
  Clone ID: PAT_TA_26131.pep
MWQSKPVLVLLLLAVSTAATSGKPLLTKITKGGASTALYTAPLSAGRPLVLDLSAPAITTPCSGQTTTVTLSANSTDGSNPLSPVSFAATATCAAAPSGAVGVAGLARSSASFPAQVASTQKVANSFALCLPSDGRTGFSGNGVGAAIFGGGPFFLAPPADRPAITTLLSDGVPLRQPFSGNPGYFVSATNGVAIDGTRVAVSGSGALVVGLSTTIPYAQLRSDVYRPFITAFDRAMGSSAKVAAVAPFELCYDSSKLSPTRSGYSVPQVDVMLEGGTNFTVVGGNSMAQVNSGTACFAFVQAGGGTAGGTPAVVIGGFQLESKLVVLDNDKKTLSFTPYLPAMGFSCSNFNFTRAG

SEQ ID NO: 131714 - protein, 102 aa, Triticum aestivum
  Clone ID: PAT_TA_26132.pep
RGRGRGTSLLDGMISGRGFDGAVQGPLSSEEEICGNIVGLMLHGISTSANLLCNILTRLVLFPKLKDQLHADIVAVHTESSELVMDDVLKMQFVPARAAAGR

SEQ ID NO: 131715 - protein, 100 aa, Triticum aestivum
  unsure (1)..(100): unsure at all Xaa locations
  Clone ID: PAT_TA_26133.pep
RAYSIFPGFPSFDASPYGHAGLRHPPRRPRLHRFDRSISVSPENSSSIPCRGFVNLCVYKKPPVAWVSPVTAAPRPLLTNTPISSPDAALQPXPARAAAR

SEQ ID NO: 131716 - protein, 66 aa, Triticum aestivum
  Clone ID: PAT_TA_26134.pep
NRRGWCEYRKRIYTIYLTGAFTVPPTIMQKNISKKKKKKLVQSLYYLTTFVVLTRRPETVPRPRPR

SEQ ID NO: 131717 - protein, 195 aa, Triticum aestivum
  unsure (1)..(195): unsure at all Xaa locations
  Clone ID: PAT_TA_26135.pep
XKLVXRMAKHLPGLDSSXCGAFEFSNTSFVXXNAVALXCGDNMLRFSVEKVMEKESRHFQKKRLNGADHSXLGSENGEGVGGPRRRQNSMTLGSGPVLLLHIPLHKSQKSDTGVIWCSHVSRWNCLRSSFGSPEFKAKSFGSPEFKAKSFGSPEFKAKGSGWPEAKGTVTHAPCELSTNYSAGGQTTGSIPRPSR

SEQ ID NO: 131718 - protein, 111 aa, Triticum aestivum
  Clone ID: PAT_TA_26136.pep
ERPPGQVTLLSLNMAIDRRPQDSMKSTWRGDEKQWGFSHKFLIWLDAFHTVPGQEPPIHAKADKMPVLSEWSCHVWILLHAIWPMLLQQAYISRTGYDFHPFAVYLGRDHA

SEQ ID NO: 131719 - protein, 88 aa, Triticum aestivum
  Clone ID: PAT_TA_26137.pep
ERPPGQVLSLPLIEADLDQRHRRNHLQSLKVLEDFQNRLRRIDKAMPAMLPRLVHAEHQRCRPAQRPIQEAKHPIDVFQLLRPRPRPR

SEQ ID NO: 131720 - protein, 261 aa, Triticum aestivum
  Clone ID: PAT_TA_26138.pep
ERPPGQVSKRVKNEQKKKVLFPEEPPHPFGVKRPCLEQNYYEVLDQDNVTIVNINEENGTPIERFTEKGIVANGEEREFDIIALATGFDVVSREGSTRYQAADFGVSIQVTGGMTNMGLKSINGTYLKDEWKAAANTFLGTTISGYPNLFHINGPHGPTLLSNGPSTVEIQVRWIRDAIKQIERQGLKYVNPTKEASDEWKKRINDLAAPSLFPTTRSTYMGGSVPGKAFEMTCYSGGVNAYGPEIRGYLSGWKGFETVKV

SEQ ID NO: 131721 - protein, 100 aa, Triticum aestivum
  Clone ID: PAT_TA_26139.pep
SSGRPGRYSYTDITAVTRHFRDKLGQGGYGSVYKGVLLPGDIHVAVKMLAGSSNCNGEDFISEVSTIGRIHHVNVVHLMGFCSEEMRRALIYEYLGRDHA

SEQ ID NO: 131722 - protein, 112 aa, Triticum aestivum
  Clone ID: PAT_TA_26140.pep
DRPPAQVPKKGRTNTPWTPAEEQRLKTLRDAGSSWSEIAKTFPTRTEGSVKKHWYKDMHYAEFAEDEVSNFSAALLQAIKDYENNKWKVIGQKVGKPAKACEQFAKEQGWKI

SEQ ID NO: 131723 - protein, 138 aa, Triticum aestivum
  Clone ID: PAT_TA_26141.pep
EYAAYRFGVATRLLKNVCLWKKVLAGDALEKLALEELLIGKILPHMKSIILEVHDAITRAERIAASLSGVWSSPNKKLQPFTDFVLELSNKLKSRHVSGVSEEEIRGLARRLKNILVALNEYDKARNILKTFQIREAL

SEQ ID NO: 131724 - protein, 170 aa, Triticum aestivum
  Clone ID: PAT_TA_26142.pep
FERPPGQVLSIEGSGPPAWNNSLAGYFNCPNSNKPVSTGGNNASLVFENKYLADAVKRFNANSTGFDWTVVDVYNAQSLCAYETVALGYSSFCGLFTYEEWEGYEYSIDLQFSGNNMFESPTGRGVGIGYVSEFLARLQHHLIAKPTAQVNVTLDSNPATFPLYLGRDHA

SEQ ID NO: 131725 - protein, 166 aa, Triticum aestivum
  Clone ID: PAT_TA_26143.pep
FHQPQFLIQQILIPSPTIFDPTDLGSPRRYLPDLGEREGRRRCHPGDDPSTIATSTQPRLRQRKQAARIKGRTHIPDQLRSSGYLDVRPSGAAAHTHTLTYMSSSTFARRIRGVSPRAVFFLEVHEREDDGPALLQSMATPGQRPGGDAVRESSDGVGEDQPEVPR

SEQ ID NO: 131726 - protein, 204 aa, Triticum aestivum
  Clone ID: PAT_TA_26144.pep
FQKEKYRNLPRDKPEVTETPSVNTPSEAYLAVGATELEVTKNEPRTAKTDAEMMAVDAKSLEDIEMAFKQASAGGVDGPILDAETAHMSGGDIDSEPLEGSGQLHVIDAKSVEDISAVLKEHSSVDVNNYFEQNEDKVGCAEAVECTKHDSLPEGAHVESLHLAGDDREPESNMSCIEAKTIDDMNAVFKKLSHEESTCPGGRS

SEQ ID NO: 131727 - protein, 53 aa, Triticum aestivum
  Clone ID: PAT_TA_26145.pep
SGGRRGRYNTLHHQLPFGGYKESGIGRELGEDALANYTQTKTVNIRLGDALFG

SEQ ID NO: 131728 - protein, 69 aa, Triticum aestivum
  Clone ID: PAT_TA_26146.pep
MAAIQLNFTLRTSANCKTVHLLGSWDNYKGQLPLSKDSSKTGGWKGTFRFQGQTLKQGQRYWYLGRDHA

SEQ ID NO: 131729 - protein, 146 aa, Triticum aestivum
  unsure (1)..(146): unsure at all Xaa locations
  Clone ID: PAT_TA_26147.pep
SVVAAEVPENETIEYGRSRRACERHLFAVWCVGHFAIVLFLVTIALTSLESARRFRIAFAVVVVGVVGEDTSAHGDDEERDESGELHIVDGRWTLEVGLWTELELIKAACWEDAEPKTWPGGALEEEERGALTTCILRXXXXXXXS

SEQ ID NO: 131730 - protein, 101 aa, Triticum aestivum
  Clone ID: PAT_TA_26148.pep
MATELTVQSERAFQKQPHIFLNGKKTGGKSKVGKGGRRYYKDVGLGFRTPKTAIEGSYIDKKCPFTGLISIRGRILTGTVVSTKMHRTLVIRREYLPGRPL

SEQ ID NO: 131731 - protein, 129 aa, Triticum aestivum
  Clone ID: PAT_TA_26149.pep
MALPTGTSSGFPVAALTADLAPKLPAHSSILFAQKKAKNLSFETIGKELGREEVAVAALFYGQSNATDEDVTKLCQILDIPEDALRATEITSLPDRGRSMEMPPREPLMYRLYEIVQNYGYAYLPGRPL

SEQ ID NO: 131732 - protein, 116 aa, Triticum aestivum
  Clone ID: PAT_TA_26150.pep
IAPLSANTLAKIVGGLCDNLLTCIVRAWDYKKPIFAAPAMNTFMWNNPFTARHIETINQLGISLVPPTTKRLACGDYGNGAMAEPSQIHTTVRLACKSHTFGTGNSPAIPSSSHPV

SEQ ID NO: 131733 - protein, 215 aa, Triticum aestivum
  Clone ID: PAT_TA_26151.pep
MTTSEPVQESWELEPSRPRVLLAASGSVAAIKFESLCRVFSEWAEVRAVATKSSLHFVDRSSLPSDVILYTDDDEWSTWTKIGDEVLHIELRKWADIMVIAPLSANTLAKIAGGLCDNLLTCIVRAWDYKKPIFAAPAMNTFMWNNPFTARHIETINQLGISLVPPTTKRLACGDYGNGAMAEPSQIHTTVRLACKSQTFGMGISPVNPSSSRPV

SEQ ID NO: 131734 - protein, 112 aa, Triticum aestivum
  Clone ID: PAT_TA_26152.pep
AWSRPRYCECKKESSEQFLKRSGESSSGQFGLVAMRGEIGPCAMLWRELRDRFALIHSQDGQSLGKIGGSAGAELYDVVDVVAHCNEQVKEHLRVALLHFHLHGTCPGGRAR

SEQ ID NO: 131735 - protein, 55 aa, Triticum aestivum
  Clone ID: PAT_TA_26153.pep
AWSRPRYLGFFKLREENGHYIQDVKEMTRVPVLLRTDLTKSPPCLTIRSLNPYAL

SEQ ID NO: 131736 - protein, 98 aa, Triticum aestivum
  Clone ID: PAT_TA_26154.pep
AWSRPRYVELEKHKQAPIPIAITAVTRAVSSRLILCWAKSASSHPIFRNVCQQRKIAPRRELALASRWRDLRADDGDGQIRDVVQVDFHVVERRDPPM

SEQ ID NO: 131737 - protein, 73 aa, Triticum aestivum
  Clone ID: PAT_TA_26155.pep
SVVAAEVHAPPISHHMSAQASYVTVNLSSFPVLCLLSSSQHLPKCATSGLCLSLPRHIFNTLQLPQVEEWNER

SEQ ID NO: 131738 - protein, 97 aa, Triticum aestivum
  unsure (1)..(97): unsure at all Xaa locations
  Clone ID: PAT_TA_26156.pep
SVVAAEVPXXXXAWHNKSRLVXXMPGGWDPYVSNPRAAARAGTGAHGVVSRMIMDINRIKAGTQWVFVDFSRLAFLTTTLHGLLSISRRLYLGRDHA

SEQ ID NO: 131739 - protein, 93 aa, Triticum aestivum
  unsure (1)..(93): unsure at all Xaa locations
  Clone ID: PAT_TA_26157.pep
RRGRGTPEREAIILSYRHCQRLLTITGICLCVPXVIFGLCTRNPRLPDTQSIATAEMSSQENLVSDDKGNISRVESAPVQRSFGKKVVDFLIK

SEQ ID NO: 131740 - protein, 167 aa, Triticum aestivum
  Clone ID: PAT_TA_26158.pep
RAAARAGAPATTFAHLDATTVLSRGISELGIYPAVDPLDSASRMLDPRIIGQDHYDTATKARRRPRGYKSLQDIIAILGMDELSEADKLTVERARKIQRFLSQPFTVAQVFTGIEGKLVSLKDTIASFKSIMAGEGDDLPEGAFYMVGDFSEAQAKGKQILADLEKS

SEQ ID NO: 131741 - protein, 93 aa, Triticum aestivum
  unsure (1)..(93): unsure at all Xaa locations
  Clone ID: PAT_TA_26159.pep
TDLMPTFLLRSPAIALPQHTSKPHVKRRPTTSMPSQAHTGPFQVILSIVPRPLTSIRPEAPCSTGCTCRAAALAYAATLQPFYNXXXXXXXSX

SEQ ID NO: 131742 - protein, 121 aa, Triticum aestivum
  Clone ID: PAT_TA_26160.pep
LAMAAVASATASPDSQHTTLSHRVDLQFLKHTSQHQFGTKCDISLFAVASSFRCFFLLFLRRFFFFSSYLLWSASPSSTTVSLSTSSSSGGVFPPPIPGAPRATAPRDQRCCKEYGSTTID

SEQ ID NO: 131743 - protein, 116 aa, Triticum aestivum
  Clone ID: PAT_TA_26161.pep
GQGYPRSHRVTSVVAAEGPESDLADGALRMLEVDNRVILPELTHVRFIISSGDVIHSYACPSLGIKCDAYPGRLNQISVMINREGSFFGQCSEICGILHSSMPIVIESISLEKFLS

SEQ ID NO: 131744 - protein, 187 aa, Triticum aestivum
  unsure (1)..(187): unsure at all Xaa locations
  Clone ID: PAT_TA_26162.pep
LXQESCFNDDLIVMRVRSCRSTDIAXVGIRKQSATIISRHIQRCSFPCRLCLPLHLSNTLIPPSLPSNFSTIFRSCTSPLRRREGQIRQGGRLARRKALHGLGDFLQGTSSAWYGRCRGGARAGWTAAWKFGHSGSARGRWPFRENLIREETSKGQHSKADGWRHNGGGGVEALMLSRGTDVESRRG

SEQ ID NO: 131745 - protein, 66 aa, Triticum aestivum
  Clone ID: PAT_TA_26163.pep
NEGTGWMISRIGGLERRVGPSSYMTGGTAASYLNSFCRHPCSSRSMMNTPLRFSLLYQFSRSLAGG

SEQ ID NO: 131746 - protein, 97 aa, Triticum aestivum
  Clone ID: PAT_TA_26164.pep
RGRGRGRPQAGEEAQARGVMSSMHLTNIIFAFTLLTLLCEWEGSRYGVKGFTACGVNCAFMVLAWAFTCNAGNHKIRGWSFARVDAFVARLLLFCSR

SEQ ID NO: 131747 - protein, 210 aa, Triticum aestivum
  unsure (1)..(210): unsure at all Xaa locations
  Clone ID: PAT_TA_26165.pep
XXXQTTXXKRRRDTPRDSKPVDDSETKDGLKGSPTVADETTDKLSTEDQFADNDDRLALVDSAEADADDAISEPHMASDTNEGDHEDHSSKRQKIISKVEQPPRHNNSSDQVDLKTLNSENSRGVRSGSSKDHQKRLESGEEVLQDRRSRRVNDARRHHDGEERDPRRKDVSARDIKPEIERTHLASRGRDDIHHPYGNRDQDVPRPRPR

SEQ ID NO: 131748 - protein, 85 aa, Triticum aestivum
  Clone ID: PAT_TA_26166.pep
EPLKLFMTIAMSVLLLLGGSVHPRNAAACLLPRFVESVHMHKDCCDASIRSRTSSGWSAIVKDRKPASRSGRRRWETRGLSAKAG

SEQ ID NO: 131749 - protein, 150 aa, Triticum aestivum
  Clone ID: PAT_TA_26167.pep
SSGRPGRSQSPAKKRKQKEKTDKPTTADAGTTKPESFQKSTKGQKSAKAMPEGESSSKKPVSMPFLNDSGKRKSPGFLSDKPIHKKQKHERPTDDRRFVGDGSSVGTPFVRNNVKQKQSIAELAALAGKDKLTAGEVRKLLKPEISAKGG

SEQ ID NO: 131750 - protein, 38 aa, Triticum aestivum
  Clone ID: PAT_TA_26168.pep
ESLLLFYKYCYVIISGVKTLVLYRKYIKLYVPARAAAR

SEQ ID NO: 131751 - protein, 131 aa, Triticum aestivum
  Clone ID: PAT_TA_26169.pep
KLYWLVKIHVTGPVGEDDLIWKILLHGIKICYRCWKSVLGAPGMCSCMLGWNFSFESIDEPMASDMPYVYSPTYDRVKTSLIDGDGFLSCWGNCMFRWFFHVRSLQLLDVFFLRCNLVPICNSQIFMSNMI

SEQ ID NO: 131752 - protein, 89 aa, Triticum aestivum
  unsure (1)..(89): unsure at all Xaa locations
  Clone ID: PAT_TA_26170.pep
GKGGRQALIQLLAGLWVSFLHWHWRWYGQRTDTALSFAVVNIITVPQSVVEKKNKIERRRREEEKGPALPQDSVDGLYIHTFVPXXGGR

SEQ ID NO: 131753 - protein, 106 aa, Triticum aestivum
  unsure (1)..(106): unsure at all Xaa locations
  Clone ID: PAT_TA_26171.pep
XVLGRRRRRPRRLRPRCRPLNAPFHTFSFINHAHDLIAENHRTGVHPRAKTTIFYFHGWHIFSTNTMTAALGNGEASNLRLWRLVSYPPGGRPDGGSLGTDSLCVD

SEQ ID NO: 131754 - protein, 183 aa, Triticum aestivum
  Clone ID: PAT_TA_26172.pep
RGRGRGIYRPADYYKFFFRDANAHPAFSLLWHSRCIMRIKVFGWLLMVDRLNTRDMLKRRHFDIGDDHSCLLCGNHDEETVDHMIFTCTFSQACWRKLGISWPPFTCRIQLLQQAKHSWGRPLFFETFLVAAWSHWKERNNKHFRRITPTVGGWLNRFKEFGLLQHRTGSHPAFISSFVSELN

SEQ ID NO: 131755 - protein, 121 aa, Triticum aestivum
  Clone ID: PAT_TA_26173.pep
VRANAVPITEEESRVHRYGVTADDCLAHLELAFKFDALTDDVHGVVGQTYRSDYVNHFDVRASMPTMGGGATFTTSSLFAADCSVARYGVSRGNDGAAVLSELAGVTCASGMDGKGVVCKK

SEQ ID NO: 131756 - protein, 109 aa, Triticum aestivum
  unsure (1)..(109): unsure at all Xaa locations
  Clone ID: PAT_TA_26174.pep
KSHPLFSLVNGYLIDSPQPSNLSYLXNFGSLLGFCLVIQIVTGVTLAMHYNPSVSEAFNSVEHIMRDVNNGXLIRYLHSNTASAFFFLVYLHVGRGLYYGSYKAPRTLT

SEQ ID NO: 131757 - protein, 59 aa, Triticum aestivum
  Clone ID: PAT_TA_26175.pep
HRSRNLGSSFVPLDANPIAAVPPRKNSKRGDSRWVFIEEVVVEEGHSDDGGGTSAATTL

SEQ ID NO: 131758 - protein, 197 aa, Triticum aestivum
  unsure (1)..(197): unsure at all Xaa locations
  Clone ID: PAT_TA_26176.pep
RPVSPTPPPPRERRRRPPPPPPPXPCPSPPSPPPAPTTSRTSYIPTRYSRYSPXPFPSPGLRPATRPTAAALPRASSSPTALRPRSPLPSPSPTSAPPAASSPLLRPYEPQEACTRXPRRPPSFTSTAVPPQRTRPPGQHEPPRXEQSASPRPSPAPRFTPQARIPSSRASSTSASSRAPTPPPSRASSPARPPPFS

SEQ ID NO: 131759 - protein, 143 aa, Triticum aestivum
  Clone ID: PAT_TA_26177.pep
RAAARAGQSIKTRNAAHSQPRIPRPGPRPWACRSIYSGGPGLGHNNIKRLLRRPIRQRILRPIPQILEIPIPIPMRRQSLDPAISALPRTPSLHRLVQKHPRKGSPGTRQIAVPPPPPPRSCNAIHLGHQEVPSSRHLGRDHA

SEQ ID NO: 131760 - protein, 183 aa, Triticum aestivum
  unsure (1)..(183): unsure at all Xaa locations
  Clone ID: PAT_TA_26178.pep
MAGSTAVLAAILLIDLVAFGLAIGAEQSRPSASLETDARKEWTYCVYRPDAATGMAGAALALLLVGQAVAAVASRCFCCGAALRPGGARGCALMLFLSSWLTFLIAEACLLAGLVQSAYHTXYRTVIFENPPDCETVRRGTFGAGAAFALITGVLTGFYYYNFSKARVAYQRPEAAIDMSRYS

SEQ ID NO: 131761 - protein, 68 aa, Triticum aestivum
  unsure (1)..(68): unsure at all Xaa locations
  Clone ID: PAT_TA_26179.pep
SSGRPGRYGRQEQSSYGHQEQSYGXEEQSYGRPEEQSYGRQEESSYGRQEQSNYGGGGRSEYLGRDHA

SEQ ID NO: 131762 - protein, 244 aa, Triticum aestivum
  Clone ID: PAT_TA_26180.pep
MLTPSGPMGQTHWGDAASNTPNPSIHSTDAQLKQELAAVFKKIGDKQTCTIGLYELYRITQLYPKVDIFAQLQNASEAFRTYIRDGLAQVEKNAAAGRTPSSLPLSTPPPIASIPSPKFAPSPVHTKSISSKTDCNEDDAFRVQGDSDLRLQSDQQTDRFQSSAGTLDALRERMKSIQAAAVGGNFDVAQTRPLSSMNGNTLHGGARVDGEPQTQSNIPPMDERALSGLQARMERLKSGSMEPL

SEQ ID NO: 131763 - protein, 126 aa, Triticum aestivum
  unsure (1)..(126): unsure at all Xaa locations
  Clone ID: PAT_TA_26181.pep
SAGPPPRYKSVSAFAPISNPVNCPWGEKAFSGYFGADNKAKWSEHDATELLPKFPNETDILIDVGTGDNFYKQKQLLPENLQEAAKKAGKKVNVRFQDGYDHSYFFISTFADDHVEHAAKYLXRPP

SEQ ID NO: 131764 - protein, 148 aa, Triticum aestivum
  unsure (1)..(148): unsure at all Xaa locations
  Clone ID: PAT_TA_26182.pep
ARPRPGSSSDSPXTLLKSQSPSTTAIMSSADKDKEIQEGNASWFEQDGYRIKAEGYDIKEATEESTNGVNASGEPFESVEVNWNTDNEGSTDASFQEHYGITWWKIAKAPWYSPFTWELTVNVRDTYHYIFADETNTSGGMYLGGGPA

SEQ ID NO: 131765 - protein, 96 aa, Triticum aestivum
  Clone ID: PAT_TA_26183.pep
FERPPGQVPPLATSPRSQAARPTRCSFPAPLVSSVSSRPCSVCSERDKGRTMANLILFVFCGGVFARSMEEHSLILPAVSLVGELNNFGQTRNCID

SEQ ID NO: 131766 - protein, 238 aa, Triticum aestivum
  unsure (1)..(238): unsure at all Xaa locations
  Clone ID: PAT_TA_26184.pep
RGRGRGTSGGKAMAKALKKLTQLRKLGVSGVNRKNSKDIFSAIKGHVHLESLSVQLDKDNQGCCLDDQISLPWKNLRSLKLYGLQDRLPLPSGLEYQQVLSDQFSKLTKMDVEMDTLNEQDIKFLGEAPKLYILRLRIKEPNGPSLNFIVKIDACALAVYKKVKILEIGCSSSSLSVEFGSETMKNLELLKLDCSSGTTYALDGLDFLSELKEVLLIGSNDATFKXNWRTNLANTQRN

SEQ ID NO: 131767 - protein, 506 aa, Triticum aestivum
  Clone ID: PAT_TA_26185.pep
MASISAAAKATSAAFAHKKELAAAAPPQQLARSRRARAGRVRAVATPTRAPRSPASTGSVKSPMTTTEKILARASERASLEPGENVWVDVDVLMTHAVCGPGTGGTLKQEFRDVAEVSDREMLAIFPDHDIFISDERANRYLDVLKEFCEEQKIKYFYDIKDLSDFRANPDYKGVCHIALAQEGHCRPGEVLLGTDSHTCNAGAFGQFATGIGNTDAGFVMGTGKALLKVPPTIRFVLDGEMPPYLLAKDLILQIIGEISVSGATYRSMEFVGSTIESLTMEERMTLCNMVIEAGGKNGVVPADETTFKYLEGKTSVEYEPVYSDAQARFYSDYRFDVSKLEPVVAKPHSPDNRALARECKDVKIDRVYIGSCTGGKTEDFIAAAKVFLASGKKVKVPTFLVPATQKVWMDVYSLPVPGSGGKTCSQIFEEAGCDTPASPNCGACLGGPRDTYARMNEPTVCVSTTNRNFPGRMGHKEGQIYLASPFTAAASALTGYVTDPRDFLS

SEQ ID NO: 131768 - protein, 82 aa, Triticum aestivum
  unsure (1)..(82): unsure at all Xaa locations
  Clone ID: PAT_TA_26186.pep
VPPPRPRRPRSNTNHTXSSKPVKQQLPTCITLAQSATLRSPAERPAARAELLAQTKARKLLQTRPRGHTSKMSESGSCDTAS

SEQ ID NO: 131769 - protein, 173 aa, Triticum aestivum
  Clone ID: PAT_TA_26187.pep
PSVTWYLGAYKRSLLPIYRRTTVVFPVIYVLVPAVALLATSCDSAVLAAVFNALATLIKTTIALAAQVLVLLLALSAAPDAASTGTLIGVISISELFKDLAVGIAGISYYLSDDYSVVIINGALWAILASLVVMGALLTRKLRETPRVGEDLPEECFVWEGVFDVEGGDENGF

SEQ ID NO: 131770 - protein, 212 aa, Triticum aestivum
  Clone ID: PAT_TA_26188.pep
NLCVAADVTTAKELLELANKVGPEICMLKTHVDILSDFTPDFGAKLRSIAEEHNFLILEDRKFADMGNTVTMQYEGGIFRISDWADIVTAHVVPGPGIIDGLKLKGLPKGKGLLLVAEMSAPSNLAHGDYTTAAVKFAEQHSDFVIGFLSGEAAAGAAPAPSPAFVHVVDTGVDVVAGGDSPGQQYETPHLVGQLPFQFCVTTTLSVFFTRT

SEQ ID NO: 131771 - protein, 144 aa, Triticum aestivum
  Clone ID: PAT_TA_26189.pep
KREWFVVKDMCTRKEASTSIQEVSRDDHPFTGNSNHCLLSSRITMLLSHRNKHQPRKAAKQHPSRVNPNCGSVMSCKRSQWAWRRWSAGAGGRRRQYRSSLILQSVVDTELKVCLVLVRYCCCCCPRECGSTYNICCTSAATTL

SEQ ID NO: 131772 - protein, 146 aa, Triticum aestivum
  Clone ID: PAT_TA_26190.pep
FTCAKGAPKAVLNLTECSKETADMFKDKATEFARRGFRSLGVAYQKNNDPWVLLGMLSMFDPPREDSAEAAEEAQQLGVPVKMLTGDAIAIAKETCKMLALGTKVYNSQKLIHGGLSGTTQHDLVERADGFAEVFPEHKYLGGGPA

SEQ ID NO: 131773 - protein, 61 aa, Triticum aestivum
  unsure (1)..(61): unsure at all Xaa locations
  Clone ID: PAT_TA_26191.pep
SSGRPXGTQRQSIGRSPQRSRSSRPPRSHQSRSWCRSRSRKKWRCIQRGSSCLGTSAATTL

SEQ ID NO: 131774 - protein, 156 aa, Triticum aestivum
  unsure (1)..(156): unsure at all Xaa locations
  Clone ID: PAT_TA_26192.pep
AWSRPRSAEVHEFLSKGKSNLETLAGFITDRSGGFLHLMGYMNKLSKLKILCESPAGCADRTDLKEAIQQFIEDEKQANIGSRSLSLHFSKCCEELLNSLKGPCYLSSLKLHGDLAALPQFVVSLRGLKELCLSSTKLTTGVLEALSNLSYLQYXL

SEQ ID NO: 131775 - protein, 190 aa, Triticum aestivum
  unsure (1)..(190): unsure at all Xaa locations
  Clone ID: PAT_TA_26193.pep
MCGGAIISDFTPERDHRGGSKRGLCTADFWPHAAAFDDPTDHHDFYPDELTXPARSLPSTERQEEPSRKRERKTMYRGIRRRPWGKWAAEIRDPAKGARVWLGTFATPEGAARAYDRAARRIRGTKAKVNFPNEDPPLDLDDYDVANVAGFIHQPSYMAPEVAYAHQLPQQDEPGMELWNFGNINAQVPM

SEQ ID NO: 131776 - protein, 173 aa, Triticum aestivum
  unsure (1)..(173): unsure at all Xaa locations
  Clone ID: PAT_TA_26194.pep
PRAXRGRTNQYRGIRQRPWGKWAAEIRDPVKGVRVWLGTYPTAEAAARAYDRAARRIRGAKAKVNFPNKILVDGPAHEASCTMAAPPAAVLPSPKKEEEGEGLEHAACSCEEVKALSEELMAYENYMSFLGVPYMEGGTAATAAPAAFGVAAEEAPAELWSFEDSYYPGPLGL

SEQ ID NO: 131777 - protein, 172 aa, Triticum aestivum
  unsure (1)..(172): unsure at all Xaa locations
  Clone ID: PAT_TA_26195.pep
MCGPAVTFDPSPAPPRPASTARLWPAACPQSDACRAAPATAPRTKRERXKTMYRGIRRRPWGKWAAEIPRDPAKGARVWLGTFATAEGAARAYDRAARRIRGTKAKVNFPNEDPPLDLDDYDVANVAGFFHQPSYMADAAAPATEVAYAHQLPQQDEPGELWNFDNINTQVI

SEQ ID NO: 131778 - protein, 120 aa, Triticum aestivum
  unsure (1)..(120): unsure at all Xaa locations
  Clone ID: PAT_TA_26196.pep
SSGXXXXVQPPPGRYYRTPHESSSISLPPSLSTSSSPLSAVILCDVVALFIALQTPAPPLPSRASRIPRRGRWRRRIHNSGCTGELNPLPPPAVAAELPAGISSANRSAMFASYLGRDHA

SEQ ID NO: 131779 - protein, 342 aa, Triticum aestivum
  Clone ID: PAT_TA_26197.pep
MASGSAAARRLLLLRHRRRHLVPNHHFSSSSADEVLDGGRVKIFDRDLKRRHRDRAAWAMRETDPLVDAVADNLLDRLEDCRKAFPSALCLGGSAGAVRRSLRGRGGIEKLTMMDMSVDMVNKWRELESATDDGPEMNFIVGDEEYLPMKENSQDLIMSCLGLHWTNDLPGAMIQCRLALKPDGLFLAAILGGETLKELRIACTIAQMEREGGISPRMSPLAQVRDAGNLLSRAGFALPGVDVDRYTVKYNSALELVEHLRAMAETNALFQRSPILKRDTALATAAIYQSMFGLEDGTIPATFQVIYMTGWKEHSSQQKPKRRGSATVSFGDIRKQFGSNQD

SEQ ID NO: 131780 - protein, 135 aa, Triticum aestivum
  Clone ID: PAT_TA_26198.pep
AWSRPRYYEKQWEHFQMSGQGPYFGQKAWFTHFHSEKNITSAIDRYGNEIKRVLSVIDLHLKRTGQPYLVGDKVSYADLMFVPWNMMFGFIMSEEFDQEWKSSYPKCYEWHQKLIARPAVKKVLDTKAAKLAESK

SEQ ID NO: 131781 - protein, 338 aa, Triticum aestivum
  Clone ID: PAT_TA_26199.pep
MARASSSSLSMGVVAALAVLVVLCAAVRAAAQGKTGPPAPKLSSNSHAIHPGRFGKRAQVLSCDDEKDSNNPCVATCDKVRCPNECVVMCPGCNTYCMCDFYPGVSCGDPRFTGADGNNFYFHGKKDQSFCVVSDADLHINAHFIGKRNPTMSRDFTWIQALGIRFADHRLYMAAQKTVVGHRDIDRLELAFDGMPIDIPTGNDAQWQSTTVPTLTVTRSAATNGIRVQLKGVFDILANVVPITEKDSRIHNYGVTEEDSLAHFDIGFKFHAFTDDVHGVLGQTYRTDYVNKLSVTANMPIMGGAASYVSSDIFSTDCKVARFGRSRGAISMTTTKAS

SEQ ID NO: 131782 - protein, 90 aa, Triticum aestivum
  unsure (1)..(90): unsure at all Xaa locations
  Clone ID: PAT_TA_26200.pep
SEGXXXXGTAYRIEMLELSSFTSISNHKTCAKSRSNGIRKIARNRRITQQRTSGKTNRIMDQILHSPACPCPAGGPARWYEGEGHQWVGS

SEQ ID NO: 131783 - protein, 109 aa, Triticum aestivum
  unsure (1)..(109): unsure at all Xaa locations
  Clone ID: PAT_TA_26201.pep
SVVAAEVLLTTIIMPISLLSNXSSISENIKSYVIIILLLETLLLAVFLVLDILLFYIFFESILPPLFILIGLFGSSNRVRASFYLFLYTLLGSLFLLLSIXYDIYNGSP

SEQ ID NO: 131784 - protein, 219 aa, Triticum aestivum
  Clone ID: PAT_TA_26202.pep
LIVNYDSGRILTAKSTRRSLVLVPVVQSKRCRACARSRASCPWRPSRSPPQPGRWWRRRGSPAIRPAAAPVLENGPPAPTTAQQGPAAPPGSATDRDAVLAKVEMNRKLSMVKAWEENQKSKADNRAEHKMSSILSWENTKKAAVQAKLRTREEKLERKKAEYAEKMRNRAAMIHKEAEEQRAAVEARRQEEMIKCQEMAAKHRSQGTTPAKKFLGCFG

SEQ ID NO: 131785 - protein, 50 aa, Triticum aestivum
  Clone ID: PAT_TA_26203.pep
RGRGRGTISLHPPPSSSISPPPPPTKTPNPTHSQHSTPQPSTPSSAPAYS

SEQ ID NO: 131786 - protein, 151 aa, Triticum aestivum
  Clone ID: PAT_TA_26204.pep
QRPAHLAPCPGGLIVVPGRPDRHRRAQKRREAADESQATDPPPENRPSAMSDGQGNAPPGGYFIGRPANTDETNEKEPPQAVAEPAPGCAGYFLVITSSAVRENQRQNTETPAPKPGFFGQILSMPQAVVKLPARPTGPAAVRRARDHGRI

SEQ ID NO: 131787 - protein, 70 aa, Triticum aestivum
  Clone ID: PAT_TA_26205.pep
STGPPPRYCRGFQVFDKDLTGFIGVGQFRYILTNLGEKMSDDEVDELLKAVDTSSGELNYMDMVKMILQN

SEQ ID NO: 131788 - protein, 51 aa, Triticum aestivum
  Clone ID: PAT_TA_26206.pep
SSGRPGRYKNQEEWLTKTITSVARMGLFSSDRCIDEYAEMIWNVEPLAPKD

SEQ ID NO: 131789 - protein, 95 aa, Triticum aestivum
  Clone ID: PAT_TA_26207.pep
RPAPRPGTISPSLVDRVGLGAHAARIEPLRLALALVDMLETRAGVIPRRALPMMVLSGHRSSVMALGFKARRCLVRQKSTRLATGIETIMIFQKG

SEQ ID NO: 131790 - protein, 91 aa, Triticum aestivum
  Clone ID: PAT_TA_26208.pep
RPWTHEQVEILADLSRNMDQRMSYLSREIRHLRSDLGQVMQGIGEIREALARMERQNPCFPPMNRCNKPWSKCTWQFRIFISYLSILCCNE

SEQ ID NO: 131791 - protein, 219 aa, Triticum aestivum
  Clone ID: PAT_TA_26209.pep
ISSEESLRDKTLSVWYTRPPFRMHHSAKRLMEFELDEELEGWRGELLKLLVTYGSDGGYFIETEAGSSPGFDVKVDGGSEHDFRVEVGGVPTDVTIAFYSKDNSKHIHIWHGKHHHHYRQTMRAEHLLDDSSQPSQASEGRSHPKGSVLAPMAGLVVKVLLKDGVHVENGQPVMVIEAMKMEHVVKAPRAGYIEGLKATAGQQVFDSSVLFTVKDKSTS

SEQ ID NO: 131792 - protein, 68 aa, Triticum aestivum
  Clone ID: PAT_TA_26210.pep
RMRRMVCGGAAAEVLLQLHTTLANDSRQSIPSRQRHSDIDRLLIRAGSIVSQNQISNPRWPTCPGGRS

SEQ ID NO: 131793 - protein, 271 aa, Triticum aestivum
  Clone ID: PAT_TA_26211.pep
MLLRSSSTPFLRSFLTSSSSPSPPSSLQLRRAFSDGHLPSLNPSSSGDNDSNRTTGLHTELSFSIYNTFSKAKLEPHQEQEMEEEQEQTAQPELPELPLFLARGMGIDRLASGLFTAGMGSEAALARMASGVDQKAVLALDAQYKEMVDEQPGNALFLRNYAQFLHEVKCDPRRAEEYYSRAMLADPTDGEIMSQYAKLVWAVHRDHERSLTYFQKSVQAAPRDSHVLAAYASFLWEQDEDDDNDDGGVGGGEQGAPGRAAQPRQLSSAAV

SEQ ID NO: 131794 - protein, 181 aa, Triticum aestivum
  Clone ID: PAT_TA_26212.pep
MLLDFARKSMPVIGYNHSGASGALCACLAAVVCSSHLCCLRPLGSSAGEGAALISKARLDRATELRADPHSAANYSRSTRSLWQASFDAFFGLLTKYCDSKYGSILQRFSMQGSNSMAGPEASKAVSREMPVELLRASLPHTSEEQRQMLLDFARKSMPVIGYNHSGASGGHSTTSEPVPG

SEQ ID NO: 131795 - protein, 189 aa, Triticum aestivum
  Clone ID: PAT_TA_26213.pep
SVVAAEVIHPITRYVMNYLRLLVVYSDTLDKLLDEDAAGDADHNASNGGADDDEEYLQSLTPLGHRLVKLMSYLEANLEEKSKLYEDGALQCIFSMNNTLYIVQKVKDSELRRILGDHWTRRRRGKIRQNSKSYLRISWTKVLSYLKDDGHGSGSVSLGNSSSRVKEKFKNFNFAFDEIYRSQTLWKVP

SEQ ID NO: 131796 - protein, 97 aa, Triticum aestivum
  Clone ID: PAT_TA_26214.pep
MAPAATGGKKQKKKWSKGKVKDKAQHNVLLDKATNDKLQKDVQSYRLVTVAVLVDRLKINGSLARKCLADLEEKGVIKQVVNHHACKIYTRAVGGAD

SEQ ID NO: 131797 - protein, 92 aa, Triticum aestivum
  Clone ID: PAT_TA_26215.pep
RPAPRPGTPLLRATRATLHATRSTYLRSGRTPSWWALTASCLPRSCSQIGSATRVETLLATSLRSRMLSRMSLAARITGRSKWSSLIERSID

SEQ ID NO: 131798 - protein, 146 aa, Triticum aestivum
  Clone ID: PAT_TA_26216.pep
VFWGLLLFMLVATTMAVEYGARSHNSGPWSWCDPATGYKVSALTGCRAMVKLQCVGSQVPEAVLRDCCQQLADINNEWCRCGDLSSMLRSVYQELGVREGKEVLPGCRKEVMKLTAASVPEVCKVPIPNPSGDGAGVCYWAAYPDV

SEQ ID NO: 131799 - protein, 151 aa, Triticum aestivum
  Clone ID: PAT_TA_26217.pep
MWMKTVFWGLLVFMLVATTMAVEYGARSHNSGPWSWCDPATGYKVSALTGCRAMVKLQCVGSQVPEAVLRDCCQQLADINNEWCRCGDLSSMLRSVYQELGVREGKEVLPGCRKEVMKLTAASVPEVCKVPIPNPSGDRAGVCYWAAYPDV

SEQ ID NO: 131800 - protein, 82 aa, Triticum aestivum
  Clone ID: PAT_TA_26218.pep
NPSQILSHPPNSPDRPDFAVVVVARADEVVEDAPPTTVLTTETSPPRRLPPPAAALLVVTCPGGRSSVVGRTAAGPARAAAR

SEQ ID NO: 131801 - protein, 126 aa, Triticum aestivum
  unsure (1)..(126): unsure at all Xaa locations
  Clone ID: PAT_TA_26219.pep
FVRCKSKEIKKFAYTISSTTDFDALYKTNFNFITQLYHRTGIVIAFAVKTPTIFLNTXLLKAHVESPLGGSIILAGIVLKLSLYGILRLILPLLPKAYFYFTSVIYVIGVITIIYASFSTSAATTL

SEQ ID NO: 131802 - protein, 69 aa, Triticum aestivum
  Clone ID: PAT_TA_26220.pep
GRPPAQVLIVLLTSLLLSRELFNLLYRLCMNSAGPSNSSGGATGGNTGGGGGSGPGGQPPHSTSAAPPL

SEQ ID NO: 131803 - protein, 73 aa, Triticum aestivum
  Clone ID: PAT_TA_26221.pep
ADKFQFNPITYTTSYAVAPHVPQDPKRQANLTNRSPCAKHSYAAHVQSSGHDSSQECPSLIRQADSERKATGW

SEQ ID NO: 131804 - protein, 179 aa, Triticum aestivum
  unsure (1)..(179): unsure at all Xaa locations
  Clone ID: PAT_TA_26222.pep
LIYIQLQYTQSTTLCNISTSTPSNQAIRSLFDKPHQNATXXPPPKPPQKLLNQQHALLFLVLLIINRGNPHGHDAPDGSAGVPLRRLGKEPPTKTTRQMQASSCSAKASGERVNESIVTNGKDFVMERETAKHDPFGASCSTERGSLELDALAIESDGIEHEEFLVVENKSTALWGGMK

SEQ ID NO: 131805 - protein, 449 aa, Triticum aestivum
  unsure (1)..(449): unsure at all Xaa locations
  Clone ID: PAT_TA_26223.pep
MDFKLQDIEAITNNFAEDQIVGSGGYGVVYRATHEGEEIAVKKLRQLQGLDDKQFDNEFRXRNIRHINVVRLIGYCHQSCKKYMEHKGELIFAKEMERVLCFEYMHGGSLDKHIQDESCGLEWPTCFQIIKGTCEGLDHLHTSQGKPIFHLDLKPGNILLDESMTPKIGDLGLSRLVASTKTRQTEMRDGTLGFVPPEYIKGGFISKKFDVFSLGVIIIKILAGEKNYIRCSEMPPEKFIQLVSENWTKKLQEKTGHSSHEIDILGVTSCVGIALRCVDEDRNKRPCIKDIVHELDQLEAKLKAMSLAFDVSKDLTVQRSCDTNILSVDPTMELRFPFEQGKEASCCLQLTNKTGGFIAFNIEINPNKYSVRPSQGTMPPCSRCYVDVTLSAQEAEPPDMRCEVIILEQEDGGRRDVGEIKYQELFETAIAHQVIDVMQLPIAYITLDD

SEQ ID NO: 131806 - protein, 100 aa, Triticum aestivum
  unsure (1)..(100): unsure at all Xaa locations
  Clone ID: PAT_TA_26224.pep
AWSRPRYDFTSWMPYLFGALWVLTLCGFMTMFFPQTKGVELGYGXSLRALIFSAYILVDTQLIMRHYHVEEEIAAAISLYLDVLNLFLAILRILNSHQNN

SEQ ID NO: 131807 - protein, 79 aa, Triticum aestivum
  Clone ID: PAT_TA_26225.pep
LDSSSVLQIFSECMSSSRPPCPSYQNTAYSIFSSAYELLIPIGSNGKQAAVIAMTIYNAAHKKIGTDVAVSAYLGRDHA

SEQ ID NO: 131808 - protein, 75 aa, Triticum aestivum
  Clone ID: PAT_TA_26226.pep
KPECCHPCREESIDSTTYSNSSILPSTSQTLALLIHEPIVPLPCSMWSVPCHANSIAIPCCDAYILIPCRGSTPV

SEQ ID NO: 131809 - protein, 460 aa, Triticum aestivum
  unsure (1)..(460): unsure at all Xaa locations
  Clone ID: PAT_TA_26227.pep
MGIGDASPSENQSAHKEKRDETTPLLPVKAEEEDGIHEFNGASFSGAVFNLSTTIVGAGIMALPASIKMLGIIPGILMIILVALLTEASIDMMVRCSHQAKITSYGWLMGDSFGQWGRIVLQASVVINNVGVMIVYMIIIGDVLSGTSTTGVHHRGIFEGWFGPHFWNSRAVVLLARRAKEMARQGRAQRAETVRTPSAPAVGLGVGSWCQARGRGTTPERTSGGRGGRNTSGLNMERNSIWELFTSCXPFLVTAYICHYNVHSIATRPEDRSQTKPIVRTSLALCSSVYVATSFFAYLLFGEGTLSDVLANFDSDLHIPFSSVFNDIVRVSYVVHVMLVFPIVFFALRLNLDGLLFPTSRHISHDNRRFIIITVSLLAVIYLAANFIPSIWDAFQFTGATAAVLIGFIFPAMIILRDSYGIATKRDKVLAVTMIVLAVLSNSVALYSDAMSIFYRKVEA

SEQ ID NO: 131810 - protein, 87 aa, Triticum aestivum
  Clone ID: PAT_TA_26228.pep
FAIWNWCRCLTDLSQPSRLILAPNCFDALFSCLMGRWLQVLIDLFRSTLMWSYLFEDLLNPTPFQFIAICSTYKLSYGDNLNIQIYF

SEQ ID NO: 131811 - protein, 141 aa, Triticum aestivum
  unsure (1)..(141): unsure at all Xaa locations
  Clone ID: PAT_TA_26229.pep
MGMGSNKRSSATVVVSCVVLGVALLVVGAQGXEGEKEIGGIAAPPTCYERCRHEPKEDIDACVKRCRKVEARGGGGGGGAGLLAMPTERAGREVEEKKKQADAAPVQLGYDPEFCSFMCRHIHDKGDCLQKCEAGPNEARG

SEQ ID NO: 131812 - protein, 52 aa, Triticum aestivum
  Clone ID: PAT_TA_26230.pep
SAGPPPRYPPLGRFAVRDMRQTVAVGVIKSVAKSANTGGKVTKAAVKAGVKK

SEQ ID NO: 131813 - protein, 215 aa, Triticum aestivum
  Clone ID: PAT_TA_26231.pep
YSVDIFNAAGRPRPYPVPCQFITIGDGSKNPNYDDIISRIATNALDAAVGDFAIVRNRTKIAEFTQPYIEAGLVIVAPVRKANSNAWAFFKPFTLEMWCVTGTLFIFVGVVVWILEHRSNEEFRGSPRRQILTIFWFSFSTMFFAHRENTVSALGRFVLIIWLFVVLIINSSYTASLTSILTVPRPPPRLTGLDNLVASALPIGYPAGKFVRNYL

SEQ ID NO: 131814 - protein, 244 aa, Triticum aestivum
  unsure (1)..(244): unsure at all Xaa locations
  Clone ID: PAT_TA_26232.pep
VTVDVFLELVVNISELSHPNILALVGYCAEFEQRLLVYEHCSKMTLHDELHYVDEPSNALSWNARLQVAVEAAKALQYLHDGRQPPLVHQNFEPSVVLLNSTLAVQISECGLASLSQLSGSLHALFHYEAPEVHESRSFSDRSDVYSFGVVMLELLTGREPYDXSRPRAEQHLVRWASTQLYDIDAISKMVDPLIRGQCSEKALSRFADVIGSCIQPEPEFRPPMSEVVQALTRMVSDATKASM

SEQ ID NO: 131815 - protein, 332 aa, Triticum aestivum
  unsure (1)..(332): unsure at all Xaa locations
  Clone ID: PAT_TA_26233.pep
MRVVVTGATGYLGGRLCAALAGAGHDVRAFVRRTGDASGLPDAVELAYGDVGDADSLAAAFDGRDAVFHAAASVEPWLPDPSVFTAVNVRGLENVLTAAKRTPTVKKIIYTSSFFALGPTDGYVADETQMHKGKTFCTEYEKSKVLADRIALQAAAEGVPITIVYPGVIYGPGKLTTGNLVSRXVVAAXGGRLPGYIGDGYDRESFCHVDDVVSGHIAAMEKGRVGERYLLTGENLSFMHIFSMAANITNTKAPYLPGRPLEIEIYGWISVFISRITGKLPLISYPTVRVIRHQWAYSCEKAKRELGYNPRNLTEGLAEMLLWLKNEKLIKF

SEQ ID NO: 131816 - protein, 92 aa, Triticum aestivum
  Clone ID: PAT_TA_26234.pep
GDRSKSVLFDACRLAGQLRGMEVRKRWRLVAGVWVEMMCYAAGKCRGNFHAKQLSQGGELLTVLWLLMGHLGIGDQYRVEAGHARAKLMVHN

SEQ ID NO: 131817 - protein, 605 aa, Triticum aestivum
  Clone ID: PAT_TA_26235.pep
GTRVFRESFVKSGKDVSIKESVNGISNNSGTSALSNSDSTKMPVKTSITNFDGDSERKYASTSHDKVNSTQLASVGSSSSTGKKKQPVISDNNVPIERTPQLNADHFQLKEDQGSSRASSSAQNKGSMETLSSDISQLSIERNNVNVAQPLPEEYKPEGWMLADQESGVLSQLNLAIVGHVDSGKSTLSGRLLHLLGKISKRDMHKNEKEAKEKGKGSFAYAWAMDESTEERARGVTMTVAVAYLETKKYRVVLLDSPGHKDFVPNLISGATQADAAILVVDASTGSFESGMDGEGGKSVGQTKEHAQLIRSFGVEQLIVAVNKMDAIGYSKDRLEFIKVRLGSFLRSCNFRDSAVTWIPLSAVENQNLIKSPSDARFTSWYQGSCLLDAIDCLQLPSRDVSKPLILPICDVIKSQSTGQLAAFGKLETGAIRNGSKVLVLPCEEVATVKTIERDSSSCSIARAGDNVAVILQGIDGSRIIPGGILCHPGFPVPVANYLELKIRVLDIAIPILIGYQVEFHIHHVKEAARVTKIVALLDKTGKPSKTAPRFLKSKQNAVVQVTLDQAVCVEEFSKCRALGRAFLRSSGSTIAVGIVTKIMRQDQH

SEQ ID NO: 131818 - protein, 72 aa, Triticum aestivum
  Clone ID: PAT_TA_26236.pep
RGRGRGTLRTIDVKELIAYSSVSHAAVYLLGVFSNTIQGIEGGIVLGLAHGFVSSGLFICAGGVLYLPGRPL

SEQ ID NO: 131819 - protein, 201 aa, Triticum aestivum
  unsure (1)..(201): unsure at all Xaa locations
  Clone ID: PAT_TA_26237.pep
GMGSTKHGVVWCAGLLVAGLLLVAAEADLCSKDCHGKTHFLGCVGRCRSQLEVARPTNCIALCHGKPSFIACCNGYRYARRAPMQLRWPGGESTRHEEEAGGGAVGVLKAPAPAPCEVVCRDRVGWVEYERCLDRCRWGAFVQRALLLHLKLTGRESATHEEARGGGGAVDVLAAALSSFCGDYCRAEEPNVDYRYCVRRX

SEQ ID NO: 131820 - protein, 122 aa, Triticum aestivum
  Clone ID: PAT_TA_26238.pep
AWSRPRYGAYGDPTADTFPGNGLETRGFNASFAFFLVFMGVLCFLYMILALRTNLVFFLIFLFLTPSFGLLAGAFWLLAEDFDPVSPNTKNAATAKTCIIAAGATTFVVDMLGWYLPGRPLE

SEQ ID NO: 131821 - protein, 125 aa, Triticum aestivum
  Clone ID: PAT_TA_26239.pep
RRGSGRVGRDIKDPEHPYSLEQLSVLSQESVSVDDKLGHIQITFTPTVQHCTMATVIGLCLRLKLMQNFPPHFKIDIKVAPGSLANEESVNKQLNDKERVAAALENPNLRQLVDDCLCSDHPSSY

SEQ ID NO: 131822 - protein, 122 aa, Triticum aestivum
  Clone ID: PAT_TA_26240.pep
MTSMTFFLIFVPILAIVLLTLNLILAPHNPYEEKDSAFECGFHSFLGQNRSEFSISFFIFALLFLLFDLEILLVYPFVVSAYVNGIFGLIVMLIFFLVLTLGFAFELGKNALSIESRQTHNS

SEQ ID NO: 131823 - protein, 222 aa, Triticum aestivum
  unsure (1)..(222): unsure at all Xaa locations
  Clone ID: PAT_TA_26241.pep
VNIWXKXGGLAAMLLAYYLLSNGWATRTNSPLYSFGSEPLEKATETTGMKEMVLPITAGILSALRRVLARRVSLKNQLKRRLHAITVASATCFLFPFAMWDTILGSTSDSIVKMQLPSWAYLSTVLFGMVLIFYVDNVAEESLHLVFSSPRHLVVSTGCIIILEILYKMDFSLPGLLLCSVILGFGILEATSLDRSKKRPLEAHEPSNGSLHNQLRISELPM

SEQ ID NO: 131824 - protein, 38 aa, Triticum aestivum
  Clone ID: PAT_TA_26242.pep
QDEILLMNCNYSFLFSSFHLVTPASCYTFCCTSAATTL

SEQ ID NO: 131825 - protein, 79 aa, Triticum aestivum
  Clone ID: PAT_TA_26243.pep
SSQHPHLHYYYPHPPPPPPALLSCLLAQPTPGHHPQLHSSAYHPTSTSSPSPTLPPHRHHHHQAEPEPSPQSYLPGRPL

SEQ ID NO: 131826 - protein, 69 aa, Triticum aestivum
  Clone ID: PAT_TA_26244.pep
YYKNRGIVLENNHRKIRPPILPESSTLIIRSCSSSLLLLSSSILRRLWQRLVVSACALALSQHLGRDHA

SEQ ID NO: 131827 - protein, 48 aa, Triticum aestivum
  Clone ID: PAT_TA_26245.pep
SLITSLVYFRILQLLSKKTCHAMDIIIRIMFPLALALALLLPPRPRPR

SEQ ID NO: 131828 - protein, 133 aa, Triticum aestivum
  Clone ID: PAT_TA_26246.pep
AWSRPRYGRGLVPAGASNGRSQNGGGSSNGRSQNQGGQTNGRSQSQGGQTNGRNQNRGGQNGSGEDEENNNGGSSNGRSQSRGGQNGRSQNQNRGGQNGSGDNEENNNNGGSSNGSGDDGDSNDGSDGGSKKE

SEQ ID NO: 131829 - protein, 163 aa, Triticum aestivum
  Clone ID: PAT_TA_26247.pep
MGFFRRIAGIFGGSRDDADHHHDAGGGGGGGGDVPHEKVAAAAAAAAASGHATRRGFSVQVPVPVDRPAAGPVLAPCPAGDGGVQGFRWYTRRLRIDEDGDVADEFLDEVLPESSNNSDASPAGRFQVKYNTRPTALAMRKQTVAVDGDIRHCVEHQGQLQWV

SEQ ID NO: 131830 - protein, 230 aa, Triticum aestivum
  Clone ID: PAT_TA_26248.pep
MMHLGALPYAIKHLGLSAPVYATEPVFRLGLLTMYDYFLSRWQVADFDLFSLDDIDAAFQNVVRLKYSQNHLLNDKGEGIVIAPHVSGHLLGGTVWKITKDGEDVVYAVDFNHRKERHLNGTTLGSFVRPAVLITDAYNALNNQVYKRQQDQDFIDSMLKVLSSGGSVLLPVDTAGRVLELLLIMEQYWAQRHLDYPIYFLTNVSTSTVDFVKSFLEWMSDSISKSFEHT

SEQ ID NO: 131831 - protein, 119 aa, Triticum aestivum
  Clone ID: PAT_TA_26249.pep
AWSRPRYKARLATCEIFAVKKIRTIEDEYGVNESMFNREIGALVQIRHRNIVKLFGYCSSSQGRFLIYEYMERGNLAETLRTNKRAIELDWKRRVNIVLDVIHALAYMHHDCTCPGGRS

SEQ ID NO: 131832 - protein, 66 aa, Triticum aestivum
  Clone ID: PAT_TA_26250.pep
LFFLRGTITAESYVVQLRILTMLRSHHFCPQQTLKFELGAFFFLFKLLKVFHNNLPYLHGMYIFSV

SEQ ID NO: 131833 - protein, 44 aa, Triticum aestivum
  Clone ID: PAT_TA_26251.pep
RGRGRGTNSWCELSLLDMNYSTCVVTMMIVGFLMVELIIDQPLH

SEQ ID NO: 131834 - protein, 55 aa, Triticum aestivum
  Clone ID: PAT_TA_26252.pep
ARFRFTLGQAKDELLRVFGLQKKVGSQLEFLRRGYKNVTWWEKNFDQEKSPAWRT

SEQ ID NO: 131835 - protein, 79 aa, Triticum aestivum
  Clone ID: PAT_TA_26253.pep
RAAARAGLREYALANSLYWALAEGHACEISARRNAMDNASKNAGDMIDKFQILYNRTRQAVITGELVEIITGAAASEDS

SEQ ID NO: 131836 - protein, 86 aa, Triticum aestivum
  Clone ID: PAT_TA_26254.pep
SVVAAEVVRSRLDTESSPLCSPITAGYRILSAMHSFAAEPNKTRILEEISEAKLPDTENRKRYNVEPNASHISSVPLGKHRLIMYQ

SEQ ID NO: 131837 - protein, 92 aa, Triticum aestivum
  Clone ID: PAT_TA_26255.pep
LWQEGVRKLAFIAPSIRPSPQHLRIYHSRASIASFASSAGSGSISVSKSPESIVDQTAIDLFLSSGSPPVVAPCCNVREQTCRISTCPGGRS

SEQ ID NO: 131838 - protein, 174 aa, Triticum aestivum
  Clone ID: PAT_TA_26256.pep
MSHEALTNHRARAPMAGTTTTSGGGGGAAQGGRRALGLLASAAKRKDGFVQLLLMSGILMMSLRSLSQKHRVRDLANDAAELSLEAGAHLPPHARASGRARPRGRRPTPRARSPPTSDASSPLTLPPPPPPPPPPPTTTSSLVSVQIVAARLVLRRLRPCLLFVISVLALCRCF

SEQ ID NO: 131839 - protein, 70 aa, Triticum aestivum
  Clone ID: PAT_TA_26257.pep
RAAARAGRNAGGPRIVQLSARKVLALESVRSREECRILPREDAGGCRGKEIETTAAIYARNDFTNCQKKK

SEQ ID NO: 131840 - protein, 135 aa, Triticum aestivum
  Clone ID: PAT_TA_26258.pep
RARAGGVFKHYPTAHFHSNTHECYAVLSGETECLYGVGTLDSPSTSPGVTFSLSAGDIAVHAAGVAHRNVASSPDYEYVGVYPKGSPKWDNNFCKTDLDTTKEITAKTEGVPVPEFDPVFGRGGPLVRLWGGGQK

SEQ ID NO: 131841 - protein, 158 aa, Triticum aestivum
  unsure (1)..(158): unsure at all Xaa locations
  Clone ID: PAT_TA_26259.pep
SVVAAEVSFLYLLLFQDYIPLWRCWTLHDDSIQSGKEPILNSALLLESYEEEWRSSRVELSTSSGKGTGYLSNPKPCISTNKCIQWTAPIDEXVAKLNSDAAFDADSGQSWAGVIARDHRGHLFLSVSKELPRSTSVEEAEGRATLPGLHALAAVAKN

SEQ ID NO: 131842 - protein, 541 aa, Triticum aestivum
  unsure (1)..(541): unsure at all Xaa locations
  Clone ID: PAT_TA_26260.pep
TRPVRVIETADGVPREADGRPPMFSPAQEALLMVHRRILETQPDDGDEDGEYGPRGKDARDRGKVTTRLIVPRQHVGCLLGKGGKIIEQMRSETKTHIRILPREQNMPRCVSLSEEVVQVVGEGNCVKKAVAIISDRLKESLHRDRGPFLRGRNSPEHRISQADEYLGGGQQMPAFEEPYPRFDQIRNNGSMEPPGYEFDSNGSKFNEHPEIPFDEIIFRILCPNDKASSLVGSRDGIIDMLQAEVGVDVRLTDLIAGSDERTLIITSREGPDHELFPAQEALLHIQTFIVDLGPDKDNIITTRLLVPSSEIAXXRGRDGSLSDIQRQTSANIQILPREELPSCALXSDELIQMVGEIRAAPNALMQVTSKLRXYIYREMSAPIQMGSLNVHGSISPAKGSPRLYAGNDLPMPIYQQAPQMATSWHSKDSGLSASGSFEQGSSINDDIRQTNTKRFAVPLVTRSTLEVVIPQSAVASLSMRAGSKLAQISEMSGASVTLAEDRPGVMEKVVRISGTPEQADKAQSLLQGFILSIQDDIPSG

SEQ ID NO: 131843 - protein, 120 aa, Triticum aestivum
  Clone ID: PAT_TA_26261.pep
MERTPRAILFLFLLLLVDPGVAQNTTTGKADEFHVGVILNLGSLVGKVARTSISLAVKDFYAVHQIYSTKLVLHFRDSMASDVKACWLPAGPPGAGWGDGLLQPSRRRVGEPRHAEEPLR

SEQ ID NO: 131844 - protein, 136 aa, Triticum aestivum
  Clone ID: PAT_TA_26262.pep
MQCISAPKNLKLAVPHGMERTPRAILFLLLLLLVDPGVAQNTTGKADEFHVGVILNLGSLVGKVARTSISLAVQDFYAVHQNYSTKLTLHFRDSMASDVKAASAGMCLAGCRQARRAPDGLLHPSRRRVGEPLSAA

SEQ ID NO: 131845 - protein, 121 aa, Triticum aestivum
  Clone ID: PAT_TA_26263.pep
RAAARAGTKYITLDICASVLPLASNLLESGYDRHLNVALAMILNLVKSFRASIFSTLSSTPPACVDLEAEHRLERCSICFQELEKINASLISLTRREGKVGRSARELSLLLQDIFKTPSSV

SEQ ID NO: 131846 - protein, 77 aa, Triticum aestivum
  Clone ID: PAT_TA_26264.pep
AWSRPRYQQYLAAKALKSQSWRFHKQYQTWFQRHEEPKNITEEFEQGTYRFFDYESTWMNRRKADFKFAYKFLEDDL

SEQ ID NO: 131847 - protein, 101 aa, Triticum aestivum
  Clone ID: PAT_TA_26265.pep
MHNPSSNSHGSTSAPSLQHEQSVCSVSSTTVPLNEDVANTVPPLNGIKIFIIHIKDTLKDGPHVSERILAELQEHEARLQEMGHGLGCEFVISQSGESYWF

SEQ ID NO: 131848 - protein, 88 aa, Triticum aestivum
  Clone ID: PAT_TA_26266.pep
KHATHTIHHDSYSIPPTPFDSDISQHLRRLGAAGTSALASLTRTLALVTAAVALGLLLTSDGHLLHLGLLGGDIARLRPGRPLGRDHA

SEQ ID NO: 131849 - protein, 63 aa, Triticum aestivum
  Clone ID: PAT_TA_26267.pep
SSGRPGRCPPKPPSAQPNPQPKRRIGPEISIPPAPANKSTTPPPLTLLFSLSSSPPLPPPPRK

SEQ ID NO: 131850 - protein, 88 aa, Triticum aestivum
  Clone ID: PAT_TA_26268.pep
GPPKNLGETRAKLVPGGKWYPLTIPHKKNNRKPKRENPGGPKGGPTPLNWGGPTGPFSRGKPGGPTGLKKPPTPREKGVGYWGPFPFL

SEQ ID NO: 131851 - protein, 132 aa, Triticum aestivum
  unsure (1)..(132): unsure at all Xaa locations
  Clone ID: PAT_TA_26269.pep
SRAAXXXGTMYPILGKCRRMPSVTSITTSSMLVPTSLPAWMWAPGVESKLSIVTCVPASSPNASSFITLVGPLAEYSFSRIALCASSPLKTSGFTSGSASINLYTFGKSSFPHPLSFPAPKSFNAHLGRDHA

SEQ ID NO: 131852 - protein, 73 aa, Triticum aestivum
  Clone ID: PAT_TA_26270.pep
RAAARAGTLCGHWLCGYWEANISVVINIFLLNIALLRSEHTAVANVAFAKLVHSLVDTLLGHRELLDNRLNLV

SEQ ID NO: 131853 - protein, 109 aa, Triticum aestivum
  Clone ID: PAT_TA_26271.pep
ERPPGQVSITATSIHPGVIITDLYASQQKTNIVMKMFLPIMKMATLDVPGGAKNTLWAPTTPDKATVRESHYWKPVGSKSGGSFWYAQKTEPAKELWEWTEEQLKKNGY

SEQ ID NO: 131854 - protein, 142 aa, Triticum aestivum
  Clone ID: PAT_TA_26272.pep
AQYNKGKWAVLFDGNLATGATAKMDVVVLLALFLLDPVPDVARVPTGLALAHTGCVLRGEVPSMPFAVGLARVGIRRLRSCSSLMLRHRSRLDPIPVVIGEPAMTSVALLDAIEELSGPGKVTSLLHAVVIARVGVFHRLCS

SEQ ID NO: 131855 - protein, 83 aa, Triticum aestivum
  Clone ID: PAT_TA_26273.pep
FFFFRSSKNLIHFNATCPVIVLSQLSHITNPSSPRLESALDFLFNVLQGIVGPHLLTPRAIRLRLCEPPRLRRGIVPARAAAR

SEQ ID NO: 131856 - protein, 388 aa, Triticum aestivum
  unsure (1)..(388): unsure at all Xaa locations
  Clone ID: PAT_TA_26274.pep
LQYLLAGFAGKFVFITGEVFQGPPLISAVKRQLRVRTIYESKLLEHDAERHLAVFWISCEAGTYVRTLCVHLGLLLGVGAHMQELRRVRSGILGEQDNMVTMHDVMDAMWALDNHKDESYIRRVVMPLEVILTSYKRLVVKDSAVNAICYGAKLMIPGLLRFENDIDVGEEVVLMTTKGEAIAIGIAEMPTAVMATCDHGAVAKIKRVVMDRDTYPRKWGLGPVALKKKKMIADGLLDKHGKPTDKTPAEWLRNVVLPTGGDAMIASIAAAPEPEKVKVEQQDVVPSQEVKEKKKRKTDEDDVTASTPAKKMKVEEVTEAVEGEKSEKKKKKKKDKGEPGSAVSEAVKEEKSSLXDEEKGGSEKKKKKKKSKEGGDDVAPESAEVRRK

SEQ ID NO: 131857 - protein, 157 aa, Triticum aestivum
  Clone ID: PAT_TA_26275.pep
METGAKAPKKAGRRAGGGGPKKKSVSRSVKAGLQFPVGRIGRYLKHGRYAKRVGSGAPVYLAAVLEYLAAELLELAGNAARDNKKNRIIPRHVLLAIRNDEELGKLLAGVTIAYGGVLPNINPVLLPKKAAAAASKEPKAGTTKSPRKSPAKKAADA

SEQ ID NO: 131858 - protein, 99 aa, Triticum aestivum
  Clone ID: PAT_TA_26276.pep
TSLKKQQKKQCQTQASIFVIFEFLNHDPAVEMGRLCSAVDSRSACRRKFSGSEPPIACRLCPDFDLLKTFGMLKTACRADMSTMHFDLVGLDLPGRPLE

SEQ ID NO: 131859 - protein, 93 aa, Triticum aestivum
  Clone ID: PAT_TA_26277.pep
ERPPGQVVDEPYDPKNFKVPEKEFSLEEVAKHNKKEDLWIAVKGIVMDVTNWVDEHPGGPQALFSHMGKDASEEFEMMHDDEVIPKYLGRDHA

SEQ ID NO: 131860 - protein, 47 aa, Triticum aestivum
  Clone ID: PAT_TA_26278.pep
KRPVIMAGARSRAPIHGCSFLSCSFREKNDVGDTTMVYSSDLGRDHA

SEQ ID NO: 131861 - protein, 261 aa, Triticum aestivum
  unsure (1)..(261): unsure at all Xaa locations
  Clone ID: PAT_TA_26279.pep
RSNSFPPRQIAIYGLYLCPIWFVTXYLSNAALARTSVASTTVLSSTSGLFTLFIGVLLGQDSINAAKVIAVFVSMAXVAMTTMGQTWATDESEVSNSGATQRTLLGDMFGLMSAMSYGLFTVLLKKFAGGEGSEKVDVQKLFGFLGLFSLCLLWWLVWPLTALGIEPKFTMPHSAKVDEVVLANGLIGSVLSDYFWALSVVWTNPLVATLGMSLTIPLAMVADMVIHGRHYSAVYIFGSVQVFSGFVIANLADRVSRFLGL

SEQ ID NO: 131862 - protein, 139 aa, Triticum aestivum
  Clone ID: PAT_TA_26280.pep
RAAARAGTSIRHALSAVKLGVDFLSIDGFECAGHVGETDITNLILLSRSRQVMPIPFIASGGFCDGYGLAAALNLGAEGINMGTRFMCTIEAPIHHNIKVAITKAQETDTQLVLRKWRNTSRLFKNKVSSEAYLGRDHA

SEQ ID NO: 131863 - protein, 72 aa, Triticum aestivum
  Clone ID: PAT_TA_26281.pep
MDVEAFFLNYLAFFVVVFFYLVGYAWKRGRWIKIHEIDIDSGRRAIDYEAFEAEKLRTKNHGAFRRFMGKMF

SEQ ID NO: 131864 - protein, 46 aa, Triticum aestivum
  Clone ID: PAT_TA_26282.pep
SVVAAGARPGRSRGGCCGGGPVDHQIDRLQRYFGFALRRYSITTCP

SEQ ID NO: 131865 - protein, 69 aa, Triticum aestivum
  Clone ID: PAT_TA_26283.pep
ASGAIFVPYLKASGFYLQGRTEFVYQDQRKMTISGSLTGALNLHGPESIKISYDNMEKKTTNEKDVAVE

SEQ ID NO: 131866 - protein, 75 aa, Triticum aestivum
  Clone ID: PAT_TA_26284.pep
QLGASVKHISPRINQQQWTCSTSQTTHIASIANTLELQPSLRGRQSGLLDGEDGAVIQRQQAEAAPVLDLPGRPL

SEQ ID NO: 131867 - protein, 224 aa, Triticum aestivum
  unsure (1)..(224): unsure at all Xaa locations
  Clone ID: PAT_TA_26285.pep
NSISVVAAEVPLEKVDSGEIRLEIEAIPNDHNDSLKRSSSKVEAGWIELVIIEARDLVAADLRGTSDPYVRVQYGNKKKRTKVIYKTLAPNWNQTFEFAETGEPMILHVKDHNAVLPTASIGNCTVEYSMLSPNQPADKWIPLQGVRSGEIHVKITRRVANSEKKTSLLTDASALGKGHKISAQMRDSLKKCSGLVDDGGDAEALSLALXXXESVXDEQDLYLP

SEQ ID NO: 131868 - protein, 114 aa, Triticum aestivum
  Clone ID: PAT_TA_26286.pep
ERPPGQVFSMCVFAIGTYAVNSIILGWVSATCGQTKEKKASSLAIVNTIANVSFIWTPYLWPDSDEPNYPIAMGSSAGFSVITAGLAWVMKFWLMRINRRMRQTEDERTLAFAY

SEQ ID NO: 131869 - protein, 118 aa, Triticum aestivum
  Clone ID: PAT_TA_26287.pep
LSSICSSHSIQAQDSIIEPPSESSPETPIMGPTRMPVSSSLQPVPTHPIQPVHCNRLCPSVSAPSPRLPYATIHQAPPRIPTSTNALKIPAPARSAVVISLGGLTHRAAYQYLPGRPL

SEQ ID NO: 131870 - protein, 121 aa, Triticum aestivum
  unsure (1)..(121): unsure at all Xaa locations
  Clone ID: PAT_TA_26288.pep
ERPPGQVLAVSXSMQHHGRRRGPNQWDAYVGTALLLLLLMFKPPAAKSHPKVESEFLRALLHRASSAKRPSRSLPRATRLSSLAPGFQFHVGAFRHSLQVGARSSCRDFRLRLYDCPPTQK

SEQ ID NO: 131871 - protein, 83 aa, Triticum aestivum
  Clone ID: PAT_TA_26289.pep
SVVAAEVQGLRISVAILQARKASLEVAAHAEGARLRALIASGNEGRPLNLTSLANIAREEESVMAEISRLTTLLNNATSSLPE

SEQ ID NO: 131872 - protein, 115 aa, Triticum aestivum
  Clone ID: PAT_TA_26290.pep
PGSGPAHLPSSNQAVRKGSSRRLRRRRLVRPQIFTELPLRAATRRKEWTSITATPGFAPLRDAPFALRGAFGTHQLVFQQHGWPSVPSLMHWASQGATHLMPLRSSSPTSKQAPT

SEQ ID NO: 131873 - protein, 145 aa, Triticum aestivum
  Clone ID: PAT_TA_26291.pep
HEEIEETIDVTSDLCAYKVQLSEKLMSNVISKKLGEHEIAWVDSGVGKVDEKLTLLPPSSTPAAHKSVLVGDLKLADFKQFLANKGLQVEFAGGALRCGEYITVRKIGDSNQKGSTGSQQIVVEGPLCEDYYKIRELLYSQFFLL

SEQ ID NO: 131874 - protein, 112 aa, Triticum aestivum
  Clone ID: PAT_TA_26292.pep
AWSRPRFTLPRRRTPTTVNADAISTCRKAWLHAIIASAECFFVFSFSGPNWQVLGIGVSTIMGSASQHVALSLDWGMDGWMGTFDVISAEPNHFDLQSIQHHNVLHYVPKKK

SEQ ID NO: 131875 - protein, 134 aa, Triticum aestivum
  Clone ID: PAT_TA_26293.pep
RGRGRGRAQHRSTFQRSSYTRSTAHDSPSNPPTNTIPNPDPTHHISDMPHNRRSRPHTPPIPIIIVWNPSFTPCHHCTKITHSTPHSPIRDTQIRPPSIFRIPAFWLFVFAHRGTFASVRAMSAFMPHSSEARR

SEQ ID NO: 131876 - protein, 62 aa, Triticum aestivum
  Clone ID: PAT_TA_26294.pep
ERPPGQVLYETDLAPQCLIAGEGVLRSYGYKSGETGKWVGIMIGIIAGYRILGWLTLYLRKT

SEQ ID NO: 131877 - protein, 106 aa, Triticum aestivum
  unsure (1)..(106): unsure at all Xaa locations
  Clone ID: PAT_TA_26295.pep
DRMHLXRMEXNDCVRLVTCERTLVIQGQEAELSLCILCFLHLISFIGKLMTDETWSVADCKPTPDRLASHPRMLLYTCPPPYLSETMGGRPSIADEAETSIEHSST

SEQ ID NO: 131878 - protein, 67 aa, Triticum aestivum
  Clone ID: PAT_TA_26296.pep
WRGGGGGTFSLLSCSPRSSSRSRFRSSISPGTSRARRTRQGPGSPRLKQEAVENFMSGIHHGMIPPS

SEQ ID NO: 131879 - protein, 104 aa, Triticum aestivum
  unsure (1)..(104): unsure at all Xaa locations
  Clone ID: PAT_TA_26297.pep
ARSPPRDAIACIAYLVVIWXLVVHGRQSASGKGNKVGGFYASIGAFTLILWTIYPIIWGVADGSHILDVDEEIISYAVLDILAKPVFGAWLLFTHSRTCPGGRS

SEQ ID NO: 131880 - protein, 57 aa, Triticum aestivum
  unsure (1)..(57): unsure at all Xaa locations
  Clone ID: PAT_TA_26298.pep
TTTTSTPTGRPASHTTRTSLPSAAATATCASSTPIRTAASTTKTLESAFSTXPGRPL

SEQ ID NO: 131881 - protein, 157 aa, Triticum aestivum
  Clone ID: PAT_TA_26299.pep
SVVAAEVADKPDFETGWLKDEGDNDVKKHIWAYKLSREMWRRMPIFRGELAINHPKFPEGSKAAVVEKADGPLSKNNDERIPYTKEDDAAIEQKVREIVSTTWHSLGTCKMAPREKKGVVDHTLSVHGLENLKLADLSIPPENVGANTGGTCPGGRS

SEQ ID NO: 131882 - protein, 71 aa, Triticum aestivum
  Clone ID: PAT_TA_26300.pep
IWDYFVDCPHVRPPAPLITLIMNHAVLEDSGCCSYASWQHAVSLQMCLGSSYLDKRCMIVSYGLQSSSARR

SEQ ID NO: 131883 - protein, 67 aa, Triticum aestivum
  Clone ID: PAT_TA_26301.pep
RGRGRGTDRAIIWEDRPAASPNSNLIERSSEDNATCRTAYPCRQYFSGGCMHASLLHELIPMMINDV

SEQ ID NO: 131884 - protein, 246 aa, Triticum aestivum
  unsure (1)..(246): unsure at all Xaa locations
  Clone ID: PAT_TA_26302.pep
MNFKGARMPSAPAGAGALVKLGLVGGTVLYLGNQTLYNVXGGHRAIGFNRLEGIKDKVYPEGAHIGIPCASGPIIYDVRARPNLVESTSGSRDLQMVRIGLRVLTRPMPERLPTMYRTLGENYNERVLPSIIHETLKAVVAQYNASQLITQREAVSREIRKILTERAKNFNIALDDVSITSLSFGKEFTHAIEAKQVAAQEAERAKFIVEKAEQDKKSAIIRAQGEAKSAELIGNAIANNPAFVAL

SEQ ID NO: 131885 - protein, 319 aa, Triticum aestivum
  unsure (1)..(319): unsure at all Xaa locations
  Clone ID: PAT_TA_26303.pep
MNFKGARMPSAPAGAGALVKLGLLGGAALYLGNKTLYNVEGGHRAIVFNRLEGIKDKVYPEGTHIVIPWFERPIIYDVRARPNLVESTSGSRDLQMVRIGLRVLTRPMPERLPTMYRTLGENYNERVLPSIIHETLKAVVAQYNASQLITQREAVSSGVTGKILDRARTKNFNNALAGGVQYKSDLGIFXYDHAKDSKLVLDDVTIASQIHLLRRMRKIEKSAVARAEGEGKRVIIVNGEYDKKQAFIRCRAERQSRPEVSSQCRLPPTLVFVALRRLAAATEIPPHPIAASNDMVSLDSGDLLLGRQSLMMWNNNNKK

SEQ ID NO: 131886 - protein, 85 aa, Triticum aestivum
  Clone ID: PAT_TA_26304.pep
SAGPPPRYSVTADSFLRRASHCLGYKAGWGGWWDVFVSKRENDQSRFSFCIIIFAISSAYATARSSSRPRTEVSSSSSYLPRRPP

SEQ ID NO: 131887 - protein, 70 aa, Triticum aestivum
  Clone ID: PAT_TA_26305.pep
AGAAVEFYSSIYVMLSMTIDLLTITCPSGVHLIPGLESVNATQTRGRDERQPCSFLDDVYICKENSPKRK

SEQ ID NO: 131888 - protein, 161 aa, Triticum aestivum
  Clone ID: PAT_TA_26306.pep
WSRESQKTDSNGGGHRYRNLASIYVDASQLVSSGNSLVEAEAKISQRDWITYDLLVILHAGLGNLDRVKDIWKSMQMTAQRMTSRNYVCVLSAYLMCGQLKDAAEVVDQWQRSKLPEFDVSACNRLFDALLAAGFTDTADSFRELMLQKSCILSSRASACS

SEQ ID NO: 131889 - protein, 410 aa, Triticum aestivum
  Clone ID: PAT_TA_26307.pep
MELGLASSRGPAGPSLAVAGRRPRPSLSPPLPCPLSLQIQTRGYSMPTLHHKAHTTVGCQASVAAKYMETPDIVDLDWENLGFGLVDTDFMYMAKCGTDGNFSSGEIVPFGPIALSPSAGVLNYGQGLFEGLKAYRKTDGSVLLFRPEENAIRMKNGSDRMCMPAPTVEQFVDAVKQTVLANKRWVPPTGKGSLYIRPLLIGSGAILGLAPAPEYTFLIYVSPVGNYFKEGLAPINLIIEDNFHRAAPGGTGGVKTIGNYASVLKAQRTAKDKGYSDVLYLDAVHNKYLEEVSSCNIFVVKGNAISTPAIEGTILPGITRKSIIEVAESKGYKVEERHVSVDELLDADEVFCTGTAVVVSPVGSITYKGKRVEYDGNQGVGVVSQQLYTSLTSLQMGHTEDRMGWTMQLN

SEQ ID NO: 131890 - protein, 80 aa, Triticum aestivum
  Clone ID: PAT_TA_26308.pep
RAAARAGQAYELQQKTDLAAEAKAVLDSWVRYEGQVKARQQKELAESVIAKIEKDLENPKVLDQILRQAVSDVERIVAQK

SEQ ID NO: 131891 - protein, 75 aa, Triticum aestivum
  unsure (1)..(75): unsure at all Xaa locations
  Clone ID: PAT_TA_26309.pep
SSGRPRRHTVGXSGATLYPTTGSSADFATDIAKAKYAYAIELRDKGQNGFVLPPDQIVPTGQEVLAGVKVLLKGL

SEQ ID NO: 131892 - protein, 369 aa, Triticum aestivum
  unsure (1)..(369): unsure at all Xaa locations
  Clone ID: PAT_TA_26310.pep
LVDKYRISDYAMMVRNTIHEISKIEGVMEEAVKGSQATWCKQLRTLTKRSYINMYRDFGYYRLRIIIYVLMAICLGTIYYDVGNGYTAIQARASCGGFVSGFMTFMSIGGFPSFIEEMKVFSLERQNGHYGVAAYIISNFLSSMPFLLTMSWASASITYWMVKFRPGFSYFAFFALNLYGGVSVIESLMMIISALVPNFLMGLILGAGVIGIMMLTSGFFRLLPELPKIFWKYPVSYIVYGSWGLKGAYXNDLLGLEYEPMTPGVEKLTGEFIITNMMGLSVSYSXKWLDLAMIFILLLAYRITFFFVLKVKEAAAPYLRVAYTRFTVKRLERRASFRESLAMTSLSKRHNAPHPMAMQEGLNSPMQQY

SEQ ID NO: 131893 - protein, 260 aa, Triticum aestivum
  unsure (1)..(260): unsure at all Xaa locations
  Clone ID: PAT_TA_26311.pep
MSFGGASSVAAGGKRPFEYGRTHVVRPKGAHKATIVWLHGLGDNGASWSQLLETLPLXPNIKWICPTAPTRPVAIFGGFPSXTAWFDVADLSEDSPDDVEGLDSSAAHVANLLSTEPADIKLGVGGFSMGAATALYSGTCFAHGKYGNGNXPYPVNLSVAVGLSCMAPMNARSLKNKIESSQEAAQKASSLPLMLCHGKADDVVLYKHGERSADALKSTGFANVEFKSYSRLGHYTVPEEMDEVVKWLTASLELGSSSST

SEQ ID NO: 131894 - protein, 156 aa, Triticum aestivum
  Clone ID: PAT_TA_26312.pep
PPCGGVEASLRIIVRTHVPIKRVTCRNVRNTTHGNAREKYKLKYRNTLSRVVSCTSVSLVPRASRARPCRELRHPRRDQRPRPLVKPRRRRGDGRAVLLLRLKPQPPCGVDGSQHGGRHSHQEQERDEDRLSWRHLRRGRRGEEVEDAHGYVLTQG

SEQ ID NO: 131895 - protein, 119 aa, Triticum aestivum
  Clone ID: PAT_TA_26313.pep
YHFSYTTPDRSRQELLQNKTPLRSEHWPFMRIDGKDVRVATPRTPKAPKHGPRPSRFKLLDVKPITAVLFPDSLPSKKRRLRRLMPPGLPRPVPKAAASPRVLLYEEELCEAVAQNKLL

SEQ ID NO: 131896 - protein, 62 aa, Triticum aestivum
  Clone ID: PAT_TA_26314.pep
RGRGRGTMHVSRFPTSVISHKNACFVDPGNPAHFMRVESREHITQKELNFSLLLHPHDRAAI

SEQ ID NO: 131897 - protein, 131 aa, Triticum aestivum
  unsure (1)..(131): unsure at all Xaa locations
  Clone ID: PAT_TA_26315.pep
SKPRNDHDMSSNRHAIHAVPKEGACSSKAMPMWLCPSDGLYLPGMYPIRSSHHAPHHINSSFLWPCAKTKRRDNSAQLLKGRRITLSLLRVDDDATLALVDDALGRGEGLGRHPPGGSAWRGLLHHAXDLL

SEQ ID NO: 131898 - protein, 137 aa, Triticum aestivum
  unsure (1)..(137): unsure at all Xaa locations
  Clone ID: PAT_TA_26316.pep
FWXXKNCSGPPPPPRPPARPVLHRLIAARILRRSNAIPARSHRSRAAAEDPFSEIGAESCTQRFLLQVAMDPKGLDSDKSASRLYVGNLDFRISESDVIKMFSPYGKIIAEDFLLHTRGPKRGEPRGYAFVQYTTKE

SEQ ID NO: 131899 - protein, 86 aa, Triticum aestivum
  Clone ID: PAT_TA_26317.pep
ESESLLLSQRRPMNRWSSPHNMHMRPSTTPYAVHLQAPTLPSSKFVGSHRRWSSPGRLGGPGVHTLFTMVCAVRLVLWPVAIGFLL

SEQ ID NO: 131900 - protein, 79 aa, Triticum aestivum
  Clone ID: PAT_TA_26318.pep
TFEELLDMLVSGQAALDMAGQESTRENVKGGNINESSPLCSCGQNLEHGYKTSIIVYGHQSRGEVMMDIRPVKTVSMGS

SEQ ID NO: 131901 - protein, 59 aa, Triticum aestivum
  Clone ID: PAT_TA_26319.pep
SSGRPGRYNFFSDENGMQEDLSVALVHSIVQPYSLHNHPCQAAGLLDALEVSVPRPRPR

SEQ ID NO: 131902 - protein, 187 aa, Triticum aestivum
  Clone ID: PAT_TA_26320.pep
AWSRPRYALGWHTMSQPGREFLCKITEMGFFAADFCLGHMLLFFMLPAILIPYIDKFHSVMLFWLRPSRQIRPPIYSLKQSKLRKRRVVRYAILYFTMFVLFIALIVGPVIVLKITKKVPDFGTLPLQLLQPTDWKNNDTTNKVTETRNVGGGASATGGAARASSTRGSRLGGGTGSGSGTCPGGRS

SEQ ID NO: 131903 - protein, 335 aa, Triticum aestivum
  unsure (1)..(335): unsure at all Xaa locations
  Clone ID: PAT_TA_26321.pep
MAKYFQSAPVSNEALKHKEILLDGLYMHQDLDGSPNQNQKTIVNPNLPLQFGCTVANDWTIYDGLGPDKKLVARAQGPHMGAGVAKGSWFICFNMVFVDDRFAGSSLKVLGHFEEPVEGEWAILGGTGEFAYAQGVVTFKKLQDGSTRVRQLQIRAICLSFPSSLSMPTKMGPWGGNGGSIQDITTGTPMRLQSVTLSSXAAGIVSLAFTYIDKLGKRRNEGPWGPDKGNSQTIEFGPKEYVTEISGTIDNVISSLVITTNIKKYGPFGHEEGQPFXSAAVPENTCVVGSFARTGIPLPAVGLGHGPIGVGAGFSAASKQSKEMCCQLFTYRKAA

SEQ ID NO: 131904 - protein, 44 aa, Triticum aestivum
  Clone ID: PAT_TA_26322.pep
FFFLHQTRGTILLLHCMHDQARTNKFSTDVQFIRKTRAPIIPYF

SEQ ID NO: 131905 - protein, 163 aa, Triticum aestivum
  Clone ID: PAT_TA_26323.pep
SGDAPPSEFDDEFDEFDDDEDYDDEGFEDDYYDDPKMMMKQMAMPPNAGGGDKKGAGNGGKKGGGGNEIPVQIKGNGNNGSGKKNAGNKQQHQGGKGAANGNGRGKNGGGGGQPNNGEGGGAQPPGKKGGSHQRASPTTTAATRTRIPPRQCERWSPNPPRIA

SEQ ID NO: 131906 - protein, 93 aa, Triticum aestivum
  Clone ID: PAT_TA_26324.pep
THQTARNMKLPVISLPSKSMSKKLSGTIATAAHTGTHLTRPSADFTKIKSPRKCKPNKQHNQTDYEFFFYHSSKIIEFKSALMINIYTFTQLG

SEQ ID NO: 131907 - protein, 49 aa, Triticum aestivum
  unsure (1)..(49): unsure at all Xaa locations
  Clone ID: PAT_TA_26325.pep
RGCAAEVIMTQLHAGGKFDQNSSXQVSGGLHGVGVSVVNALSTCPAGSG

SEQ ID NO: 131908 - protein, 70 aa, Triticum aestivum
  Clone ID: PAT_TA_26326.pep
LAWFVGRGTCPGAAARAGRFWRYPSSLLLTPPSSHPFHSAVRDTVYHHHSHAAARSAAPKRSHLGRDPPG

SEQ ID NO: 131909 - protein, 93 aa, Triticum aestivum
  Clone ID: PAT_TA_26327.pep
IVCFCVSASLFFSPYLSLSVLTSGAAGGVLRLVNIVLVFISYIHNISPYNLCLNSITSLVLFVILNVPIRGGWSCQLRHHHHNNTHQQISTLH

SEQ ID NO: 131910 - protein, 162 aa, Triticum aestivum
  Clone ID: PAT_TA_26328.pep
MKIERKINSLVVKDMDQKQIKNNKKIINYYDHTRVVSVRGGERGGVVGCGTPTGRRRHGGTRKRVRKRSAREGDDCEGGWRQGTGTAGRGTTQGRRGDGIGKAGPERLIRAPYRANWARRRMLPAAMAAGLWVGLVRRSTSESYINIKVIVVALGIWKKGKI

SEQ ID NO: 131911 - protein, 90 aa, Triticum aestivum
  Clone ID: PAT_TA_26329.pep
RLCTRQWKGKSNRSLVGVSGLLNHWFPPCGSTREALWLVEIFPVLKVLLLLARGPQWHILVVVWKFNNIGRSCKKIQSQEFSRPSRWLIK

SEQ ID NO: 131912 - protein, 70 aa, Triticum aestivum
  Clone ID: PAT_TA_26330.pep
SIRPWGALPYGRPAGGRTSDWNGRRGKNMVLSTIQLLRITLITRLLLLIPLTILLDYDHPEWPWPLKTGI

SEQ ID NO: 131913 - protein, 69 aa, Triticum aestivum
  Clone ID: PAT_TA_26331.pep
IPTLSVMDSTWCLISWYLSWRLPRVKPLLLLGGNQMSKGLTNSSHSNPAAMAAGSMRRRAQFALLGARF

SEQ ID NO: 131914 - protein, 119 aa, Triticum aestivum
  unsure (1)..(119): unsure at all Xaa locations
  Clone ID: PAT_TA_26332.pep
GRAVTIGDGSLIDAQASNDANSVMGSSGAIIHSGAVIGXADGFGFCERSVVPGIKIPQTGRVLIGDEGEIGANTSIDRGALADTIIENGVKLDNQIQIGHNCHIGEHTAMAGCVGVAGT

SEQ ID NO: 131915 - protein, 98 aa, Triticum aestivum
  unsure (1)..(98): unsure at all Xaa locations
  Clone ID: PAT_TA_26333.pep
LLCPQVRVFTAQAGDHFHDCWPPELILVDTPASGFKNFQVLPLHTCFLEVVGSRDLKSCLPSDLNWWNPWGTKFLLLEDQNWGQGPPSLWSKXQSKKL

SEQ ID NO: 131916 - protein, 93 aa, Triticum aestivum
  unsure (1)..(93): unsure at all Xaa locations
  Clone ID: PAT_TA_26334.pep
MAYFQEVDYCSEEVRSVAPAGGFGRYGGGVQQHVVKEKFEEVDTVSRAGAXHHHHGHHGGHGVVVRETRVEEDFNTCTGEFHERKESFLARAN

SEQ ID NO: 131917 - protein, 134 aa, Triticum aestivum
  Clone ID: PAT_TA_26335.pep
LALLPTDHSQTIPLHLPEEHEKEMEPLLMKGCRTSGGAGQGKLKPAAAWRLGDISEIISVWCMKTAIALACVYLVFLSYVAVTYTPSWAEKLRLSPLFLFATIVLLFGALMIRDKQDGCGRNTQCVLMEYQPRL

SEQ ID NO: 131918 - protein, 82 aa, Triticum aestivum
  Clone ID: PAT_TA_26336.pep
RVLSANHLHQLYKASSHFDHIPFIPSFYALVSPSNIAWVGLITCGYWEVVDEVGTYCPASKPWELLLRCLYCYAMLVDVVWV

SEQ ID NO: 131919 - protein, 101 aa, Triticum aestivum
  Clone ID: PAT_TA_26337.pep
CTTISVDYYNLGIPAITILQSNRTDNSLLSSTSRLHAFLHVFALPTFLGLELRRGGCSRSRTQAPPPPSPSRGDAAASSTDSSPESFIFQIVLTPPKQKRR

SEQ ID NO: 131920 - protein, 300 aa, Triticum aestivum
  Clone ID: PAT_TA_26338.pep
TRQAAAAGAGGSTSCHGGKAVGRSGGGRARPMVKAVFVFGSSLVDNGNNNFLNSTGVRADYLPYGVDFPLGPSGRFSNGRNTIDALGELLRLPRGGRIPPFADPGTRGRAALHGVNFASGGSGILDRTGQDTGKVLSLNQQISNFEAVTLPDLRATAANIRGMKGHDFLHDCFLPKSLFVIGTGGNDYLLNYYQPRNTARPQLSDFTRSLITELSAHLQRLYALGARKFVIFSIQPMGCTPVVRASLNVTGAGCVEPVNGAALLFNGELRSLVDAAGPRMPGASFSVVDSYKIIKDLLDH

SEQ ID NO: 131921 - protein, 81 aa, Triticum aestivum
  Clone ID: PAT_TA_26339.pep
MGGEGASSSGGGFRARIDHYLYSGEKKHVVAGIAIFAAIFGVPWYFMTRGAKHDSHQDYVERANKARSDRLSSGQPSSLKE

SEQ ID NO: 131922 - protein, 389 aa, Triticum aestivum
  unsure (1)..(389): unsure at all Xaa locations
  Clone ID: PAT_TA_26340.pep
ARGASQSNGWADEFQTQHNANANSWADQFVHEELSQGADNWVSEFSSEQNQXGSKRSVDEFSKLNMDDWAEEFSGGAFGESSADPWADEFQNQLSASKSSGASRGVYVFSEMNPYVGHPNPMQEGQELFRKGLLSEAALALEAEVLKNPDNAEGWRLLGVTHAENDDDQQAIAAMLRAQEANPTNLEVLLALGVSHTNELEQGEALRYLSRWLQNHPKYGALAAPHQTDSPYGPDVGRLFNEAAQMSPEDADVHIVLGVLYNLSREYDKAIASFKTALQLKPQDYSLWNKLGATQANSIQSADAVLAYQQALDLKPNYVRAWANMGISYANQGLYEDSIRYYVRAVSMNPKADNAWQYLRISLGNASRSDMIAACDSRNLDVLQKEFPL

SEQ ID NO: 131923 - protein, 63 aa, Triticum aestivum
  Clone ID: PAT_TA_26341.pep
LTCPFFSLINIINIPAFLFSALPLSLGAGSQTEESFFFSNSWFIQHPSSRVPRLFSSAQAFLA

SEQ ID NO: 131924 - protein, 208 aa, Triticum aestivum
  unsure (1)..(208): unsure at all Xaa locations
  Clone ID: PAT_TA_26342.pep
HQLRSHARLVQLLARDDVPVAAAFRRARLRKDPNAHFLLAVNLQVPGRPDAYSSVFYFAAEAPIPPDSLLGRFVHGDDAYRNARVQLGNRLLGGPWRVPATGGDYGECLLRRALTSRXDRVGDELEIDVDIGSSAIATAVLLLALGAVTSVTIDMGFLVESQSEEELPEKRFGAVRIAQMEMGSAKYVETASDEPETDGKVAPAVDVG

SEQ ID NO: 131925 - protein, 107 aa, Triticum aestivum
  unsure (1)..(107): unsure at all Xaa locations
  Clone ID: PAT_TA_26343.pep
EAEQXEVDCESLKRCCETLTEENRRLQREVQELRALKLLAPPAPHLYMRAPPPTTLTMCPSCERVAPSGKPAVDESRAAMVTRAVPTGPWGPVPVMPVFLGRPAQRS

SEQ ID NO: 131926 - protein, 158 aa, Triticum aestivum
  unsure (1)..(158): unsure at all Xaa locations
  Clone ID: PAT_TA_26344.pep
PXSTPRVRXNLRAPXRGSASAAGGLRRAAGPNPISSWIGLPTNPWQVLNGAGRTRFRRRRGSISPVDRLFHNKVRSRQSKRASRSSSWRTNYEAGRRQRLRPRGADISKSCQPVFICKRATAVGGVHWLSLAPHGEKKLERKIRFLRKLCFPSQQQAL

SEQ ID NO: 131927 - protein, 203 aa, Triticum aestivum
  Clone ID: PAT_TA_26345.pep
IDSIVDELGPMLASYGFNHHGTEVLYSGLFGTELQFEIFIGPVYYQRLRHMVSDKFQVRTTGRIDQVTKQPIGGRKHGGGIRFGEMERDALLAHGASYLLHDRLHTCSDYHVADVCSLCGSLLSATVIKSDTQKKSKRHLLGVNTVRPAKNFACQACQTNKGMETVAMPYVFRYLAAELAAMNIKLDLRLSNRREAPPSNESC

SEQ ID NO: 131928 - protein, 247 aa, Triticum aestivum
  unsure (1)..(247): unsure at all Xaa locations
  Clone ID: PAT_TA_26346.pep
LGGCLGCRHGQKGVCSQLWPDIDMPFSANTGMRPDLCPSPPAPPARLPGARPMESIPAKAGSVHGKFFHSCSLLQAQSKXDGENRCKYHSIVDELGPMLASYGFNHHGTEVLYSGLFGTELQFEIFIGPVYYQRLRHMVSDKFQVRTTGRIAAITKQPIGGRKHGGGIRFGEMERDALLAHGASYLLHDRLHTCSDYHVADVCSLCGSLLSATVINSDTQKKSKRHMLGLNTVRPPVHCACRHRASI

SEQ ID NO: 131929 - protein, 199 aa, Triticum aestivum
  Clone ID: PAT_TA_26347.pep
SKGENKSAVGASERLVAGGLAGAIAQTAIYPIDLVKTRLQTFSCESGKVPSLGTLSRDILKHEGPRAFYRGLVPSLLGIVPYAGIDLAVYETLKDASRTYIIKDTEPGPLVQLGCGTVSGALGATCVYPLQVIRTRLQAQQANSEAAYKGMSDVFWRTLRHEGVSGFYKGILPNLLKVVPAASITYLVYEAMKKNLSLD

SEQ ID NO: 131930 - protein, 153 aa, Triticum aestivum
  Clone ID: PAT_TA_26348.pep
TPNFLVESSASSSDLLRRRSSDARRRRHKPSFSSRLASAGTKESGRRLRGLFHGGRRVYPARPHLATSNTATWRRPVNPPLSLTTTSLSRSGNGQGGDVDLLEKEAAVNQQGRGTTSALLIRSVSRGTPLKAMLILWRKGRRWPKPTRPRTRG

SEQ ID NO: 131931 - protein, 102 aa, Triticum aestivum
  Clone ID: PAT_TA_26349.pep
MTRMTTTTRPPTATTPTRTIAPPLPIPSSWTPSLSSRSGCAPPAGGPRRGTTAASSLASAPPSRPRGPWRVPGPAAGPRRAARTALRWRSRAPSPTRRPRFQ

SEQ ID NO: 131932 - protein, 294 aa, Triticum aestivum
  Clone ID: PAT_TA_26350.pep
AIRFLCIFEEHHGVIFHILWEMVASSDTYLKTSAAALLKALVPYVGVKVASTHVLPALITLGSDQNSAVKYASIDALGAVAQHFKSDMVVDKIHIQMDAFLEDGSHEATISVIRALAVAVPHSTDRLRDGLLTKIFRLTSAPPTENDIERRRERANVFCEALRALDATDLPATSVRDLLLPSIQNLLKDVDALDPAHKEALEVIGRERSGGTLESIGKAMGAHLGIATSVSSFFGESSLLGKKEGGEQHDPAAASVPPQVGLQTQQENTRFGRIMRGGFGDMLRGKAKGGDEPS

SEQ ID NO: 131933 - protein, 115 aa, Triticum aestivum
  Clone ID: PAT_TA_26351.pep
MPKIKTSRVEYPEGWVLIEPTIRELDAKMREAENDTHDGKRKCEALWPIFRISHQRSRYIYDLFYKRKEISKELYEFCLDQGYADRNLIAKWKKPGYERLCCLRCIQTRDHNFAT

SEQ ID NO: 131934 - protein, 215 aa, Triticum aestivum
  unsure (1)..(215): unsure at all Xaa locations
  Clone ID: PAT_TA_26352.pep
VRPTQRRRRRVTTAPPAPPRLPRGSQPRRPPAPPAFHPSAGHPRPRSAALRRPSVRPSVRDFGHHFRRDSIPNEPSDSDCDPKGKILNEPSIRELEVNVRATQNDTDDGKRKXEALWPIFRISHQRSRYIYDLFYKRKEISKELYEFCLDQGYADRNLIAKWKKPGYERLCCLSCIQTRDHNFSTTCVCRVPKHLREEQVIECVHCGCKGCARGD

SEQ ID NO: 131935 - protein, 291 aa, Triticum aestivum
  Clone ID: PAT_TA_26353.pep
VFDKPVYDDDIFDGVPGVKSSSVRYDDVFAGNHAPAPADDDLLAGFGTKSVAREVPEDKWKPGPAAASAGFDDLFAGIGRSSPVKQRQTAGAEEKRVPTSQPASMASDPFVSFETTSTSARQSSGIFSDPLDELGRHSKSQVKTAADSGLFEDSSAFNQVPKSEPLFTTNLSDDSKGSNGSTKVRDSSPVQNFPKRKSAQQPSVEDFENIFPQSQSAKYSDVHVDSGAPGSEKYSGNGMDDRSPRSDESEDEIWLTVSEIPLFTQPTSAPPPSRPPPSLAIKQKPHGSRAK

SEQ ID NO: 131936 - protein, 116 aa, Triticum aestivum
  Clone ID: PAT_TA_26354.pep
ARRRSPRSRAGWCRNGRRLRLLLPGRSGGRRHGDGGVPQLEEERAGALRPRHGPPELLFVHGGHTAKISELSWNPSEKWVVASVAEDNVLQIWEMAESIYSDDNSNNANSASCLST

SEQ ID NO: 131937 - protein, 157 aa, Triticum aestivum
  Clone ID: PAT_TA_26355.pep
KPSIYDLLPTLVVAVGWAIGRRCPVGPGSGGGHDDRVQELPCLPLHLFPHRRARFAAISRTSSSPTPAGGGVFSFSFAFASSDALSAAIWGRPRLCVSDGIGSGSSTAALPAPCTAAGGVPFITTTCSCCCVLALAADPDDDEEEAAARAAAAAAMA

SEQ ID NO: 131938 - protein, 143 aa, Triticum aestivum
  Clone ID: PAT_TA_26356.pep
LMYLSDVKMGDETVFPSPHAESLQPKDDTWSECARSGYAVKPVKGVAVLFFSLHPNGTTDPDSLHGSCPVIDGEKWSATKWIHVRPFDSRPRVPSTAGCGDENDLCPRWAANGECAKNPRYMVGTPGNPGFCRKSCNACTGTL

SEQ ID NO: 131939 - protein, 154 aa, Triticum aestivum
  unsure (1)..(154): unsure at all Xaa locations
  Clone ID: PAT_TA_26357.pep
PGERERERERERERERERERERERERERSPARSASASPVLLLLVVLAAGASAAPLTITNRATYXWPAVALVLHQGGGGTELHPGXAWSLDTPVIGSQYIWGRXGCSFDRAGKGRCQTGDCGGSFADLRGQPGGAGDCPCPVLPRANFFPTGFHP

SEQ ID NO: 131940 - protein, 224 aa, Triticum aestivum
  unsure (1)..(224): unsure at all Xaa locations
  Clone ID: PAT_TA_26358.pep
MPLVESPQWRRKATDFFSSSSFKLKQAGQSAGDNIADVAGKVGTVVKSRWAIFQDARQRPPQPGDTVQERFISAAANTGVILRKGISETKEKVAVGKVKVEEAAKKTADKSKTILNNIERWQKGVASNDVFGVPVEATVQREQSGKAVPLILVRCADHLVISGLSNEYLFKSEGDRKVLQQLVSLYXNEDXGASLPDGVSPIDVAALIKCYLASIPEPLTHLLF

SEQ ID NO: 131941 - protein, 369 aa, Triticum aestivum
  Clone ID: PAT_TA_26359.pep
MPLVESPQWRRKATDFFSSSSFKLKQAGQSAGDNIADVAGKVGTVVKSRWAIFQDARQRPPPPGDTVQERFISAAANTGVILRKGISETKEKVAVGKVKVEEAAKKTADKSKTILNNIERWQKGVASNDVFGVPVEATVQREQSGKAVPLILVRCADHLVISGLSNEYLFKSEGGRKVLQQLVSLYNEDSGASLPDGVSPIDVAALIKCYLASIPEPLTTFALYDELKDARVSIDDLKNILKKLPNVNYMTLEFVTALLLRVSRKSALNKMDSRTLAVEFAPLIIWQQGDSGTDLRNHLRFTLKPPPKIVDTTTSTTTWDLLDEDDVDASSQIPLDDGSPPDYGAIEVIQCLIEHHNPIFTDANETVWR

SEQ ID NO: 131942 - protein, 110 aa, Triticum aestivum
  Clone ID: PAT_TA_26360.pep
TKCTEPLPLLLHGPNSEGRVITENTGSVAVEPERPVEHPAAVPNGTQYAGGDGDEEMADAEAEELPGSHDVEMQEEKPDQIPDVNSDTNSVTAVACETVNASEKAPDSQS

SEQ ID NO: 131943 - protein, 446 aa, Triticum aestivum
  unsure (1)..(446): unsure at all Xaa locations
  Clone ID: PAT_TA_26361.pep
SLQLSHTLRHQITVGSSRPSCLPGPFLVVSSSRAFRLPHSPPGAPPRPLAGRSVPPGGAPXATVVVALALPFAGGLXALGAARLAGLGRSRPSLRARIRHARAAEPAAPAPVRGAGPLSRALILEXSMRARDLLMEQNVALDLARREAEMAIRARNDFLAVMNHEMRTPMNAIIALSSLLLETELTPEQRLMVETVLKSSNLLATLINDVLDLSKLEDRSLELEIRAFNLHAVFKEVMGFIRPIAAIKRLSMSVMLTPDLPLCAIGDEKRLMQTILNISGNAVKFTKEGHITLLASVLKPDSLREFRTPDFHPAASDDHFYLKVQLKDTGCGISPQDLPHVFTKFAQTQPGGNQGYSGSGLGLAICRRFVTLMGGHIWLDSEGAGRGCTATFIIRLGVSDNTDAYQQQLAPLAWPGSANVESAGPKALHEETWPPSSLKPRYQRSV

SEQ ID NO: 131944 - protein, 470 aa, Triticum aestivum
  unsure (1)..(470): unsure at all Xaa locations
  Clone ID: PAT_TA_26362.pep
PSSPIPPRRARAPPWPRARSRPPARAPPPPPAKGPRRVSGSRSSSGSSQRKEWLYRQRERSLSRYPKAQVERNSCSRGFSPPAALSSSPRLSQGRSPSPALKKGSPSRKGRSSSPPPKKASPPRKASPPPQSVVLHVDHLSRNVNEAHLKEIFGNFGEVVNVELSMDKFVNLPRGYGYIEFKKRTDAEKALLYMDGGQIDGNVVKLKFTLPPRQRASSPLKPPPPPPKRDAPQNDKVAIGAEKDAPQRPGGSASPRKKPPSPPRKRSPPNRRAESPRRPPNPSPRRRAESPIRRRPDLSPVRRGDRRPGSPIRRRSPSPRRHRSPMRRGRGSLSPRRRSPGPPRRSPGPPRRRSPPPRRLRSPPRRPPPPPSRRHSRSPPPRRPLHSRSRSISPRSKGRGPPLGRGRSXSSYSASPSPPRKGPRXCQGAAALEGLQEEGVALATAGAAALPQPQGAGRKKLGDVCGFLGR

SEQ ID NO: 131945 - protein, 93 aa, Triticum aestivum
  Clone ID: PAT_TA_26363.pep
AAAISSNHQGTIRVDGAPSTSHHVRQMSHDGSESESETIDLNSRARGGGRRGRTTRGGQCRNFHRTPEIESAIAGEHTQRDGTARSITGPRYP

SEQ ID NO: 131946 - protein, 350 aa, Triticum aestivum
  Clone ID: PAT_TA_26364.pep
HGPDTTQCVAFSRVSFPSLARVVNISAFHNHAAFVTESGEVFTCGDNSSACCGHGDVGRTIFRPTQILALKGISCKQVATGLSFTVILTRKGLVYTCGSNTHGQLGHGDTTDRAAPKIVELFKGPSPVVQVAAGASYTFAVTDDGTVYSFGSCTNFCLGHGDQHNELLPRAIQSFKRRNILVVRVSAGDEHAVALDALGYVYTWGRGYCGALGHGDENDKTSPELIAGLKGQVGVQVCARKRKTFVLTDEGSVFAFGWMGFGSLGFPDRGSSDKVMQPRVLDSLSGHYVSQISTGLYHTVAVTNKGIVFGFGDNERAQLGQEFIRGCLKPTEIMFDKSSIEDIAIAAPSG

SEQ ID NO: 131947 - protein, 219 aa, Triticum aestivum
  Clone ID: PAT_TA_26365.pep
YPDGDPIPFLGFDAAVPSRFVVFAPRPNTFSVDGSAQVAIYSSETGRWTHLQSGWSPDPTIIHSRYTQAFLNGTIHLRSIGHKIATVDAEGKVWRVITMPGDSSKICDVGQSQGRLYAWKIDNSHDCQLYIWVLEDYGTGKWTLQHTINVLELFGRNQREDGDSYAMFAVHPDCNMIFLTDEKNMTLSYDIDNRKVTVICTEGMKGSALYSLVCGIALS

SEQ ID NO: 131948 - protein, 157 aa, Triticum aestivum
  Clone ID: PAT_TA_26366.pep
MARTGAAAALFVLVCCLLVGSVPARLPVELPTQVVPEAVDLLATAEPLLAKQLAAAEAANPTKVHSMITEEEEMVVHPARQRPQIIRCGGGDDVAVSDESPSFGGQGHPALKSEGEEHGPEQERPGEDSDTDSDSDSDDEDNENGIVAWFWRLARRF

SEQ ID NO: 131949 - protein, 158 aa, Triticum aestivum
  Clone ID: PAT_TA_26367.pep
MARTGGAAALFVLVCCLLVGSVPARRPVELPTQVVPVAVDRVAAAEPLLAKQLAAAEAADPTKVHSITAEEEMEVHPARQPPQIIRCGGDDVAVSDESLAFGGQGHPALKSEMLEEHGPEQERPGEDSFSDTDSDSDSDDEDSEDGIVAWFWRLARRF

SEQ ID NO: 131950 - protein, 297 aa, Triticum aestivum
  Clone ID: PAT_TA_26368.pep
MALVCSRPASLLLIAALLSAATFLAVPAAATGKTGQVAVFWGRNKNEGSLREACDTGTYTIAIISFLDVFGRGNYHLDLSGHDVSAVGADIKHCQSKNILVFLSIGGFGNQYSLPTAQSAADVADYIWNAYMLGTRKGVYRPFGDAFVDGIDFFIENGAPANYDELAKRLWNFNKDFRGRTPVQLTATPRCGYPDRHVEWALATGLVGRIFVRFYDDADCAANWQRQWDKWTAAYPSAQIYLGLPASEQKVGYVHPKNLYYSVIQVAQKAANYGGVMVWERYEDKRTNYSSYAIQWA

SEQ ID NO: 131951 - protein, 105 aa, Triticum aestivum
  Clone ID: PAT_TA_26369.pep
MARSAALLLLLLALLLVCSGAASAAAAAGRIKSKAAARSARAEAEAGCRDLATRGKCVASGGGGRCRWCRSEALDDMCFGAAEAWRLPKQVFSCDQPAGAAHARR

SEQ ID NO: 131952 - protein, 105 aa, Triticum aestivum
  Clone ID: PAT_TA_26370.pep
MARSAALLLLLLALLLACSGAATAAAAAGRIKSKAAARSARAEAEAGCRDLATRGKCVASGGGGRCRWCRSDALDDMCFGAAEAWRLPKQVFSCDQPAGAAHARR

SEQ ID NO: 131953 - protein, 143 aa, Triticum aestivum
  Clone ID: PAT_TA_26371.pep
MDKDSVSMEEDEMPRIVEQGQAEDKMPEAVEQTQEEAVEQQMRLRWLQDLFVAADRYHLQRLKFICEKQLSEHMCVSSVVSTLLLSKQHHCDGLKQACLKFIQVLSPLRLQTLMATTGWGHVATTYPSVLFELIAMLAANQRR

SEQ ID NO: 131954 - protein, 389 aa, Triticum aestivum
  unsure (1)..(389): unsure at all Xaa locations
  Clone ID: PAT_TA_26372.pep
MKDQSLRAQQLAAMEPHAQSKPIPLMTPYKMGSSLDLAHRGVLAPLTRQRSYGNXPQPHAAVYYGQRATPGGMLIAEATGVSDTAQGYTDTPGPPGRSEHXAASRRVVDAVHAEGALFFCQLWHVGRVSRYGCQPGGAAPGSSTQTMAGPQVGHDGTTEEFSPPVRLXLQEIPMKVDDCGKPARNAIKAGFVAHGAPRPRXSTPSSSDKSGGNIDKRCDFALDAVDVVATEVGGRRVCQRPSPLTXYMSASRASSPTLDRHDSTTHALDLNMATKLNDHNILYLHMIEPRMXSVDGRREVPHRLLPYREAFKXGTFISGMAGMTGKRGGQGGRSRGYPDLVSVWAALPLQTPDLPKRLRAQPRRLNKYNRLTFYISDPVVGYTDYPFLP

SEQ ID NO: 131955 - protein, 98 aa, Triticum aestivum
  Clone ID: PAT_TA_26373.pep
DIEDCKTQQQGHSDDDQEETPAPAKARGGKRVFPPPISVIGAAGKPWQYLRAQRGGGRLVLREVRIPSRELLHACREDGRLKLHFAHPEQDDDQECNN

SEQ ID NO: 131956 - protein, 134 aa, Triticum aestivum
  Clone ID: PAT_TA_26374.pep
DDAPSHQRKLGELLQRPWSRSSPLDDQDTSPSRSRTVSMLDFSRRPSRCKVPTTTLRAVLIFSATAATSWIQASASSFWISGSGASIRPPRPRHPAASISSPWPPDHAGSNPDGPYSPLSHYKGRDIHPAPVEG

SEQ ID NO: 131957 - protein, 475 aa, Triticum aestivum
  unsure (1)..(475): unsure at all Xaa locations
  Clone ID: PAT_TA_26375.pep
MGATDEAEVAAAEGAAAGCRARAALLGAYELGRTLGEGNFGKVKHARHRATGEHFAVKILDRGRVLSLRGADDQVRREIATLTMLAHPNVVRLHEVAASKTKIYMVLEFVNGGELFDRIAIKRKLSEREGRRLFQQLIDGVSYCHGKGVYHRDLKPENVLIDRKGNIKISDFGLSALPQHLGQVAXNDGLLHTTCGSPNYIAPEVLQNRGYDGSLSDIWSCGVILYIMLVGHLPFGDRNMVVLYQKIFKGDTQIPEWLSPGAQNLLRRILEPNPMKRINMAEIKLHEWFQKDYIPAAPYDDDDEDVRLGAILPIKQQISEAPGDKSTHQMNAFQLIGMASSLDLSGLFEEEGVSQRKIRFTSAHPPKDLFDKIEVSATQSGFHVQRAHSKLKITGNCNGPNNPTPFLVCAEVFVLGPSLHVVELRKSHGDTAVYRQLCDRISSDLGIDKIFGMGSLFDDNLPGFDSRAATPLVAL

SEQ ID NO: 131958 - protein, 149 aa, Triticum aestivum
  unsure (1)..(149): unsure at all Xaa locations
  Clone ID: PAT_TA_26376.pep
SRTLPHRTVAGEERETDLFINLWERWLRCGMQATRGVWGRWAEQSVAARASSPYTTHALYLPLFLLLHLQAGGGSPSSSWLGRDCVHPASQTPGRSRWTLREGQQAGEGSWVGGAASAGGCDVEQQERKIGSRKGQTEFAIAIKIXTLG

SEQ ID NO: 131959 - protein, 67 aa, Triticum aestivum
  Clone ID: PAT_TA_26377.pep
MGDAKSSWPELLGAPSEVAKQKILSDRPDVRVFVVPVGNNVTGDFNDKRVRVFVNTRGDVARVPNIG

SEQ ID NO: 131960 - protein, 137 aa, Triticum aestivum
  Clone ID: PAT_TA_26378.pep
FPLIRRRTRIPAPRSFQKRGHASGSGHGESVTKLASPGRGPDRVGGAQALHRRRHEDVAQAARHGEEDCDAEGTGGQTRGPREGAVGDDGGPEDAKQDLQDRPLRSPPADHAVPFPQDVLRPGLCPLRRSRTDMMAN

SEQ ID NO: 131961 - protein, 274 aa, Triticum aestivum
  Clone ID: PAT_TA_26379.pep
MAVRPSLAYFPSDNALLDSSGLPWGVAVTPFSSTDERGSSPVTGDEGDLIPRCTSCFAYFSTLCSLHRWSWTCPICSEDNDLSADAAARYARDGSHDPPELRSAFVDLLLPGEEGEAAAATTPVYVAAIDLSSSEEFLELVKSALLAALEALSPGSLFGILTFSSKIGLYDVQGPIPIVKNVFIPPDSDGTLHVDLKDVMPFCSFLAPVGTFKDHIAEALETIKPIASWERATTASQVQDHALHHTRGFGVAIDALVNYLSVENGPTFELGSVF

SEQ ID NO: 131962 - protein, 220 aa, Triticum aestivum
  Clone ID: PAT_TA_26380.pep
MRVAVVGGGVSGLAAAHELAASGGDGVRVTLYEEEASLGGHARTVAVDDGAGCVKLDLGFMVFNQVTYSHMMEWLEGLGVEMERSDMSFSVSSQSKGGGGGCEWGNGNGIPGLLAQKTNILKPSFWRMVREILKFKNDALTYLEDHEHNPDLDHNETLGQFIQSHGYSPSFQEAYLIPVCTGMWSCSPQDVLSLSAFFVLSFCRNNDLLQLFPHTQLPTV

SEQ ID NO: 131963 - protein, 244 aa, Triticum aestivum
  unsure (1)..(244): unsure at all Xaa locations
  Clone ID: PAT_TA_26381.pep
GTRSEMLVEIVSSFGQLAAYHFVCNEDLGGRCAFLEYIDHSITNKACAGLNGMKLGGCILTAVQGFPNPVEVRNEASPFYGIPDSAKALLEEPTNVLQLKNVFAQEEFLALSKPELEEILEDVRMECARFGAVKSINIVXEYPASSDSITEDVLVEPKDEPVKLEPSECRANDNCVETGADCSLPSRSIVVPSNPVEITGAECQDHKELDTLRECDGSAAADQYTDLDDIHARAAGPTVDQQTE

SEQ ID NO: 131964 - protein, 104 aa, Triticum aestivum
  Clone ID: PAT_TA_26382.pep
LEERNHMARQRRERLAAEERKQQEARRSVSLDSKKRKLQVARRLWTESRDLEHVRESASLVAKLIGLQEPGQVLREMFGLSFAPQQPPARRSSNGWRYGIPSFG

SEQ ID NO: 131965 - protein, 145 aa, Triticum aestivum
  unsure (1)..(145): unsure at all Xaa locations
  Clone ID: PAT_TA_26383.pep
MAMDDVAFAAGSSSSAMDALAAXSSAAAPADPSHGWQKVTYAKRSSRKPAAVAPAAAAAPGLGKPGGVFEGLDKRSQERHRAIQAARDAAAGYDSDDANARVPWGSXSSDEGSDSDGAAKDRPQAEAPKKPKKPKVKKPKVTVAR

SEQ ID NO: 131966 - protein, 103 aa, Triticum aestivum; identical to SEQ ID NO: 107316
  Clone ID: PAT_TA_26384.pep

SEQ ID NO: 131967 - protein, 103 aa, Triticum aestivum; identical to SEQ ID NO: 107316
  Clone ID: PAT_TA_26385.pep

SEQ ID NO: 131968 - protein, 476 aa, Triticum aestivum
  Clone ID: PAT_TA_26386.pep
SLRWFASSFFFLLLLERLGTAAALLPLGVSLAFYAASPKPSSFIPRAASSRISGRTPSSRGLLLTGGILRHLRTLVAVGLMLGMIAGFLGGSVFFSYKIGLEGKDAVMSLKSHVENGNYSEKIGLKKLLDDNDIPGLVEQYSGKLVETVWEQVDQLAVQYNLTDFTSGFKHFLISQSVPSGAKSKELIAWGRPRYSLKLQAITLRVKNREWLEIYRELDSFFRELLITREDLVVKAKDLALQGTEIAKSLLSSGTSVLGGSANLMLSIALRILSGAAEVLNFVSQLMVFMWVLYYLITVEGSGATEQVIDLLPVSKQVKERCVEVIDHAISSVLLATAKIAIFQGCLTWLLLKFFKVHFVYTATVFTIISALFPILPAWLSSVFAAAQLLTEGRYVLAVMVTVIHLVIMDYGTTVIQEDIPGYNGYLTGLSIIGGMTLFPNALEGAILGPLIMTVVIALKNLYTEFVLADTEEMSS

SEQ ID NO: 131969 - protein, 110 aa, Triticum aestivum
  Clone ID: PAT_TA_26387.pep
APSASIYPSSHGVREARRRPLGVRRAHGDGGGVRAVPAGARALQDAGHVLQELPPPRERVREVLHGRGWPTPRATARLGAGTALIDCAPGHQLQPRRLEDQDRRDEPLLD

SEQ ID NO: 131970 - protein, 280 aa, Triticum aestivum
  unsure (1)..(280): unsure at all Xaa locations
  Clone ID: PAT_TA_26388.pep
GNNKNDRHKALLAMAVGISQMQNVDVMARKFLNESYTVMLFHYDGNVDGWRSLEWSDKAIHIVAPNQTKWWFAKRFLHPSVVAIYDFIFLWDEDLGVENFDPRRYIDIMVSEGLEITQPALDPDLSTDIHHRITIRNKMTKVHRRVYDNRSSMNCSDDSKGPPCTGWVEGMAPVFSRAAWXCVWHLIQNDLIHGWGLDMKLGYCAQGDRAEKVGVIDSEYVVHQGIPSLGGPSDTSKLPRRSLDLRTHIRRQSSAELEKFKERWEKAVREDDEWMDPFDA

SEQ ID NO: 131971 - protein, 305 aa, Triticum aestivum
  Clone ID: PAT_TA_26389.pep
MEDANAVVDWNVDIIGPDGGSGACRKLAKTEDPDATECSSSFGDTLSGSQDDAKPSEISDIEVDSPFCRYPHNGDAAALLDAAAADNLDRLLKKKKVTDHWRSYISPLMWRCQWLELRMKDLQSQVSRYDRELAVLKHEKELQTKMIELDCSSSRSVPFSSHCCRKTMKRKKRKRNEEKINAPSYIATHTILSYYEKEKTEGDGHSIDDIGNLADDSTKGNNDADWLLGNGDDATVEQILVSIQSVQDRVCSLRSDLKKAMAKKSKGLLLKVNTQVNGAQSSNCSHGKGKVAEMPEISPQDASDC

SEQ ID NO: 131972 - protein, 89 aa, Triticum aestivum
  Clone ID: PAT_TA_26390.pep
RIHNYGKTGSDSLVHLDLGFKFHSLTKSVDGVLGQTYQPEYVNKVDISAKMPIMGGAPKYLSSSLFSTDCAVSKFRSNNVAGPVVTFAS

SEQ ID NO: 131973 - protein, 77 aa, Triticum aestivum
  Clone ID: PAT_TA_26391.pep
LNNIITHGNGCLLSLCGAAAAVLLLYGLSFPVNMGTSFCRHVKISLDSNFFTRAEVVTSSHNGKLAHQIFKKLQKLP

SEQ ID NO: 131974 - protein, 136 aa, Triticum aestivum
  Clone ID: PAT_TA_26392.pep
GGGGGGGPASPRRRRARPADRTPPPPPSAAPPPPPPPRRPRSGPPPGLKNLGNTCYLNSVLQCLASTPPLASFCLASRHSNLCKKVFPNRDKECAFCVLERQIVRQLRAEAGALDSPGKVLRSLPLFAEHFRWGRQ

SEQ ID NO: 131975 - protein, 90 aa, Triticum aestivum
  Clone ID: PAT_TA_26393.pep
GNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 131976 - protein, 142 aa, Triticum aestivum
  unsure (1)..(142): unsure at all Xaa locations
  Clone ID: PAT_TA_26394.pep
RTEGVFFREGGGRGQRPREASPRMAAVPPPETALSSAADGSDDEDGDQCRICRFPAEADRPLRRPCACSGSIXFVHDDCLLRWLATSRQSRCEVCSREITISPFYAPNAPARLPLSEFMLGLANKVMGWVIVLLSLVVTVLV

SEQ ID NO: 131977 - protein, 144 aa, Triticum aestivum
  Clone ID: PAT_TA_26395.pep
MCGGAVIADFVPAGARRPDGSSADVPGSILAGGEVKEKPLAPGRKTAYRGIRRRPWGRWAAEIRDPTKGARVWLGTYATAEEAARAYDVAARDIRGPKAKLNFPPAVGAPQAAAAVGGAGGAQEASVGRCRGELRVFVSPSGPG

SEQ ID NO: 131978 - protein, 70 aa, Triticum aestivum
  Clone ID: PAT_TA_26396.pep
RFCSCSESNFSIVHTQMFWKARKLNMQTQGHEQKQSSVPFLPRANRLKHFGDGGFKNCASSYYHLAATAL

SEQ ID NO: 131979 - protein, 203 aa, Triticum aestivum
  Clone ID: PAT_TA_26397.pep
PSRPIPHATCRLTKTLPGSSSTSRRDRMDEDRFRRCSTKTARRRLRSLLVLAADYLKYLFMNRRRLLRRVARRTHAVLSSYHGKSNKRLPPYYPPRALMEHEFSCSNSPSPVFLAAKRLHSRLKWGAAAGAAVSSCFGATVGASYGSPPATEEDDVVEEEDEADGLACYELEPDVDYRAEEFISMFYEQLRAQNFPPVLQRSP

SEQ ID NO: 131980 - protein, 119 aa, Triticum aestivum
  Clone ID: PAT_TA_26398.pep
MPPPPPPPQGAMATGAANHPLPCSVGRPKGTNQRRRPASLSVRASSDANTVTLLDYGAGNVRSVRNAIRHLGFNIRDVRSPEDILAADRLVFPGVGAFGSAMDVLNRTGMADALREYIR

SEQ ID NO: 131981 - protein, 246 aa, Triticum aestivum
  unsure (1)..(246): unsure at all Xaa locations
  Clone ID: PAT_TA_26399.pep
LCLSSYGYLNICVHGDTDELRPWCKAKLPLLYSFIQSHYWGVGFLRYFQVKQLPNFLLASPVLSLAVYSIVHYTKLLQQLFQSTSIHEQIIAIVDGRLVEAHESSDVATVLKSEISTGLHNKKQGNTEVKKRKSVAASAASAASLDGNISTGRMVGDNEDEXPLARGTLPFILHLTFMTFTAFFVMHVQVSTRFLSASPPIYWAASRILAPARGGSCKRWGYFIIVYFIAYILLGSLLFPNFYPFT

SEQ ID NO: 131982 - protein, 286 aa, Triticum aestivum
  unsure (1)..(286): unsure at all Xaa locations
  Clone ID: PAT_TA_26400.pep
VTERGRGRQQEGSGAEELRIGSGNVFAALETLKKKKKKPAAAEKKQAPLXEKPEVFWAPAPLTAKSWADVEDDDDDDYFATTAPLCPVRESQGGDADAGHEDDIEQEIESEDDSLDDEVDAAAEDEHEAGDAVLSEPAVQKAVAPLVPPKDTERQLSKKELKKKELEELDAVLAELGISHESSNATQDETNDKNGTCQAADGGKKEDASAPLESKTSKKKKAKKDKSSKEAEETLDQNNVVDGAASVEPDEDVASVDVKERIKKVASMKKKKSSKEMDAAAKIAAS

SEQ ID NO: 131983 - protein, 163 aa, Triticum aestivum
  Clone ID: PAT_TA_26401.pep
RYLKDSLSKKELKKKELEELDAVLAELGSAYESSNATQDETNDKEGMGQAAEAGKKEDASAPLESKTSKKKKAKKDKSSKEAEETLDQNNVVDIAAGVEPDEDVASVDVKERIKKVASMKKKKSSKEMDAAAKIAASEAAARRAKLVAAKKKDKNHYNQQPLR

SEQ ID NO: 131984 - protein, 264 aa, Triticum aestivum
  Clone ID: PAT_TA_26402.pep
FLVTTVIQPIANICRSSSVSDHVYTMATLADQDSRILFFKEAFQDDDLPQHVDDLGSAALKKCDGLPLALVATARFLQSAGNPTPMKWAKLCADLGTHLESDELFARMRRVLVQSYTSLDTQVARTFLLYLGTYPSGRPIKKSSLLRRWLAEGLSPVDNTCSDVDAAISNFDKLVDRSIIQPTDASGNSTEVKTCHTHGMMREFVLRKSMSDNFVTVLYNGQSNPSIPSNIRRLALHHARPREVQGLTLVRSLTILGEAHPSVL

SEQ ID NO: 131985 - protein, 115 aa, Triticum aestivum
  Clone ID: PAT_TA_26403.pep
NVLASPARSQSRTSLPGNVRTMPNVLGRSIAWPRRYVKLLSDHVYFCSCRSNCILLIILCIYADGDLSQGYAEATMKAGSSPHIYTALQIVRRLYPQVSRGVFCELNRSSTSICF

SEQ ID NO: 131986 - protein, 101 aa, Triticum aestivum
  Clone ID: PAT_TA_26404.pep
FRAAPPVAVVFSEPCVSLLPPTSHECGVFTFKYMEIFTPRTQMANFFSSADIPNLRIRYANDMFCSPMNSCDKSFVTGFYRDGEAMPGEVKHVCGPSTNGG

SEQ ID NO: 131987 - protein, 59 aa, Triticum aestivum
  Clone ID: PAT_TA_26405.pep
VLDIPDTDLLKHSDECFGFIDEAISSGGNVLVHCFAGRSRSGAGMENATCAALIIILVL

SEQ ID NO: 131988 - protein, 219 aa, Triticum aestivum
  unsure (1)..(219): unsure at all Xaa locations
  Clone ID: PAT_TA_26406.pep
MARLQLXAVAACAVLLALAAPSLAGDPDXMLQDLCLADLKSSIKLNGFPCKADITADDFFFAGLKKAGNTNNPAGSNVSGGKRTVHSQGVNTLGVSMARIDYAPGGQNPPHTHPRATEIIFVLEGVLEVGFITTANKLFTKTITVGDVFVFPXRGLVHFQQNRGHGPASVIAGFNSQLQGTQAIATTLFAAAPPVPSDVLAKAFRVGTEDIDAVKAKFK

SEQ ID NO: 131989 - protein, 223 aa, Triticum aestivum
  unsure (1)..(223): unsure at all Xaa locations
  Clone ID: PAT_TA_26407.pep
MSEVFEGYERQYCEESASLSRKWPAASALDGEKKKQRLSEIQSGVQEAESLIRRMDLEARNTPPSVKAGLLAKLREYKSDLNNLKSELKRISAPNARQTTXREELLESGMADTLAVSTDQRGRLMMTTERLNQSTXTELKESRRTMLETEELGVSILQDLHQQRQSLLHAHDTLHGVDDNVGKSKKILSAMSKRMDRNKWIIGGIISALVVAILIILYFKLAH

SEQ ID NO: 131990 - protein, 129 aa, Triticum aestivum
  Clone ID: PAT_TA_26408.pep
MEKPPIPSIISTVTYCCGACGYDLRLSSLARDTAGGAGARRRCVGAAEVVFDAIDDARFGHLEEFRWLDVRACLPFSRRTRLLCRKCGARLGYGYDDTAAADRPPRYHIKIRALQPAPGPACGAVRSVI

SEQ ID NO: 131991 - protein, 256 aa, Triticum aestivum
  Clone ID: PAT_TA_26409.pep
MAVGKNKRLSKGKKGLKKKTVDPFSRKDWYSIKAPNPFNVRDVGKTLVNRTTGLKNANDALKGRILEVSLADLQKDEDHSFRKVRLRVDEVQGKNCLTAFHGLDFTSDKLRSLVRKWQTLIEANVTVKTTDDYLIRLFAIGFTKRRGNQVKKTTYAASSQIRAIRRKMTDIIQREASSCTLTQLTSKLIPEVIGREIEKSTQGIYPLQNVHIRKVKLLKAPKFDLGALMALHGESGTDDQGQKVEREFKERVLEEV

SEQ ID NO: 131992 - protein, 89 aa, Triticum aestivum
  Clone ID: PAT_TA_26410.pep
SATGRCASRREELEKWMAAYPQSRVLVGVVASPEADRDGYVSHKDLYYDVLQFINKLPNYGGIMVWNRYWDKKTGWTAGNEPGLLDQVL

SEQ ID NO: 131993 - protein, 109 aa, Triticum aestivum
  unsure (1)..(109): unsure at all Xaa locations
  Clone ID: PAT_TA_26411.pep
RTCRKKKTDDDVTFLEDVKEHIDEFIHASMDEHKTCFKKXTFEKMFGDVRRVVRRSGPSAAKEAAAENALPLHTKCVPSRGMRPGGGPLLLSRWFGSSGHDKFRVRKLE

SEQ ID NO: 131994 - protein, 54 aa, Triticum aestivum
  Clone ID: PAT_TA_26412.pep
YPVHFSSVVGTYFQIPTIVVHHIMLCNICPLCCTFLNHLSFSCIKKKKKILVGG

SEQ ID NO: 131995 - protein, 70 aa, Triticum aestivum
  Clone ID: PAT_TA_26413.pep
SWTRGRTRGLSARQQSTPFDILRRFLCIAKWAMKQKISGKKQQRITQLVVPRSCSSRHHQHVQAVQAVTC

SEQ ID NO: 131996 - protein, 118 aa, Triticum aestivum
  Clone ID: PAT_TA_26414.pep
FLATLSKVPGLAHLKLVATSLGRLVITKGTLKSLVRLSILVKSMIGQLEIQEGALPRLRSMQLLCKDLAGSISGTSAVHSLGHLDEIALHRDVGDETKNEWKEAAKNLPGRRPKILFL

SEQ ID NO: 131997 - protein, 253 aa, Triticum aestivum
  Clone ID: PAT_TA_26415.pep
ADEELATEVAWVVVYLSALSEKAISLIVRSHVPQLLIGRLLASENLQLLIPVLRGLGNLVAGDEYMVDSILIVGNSITDQALSSLIKCLKSDNRVLRKEASWALSNIAAGSFEHKKLIFTSEATPSLIHLLTSAQFDIRKEAAYTLGNLCVVPAGSTEPPNIITEHLVSIINGGALPGFINLVRSADIESARLGLQFLELVMRGYPNGQGPQLVERGDGIEAMERFQFHENEAMRNMANGLVDKYFGEDYGLE

SEQ ID NO: 131998 - protein, 78 aa, Triticum aestivum
  Clone ID: PAT_TA_26416.pep
RSVYPHCPKGVYGVFSIDSILLFAMGYRREGYLPYDISVSINSIGFFLSCCTYTLMRRKYTPKKLSTELRETYEEKHA

SEQ ID NO: 131999 - protein, 197 aa, Triticum aestivum
  Clone ID: PAT_TA_26417.pep
MMEAHMERALQEGVTEAERAALEGTVRAHHTFPGRVPGATCTSLVAQRVAAPVRAVWPIVRSFGNPQRYKHFVRTCALAAGDGASVGSVREVTVVSGLPASTSTERLEILDDDRHILSFSVVGGEHRLRNYRSVTSVTEFQPGPYCVVVESYVVDVPDGNTEEDTRMFTDTVVKLNLQKLASVAEETAAAPGSRRRD

SEQ ID NO: 132000 - protein, 91 aa, Triticum aestivum
  Clone ID: PAT_TA_26418.pep
GISPTLSDKKEMRRTCQARQLDLPSSTNITCRKNLYLYLILKGGLFLHFFVINDFSYAHPPFRTSSHFLFSFCVAPKRKLRFVKKEAAKKK

SEQ ID NO: 132001 - protein, 49 aa, Triticum aestivum
  Clone ID: PAT_TA_26419.pep
GERSGGKNGLAQGQGSDASRIKEAMELATQIASMKLNFNASRVKEIKVY

SEQ ID NO: 132002 - protein, 260 aa, Triticum aestivum
  Clone ID: PAT_TA_26420.pep
PISSQIPNLAAAGVTRRRLSALLLSSRATPRRLLLLTGAAASASSAHLSPWAPPSRGAKTALPGRPGYSPLNDPSPNWSNRPPKETILLDGCDYEHWLIVMEFPADPKPSEEDMVAAYVKTLTAVLGSEEEAKKKIYSVCTTTYTGFGALISEELSYKVKGLPGVLWVLPDSYLDVPNKDYGGDLFVDGKVIHRPQFQFTERQQVRSRPRPRYDRRRETMQVERRETMQRGPSVQEHRPSFSQQVPHNNGQHEIVPPGRN

SEQ ID NO: 132003 - protein, 245 aa, Triticum aestivum
  unsure (1)..(245): unsure at all Xaa locations
  Clone ID: PAT_TA_26421.pep
MPRSGGRAPAAHSAAPRMVLDTKTGSNLLQWPVEEVETLRTNSTDLGGVTIDRGSVFPLSLHRATQLDIEATFRLDPLDIAVTNEADVGYNCSTSGGTTGRGTLGPFGLLVLADARRHGGDMERTGVYFYVARGLDGXLRTHFCHDETRSSRANDIVKRGVGHIXVPVLNGEELSVRVLVDHSIVESFAMGGRLTATSRVYPTEAIYANAGVYLFNNATSARVTTTRLVVHEMDSSYNQAYMASL

SEQ ID NO: 132004 - protein, 257 aa, Triticum aestivum
  Clone ID: PAT_TA_26422.pep
NPDSAIWGNKIAWGHAASRDLVRWRHLPVATSPDQWYDINGVWSGSATVLPDGRIVMLYTGSTNASGFQVQCLAFPTDPSDPLLINWTKYENNPVMYPPPGVGDKDFRDPTTAWFDGSDDTWRLVIGSKDDHHAGMVMTYKTKDFIDYELVPGLLHRVPGTGMWECIDLYPVGGVRGIDMTEAVAAASNNGGGDVLHVMKESSDDDRHDYYALGRYDAAMNTWTPLRRGRCRRHGADLRLVLRVQDLRRRPAHTLLP

SEQ ID NO: 132005 - protein, 609 aa, Triticum aestivum
  unsure (1)..(609): unsure at all Xaa locations
  Clone ID: PAT_TA_26423.pep
MKYVLVTGGVVSGLAKRVPAGSSAAPLVPRGRRAPSLAIGPVPNAAARAIAPGGPRGVFVLDDGGEVDLDLGSYERFLDIKLTRDNNITTGKXIYQSVINKEREGEYLGKTVQVVPHITNAIQDWIERVAMVPVDGQEGPADVCVIELGGTIGDIESMPFIEALGQFSYRVGAGNFCLVHVSLVPVLNVVGEQKTKPTQHSVRGLRGLGLTPNMLACRSTKELEENVKEKLSQFCHVPAANIFTLYDVSNIWHIPLLLRDQKAHNAILKVLNLESVAQEPKLDEWVARATLYDTLQDEVRIAMVGKYTGLSDSYLSVLKALLHASVSCHKKLVVDWVASTDLEDSTASEAPDAYKAAWTLLKGADGVLVPGGFGDRGVKGKMMAAKYARENNVPYLGICLGMQLAVVEFARHVMKFPDADSTEFNPNTKTPCVIFMPAGAKTHMGGTMRLGSRRTFFKVTDCKSAKLYGDVNYVHERHRHRYEVNPDMVPAFENAGLQFVGKDETGQRMEIIEIPDHRFFVGVQFHPEFXSTPSKPSPPFVGLIAAACGQLDQVSAGXACNGHVVAAKHKLGDSFSTPLVHQNGHAQKQANGGVANGTCHANGNGSTHG

SEQ ID NO: 132006 - protein, 331 aa, Triticum aestivum
  unsure (1)..(331): unsure at all Xaa locations
  Clone ID: PAT_TA_26424.pep
MGRDKSRRLSGSRDFRQRLVLATLTSTPITIRDIRAGEGGLRPHEMSLLRLLDKVSDQHVIDVNDTGTKVGYKPGVVLGGKDLEHDCGVHRGIGYFIEPLILLGLFARSPLSIRLKGITNDTKDPSVDTFRMVTLHMLKHFGVPLEGLELKIENRGAPPRGGGEVLLRVPNINSTLKAVNGIDEGMVKRIRGXAGYGVSVVAEPTTGCLISADATVSYPNVDEVSEQSKKPELMSPEDLGEQVASMLLEEVAHGGVVDSTHQGLLFMLCALCPPDVSKVRVGQLTPHAIESLRNIKEFLDVKFIIKPDPNSNTVTLKCVGAGVKNLARKIS

SEQ ID NO: 132007 - protein, 118 aa, Triticum aestivum
  Clone ID: PAT_TA_26425.pep
FRTDGVDEEHVVQLVDTFPGQSIDFFGALRARVYDDEVRRWVSETGVENIARKLVNSKEGPPTFEQPKITIEKLLEYGHMLVAEQENVKRVQLADKYLNEAALGEANEDAMKTGSFFK

SEQ ID NO: 132008 - protein, 247 aa, Triticum aestivum
  unsure (1)..(247): unsure at all Xaa locations
  Clone ID: PAT_TA_26426.pep
SARGVDPLCYEALECLVDNYMLTCEEESELLASLKFGKEDGWLSAFYSCLIRKHEKEYVVEAKFKELERESCSISPSSGQMMKNNIDVLACKAEYYHQSGEYQKCFELTSVLLERDPFHLKCTLVHLAAAMELGHSNDLYLLSCNLVKDYPQKAISWFAVGCYYYCIKKYDQARRYFGKATGLDGTFPPAWFGTGIAYAAQEEGDQAMAAFRTAARLFPGCHLPTLYMGMQYVRMHNFKLAXAVLHA

SEQ ID NO: 132009 - protein, 241 aa, Triticum aestivum
  Clone ID: PAT_TA_26427.pep
RVGDDFARVAQDEGRHFAVLSARLRELGSHYGALPAHDGLWDSAMRTSHCLLARLAVEHCVHEARGLDVLPTTISRFRSGGDEETAKLLEDIIYPEEITHCAAGVRWFRYLCLRSLPSDPIAPPVPQPKSQCSELLEGRTGDDNKTSQAVHDGLADKPTEDINSHDEAVQQVGDGLARCSLGDADEMAIIERFHSIVREHFRGPLKAPFNAEARKAAGFGPAWYEPLAVKEVETQAIEQSE

SEQ ID NO: 132010 - protein, 105 aa, Triticum aestivum
  Clone ID: PAT_TA_26428.pep
GPMMPTVQSRSPSRGSGLPLGPSRRSSTSPPPFSTKSPKGSLPLAITHSAPLLAERLKGGIRGMPPPPALKRAAISIVVCYVAMQQDAFVDGIILMCVTCDVMKH

SEQ ID NO: 132011 - protein, 250 aa, Triticum aestivum
  Clone ID: PAT_TA_26429.pep
RTRIHLSRSRRTNPAPSILARSTPPCRQRLFLAGSASLVPSPLVLQAANSGDPIARSSLHARLLLFGSSRIPSRVERSFQPSAASCRSPEQLQAATSHAGDPPLPRHAPSPSSTSPSFYTSSPKTPAPCTILLLPLDMEYASSRPFRRCQAQEGAKIPSTTTSTTIKFNYIDYDRRRPGTSTECVRVLSPKTRVAKMSSTYDRRTPSTSPKNEHVPLRTEASDPSSSTMRCTTIVDPEDLGFTKFPRRPV

SEQ ID NO: 132012 - protein, 237 aa, Triticum aestivum
  Clone ID: PAT_TA_26430.pep
DQSSLVSLQQPTLLMPEPHQIHQPPPPPPPPTDPNPVASTAANARRNPAPLPLPLPLPEIAVPPVQPKMIIKGMLGRYERWNPVHPTAGAFWGVGLGFGCGVGWGPGFGPEVIGYVGAGCGVGFSVGITLAGVGVGLPQHGIIRNHYHGGGFASNVPFESARFYLLTMLKGMVWDAISYASNVAAMRKESRQKLLRCQENPQVSGGFDLPKLGKGMSSSFRSTMECIKAFTNQHWPP

SEQ ID NO: 132013 - protein, 247 aa, Triticum aestivum
  Clone ID: PAT_TA_26431.pep
ACAESVHVSDVLEPAFDLEKTYFGGEGSDIQKELHEGSTLVTREYMAVDPAPCAEPTDVSLTEQNRGALCMDSLAAIEQFMTASPEEEPQCSSPIALSPWGESGYYQGDAVDSGLGGVQDDTINEMWSLLSPTPTPQNLSGVKSEAEGGAHVVNAATVAQGEYDFFQRDPTPGVHWGLTEVKPKATAASASPIDVNVSTGAFGWQPSSERSNAASASPIDVNVSTGFGWQPSTDSNPHGALATIQTT

SEQ ID NO: 132014 - protein, 103 aa, Triticum aestivum
  Clone ID: PAT_TA_26432.pep
ASGRPAAEPHGLIELARQRRGLLLLLLAAGLTRPLLPVVHRRIPPLRRQDAEGEEDITEAEPEAAGARAGAILVDVRRVGGAVVQLVVAQEQHRRARGHRLAS

SEQ ID NO: 132015 - protein, 162 aa, Triticum aestivum
  unsure (1)..(162): unsure at all Xaa locations
  Clone ID: PAT_TA_26433.pep
ATTSSTTAPPTRRTSTRMAPAASGSALAMSSSPSGVLAPKRRDAAVHDGKQEGASSAAGRGGRRSPADAWRASPMRPCGSAAGPPAILSYLNSGVPFYLLLRSAVQACAVPICDSGNIFVYKMWMCIRISFFSFCVKSWVKLFSEKNRSEDIAKGLIXLRRR

SEQ ID NO: 132016 - protein, 184 aa, Triticum aestivum
  unsure (1)..(184): unsure at all Xaa locations
  Clone ID: PAT_TA_26434.pep
FPVPDPVVELDADFKVSLRRHDSSSFSTTXSFRNLSRSLRVSGNDMFSQPILARRFSVCDPVNIGFRPSDFDGNFKCIGSPVDEYIEEGTSNGAYFSPFPYGYGTXTPMEEDEEQPNTSRCPXYCLVASKQMVGRFLTFWVPGIAPVNSEATICHLRGVPCRCCSVGGAACLCPLRSGASALNF

SEQ ID NO: 132017 - protein, 230 aa, Triticum aestivum
  unsure (1)..(230): unsure at all Xaa locations
  Clone ID: PAT_TA_26435.pep
MESVGVAPAPAAVAVAEQKMKLLEPRKEPLASAAAAAAKAPCKWAMKKKLVGGDAGYVLEDVPHLTDYMPELPTYPNPLQDNPAYSVVKQYFVNTDDTVTQKIVVRKNSARGTHFRRAGPRQRVYFQPDDVNAAIVTCGGLCPGLNTVIRELVCGLYDMYGVTSVVGIEGGYKGFYSRNTVTLTPKSVNDIHKRGGTILGTSXGGHDTAKXVDSLQDRGIHQVYIIGGDG

SEQ ID NO: 132018 - protein, 199 aa, Triticum aestivum
  Clone ID: PAT_TA_26436.pep
CNRIIAFRYTDLQQATTKFTDKLGAGSFGSVFKGFLNGSVAIAVKRLDGAYQGEKQFRAEVSSIGAVQHVNLVKLVGFCCEGSKRLLVYEHMSNRSLDVHLFRNNSMILSWTIRYQIALGVARGLAYLHESCRDCIIHCDIKPENILLDDSLIPKVADFGMAKLLGREFSRVLTTTRGTPGYLAPEWISGVAITPKVDV

SEQ ID NO: 132019 - protein, 162 aa, Triticum aestivum
  unsure (1)..(162): unsure at all Xaa locations
  Clone ID: PAT_TA_26437.pep
MFGFSRRRMKLGRLKGHLHDPFHGPRSPAHPTKRSSHLTGEEPVVTSVSGRPDDLAWCCSSDTFDLNGRAFESSENWAVLSTDGDKPSPRFDHAAAMVGSKMIVFGGDSGNHLLDDTKILSLDKLTWDSVASKVRVSPGXTSCAVSTXKGHCLVPWDKTVIL

SEQ ID NO: 132020 - protein, 58 aa, Triticum aestivum
  Clone ID: PAT_TA_26438.pep
LVGSQKLKKIKQHKNKKAGISFPSYSIIIYSGLISMLKTNQKYLGKFHICFYLHNITL

SEQ ID NO: 132021 - protein, 211 aa, Triticum aestivum
  Clone ID: PAT_TA_26439.pep
MPLCLPPWLLSVRRTLQYSNSSGSPCVSESGSDIYIKREVIQKLRQHLRRRDEMIMEMQAQIADLKNSLSIEETQTANLQSQLDGANRDLFESDREIQQLRKIIADHCVAEALSRDKPLQAGNWQPDAANGHANGYADSSIDDPELHCIGIEKRNGEAERVEMLKREVGELKEVIEGKDFLLQSYKEQKVELCSKMRELQERLSAQVPNIL

SEQ ID NO: 132022 - protein, 135 aa, Triticum aestivum
  Clone ID: PAT_TA_26440.pep
ARRRKPRVLHLQGRRDWRRPGVGRGAGEFVRNGAKVILTDIQDDLGHAVAAELGPDASYARCDVTDEAQIAAAVDLAVARHGRLDVLHNHAGVTGRMSLESVASLDLADFDRTPSRRRSGCAGWQSCCRRRARRS

SEQ ID NO: 132023 - protein, 74 aa, Triticum aestivum
  Clone ID: PAT_TA_26441.pep
LTVVIAEIINVDRHYASKSTDLIHRQLASRKELGDKLLHTVWFRRSPPGITSSHAYHLHTPENPIYWRLLFTAL

SEQ ID NO: 132024 - protein, 322 aa, Triticum aestivum
  Clone ID: PAT_TA_26442.pep
MEPQPPTSTEEEAAAGSTTPRFRLGKQSSLAPNRGGGGGENGAEASGEAAGVASFQMMYLAHEGNAEGIRELLDAGADPNFRDSDGRTALHISACEGHAEVVELLLDRGAEAVVEDQWGSTPLADAMHYQNHDVIKILEKHGSNHKVAPMHVNSDRDVPEYEIDPDELDFTNGKDLAKGTFRKATWRGILVAVKKLDDDVLTDENKVQAFRDELDVLQLIRHPNVVQFLGAVTQTNPMMIVMEFMPKGDLRKHLNRKGALEPLYAVKLALDIARGMSYLHEHKPQAIIHRDLEPSNILRDDTGHLKVADFDLCKMLKWRRKV

SEQ ID NO: 132025 - protein, 189 aa, Triticum aestivum
  Clone ID: PAT_TA_26443.pep
MVSVSFKIHGAVAALLLGSLILCSGASMDQPAAYKHVAPAPTPAPAPIQPVIIVQGLIYCKSCNLRGYNAGMDASPLANATAKLVCYGSKGGYRVLNMTSTATDESGYFLVMVYDLAMFSRRSCRVYLRTSPTPLCDAPFLPADASLGIVLKREEVRPSSPAGVRGVYSARTALMYAPRKGGKCPAYNY

SEQ ID NO: 132026 - protein, 98 aa, Triticum aestivum
  unsure (1)..(98): unsure at all Xaa locations
  Clone ID: PAT_TA_26444.pep
KAHSPSTQRNCLMLCTLARFTLFCLKFFIKYLLYTLMCLCDRQCIVCARVPDNEWFRLQQPYQSRALTLARPVLSIIDFXRPLDIQTALAYECQSFLP

SEQ ID NO: 132027 - protein, 178 aa, Triticum aestivum
  Clone ID: PAT_TA_26445.pep
QYQIHKPAERKKMMSTKALTLGAVVVLAIAMAGAHAEQCGHAADGMECPNNLCCSAWGYCGMDANYCGDGCQSGACYEPKRCGAQAEGNAVTCPNNHCCSGNGYCGYGQEYCGDGCQNGPCRANIKCSADKPCLSNFCCSKYGYCGLGVEFCGQGCQSGACHDAVGAAALPLSSIVQG

SEQ ID NO: 132028 - protein, 141 aa, Triticum aestivum
  Clone ID: PAT_TA_26446.pep
FGNMVLWAFPRLQVRDILNSSYGSVIGVIRDAVARINDEYVQSFVDFGGVADANGEELVATAAAAGTMFCPDAEVDSWLGFRFHQLDFGTGAPSAFVPPDLPFEGLMIFMPSRKANGGVDLFMAVAEEHVAAFEQICYSLD

SEQ ID NO: 132029 - protein, 172 aa, Triticum aestivum
  unsure (1)..(172): unsure at all Xaa locations
  Clone ID: PAT_TA_26447.pep
MNHLTSKHLSGGLEDSLVQTVDEQPPICFSTDKISCRKRKTANIKTSRSRPNVHLFYLANILNDQEFQEFDEESHRRTKRDVYPQTKSLAVRTTRSLVQKQRSTTLQHQCGTMIGRGWMFRCSPGWPWRTRTPRRRRRSSGARPPPPRWPGDGRARRATRPPVATRAAARXG

SEQ ID NO: 132030 - protein, 159 aa, Triticum aestivum
  Clone ID: PAT_TA_26448.pep
RPATTGKGDACHPSKRQHLRLPLALHCCTTPSSRPQPRSRNHMPDSGRGHARRLARAVQREVGSIPCARGSCSASWIPSRRRACLDARIWTRRGSGGAPQRRRLLFAIELLNLQDTFQPSLLLMHLKFSYNAFNIYTVWSIFLILRQTAVQKKKKKKHT

SEQ ID NO: 132031 - protein, 139 aa, Triticum aestivum
  Clone ID: PAT_TA_26449.pep
MRGGKSSVKTMAVMLAVVGLVALQQTQRVQASVCCCLDLAVPVYYTCRGSSGTMSQCCPTCGGYVSVGGCRPPYVPISGYRTTTVNYCKVGCTASVCNKLIPSVIGSGNEGKDAMERCTSGCHDLCTKSSTDIAKVHNA

SEQ ID NO: 132032 - protein, 194 aa, Triticum aestivum
  unsure (1)..(194): unsure at all Xaa locations
  Clone ID: PAT_TA_26450.pep
CSPSAAASRAELPHGDGPGHARVWRLRRPPAAAPATPKSQTXLVERYRDGAAKRYMLDGDSKLQVQWEKHDESSTNTVEDENANSSIPRAVSDFVLPAGFPESVSDDYLQYMLLQFPTNVTGWICHTLVTSSLLXRWVSKDGIGAFGRLLIGGRFGTLFDDDPKKWRMYADFIGSAGSIFDLTTPLYPGYFLPL

SEQ ID NO: 132033 - protein, 294 aa, Triticum aestivum
  unsure (1)..(294): unsure at all Xaa locations
  Clone ID: PAT_TA_26451.pep
PVKGRGRPKVPPIDASEXIPWVSLASTSAPDXRRNNIQNVLKTNMSMPLAEVVICNTSMELEPDALALLPNALPLGPLVAPTSRPAGHFLPEDLASLTWLDAQPAGSVVYVAFRSSGFLDATQFQELSDGLALSGRPFLWVVRPKFTTGPGQDRFDLNAFKRRVEGQGLVVGWAPQQRVLSHPAVACFVSHCGWNSTVEGVLHGVSFLCWPYFADQFCNQSYVCNVWGTGAKLRRDERGVVSKEEVQRKVARLLGDGEVKARAATWKEVACGSIREGGSSHGNLLKLVSLLRQQ

SEQ ID NO: 132034 - protein, 170 aa, Triticum aestivum
  unsure (1)..(170): unsure at all Xaa locations
  Clone ID: PAT_TA_26452.pep
PSLRPPSNPHRPGRGGTGAGWRTIYYVGNLPGVRREREVEDLFYIWRRIVDIDLKVPPRPPGCAFVEFEDPRDAEDACAGRDGYNFDGNRLRVEPAHGGRGSGGPSHDRSSSFGGGGGGGGGGVRRGXLDSHVLPSFWFLALPSSASWHDMKDHMRKAGDVCFAEVYHEG

SEQ ID NO: 132035 - protein, 339 aa, Triticum aestivum
  unsure (1)..(339): unsure at all Xaa locations
  Clone ID: PAT_TA_26453.pep
MATGDGAEGTGRRGVPSLLAGGGTGQEEHIASDVTQLIGWTPLNELKRISGRERVGDRIVGKLEAXQPLCYVKGRRAQRMIDDXDRTGVFPTSVNFVVELMIIDLGLGXGLVAVMKGXCSLDEQTGLRYMGAELFITDPAAGLTVTVETLEFPGIEERVEQLHKEFPNVQVLDPFIKPAKPDAHMGTAGTVDVFVXKVDAEEVLDAGLGTIGRXQNPTRDQICVVRTEGPVISGGEPGKHXIQGIGPGLLPEILDTSIIDQTVTVTTEEAMTNAWRLAMEEGLLVGISCGANLAACLKVAAREENKGKMIVTMFPSGGERYMNSDLFAAVREECIAMTF

SEQ ID NO: 132036 - protein, 82 aa, Triticum aestivum
  Clone ID: PAT_TA_26454.pep
QMPPALGPWGRRAIALHPIRASSHSTEKQISRATDQIDFPLLIHGLACGIPPLADPAFSFQSPEESDFPHYLSCFQSFGPAS

SEQ ID NO: 132037 - protein, 209 aa, Triticum aestivum
  Clone ID: PAT_TA_26455.pep
AVPADIRRAVGEGTTRDLPSTTSLLLAFLDDLPLFHQVIGELADPELALCRKDKGRAAELKGRGNACFSRREVEQALGFYSQALRYAPISSDGTGDILVPALYVNRASTMHKLGLLEECLRDCDRAISVSPNYAKAWYRRGMVNASLKNYSSAMHDLEVALSMEVTSSGKSNIEQELKLILLKPQCVNKVGRSSSDCKDARLAHTADAH

SEQ ID NO: 132038 - protein, 277 aa, Triticum aestivum
  unsure (1)..(277): unsure at all Xaa locations
  Clone ID: PAT_TA_26456.pep
VEYGAGDEGFFAVYDGHGGSRVAEACRLRMHLVLAEEVRLRRLQPGGGGQGQDEDDENVTRWKEAMTACFARVDGEVGVDDGTDAGXXTVGSTAVVAVVGPRRIVVANCGDSRAVLSRGGVPVPLSADHKPDRPDEMERVEAAGGKVINWNGYRILGVLATSRSIGDYYLKPYVIAEPEVTVMDRTDKDEFLILASDGLWDVVSNDIACKIARNCLSGRAASKYPESVSGSTAADAAALLVELAMARGSKDNISVVVVELRRLKSRTAAVIKENRRW

SEQ ID NO: 132039 - protein, 161 aa, Triticum aestivum
  Clone ID: PAT_TA_26457.pep
VWVWPSPSRSPSLLLLYPQTPFLLSNPKFEPNTVRARSNLLEVSAEGSSDNQGYKQSVDSVVPSGLVEGKVFFSIAWVPFAAPGTMMLATSGAWEVFAELPVKDQLECSLATSRAWEVFPDLPVKDRLECSLVWTAILRIEQQRTPVYNLSHVFSPEGPFS

SEQ ID NO: 132040 - protein, 352 aa, Triticum aestivum
  unsure (1)..(352): unsure at all Xaa locations
  Clone ID: PAT_TA_26458.pep
SARGVDGHSGDWVGVDWDGGAGGRHDGSLAGRRYFAAAGDRSASFARPSALSAGIALPDALRLRYRVDDFTKEEEDEMYVFSTSQKRVSVELVGTNKVRDKLKNFDELLCASVSFMGVSSAGSPEELQGLVPNLRQLDLTGNLISQWQDIFSLCQALPSLEVLDLTNNTMENDFVESPLLKNIRVLVLNNCGVTWELIEKLKVPFACLTDLHLIWNKLNIITTPVGNFVQGFDTLRLLNLEDNHIVSWDEMVKLSYLRSLEQLHLNKNKIKHVRYPYNLPSSGPLGDVAVPAFEKLQVLLLGSNEIEDFPSVDSLNLFPSLMDVRISDNPIADPXQGGAPRFVLVARLXNVK

SEQ ID NO: 132041 - protein, 243 aa, Triticum aestivum
  unsure (1)..(243): unsure at all Xaa locations
  Clone ID: PAT_TA_26459.pep
PVGPPRALSASYPGPPPPPLTSRPHLSPXRLHHRHPSPRPRSARPPLRCGPVRGPXPPPPRRPRPARPRPRGPFMCWAPRPPPAVSRPXPEPCPTRPHPPDPPPRDRRPFLLCAPHEGEGPAPPLLLHCELSFSLGSIRGRTGSPFSPLHRMRGKRDPLPPDPSAHCPLLLARASRESWTPAAVGFGFHRASSHGIHGSPSGSAPPPVPRRTPVRRQGPRRRPGGLHISSPSGDHRRAARRHV

SEQ ID NO: 132042 - protein, 246 aa, Triticum aestivum
  Clone ID: PAT_TA_26460.pep
GSELQLPPNLTLQPRALQLIESIRAQVHAACGPVVSCADITALATRDAVAFSGGQGYDVPLGRLDSLAPAPSSAVFDLPQASSNASTLIDVFDTRNLDNVDLVALSGGHTIGKGHCSSFSNRFSEDSDFVRSLASNCSSDFNRLQDLDVTTPDVFDIKYFTNLQQGKGVFTSDQKLTADWRTEWVVNGFAGNHWWFFGQFAASMTKLGNLQGPQGNVGEIRRNSCFVRNGQSILTTTSDEGLAASA

SEQ ID NO: 132043 - protein, 145 aa, Triticum aestivum
  unsure (1)..(145): unsure at all Xaa locations
  Clone ID: PAT_TA_26461.pep
LCFEYMKNGSLDQYIEDACSGLSWHRRDQIIKGISEGLRYLHEGLKTPIIHMNLKPSNILLDHNMIPKNSLIXGLRRLVGEGNARCMGTIAYMSPEFIERQVISHKCDIYSLGVIIIKLITGGEXYSGHFDMSSDRFIELAHEEW

SEQ ID NO: 132044 - protein, 299 aa, Triticum aestivum
  unsure (1)..(299): unsure at all Xaa locations
  Clone ID: PAT_TA_26462.pep
PIQKSSKNDNIITCAENSNLSAIPKGIHLPRVVLCLAHNGKVAWDIKWKPPLQNQLEQKSRLGFLAILLGNGSLDGWEVPSPSMIQKIYSSSSVKGTDPRFLKLRPVFRCAKVKCGNIQSIPLTVDWSPSPHDMILAGCHDGTVALWKFSTDLPAQDSKPFMCVTAESVPIRALSWAPYVSEEDTNTFVTAGEDGLKFWDLRDPYRPLWELTTAPRAGLSLHWLKEARGIXISLEDGTLKFLXLPRIGNDVPXTGRPLLGLKXQXGSTYQLXEYLIWNXHVXXIPVHLFGKTGGRFHLL

SEQ ID NO: 132045 - protein, 118 aa, Triticum aestivum
  unsure (1)..(118): unsure at all Xaa locations
  Clone ID: PAT_TA_26463.pep
TTGXFFTSSSVLPPPPVQFSSVQLSCGSDRSPLHSTGSGTVISAVLAVWNACFSVVSTCTICNVSLLLPFRVFVWYLWYCKVHGHDRQGKHMYTPLEGCALRLCPSLEDRSCMYFSPI

SEQ ID NO: 132046 - protein, 353 aa, Triticum aestivum
  unsure (1)..(353): unsure at all Xaa locations
  Clone ID: PAT_TA_26464.pep
HLALPCNKAARSQIIPDIIKCYSHGGRTIIFTETKESASELSSLIPGSRALHGDIAQAQREVVIAGFRSXGKFLGLXATNVAARGLDINDVQLIIXQCEPPRDVEAYIHRSGRTXRGWQYWHLLSCFLNPXYKFGVTRIERESGVKXEHIXAPQPTDVAQSAGNEAAEAIARVSDRVIPVFRQQAEELLSNSSMSAVDLLAKALAKAVGYTDIKKRSLLSSMENHTTLHLQTGRPLYTPSFVISTLKRFMPEDRLSSLHGITLTTDGTSAVFDVPSAEVQDYIQGAENVAGVTIDEVKQLPALQEREQSKGNFGGSRFGGRGGGGRRFGGGGGGRFGGGGRGRGGGGGRFNRR

SEQ ID NO: 132047 - protein, 70 aa, Triticum aestivum
  unsure (1)..(70): unsure at all Xaa locations
  Clone ID: PAT_TA_26465.pep
QSWPGXVSCLPDFKTAFPRWQAQDLATVVPNLDPAGLDLLSKMLRYEPSKRITARQALEHEYFKDLEVVQ

SEQ ID NO: 132048 - protein, 311 aa, Triticum aestivum
  Clone ID: PAT_TA_26466.pep
MLRRCVRDLYPLRSLRRIPRPISSEVQSPTFGQLRRNSTKASQQGSAQKSVPGPKEEPSKSGSKVPKLLLGTLLVGAAGMAAYQAGYIDLQFMDEKLPSTIREQNLTKMYENLKFPFEQKVDQKQTMLDPKNDIVQDTPMVLPAEGIPTASEQPTPAEEKETETVTQGTLPVQDEHGADTKLPSQDTLSVDIKPNVVNKAAGEVPLGQADKISSTVSPVESSPTTAEVQKDPLGADVGEQKSLAETYLLQEEHDIPKDVSAKETKSDGTVGAVYASDVALPIRDIIDAIHAAEKKQADTDAYTYSEEKRKL

SEQ ID NO: 132049 - protein, 175 aa, Triticum aestivum
  Clone ID: PAT_TA_26467.pep
MATNGYSNGGSTKGKPIKCKAAVVWGPGEPLVMEEVGVAPPARMEVRVRILFTSICHTDLSFWRGENERQRRFPRILGHEAAGVVESVGEGVEDLAPGDHVVPIFNGECGTCAYCHSSATNLCGTYRVDPFKSTMVSDDGTRFSVVNTSGDTVPVYHFLNTSTFAEYTVLDAACA

SEQ ID NO: 132050 - protein, 395 aa, Triticum aestivum
  unsure (1)..(395): unsure at all Xaa locations
  Clone ID: PAT_TA_26468.pep
MATNGYSNGGSTKGKPIKCKAAVAWGPGEPLVMQEVGVAPPARMEVRVKVLYTSICHTDLSFLRGENERQRRFPRILGHEPGGVVESVGEGVEDFAPGEHXYPAGGEGKLRWLHNPTRCHSREINEAFRLLGGRQVPPGVCYVCDEAHQELQVCVXRRYTVVVNTIYCTSCIIKXEGYISLKMKTNYVGLPCGALAPGVGAPGCSANVSKGSTVAIFGLGAVGLAVGEGARIRGASRIIGVDINPEKFAKGKEMGITDFINPKACGKPVHEVIKELTDGGVDYSFECSGNVDVLREAFVSTHDGWGLTVVLGIHPTPRMMPLHPMELFDGRRITGCTFGDFKGKSQLPLLVDQCMKGEVKINFDGFITHEMPFSEINEAFRLLEEGKSLRCVLRL

SEQ ID NO: 132051 - protein, 108 aa, Triticum aestivum
  Clone ID: PAT_TA_26469.pep
HRTFWCLARRIRMELIGGQPLGASPLITARHLRHHFYLLLLHSSVLRGDRGQWGCRWHRQDNARLVLGANRLQEEMNEVDVLAGSSWGAPSADKAAMAGHVLARTTSS

SEQ ID NO: 132052 - protein, 160 aa, Triticum aestivum
  Clone ID: PAT_TA_26470.pep
MANPMAGGGRKFWRSASWSASRAAARGGPAAAPLPPPLRPPPLTPRSKGRACLPPLQPLAITRRSLGQWPEEGSDDVGEWPDPTTPGASPGGGGGGGPVSAPAGEGLRLGLSTLRSHRRTHHRAFFDALCSRRAAHVYLGGDAVAKNRDILRKNGITHVL

SEQ ID NO: 132053 - protein, 178 aa, Triticum aestivum
  unsure (1)..(178): unsure at all Xaa locations
  Clone ID: PAT_TA_26471.pep
MVNPPELYHRILDVPRGTSSQGLRAAYKGLARKWHPDKHPPASKPEAEARFKAITEAYEALLDQQENRAVFGVCNDDRAAEMFGTFGAGAGGGGARMARSRSDDFCMRSAPATPAREFTKVYSSGNTGGRRAFAEFSNSIXGKXPPXGTRLXVHLEELSAAATQVHREVSQQRVIVRS

SEQ ID NO: 132054 - protein, 120 aa, Triticum aestivum
  Clone ID: PAT_TA_26472.pep
PPGRRRGGSQPSPPAPRIQTSRHRRRPTPPQDAAARRLYADVSPPAYPWLWQRAVRPASLPPLGMNPVPPWCCGAKWQSCLEGPDLAERRMTTLLPQVASTPCSPQTCLASICQSNFMLQ

SEQ ID NO: 132055 - protein, 61 aa, Triticum aestivum
  Clone ID: PAT_TA_26473.pep
SFNFVNKRQFRLKKKHNKATLQVHQCTLNKIQKCTIKFSISSLIKKQKGGCVKKTGESMSA

SEQ ID NO: 132056 - protein, 387 aa, Triticum aestivum
  Clone ID: PAT_TA_26474.pep
MSHGDEVVRLPEGFEVVARSVQGAIAAIEHREKRFYGLQYHPEVTHSPQGMETLRHFLFDVCGIKADWKMQDVLDEEIKTIKSMVGPDEHVICALSGGVDSTVAATLVHNAIGDRLHCANGDTGPWRHPETERGMSAINSDSHPPDPCAGGSAKFLTELKGVPAGEMKRKIIGREFIVGKVKRLGQRRRTEDKEKGREIVGSAMEGWDKGTKSVVGEIPLLSTRAGPRDGDPWRQRLKEEYRALIAYTSVNKAKDNDWFRISAANPEGTRWEGTCWYVHNLRRYEFPLQFDIPVAYPQVAPEIELPTLDGKTHKMYRGGKICLTVHFKPLWAKNCPRFGLAHALCLGLAPWLAAEVPILVDSGMVKHKDDEAAPADAAAASGSAAAS

SEQ ID NO: 132057 - protein, 208 aa, Triticum aestivum
  Clone ID: PAT_TA_26475.pep
RTRGRKRGEYLVQGTLYPDVIESCPPPGSGRTHSHTIKSHHNVGGLPKDMKLKLIEPLKLLFKDEVRKLGSILNVPESFLKRHPFPGPGLAVRVIGDVTAGNALEVLRQVDEIFIQSIKDAGIYDEIWQAFAVFLPVQTVGVQGDQRTHSHVVALRAITSEDGMTANWYDFERPFLVDVVKKICNNVRGVNRVVLDVTSKPPATVEWE

SEQ ID NO: 132058 - protein, 115 aa, Triticum aestivum
  unsure (1)..(115): unsure at all Xaa locations
  Clone ID: PAT_TA_26476.pep
CAPVDLDAGMKKALKKGVAAILEALDAGVPNETGVASAEGNEEQVFQSANXDEFVPGETKPKLDLQRDNKKGIQVQLNLLGNGNGSSAKKAPAARSKTPGSAGKAVGGSGGKRNR

SEQ ID NO: 132059 - protein, 95 aa, Triticum aestivum
  Clone ID: PAT_TA_26477.pep
MLTIRLIVSLKQIVHASQTGLSNTASWHGSHTHLWVDEKNAVVASARPHLRHSGGGGIPGATGWGGGGTTVVMGWTPLSSAESAALVSMMGLSTR

SEQ ID NO: 132060 - protein, 269 aa, Triticum aestivum
  Clone ID: PAT_TA_26478.pep
VVSSTSARTNPTTPAVVVAAKVTNSSRNSTVPARSEEKRAGNTTVTESKIQKPKTRSLEGKQVKLAVSASTRVDDLQEQDTDFFDMDDIYGGTLPESAGPARRNKKVLPDSHVENQKSGHPLDQQDSHHVRYNKLLEKENIKPDETKKKNSTVGHLEKISKDETKTKNSTVGHLEKISNDETKKKNSTVGHLEKISKDETKKKNSTVGHLEKISKDSLSDVNLDRPRQRMTGAADVKPKVPVNDDLQQNKKQKNKKPKSKKKVVDTSTW

SEQ ID NO: 132061 - protein, 198 aa, Triticum aestivum
  Clone ID: PAT_TA_26479.pep
RSPSHGRHRGFNAVDYFPSLAKVPLLQRVLLAKTSRLKKRWDELLDKITEDHATRSASLPVQDEQDRDMVDVLLSLQHEYNLTTDNLRGIWMDMFEAGTDTSYVTLEFAMAELIRKPRLMAKLRDEVRSKTPGTQQMVKADDLGGMYYLKAVVKETLRLHPPAPLLLPRLSMADCDDVNGYTVPAGTQVIVNAWALGR

SEQ ID NO: 132062 - protein, 242 aa, Triticum aestivum
  Clone ID: PAT_TA_26480.pep
WRAAARTTRRVAPAPAAAAAARLLLREPTRRYRRRRAGSEHVPVFPRQKTWDPYKLLGVDHDASEEEINSARNFLLQQYAGYEENEEAIEGAYDKIMMKSYSHRKKSKINLKRKLMKQVVQSPSWVKSLLGHFEVPSMDVVSKRFALFGFIAGWSIATSAETGPTFQLALALVSCIYFLNDKMKNLARASATGLGLFAGGWIVGSLVVPVIPAFIFPRTWCLELLTSLVAYVFLFLGCSLVK

SEQ ID NO: 132063 - protein, 426 aa, Triticum aestivum
  Clone ID: PAT_TA_26481.pep
VIPTRKDMEGKIESMRVLDNNPQKPVVRMANLCVVAGHTVNGVAELHSNILKQELFADYVSIWPNKFQNKTNGITPRRWLRFCNPELSEIVTKWLKTDQWTSNLDLLTGLRKFADDEKLHAEWAAAKLASKKRLAKHVLDVTGVTIDPNNLFDIQIKRIHEYKRQLLNILGAVYRYKKLKEMSAEERKKVTPRTVMVGGKAFATYTNAKRIVKLVNDVGAVVNNDADVNQYLKVVFIPNYNVSVAEVLIPGSELSQHISTAGMEASGTSNMKFSLNGCVIIGTLDGANVEIREEVGQDNFFLFGAKADQIAGLRKEREDGLFKPDPRFEEAKQFIRSGAFGTYDYTPLLDSLEGNTGFGRGDYFLVGYDFPSYIDAQARVDEAYKDKKKWIKMSILNTAGSGKFSSDRTIDQYAKEIWGISACPVP

SEQ ID NO: 132064 - protein, 802 aa, Triticum aestivum
  unsure (1)..(802): unsure at all Xaa locations
  Clone ID: PAT_TA_26482.pep
MSAADKVKPAASPASEDPSAIAGNISYHAQYSPHFSPLAFGPEQAFYATAESVRDHLLQRWNDTYLHFHKTDPKQTYYLSMEYLQGRALTNAAGNLAITGAYADALKKFGYDLXQSLDRXRDAAQVNGVAVWLSSLFSYTITTLSLPSWCYGLRYRYGLWKQRLAKEGQEEIAEEWLDKFSPXYTNAKRIVTNQIFRGAVVINEADVXKWAGGEVLFQTXNVSVAEVLIPGSELSQHISTAGMEASGTSNMKFSLNGCVIIGTLDGANVEIREEVGQDNFFLFGAKADQIAGLRKERENGLFKPDPRFEEAKQFIRSGAFGTYDYTPLLDSLEGNTGFGRGDYFLVGYDFPSYIDAQARVDEAYKDKKKWIKMSILNTAGSGKGDVIKRCWMMMRGTNKDLVLVHGXITPASVVAEKNEATYEACCCVVYSAALLKCIXRMRLFFCSFSFLVCNHTILILNRKGGIIQVLNKXDQWTSNLDLLTGLRKFADDEKLHAEWAAAKLASKKRLAKHVLDVTGVTIDPDSLFDIQIKRIHEYKRQLMNILGAVYRYKKLKEMSAADRQKVTPRTVMVGGKAFATYTNAKRIVKLVNDVGAVVNNDADVNKYLKVVFIPNYNVSVAEVLIPGSELSQHISTAGMEASGTSNMKFSLNGCVIIGTLDGANVEIREEVGQDNFFLFGAKADQVAGLRKDRENGLFKPDPRFEEAKQFIRSGAFGTYDYTPLLDSLEGNTGFGRGDYFLVGYDFPSYIDAQARVDEAYKDKKKWVKMSILNTAGSGKFSSDRTIDQYAKEIWGISACPVP

SEQ ID NO: 132065 - protein, 171 aa, Triticum aestivum
  Clone ID: PAT_TA_26483.pep
MAPSTSDGEASSSGTGSKSKEKERPRSFDEKTRTACWRKAAVLAGRHPERWRQDAAGNVVCRRFWSCHGCLCYEYDHIIPFSKGGESTVENCQILQTRVNRSKSDKAWVEKAEMQGFSCDIKFTDKELDVIEMAVYGDVIRPGKQCRCKTVAEMLGQVKSKNQMAACDSPT

SEQ ID NO: 132066 - protein, 114 aa, Triticum aestivum
  Clone ID: PAT_TA_26484.pep
GRPGILCAQVSEAHPAQIDSWSSQQPMQRYGPALRLECPKEGQVISSVKFASFGTPSGTCGSYSHGECSSTQALSIVQEACIGVSSCSVPVSSNYFGNPCTGVTKSLAVEAACS

SEQ ID NO: 132067 - protein, 110 aa, Triticum aestivum
  Clone ID: PAT_TA_26485.pep
ASLQLQPDLGFMKRIQQILGRKHQRNLHGIYILHPTLGLRTAILGMQLLIDGEVWKKVVYVDRLVQLFRYVPREQLTIPDFVFQHDLEVNGGRGMIVDPRTKHIYQRPSG

SEQ ID NO: 132068 - protein, 413 aa, Triticum aestivum
  unsure (1)..(413): unsure at all Xaa locations
  Clone ID: PAT_TA_26486.pep
SARASRGPEHAVKYHSAAVSARSHCYRAPLVLPVEKGLLPIAMGCIYTNFSNSYRDPPALLPIYTVIEFSEKFXDKLTTVVDRILPXTSTEIFMRLLPLEFPLVNQEDESGSXKPPADVGDENGEPIIDERKIRIKTLPAEAANSKYAVPVPADIPLSGSGLTRRRNSKLDSYLDPSFMSIIKDPDLRRKEQWEKSAQAKKGFNFAKLLGFGDLGGPALSAAEEYSLHQRYLAKANSLNLSEIAEMKIIYRGGVDSEGRPIMVVVGAHFLLRCLDLERFILYVVKEFEPLIQKPYSIVYFHSAASLQVQPDLGFMKRLQQMLGRKHQRNLQAIYVLHPTLGLRTAILALQLLVDGDVWKKVVYVDRLMQLFRYVPREQLTIPDFVFQHDLEVNGGKGIIVDPRTKHVYQRPSG

SEQ ID NO: 132069 - protein, 266 aa, Triticum aestivum
  Clone ID: PAT_TA_26487.pep
MAMGNGDLYSHDHGFHEGSIGKGENGGFRAGLDPYADSISMLQSAQEALENELQMFVEIGKESSDNSTDNSDENEWSSSPNCEDFSEEISEKLKLLESKLEEASLLIDEKDSRILELDTLNKTKPGETALYNSKLLSLQSEVDQLLMEKMEAEIQCFILKRASEAWQPQTEGQGTLQEAQKTLSEDHKQLEVKLRHTENRARTLEELVEKLESQCKELSNASEVLKLQAGASRASLFCSVQLVLLCIAAWTFVARFLPSPPEFVPT

SEQ ID NO: 132070 - protein, 294 aa, Triticum aestivum
  unsure (1)..(294): unsure at all Xaa locations
  Clone ID: PAT_TA_26488.pep
FSNIIGSSHETVVYKGTMKDGREIAVVSMSAPVHYWTNYVELYFQKEVVEVARLSHENAAKMVGYCKSSDPFSRMVVFEYPPNGTLYEHLHDVEGCQLSWPRRMKIALSIARVLRYLHTELQPPFAVAALASSSIYLTEDFSPKIIDFESGRGSRRQTPPELRLRGXGGGGHSNGVVDSRHVRFMDVQANTFAFGVILLELISGRASLSKDTDDLVNWARKHLEQAGEFGKLVDPKLRSVGQESLGIICNVVNLCIDAEPSRRPSMNMIGAILEEGVDTSVRDSSLAWAEAAIS

SEQ ID NO: 132071 - protein, 296 aa, Triticum aestivum
  Clone ID: PAT_TA_26489.pep
PLLVTLAVAFMETLSTVLQGFTDGHGLEDTSGFLVSLVFGLGPLFGGIILVAFSLAFNMPHPLLTGVASGIAFRLASWRPLQLVTSLKMGFFTTLFLLLGGSVFYHLVEASILMVAKHKKSSVNVITSSSGLSLSVLTQQSLLACGCVFLHAYAEGLALGVAARKASGLGRYMVLPVSLHGLPRGAAVASCVYGATDSWRGALAAAALTGFAGPSAAIGAILAKIGYDGLDYWMVIACGALIPSFGRVFRRSLRLDARNSVCGLLIGFGFAWVCLMSTRFICLHTPYCNSAPEAVT

SEQ ID NO: 132072 - protein, 285 aa, Triticum aestivum
  unsure (1)..(285): unsure at all Xaa locations
  Clone ID: PAT_TA_26490.pep
PLLPVIFRAVGSCAPGSVLGELPAGAAGVAGLSRLPLSLLHQFASLLEXANEFALCLPSGGDGVAVFGGGPFQLLAAPPVELAERLRENPLPLLKHPYNGGYYFGITGVAVNQQRVPTPDGVFDLDAGSGTGGAVFSTVTPYTALRWDIYWPLRNAFDVATSGIARADKVAPFDLCYQASALTVTRVGYAVASIELMLDGGRNWTLPGASSLVQVNDNTVCFAFVQMASSMPAAIDSPAVILGGHQMENNLLMFDLVKETFAFSGLLLGIRTTCSNFNFTMGSSY

SEQ ID NO: 132073 - protein, 193 aa, Triticum aestivum
  Clone ID: PAT_TA_26491.pep
ATRASTGVVWTSEQAYKHGFLEHPEEWANLGQGAPEVDDSIKGCFERPKEVDISAHGREYGPTAGIRPLREAVATLYNEHHRKWRKSQYTWENVCIVPGGRAGLIRIAAVLGNCYLGFFIPDYTAYNEMLSLFRNIAAIPVPLGEADQYHMSPDKIAEEIARGTSVILTSNPRNPTGQMVTNPELAQIQNICR

SEQ ID NO: 132074 - protein, 97 aa, Triticum aestivum
  unsure (1)..(97): unsure at all Xaa locations
  Clone ID: PAT_TA_26492.pep
STHPHHALHLGYTVAIKNFSKLKKDQQTQHMHCLPPDNTLVSRYLHLAVPTKQTQHMHCLPPDNTLVSRYLHLAVPTKQGLLIAVMRRTVRSCTSHX

SEQ ID NO: 132075 - protein, 130 aa, Triticum aestivum
  unsure (1)..(130): unsure at all Xaa locations
  Clone ID: PAT_TA_26493.pep
MVRVSVLNDALKSMYNAXKIGKRQVMIRPSSKVIIKFLTVMQRHGYIGEFEYVDDHRSGKIVVELNGRLNKCGVISPRFDIGVKDIEGWTARLLPSRQFGYIVLTTSAGIMDHEEARRKSVGGKVLGFFY

SEQ ID NO: 132076 - protein, 242 aa, Triticum aestivum
  Clone ID: PAT_TA_26494.pep
LPARVGPSLLGFPPPHRRRRRLSAPTPPRPWTPDLHVPCRRPVPPVLRPTLPHPRREAAPVHPQAAKFRFAAMAEEEKMTEVFDVGCVTNEHARVPTPTYQGGPAQVDSEDDSGCECEHVQVTPLPNRVKSRKKRACPYSRMVASEIAKNKALVRLVEIFEAREKRVTNQSAKEIVDPTRQEIQDVMAMVIADGAKPGSDEHFYASHLLLEKKNRDVFTSFKGPKPSERLAWIRRMWELTNK

SEQ ID NO: 132077 - protein, 175 aa, Triticum aestivum
  Clone ID: PAT_TA_26495.pep
MLVTKFISRKQWVVIGNSDGFILVCTCPSMDQVTHFKAHRDSLGLLAVHPTRPFLLSCNNMKMKIWDWNRGWSCIGKIHSTSRVTQVMFNPRNTNDFATHHHDGIVKMWRIDHPDPVGTTHRLHDMYETASSSFTYTGDRYFIAAIHNSKNVALTIWDLQKEEHVYTLTTDEVTA

SEQ ID NO: 132078 - protein, 110 aa, Triticum aestivum
  Clone ID: PAT_TA_26496.pep
KPVAGDDNREGVASSDTPLALPEGDQYDEVAAGRTRPWPAHRTSGRNRSRPARHGSGSGATAATPWLNCIFLWRLGTFPNQLQNPSLRPCPEISQYFGDVVAQLIGDRTR

SEQ ID NO: 132079 - protein, 210 aa, Triticum aestivum
  Clone ID: PAT_TA_26497.pep
MDGVIGQILEKQVLSAAKAVEDKLDEQIAALERLDPDDIEALRERRMLQMRRAAERRAKWRALGHGEYTEVPEKEFFSAAKASERMVCHFYRDNWPCKVMDKHMSILAKQHVETRFIKVHAEKAPFLTEKLRVVVLPTLALVKNAKVEDYVVGFDELGGKDDFSTEDLEERIAKAQVIFLDGEGPANPSKQAAASKRSVRQSDTGNSDSD

SEQ ID NO: 132080 - protein, 94 aa, Triticum aestivum
  Clone ID: PAT_TA_26498.pep
HEGLQKNFRILKIYCVYKTRSIFRILFSIYCSPGSICSLEPKLQASLSCQWRMRNKICVREKLLLMEDEMMLPPDSYAFHVWFLLLSYFFYFFF

SEQ ID NO: 132081 - protein, 169 aa, Triticum aestivum
  unsure (1)..(169): unsure at all Xaa locations
  Clone ID: PAT_TA_26499.pep
SASPRPPPSPRLEPGAVPPPTFSPAGSXPPRPPPSSRLAPGAAPCFHPPSSPPPASTVPPATVRPLLPATAAPPPSFAGGPTSLPCYTVKVARETSSLAQPMWPGTLTTAMPLRLDYRRCPTPRCLPWRPFTAATLGRSTTQRRAVKRRSSTTIRNSDFHGCSKNKMPK

SEQ ID NO: 132082 - protein, 218 aa, Triticum aestivum
  Clone ID: PAT_TA_26500.pep
SPPLIQSPPPAELTLVYRPAIGGSALELASRALPPACPAEASLLLVRGADDAPAYASADRVSAAEGARFEVYAGKELAAEGAFFPRRRLDGGGWRVECRRPAGSRSRVAEVLVLAEGGVLIRARARAATRIGCATPLEGIPEEDASSWGSCECGACGDEWQMVGDSSSDDDDGDKLKEEEVEAETMRWALEMGAWAVCVGVGLLATARRFSRRRAALR

SEQ ID NO: 132083 - protein, 230 aa, Triticum aestivum
  unsure (1)..(230): unsure at all Xaa locations
  Clone ID: PAT_TA_26501.pep
PGPPPARGDGGSAQWGIPNGGETDAAQNGVLQSEDGDAFVSASFPIFERLERGPPGGSAPFTDMLSLRAAAFPALVTFXSCDLLPSSWMSVAWPAVKRVPTRLSLTALDACFLSFLLLSIPSKDTXPTLPACPGFSVSWHYLPGMAILSHPDSPVSRETASAPTSTARLSLPAFGLASYKLRSSLWASXGAPEQESVTSLMQEADNWLRCVQVDHPDFRFFVSHFGATWR

SEQ ID NO: 132084 - protein, 91 aa, Triticum aestivum
  Clone ID: PAT_TA_26502.pep
DVVHKLFTELAYRYKDRAGGYTRLLRTRIRIGDAAPMAYIEFVDRENELREAKPATPPPPQRAPLDPWTKSHASQQWAGPKVSQNSKTEGL

SEQ ID NO: 132085 - protein, 161 aa, Triticum aestivum
  Clone ID: PAT_TA_26503.pep
MGKFRKLGRHAAHRVSMLRTMVSQLVKHERIETTVAKAKEVRRKADQMVQLGKDGTLDAARRASAFVRGDDVVHKLFTELAYRYKDRAGGYTRLLRTRIRIGDAAPMAYIEFVDRENELREAKPATPPPPQRVPLDPWAKSRASQQWAGPKVTMNPKSEGL

SEQ ID NO: 132086 - protein, 74 aa, Triticum aestivum
  Clone ID: PAT_TA_26504.pep
KPVAPAAASPKPRGRPPKVAKTSAKASPAKAAKKAAAPAKKGKAAAAPKKVATPKKAAAAAAPARKGVARKAKK

SEQ ID NO: 132087 - protein, 287 aa, Triticum aestivum
  unsure (1)..(287): unsure at all Xaa locations
  Clone ID: PAT_TA_26505.pep
XRLLTKVDHPYVVQLRYSFQTKYRLYLVLDFVNGGHLFFQLYKQGLFREELARIYTAEIISAVAHLHANGIMHRDLKPENILLDAEGHAMLTDFGLAKEFRENTRSNSMCGTVEYMAPEIIQGQGHDKAADWWSVGILLFEMLTGKPPFVGNRDKVQQKIVKEKLKLPPFLTSEAHSLLKGLLHKEAGKRLGTGPGGSDEIKKHKWFKPINWRKLDAREIQPSFXPDVAGLTCIANFEXCRWTNTPVLDSPAATPVTAGGGQGNFAGFTYVRPAPFLHDLKPPSSSS

SEQ ID NO: 132088 - protein, 107 aa, Triticum aestivum
  Clone ID: PAT_TA_26506.pep
CMRAHQSRIHPLHVYSAVTLAWNTSSLIKLLMPISSNVVSKKKYPLVSLLSAMNHAFSRCESKSLKMSSIVGPKVISPISRDTGSEAHEQRRGGTRAARRPSVVMLP

SEQ ID NO: 132089 - protein, 155 aa, Triticum aestivum
  Clone ID: PAT_TA_26507.pep
TASLNPQKTREREDLRNPRSLKEMEMEIERDSQEQRRMWIADHSLKHAKMLAEFGYDMPSRKTTMSLRKEASTSLRLEDGGLVDALCRHREILRRETNFLMGEVNSRALATLGGRKAYRESIQRENNVAVALLRFVRLKNGRLGGGELAPLCHQP

SEQ ID NO: 132090 - protein, 119 aa, Triticum aestivum
  unsure (1)..(119): unsure at all Xaa locations
  Clone ID: PAT_TA_26508.pep
MPAGQRGALRARPRGGAGRGGEAKEGGAAARRAGGRDVPAAPKVLRLQPGHKYCLLGXLSKEVGWNYHDTIRELEEKRKEKAKVAYERKKQLAKLRVKAEKAAEEKLGSQLEILAPIKY

SEQ ID NO: 132091 - protein, 236 aa, Triticum aestivum
  unsure (1)..(236): unsure at all Xaa locations
  Clone ID: PAT_TA_26509.pep
MSYSVHIYTRKGMRERGKAAVESLCRECNLYNIIFHQLNILYAGRRAXLTRHIXPHMRKLDILVNNAGVGGVAVDQEGLRALNIDPKMWLSGKAAHLVESVIIQTYDEAVKCLNTNYYGLKWATEALLPLLKKSTSGARIINTYSRRPEPPGWPMMLPAYSMSKMVVNLYTRILARRHPEMRINCVHPGFVKTEINWNTGVLPPEEGARGAVMLALAPGDGPTGCYFDQTKMGEAW

SEQ ID NO: 132092 - protein, 379 aa, Triticum aestivum
  unsure (1)..(379): unsure at all Xaa locations
  Clone ID: PAT_TA_26510.pep
MSSVRRFTACYPYIFPSWLPMSAVVHQVIADPWLLVERLLPCRLHAYAVYSHAPLSLRFQSSLRFPFPSPSPRTPCVRTQSVVVPLVVCSVVPSPLHVLLNHLLVNVLGLGLSGASAAISLTFWFSCLMLLGSVMWSKQFGETWKGFSADASNYVLASCRLAAPARRMVPYAQXTQAVSYMITYGFSAAXVSTCLIGLWLVTEAIAYMRSYGFSAAVSTRXSDEIGAGNVDMAKNAVAVTLKLSVCLAFSFVLLPGFGHGLWPRLFSRSEVIGAEFAAITPLVMASIVLDSAQGVLSGVARGCGWQHLAAITNLVAFYFIGMPLAILFAFKLNFYTKGLWSGLICGLTCQTITLVVITARTKWAKIADAMQQEKANYVA

SEQ ID NO: 132093 - protein, 154 aa, Triticum aestivum
  Clone ID: PAT_TA_26511.pep
LMLAPMAMADGYSQPQDYQPPAYRKPADGLAAGYYGESCPDMEGIVQRAVKKAFAADYTIAAGLIRLFFHDFAVGGCDASILIDAPGSEKYAAASKTLRGFELIEAIKTELEAKCPKTVSCADILTAATRDASREVGSELLAARVRPQGRPPVP

SEQ ID NO: 132094 - protein, 106 aa, Triticum aestivum
  Clone ID: PAT_TA_26512.pep
VVDTGEVDLAFAAGRSMSTMDCVIHVVLGVAMRRCICRLHEVVAMAMEVGTALLVAVRFSGMAFRHTPAPTQAVSGSTQAVSGSTHYYYYAPVAASMVGMSRLDRH

SEQ ID NO: 132095 - protein, 103 aa, Triticum aestivum
  unsure (1)..(103): unsure at all Xaa locations
  Clone ID: PAT_TA_26513.pep
SAFLLLLTGXAALNDQRGAGESCTSASFCYVVKPGVFSGGAVLSLASVALAIVYYVALTSSKGPPSWGPQQNQGISMGQPVIPQQSSEPVFVHEDTYNRQQFP

SEQ ID NO: 132096 - protein, 112 aa, Triticum aestivum
  Clone ID: PAT_TA_26514.pep
VGNAVTNHSGVGGMGFGAMGGFGSNSAASGLRMAMANNAMANSAMAMNGRMGMGMHHSAHDLSQLGQQQQQQQNQHQHQQHQQQHDIGNQLLGGLRAANSFNNLQYDWKPSQ

SEQ ID NO: 132097 - protein, 143 aa, Triticum aestivum
  Clone ID: PAT_TA_26515.pep
MQRPQGAEEAGGGEGREEARRRRRPKKTNAEKRPPASKEGGEKKAKKNSKKSVETYKIYLLQVLKQVHPDTGISSNAMSIMNSFINDIFEKLAGQSANLARYNIKPTITPREIQTSVRLDLPGELATHAVSEGTKAVTKFTSS

SEQ ID NO: 132098 - protein, 202 aa, Triticum aestivum
  Clone ID: PAT_TA_26516.pep
MRREYLIGFALIVAGLWPLHAAAQKYAAIFNFGDSLADAGNLVVDGIPEYLATARLPYGMTYFGYPTGRVSDGRLVVDFIAQELGLPLLPPSKAHNASVHRGANFAITGGASLDTSFFEARGMRHTVWNSGSLHTQLKWFEDMKPSICNSPKECRDLFRRSLFIVGEFGGNDYAAALGAFLPVQKVHTFVPHIVDSIGKGIE

SEQ ID NO: 132099 - protein, 219 aa, Triticum aestivum
  Clone ID: PAT_TA_26517.pep
LPATSSSAVAVSTPQGVAERRGIPAAAATSSSAVAVSTPQGVAERRGIPAASFVEDVETYLRQAGLEVNSALAFLQERLQQYKMVEMKLLAQQRELQAKIPDIEKCLDIVATLKAKKALGEALIADFELSEGIYSRAKIEDSDSVCLWLGANVMLEYSCDEANELLKSNLENARASLEVLVGDLHFLRDQQTITQVTIARIFNWDVHQRRSKQSVMKET

SEQ ID NO: 132100 - protein, 178 aa, Triticum aestivum
  Clone ID: PAT_TA_26518.pep
LTAAIRDPEIRRVCGDVSTEQLLEKMFGVFMDHANMLADISTIPEVNSPELSESDLYGYIHQYIHLLESDVRVDVLEALHEKIRKRFKTPKLTNSNFAKICKHASLSWCRCILIKLASITPLPESMDTDNQPVPLSNGLLLYVDLQPDELLISSPDGPTQFKGLDMNWFETLTKIKNI

SEQ ID NO: 132101 - protein, 166 aa, Triticum aestivum
  Clone ID: PAT_TA_26519.pep
MEARVAAGVPADEESGLLPRARPPAAAAAGRRPSSSSSSAAAPRRAPPPAVWATVDGPLGMPLEEAEGHARRFFLWGFACLPFLWAINCCYFWPVLRSPAASSPPAFAPIRPYVMRSAIGFTIFAAVLLTWATTFIVGGERLFGPVWKDLVMYNVADKLGLTGFMG

SEQ ID NO: 132102 - protein, 221 aa, Triticum aestivum
  Clone ID: PAT_TA_26520.pep
RENLQESWSMACRWMDLSDWLAYRATGDDTRSLCTTVCKWTYLGHAHMGQWRELDSRDMEACGWDEVFWEEIGLGDLVEGNRAKIGRSVAFPGHPLGSGLTPTSAKELGLLPGTPVGTSLIDAHAGGVGVMESVPEAESKADLSDEEAICRRMVLVCGTSTCHMAVSKNKLFIPGVWGPFWSAMIPEYWLTEGGQSATGALLDYIVENHAAAPLLANHAAS

SEQ ID NO: 132103 - protein, 240 aa, Triticum aestivum
  unsure (1)..(240): unsure at all Xaa locations
  Clone ID: PAT_TA_26521.pep
SARGPHKGAAKXETGATPDNAQTYNTNLIRHVVNDSGTPAKPGEEIDVYIFSLFNENRKPGIESERNWGLFSPDQSSIYSIDWTGRGNVDIMTGGNRSNGTWCVASTNVSETALQNGLNWACGPGNVDCSAIQPSQPCYQPDTLVSDALGAFNSYYQQNGATDVACGFGGAGMRTTKDPSYDTCVYMAAGSKIXHQKFNRHSNSKRLQPVTVGPMPHPSAPCASHCDCRGLSVIFGARSS

SEQ ID NO: 132104 - protein, 181 aa, Triticum aestivum
  unsure (1)..(181): unsure at all Xaa locations
  Clone ID: PAT_TA_26522.pep
EQSRPTASLLPSSAPXTIILGFSKGGVVVNQLVAELSNWASKSAKGSVDISRQNPALLTGDLFVPATASDILSSISEFHYLDVGLNCAGAYTTDHAVIKGIANYVSQTSDTPRFVLHGTPRQWSDPNRPWILAEKNTMLRLLQDEANKCEGRLTLSEKKYFDGRPRSLLMHFEILEAMDIS

SEQ ID NO: 132105 - protein, 236 aa, Triticum aestivum
  Clone ID: PAT_TA_26523.pep
MTRRAAATFMLMLSLPTAALMVAADDVGVDSIRLPTDGGEGLATSKGGEKQTLSLPVPDQIVAPREQNVGDVLEEEERPWACCNSTVCTKSFPPTCRCLDEVEECAPACKACEPSGFNPAFHVCNDQYHGDPGPTCAKEERPWTCCDRTVCTKSFPPTCRCLDEVEECAPACKRCEPFGINPNRHVCNDQYHGDPGPTCGKDDDDDDHPSGSPSLAAATQMQLLLVSLILLFIQSP

SEQ ID NO: 132106 - protein, 47 aa, Triticum aestivum
  Clone ID: PAT_TA_26524.pep
MEMEGRGLSDLFRNTSEEIFLKAVMENSIGVAAPPSMEMMGFRNMSQ

SEQ ID NO: 132107 - protein, 280 aa, Triticum aestivum
  Clone ID: PAT_TA_26525.pep
TVLSLVGALFNIVLHLESPLIFYIEKLPPLCPDLHPDAGAIVLMCVEVITSFAGRHTFQIDACHVSQCLHRPRGLFKGFKHLLADRSVSCSSENIHEQIAGQPLASKEYLLDRQFSVDMYAACCKLLCTVLRHQQSEVGQCVAVLEDSVNILLSCLESADSKMVSMAGCFTWNKEEALKCASFFRRIYEEMRQQKTIMEHHSMHFLAGYISMFSGLGPFQTGITREIDEALRPGVYSLIDICQESDFQQLHTYLGEGPCRTTLANLVHDYKLHFQYQGKI

SEQ ID NO: 132108 - protein, 93 aa, Triticum aestivum
  Clone ID: PAT_TA_26526.pep
KDGEGRENIHAGFRDMMIKKKCTRRELGIEDEYTYSKQTPRHELVTPLELRAQSWTLVSTLRQLTDWLSIVHNNVYIKGVLCHFSSPFRFIIL

SEQ ID NO: 132109 - protein, 109 aa, Triticum aestivum
  Clone ID: PAT_TA_26527.pep
SSSFVCYLVVPVKKLLHAGSLSGPVVGIFSWFAVYPSVGSSVICLPTKVGFPASGFCFISLCFCTLLIASGTDRVFFFGINHVNANVLKFLPVASLHTYWNSICSLIVE

SEQ ID NO: 132110 - protein, 41 aa, Triticum aestivum
  Clone ID: PAT_TA_26528.pep
MAEAVLIAVTKIGSILGDEVIKAIISELSVKVTNLKELPVK

SEQ ID NO: 132111 - protein, 128 aa, Triticum aestivum
  Clone ID: PAT_TA_26529.pep
SAGSAARPSGPCSPGPRAAVSDAPQPPASPAPPVASAPSACRGARLLPALGAPPEPRLCGRNPPPSPAQVAVSLPFGAVAVPLSRGSSRTGGSRRRRPAENKVGLPFGAEEEPLKAAAAPALTKLPLC

SEQ ID NO: 132112 - protein, 170 aa, Triticum aestivum
  Clone ID: PAT_TA_26530.pep
MEMEAMGKQQREEALLRAAAAGNLGLLKKMARWMGSGGQGEAAVLGAVEDGVGDRALHLAAGAGRVEVCRYLVEDLRLDVNQLNFIGDTPLYHSAIYGRAAAARYLLGHGADPLAGKLHSPLYGAAKKGHCEIAELLLSRGVDADLDSAQGTPLHAAAIAKDHNIIKILS

SEQ ID NO: 132113 - protein, 204 aa, Triticum aestivum
  Clone ID: PAT_TA_26531.pep
AYQKAVDDGADVIDCPVQVTKDGIPVCMGSINLMDSTTVAKSPFASQAAVMKDIESVLGVFTFNLTWDDIVKNLKPKISTPLSTFSLDRNPRYRNAGNFMRLSDFLDFSKDKDLSGIMISIEHAAFLAEELGFDMVDAVIKALDDSGYNKQTAQKVMIQSTNSSVLVKFKQETKYDLVYMINEDVSDAAPSSLAGIKKFADAVS

SEQ ID NO: 132114 - protein, 161 aa, Triticum aestivum
  Clone ID: PAT_TA_26532.pep
MAIMAATATAVASPSSSTSPGPLHPSPRFLSPVSTPARCRLLPKPRRWCARLHIERRVAVGSDVSSSHDVAAEEAAAVPKVGKRVRVTVPVRVHHVAKAPGLDLRGMEGVVKQYIGVWKGKRITANLPFKVEFELKLDGQDKPVRFITHLREQEFEILGEE

SEQ ID NO: 132115 - protein, 357 aa, Triticum aestivum
  unsure (1)..(357): unsure at all Xaa locations
  Clone ID: PAT_TA_26533.pep
LVNRASALLDPSGRRLCRDDPDPLGHTAEVLPVEVAGEEEVVLHVLVRHDVPGDGIGEVEPVVVALGRVVHEHAAEGAREAAVPGVAAELDAVADAAPVQDHRHRRHHARRQRVVVPLPVLHRQPQQLPLLVRRRRRRGPPLRVPLEAGAARPRAAAAATATAAHHGRNGTDLSWTRSNSRAGRRPGFVVGGCVWGLGRRPARTGKPVIPVWLLLMAEXLFTLVQLSATATVYLQPTNEVLEGLLSDPKAGQYAARNVVPRLVSRTLAVAFGTTIAAMIPFFGDMNALIGAFGFMPLDFAVPALFYNLTFKPSKKGFVFWLNTAIAXVFSAXAVVASVAAVRQIVLDAGTYKLFANV

SEQ ID NO: 132116 - protein, 226 aa, Triticum aestivum
  Clone ID: PAT_TA_26534.pep
GITEKHHRGSTSMKVEDVLHMATGDGENSYAANSRIPMKAMLKNRPLLQRTVEEVYTSLSSASTMVVADLGCSSGPNALFIVAEVTGMISDYNQNTNEEQHGVELQFLLNDLPKNDFNLIFQSLDQFHTVTRKGEGDEAATPPYYVVGLPGSFYNRLCPSQSVHLFHSSYSLHWLSKVPEELSSGEYVNEGNIHIGKTTPHSIVNLFREQFQIDFELFLTLRSKEL

SEQ ID NO: 132117 - protein, 116 aa, Triticum aestivum
  unsure (1)..(116): unsure at all Xaa locations
  Clone ID: PAT_TA_26535.pep
AVRRSSVNREACSLATEVSSLRQFSGFISTSPRRPPHPFAHIFLNPLTAAITFGHAVLPSAPHSRHTSYLLISSSRIDQPTGGRSRAAXRLSGQLHVLAAAGMGAYPGXRTVLQAT

SEQ ID NO: 132118 - protein, 376 aa, Triticum aestivum
  unsure (1)..(376): unsure at all Xaa locations
  Clone ID: PAT_TA_26536.pep
RPAPPAPPTGGAAALRVSSGTCRPGRQPVLGLPGPAGGAAVSVRPRLPLPPVLQAPHLVSVLRRLGSLAFLKGDAVAEGQQRMIDLGITGPEGHALSRPPVLEGEATSRAIRLAKFVNTPLYVVHVMSTDAMEEIAKAKREGQRVIGEPVVSGLVLDDSWLWDPDFATASKYVMSPPIREAGHNKALQAALSSGILQLVGTDHCTFNSTQKAFGSDDFRKIPNGVNGIEERMHIIWDSMVETGKITVTDYVRVTSTECAKIFNIYPRKGAILEGSDADIIVLNPKRSFAMGTRTHHSRSDTNVYEGRKGKGMVEVTISRGRVVWEDGNLNAVPGAGRYVRTPPFGYXFDGLDKSDAVYRASLRAPVQRGEAAAAAA

SEQ ID NO: 132119 - protein, 367 aa, Triticum aestivum
  unsure (1)..(367): unsure at all Xaa locations
  Clone ID: PAT_TA_26537.pep
SHQAGDAKTIPSFSSFGSPGNISLAVVLLCALVAVPVALPAAPAEAGERVVGDYDKKCRGVGNVVXWHGRRAVQTNRPAGPAPVRLLFHACFVRGWDGSGLRDPSPENPHPEKAAPGNVGVADLGLXAFDMAAVDEAAPGGGCPCAVILIDAPRDAAPARSKGIIHVDLPVGRPGGLSSAAAASAAEPPAATFHAAAAIQQLAHKGAREEEEVVMLGGPSCAVGIRSSSLTRLPAPPQQINPADRPLLTHTCHPGANPAGVHNVRHEDYETVSKFMPGFTSRVRKISDFLDNTFYHNNLARIVSFNSDWQLMTHTEARGHVHEYADNATLWDGDFAESLLKLSKLSMPAGSKGGIRKKCSIATHPLY

SEQ ID NO: 132120 - protein, 111 aa, Triticum aestivum
  Clone ID: PAT_TA_26538.pep
INRVAALLLRRRRQAFSSASPLPLARILSATVEPKLDILARSSRSVRSAGTTALSCLRKAATDASAPRRHRPARRSAVLDAAISDAAGTPPPLRVPCHLRPGQLRSRAPHA

SEQ ID NO: 132121 - protein, 182 aa, Triticum aestivum
  Clone ID: PAT_TA_26539.pep
TVLFITKPNSNSVRVLCAEMVRWLKEHKNINVFVEPWVSKELLTDDSNNTVQTWDNDDDKKMLHKKVDLIVTLGGDGTVLWAASLFKGPVPPVVAFAMGSLGFMTPFPSEQYRDCLDNVLKGPFSITLRNRLQCHVIRDAAKDEIVTEEPILVLNEVTIDRGISSYLTYLECYCDSSFVTCV

SEQ ID NO: 132122 - protein, 165 aa, Triticum aestivum
  Clone ID: PAT_TA_26540.pep
EGRRPYTSPSSTAPPRRGWICSLAGVSFPSSEMQLRGVSCPSTKDLGKDGAAPSRSGGSPSGTTAPPRSLSRQAAADCSLLPFLSPSRQQRWQVRCSRFVGKQSRRRSARPVSFPAASRPVASTHLGGSSTNQGAASSASSKRIISGGKSKLLRLALSNLAFSIQ

SEQ ID NO: 132123 - protein, 160 aa, Triticum aestivum
  Clone ID: PAT_TA_26541.pep
EDVKRSEVQDDKKRSDRGTRGGKDERSVKDAVDKNAHSSVVPHKRSSSVSEDELLDIDNGNHKKSRHDAAGAVEYDKRKNEDCIEDVDSPRSKSEKRSLGEDGDNIQKHDTTRSTKTKTDGKKYDKDDSSRKDRIYREDESRHSRDKSSRHSSSRSHRSS

SEQ ID NO: 132124 - protein, 263 aa, Triticum aestivum
  Clone ID: PAT_TA_26542.pep
RRWDRVRHSIRSSKAKSDIIETMNYILSLSYFDLPHHLRSCLLYLALFPEDQLIERQRLVRRWISEGFIHGESGQDLMELGEEYFHQLVNRSLIQPDNIGYDGKAKYCRVHDTILDFLIDKSSEENMCTVLKKQCKPNGIVRRLSLMGNEDEETVEQLDLSHARSITAFRDIKLLPSLGRSKCLRVLDLQACNQLENHHIKDIERLYQLRYLDISFTGITELPRQIGELLYLETLVTSDGLRELPESTSRLQRLARLIVGCDC

SEQ ID NO: 132125 - protein, 134 aa, Triticum aestivum
  Clone ID: PAT_TA_26543.pep
MSAGAGGTGCSGSDGGMVAPFVAKTYAMVDDPATDAVVAWGPASNSFVVADPFAFSRALLPAHFKHANFSSFVRQLNTYGFRKVDPDRWEFAHASFLRGQTHLLPRIVRRRTGGGRRAKDSHDEEEDEDISSKM

SEQ ID NO: 132126 - protein, 122 aa, Triticum aestivum
  Clone ID: PAT_TA_26544.pep
TLARDGTFLVQPHSEWLPQQHYPRYSQDHKLCQGILCLPCFPREVANQILYWHSSSAHLQLWNHIPRLLRLQYRYYPAPHDLLQVMRIQPPPCGEVVSSKTKCYTQTDYTTLPLQYQNLFLS

SEQ ID NO: 132127 - protein, 92 aa, Triticum aestivum
  Clone ID: PAT_TA_26545.pep
RKGTPERRSPSQRPNYMEGEHMDGFVLGSHYHHIGPAPLNPDIYNLSTTLRGVWMGATGQRPHSCLFGLTGSSLQLGIEATQMEQLPISPKL

SEQ ID NO: 132128 - protein, 214 aa, Triticum aestivum
  Clone ID: PAT_TA_26546.pep
MAPCSPLACPFSGLVSERRKLGFLFLVRHTERLTLFLGNFCVVMGNCWFKGSPYFNRDFLQCDIVRISKIAEPVGEDREWTIACCPFQTHIKVGGPMRNRFGLGRNPPHRHSRYEEAQGGSPRTSRQDPALGGCRGQLSHPNLVKLVGYCCEDNHRVLVFELMPQESVESYLFPRVMLPLPWSTRMKIALSAARGLAFLHEAEKPRILDAALPP

SEQ ID NO: 132129 - protein, 197 aa, Triticum aestivum
  Clone ID: PAT_TA_26547.pep
MGDSSGSVSIDVERIYFGGKEHPVRTRYGSVSVSVYGDEDKPALITYPDVALNYMSCFQGLFFCPEAASLLLHNFCIYHITPQGHELGAAPIPSDVPELSVDNLADQVADVLDFFGLGSVMCMGVTAGAYVLTLFAAKYRERVLGLMLVSPLCKAPSWSEWLYNKVLLNLLYYCGTSGLVNECFLQRYFSTEVRGSG

SEQ ID NO: 132130 - protein, 189 aa, Triticum aestivum
  unsure (1)..(189): unsure at all Xaa locations
  Clone ID: PAT_TA_26548.pep
HSAGLHPHPPRRAPRAPRPPPAVTYLHFYDCPQFSFGIFCLPKHAVIPLHNHPGXMTVFSKMLFGSMHLKSYDWARSISEAGTTALTTSDGARLAKINTNNVVDASXKPIVLYPENGGNLHCFTALTPCAVLDVMGPPYNSAAGRDCAYYSESPFANTAGVADVRYSWLKEIPNNFRMKGVTMPRDFVV

SEQ ID NO: 132131 - protein, 162 aa, Triticum aestivum
  Clone ID: PAT_TA_26549.pep
HSETSSMQSIDDIQQQREIMVLSKLPEDDMGPNSADPELASFGYADSEGRLSDISDSGISMGTETDGSISSMVDFALFPEQEKIASAWKEQENAPNTPKDRLPKVTTRVQKATTPKTAPSSSVWPKSRDSTPRSSASASTRRSTITQATSSPRTSNTPKRWN

SEQ ID NO: 132132 - protein, 120 aa, Triticum aestivum
  Clone ID: PAT_TA_26550.pep
PATAKTNGFAIFPRVFSIGYHSSLCLPDLTLRFALRVVVFSRGFLLSGVVWCGFLLGRRGFIAGLSVTVSPVCPFEFFPHFIWAVLFREGGVAEEVFERRRSRGDSLVFLAFLRSLSGES

SEQ ID NO: 132133 - protein, 306 aa, Triticum aestivum
  Clone ID: PAT_TA_26551.pep
MIRRLDGRKKKSKKQENDEDVEARLEKVELAVKAKFEAAGKLKVHDKKSGEDEPKTQNDEANENGLSDGAPLDKGKKKKKSKSTSETSDKTDAGTAPAEAEVKSNGASENNNAVGEGKDVNEKKSKKKKKKSGSEENVQVEDKQVAGKDSAPKPDDENKTAMDIENGQDGKASADDAVVSKKRKLEEVEGSEPPAKEDITATEDDVKEPSTASKSNKRQKLSEPKIAFQRVKTEGIKFADERLQDNSYWAKGGADSGYGAKAQEILGQVRGRDFRHEKTKKKRGTYKGGFIDLQTHSIKFNNSDDE

SEQ ID NO: 132134 - protein, 174 aa, Triticum aestivum
  unsure (1)..(174): unsure at all Xaa locations
  Clone ID: PAT_TA_26552.pep
CXXEXKVTAXPPFXXSXLWGKSQXMNLLTHTHVXREHXTCCXXAXWCXCARXSCCRTGAIARAGAGGADEVLLLGLRPLEAAAAPRRPHQPPASAMSSAQDPFFIVREENQGSVLAISRLSSKVHGATEDKRFMSNQGAWCSQLMNRRSTKFEVRSQIALLSKESSLLFDCNRL

SEQ ID NO: 132135 - protein, 238 aa, Triticum aestivum
  Clone ID: PAT_TA_26553.pep
MRIFLLSGQSNMAGRGGVHHRRWDGVVPAECAPDPSILRLSAALAWEEAREPLHADIDTTKTCGVGPGMAFARAILPRLQPPGTAGVGLVPCAVGGTAIREWARGEHLYEQMVRRARAATECGEIEAVLWYQGESDAESDAETAAYQGNVERLIANIRADLGMPHLPFIQVALASGNKRNIEKVREAQLSINLLNVVTVDAIGLPLNEDNLHLTTEAQVKLGESLAQTYISNFLQATC

SEQ ID NO: 132136 - protein, 249 aa, Triticum aestivum
  unsure (1)..(249): unsure at all Xaa locations
  Clone ID: PAT_TA_26554.pep
LVVASEESKLVQHPWRNILQRKYRPQLTMAIMIPFFQQLTGINVIMFYAPVLFETLGFKGDASLMSAVITGLVNVFATLVSVFTVDRLGRRKLFLQGGTQMLLAXAGGGTLIAVKFGTSGVGEXPKGYAAAGVLFICSXCGRFAWAVGPLGWLCPRDLPWRISRRGRHNGSXNIXFTFVIGRRSHIFPMKLAFYFPGGGDMTVYGFLAEQNALNGFLKEWLPSLFLLTPRTEGPAPSLILVLRPLVSFL

SEQ ID NO: 132137 - protein, 212 aa, Triticum aestivum
  Clone ID: PAT_TA_26555.pep
LNLSYSSCSHTGPSSSSSHAPPGAPRPDFLLPRLARCCFLLSPPSSSTAAPPASSARCFSKPHHLLHLCDPRATTLVLHPGVERSLSSSMIPALPGQIRSATPPGRRPVPPARGVPRPRAPPCYGLPAASTRVCQGIYRLDVRWGCCLLVLCGPGARRGACLLPCMQLGGVVDLHGAALWQVVGLCCWGTAGVSPARICSRRGTNVKLVGGL

SEQ ID NO: 132138 - protein, 175 aa, Triticum aestivum
  Clone ID: PAT_TA_26556.pep
MAAAGDGTTRKTACVTGGSGYIASALVKMLLEKGYAVKTTVRNPDDGEKNAHLKTLAALGPLEVFRADLNEEGSFDDAVAGCDYAFLVAAPVALMPKNPEEEVIQPAIQGTLNVMRSCVKAGTVKRVVLTSSTAAISSRPLEGDGHVLDEDSWSDVDYLRATKSGTWAYPASKVL

SEQ ID NO: 132139 - protein, 326 aa, Triticum aestivum
  unsure (1)..(326): unsure at all Xaa locations
  Clone ID: PAT_TA_26557.pep
MGGRGCRPASPVGTLLARRRSARTTGRSPADGGKTAHLKAMAALGPLEVFRADLTDEGSFDHAVAGCDYAFLVAAPVAPLPRDPAEGGIQPASQGNPDLKGAVRETRNVEGVVPHSAGGPTPSRPPLGDGGDLHEEASWAEVDLRRSTMTGPWAYSLSKVLVEKATCAFAEKGISLVTVCPAVTVGEAPAANDLTSLSIILSLLSGDDAYXGALEHIERATGSIPMVHIDDVCRAEILVAEEEAASGRYIVCGLNPTVVELARFLPAKYPQYKVNTHRFRDLPEKPRVCISSAKLVKEGFEYKYKNVEEIYDSVVEYGRALGILPY

SEQ ID NO: 132140 - protein, 184 aa, Triticum aestivum
  unsure (1)..(184): unsure at all Xaa locations
  Clone ID: PAT_TA_26558.pep
MEVRSAYCSLGAAVPLGVRLNVRSYLKFLSWMPAALKMPEEELIEHAGLDSGVYLRIYLTGLKIFVPITILAFAVLVPVNWTNDTLDDLKVVHSDIDNLSISNIPHGSKRFIAHLVMAYVFTFWPCFVLRIGFERVATMRLRFLASEKRRPDQFTVLVRXNIPPDPDESVSELVEHFFXLVNHP

SEQ ID NO: 132141 - protein, 109 aa, Triticum aestivum
  Clone ID: PAT_TA_26559.pep
FIWAAIYLLHAGAARHPQVVLPTFAARDPGGHWRCRRHHRLPPTQLRHLNTPCPRPRLQPPCPLKSCQSSQHWQCELKSCQSSQHQRRELKSGGRQSFTLAWTIMRTWN

SEQ ID NO: 132142 - protein, 223 aa, Triticum aestivum
  unsure (1)..(223): unsure at all Xaa locations
  Clone ID: PAT_TA_26560.pep
LERHENALLKQENEKLRTENLTMTEAMRTPMCGGCGSPAMLGEVSLEEQHLRIQNARLKDELNRVCTLATKFLGKPVSLLSPLQLQPHLSMPLPNSSLELAVGGIGGIGSMQPSMHGMMSEYAGGASSSMGTVITPARATGSALASMVDIDRSVFLELAISAMDELVKMAQXDDPLWXXGLPXFPDKXSLNFGEYXHSSNICIGMKPAXFVSXALGKSGWASS

SEQ ID NO: 132143 - protein, 244 aa, Triticum aestivum
  Clone ID: PAT_TA_26561.pep
FPWGGGDPGRVGQTRAEERRRLPCPRDGHLGRRRRQLAAHHRRGRLEAPRLLLLRRGGGQLLLRAGPPDEAAPHPHDPRPARPLSNTRHKTTPQALPHTRPRPFPLPRRRLHALSLQFQERPADTEFPQPDEDEEDQDERHDDHDSDMELDYHTPLEDSARRSTIQGTRVKRESAGAETKDQQDGSRVTGEHRGSEPMAEDISPSKQAHQVDANAMAVDEPGNVKTESGSSTKLPDPPAIYQKP

SEQ ID NO: 132144 - protein, 521 aa, Triticum aestivum
  unsure (1)..(521): unsure at all Xaa locations
  Clone ID: PAT_TA_26562.pep
MDPSSAGAGGNSLPSVGPDGQKRRVCYFYDSEVGNYYYGQGHPMKPHRIRMTHSLLAQYGLLDQMQVLRPNPARDRDLCRFHADDYISFLRSVTPETQQDQIRALKRFNVGEDCPVFDGLYSFCQTYAGASVGGAVKLNHGLDIAINWSGGLHHAKKCDXPSGFCYVNDIVLAILELLKHHQRVLYVDIDIHHGDGVEEAFYTTERDMTVSFHKFGDYFPGTGDVRDIGHSKGKYYSLNVPLDDGIDDESYQSLFKPIMAKVMEVFRPGAVVLQCGADSLSGDRLGCFNLSIRGHAECVKYMRSFNVPLLLLGGGGYTIRNVARCWCYETGVALGQELEDKMPVNEYYEYFGPDYTLHVAPSNMENKNTRYELDNIRTKLLDNLSKLRHAPSVQFQERPPDTEFPEPDEDEDDQDERHDDPDSDMEMDYHTPLEDSARRITIQGTRVKRESAGAETKDQQDGSRVTGEHRGPEPMAEDMGPSKQAHQVDANAMAVDEPGNVKTESGSSTKLPDPPAIYQKP

SEQ ID NO: 132145 - protein, 341 aa, Triticum aestivum
  Clone ID: PAT_TA_26563.pep
VNTAITFLVGSALGWPACKLLKPPPHFRGLILAFCSAGNLGNLLLIVVPAVCDEDGNPFGSDRSQCRSRGLSYSSLSMALGGLFIWTYTYSLMQKSGKLYHKMQSKSIQCPADSDEEHLEGFKAGDEEAALPASAGPDDEHNEGRQIEAPLLSCESDVANNKGFWVNLKEAVHQLVEELMAPPTISAMIGFAVGLVPYLKSLIIGEGAPFRVIQDSLALMGNGTIPCITLVLGGELPQGLRKSVLKRMVIVAIVFIRYVAMPVIGIAVVRAAHGVGFLPHDPLYRYVLMLQFALPPAMNIGTMAQLFDVGQEECSVIFLWTYLVAAVALTTWSTVFMSILS

SEQ ID NO: 132146 - protein, 126 aa, Triticum aestivum
  Clone ID: PAT_TA_26564.pep
HIFELCFQERFSCHLNHLWHKHKHPERRKLLIVSAWLSQNKVLRFLTFLLVNLSHLSTLSTTVIHLMLYGIRSLYHRPNDRKWVGLSIKYILVQWKNITFTKQQIQVLQCFPQEEGLLQAFGLRGR

SEQ ID NO: 132147 - protein, 72 aa, Triticum aestivum
  Clone ID: PAT_TA_26565.pep
YWTSGSSALCLFLYATFYFITKREITKFFVSAILYFGYMLIASYAFFALTGTIGFYACLMFTRLIYSSVKIE

SEQ ID NO: 132148 - protein, 71 aa, Triticum aestivum
  Clone ID: PAT_TA_26566.pep
FYGLEETPYVPVNIIVEVLKNFDAQGFVAVNDDHSLNRWPVPKPFWCYPTWHKLEEEVDLEEELKYQREQY

SEQ ID NO: 132149 - protein, 102 aa, Triticum aestivum
  Clone ID: PAT_TA_26567.pep
YSRENQTKTKVKLFLFYCAMHITLKGLSVQRDFSYSNSYLPESCPFTGHLTLLPTDHNTQRQFTSCPRKKLLVARSSMSTHTSIIGTFSLVCLRLLPNQPAA

SEQ ID NO: 132150 - protein, 80 aa, Triticum aestivum
  Clone ID: PAT_TA_26568.pep
GGDSTYVAPLPSGFAILPDGPSIGSEHKTGGSLLTVAFQILVNSQPTRGLTGGSVETVNNLISCTIKKIKTALQCATPEC

SEQ ID NO: 132151 - protein, 59 aa, Triticum aestivum
  Clone ID: PAT_TA_26569.pep
SVGIILNSFTDYFVCSCFIESNKFRCFVAVVATVTFNSTILAACWSPNLLWDISAIWAG

SEQ ID NO: 132152 - protein, 123 aa, Triticum aestivum
  unsure (1)..(123): unsure at all Xaa locations
  Clone ID: PAT_TA_26570.pep
ASPSIPHTHRRRALHRASALHHGVGLSLAPPRLYSTLSTSPPRRPPLHLLQRSVALRNGVTAVAAHVPEVLLLVVSNPVDDLTYLAXKLSSFPASSVGGSGTNLHSSRFRFLINQLHVNTQDV

SEQ ID NO: 132153 - protein, 127 aa, Triticum aestivum
  unsure (1)..(127): unsure at all Xaa locations
  Clone ID: PAT_TA_26571.pep
RRPSTSPSIPFTHRRRALHRASALHHGVGLSLAPPRLYSTLSTSPPRRPPLHLLQRSVALRNGVTAVAAHVPEVLLLVVSNPVDDLTYLAXKLSSFPASSVGGSGTNLHSSRFRFLINQLHVNTQDV

SEQ ID NO: 132154 - protein, 116 aa, Triticum aestivum
  Clone ID: PAT_TA_26572.pep
HHSHTTRSVGKESIHEFVNTMCKGVHQRDVPHLQGCCFVTTLVPCPGATYQPLILFLNSRSYAGPTSNIKALPSLLALKPLAWLLCCTVVYTRRASLPICCSSVFLLLHGSWVFGC

SEQ ID NO: 132155 - protein, 104 aa, Triticum aestivum
  Clone ID: PAT_TA_26573.pep
HASGRLESVSSRGIGQEWTRYQKIEGLKETISTREGVKNQALREYESIKENNMTEIKRFDKDRRRDLIEMLKGFVVNQVSYSDHFANMWGKVAEETKVYANRSN

SEQ ID NO: 132156 - protein, 301 aa, Triticum aestivum
  Clone ID: PAT_TA_26574.pep
CTRPSRAIAAFQGEAPRHWTTTVNAAIPTVPAKAGRDLFGMFKDLKQTVVHGFGATDPPPVEEETDTEFLSHKSRLEDLQQQLTTTSQQAESLVKAQDDLRTTTAHLGMTFIKLANFEREQATCNSERRRAGVIQHFANSVVKFSRSQAKLNSEVVQQLDTIHEYLEMMISVNHAFTDRSNALQHVQSLSADLFFLHTRAGRLESVSSRGIGQEWTRYQKIEGLKETISTREGVKNQALREYESIKENNMTEIKRFDKDRRRDLIEMLKGFVINQVSYSDHFANMWGKVAEETKVYANRSN

SEQ ID NO: 132157 - protein, 78 aa, Triticum aestivum
  Clone ID: PAT_TA_26575.pep
MGLWMLLEGFLLLANSLAILNEDRFLGPRGWSMSEVSGNGQTKSLKGQIVGLIYATQFLRMPLIALNVLIIVVKMVSG

SEQ ID NO: 132158 - protein, 270 aa, Triticum aestivum
  Clone ID: PAT_TA_26576.pep
MAESLDMSLEDIIKSNKKGNSSSGGGGRRREGRRGSAAAGSGAAAAAAGGVGPNRRAFKRSGNRAAPYQPPKAPESAWQHDMYSDASARGGGGGRVSAIETGTKLLITNLDFGVSTEDLKELFSELGDVKRCLIHYDRSGRSKGTAEVIFARRGDAVAALRKYNNVQLDGKPMKIEILGTNTPTAPAALPTNNGTYARNVAKSAPRGVSASLPQNRPRARGGRGRRGGGGGSGSGGRRGKERSQPRSAEELDAELEKYHAQGTTPMQTTE

SEQ ID NO: 132159 - protein, 153 aa, Triticum aestivum
  Clone ID: PAT_TA_26577.pep
MMHMTFYWGTSATILFDGWRTSAWTGYLLSLLALFLAAAFYQYLEAFRIRVKLLAGAKADPLPPPAGSDARAPLLAPGSAAFLGGRWPARVATAALFGVNAGIGYLLMLAVMSFNGGVFIAVVLGLAAGYLAFRSGDVDGDDLVVVDNPCACA

SEQ ID NO: 132160 - protein, 546 aa, Triticum aestivum
  unsure (1)..(546): unsure at all Xaa locations
  Clone ID: PAT_TA_26578.pep
MGFCCANAAGGGRWRRRRRQRCRRCRSIWKGLCSPSPSRCEYNRSAPPGASGLVVPREPTGTGRDIAERYELGGELGRGEFGVTYLCTDRATREALACKSISKKKLRTAVDVEDVRREVEIMRHLPKHPNIVTLRDTYEDDNAVHLVMELCEGGELFDRIVARGHYTERAAAVVTKTIVEVVQMCHKHGVMHRDLKPENFLFANKKETAVLKAIDFGLSVFFTPGERFSEIVGSPYYMAPEVLKRNYGQEVDVXWSAGVILYILLCGVPPFWAETEQGVAQAIIRSVIDFKRDPWPRVSDNAKDLVRGMLNPDPRRRLTAQQVLDHPWLQNIKKAPNVNLGETVKARLQQFSVMNKFKKHALRVIAEHLSVEEVAGIKDMFEKMDLNKDSMINFDELKLGLNKLGHQMPDADVQILMDAADADGNGCLDYGEFVTLSVHLKKIGNDEHLHKAFGYFDRNKSGYIEIDELRESLADDLGPNHEEVINAIIRDVDTDKDGKISFDEFVAMMKAGTDWRKASRQYSRERFTSLSLKLQKDGSLQITSTQ

SEQ ID NO: 132161 - protein, 234 aa, Triticum aestivum
  Clone ID: PAT_TA_26579.pep
MAGRAGAATFPPASPPPGKQFAEVVVVRHGETSWNATRTIQGQMDPELNETGRRQALVVARRLSREAKPAAVYSSDLKRAAETAQTIATACGVSSLVLDPALRERHMGDLHGLVFDDAVRRNPEIFSSYSRTQEIPGGGESLDQLSKRCVSYLNTVAEKHKWERVIVVTHGASTEELCIHADPTSPVRGKLYNTSICVFRIGGGEWILEKTGDVGHLDQGEFLEDAFGGDGVSA

SEQ ID NO: 132162 - protein, 86 aa, Triticum aestivum
  Clone ID: PAT_TA_26580.pep
HASAHASDGSSRDSIRSLGQLWNFSLSDLTADLTSLGDLEALENYEGTPFLPSDSDLLLDSPDHNDDIVEYFADAINGTQSDEEKS

SEQ ID NO: 132163 - protein, 67 aa, Triticum aestivum
  Clone ID: PAT_TA_26581.pep
ICFRITHCISMSSTTHTYVSPDPSMRVQFDNDVISSCLFSGFNVMKFNGCHCHEAGATRSIDGTTTA

SEQ ID NO: 132164 - protein, 141 aa, Triticum aestivum
  Clone ID: PAT_TA_26582.pep
MPMLIPDDVRAKAEIYTGDAAGQEKTRLMLAETELPSGLLPLKDIIECGYVEETGFVWLKQKKRVDHYFAKAGRHVSYATEVSAIAEKGRLKKISGVKAKEMLIWVNLHEICVDDPPTGKLHCKAIGGLSRSFPVGGIRGH

SEQ ID NO: 132165 - protein, 255 aa, Triticum aestivum
  unsure (1)..(255): unsure at all Xaa locations
  Clone ID: PAT_TA_26583.pep
XVAFITILDDTLDSHANSYESMQLAEAVXRWDETAVSLLPEYMKDFYMYLLKTFSSFENELGPDKSYRVFYLKEAVKELVREYTKEIKWRDEDYVPKTLKEHLKVSLISIGGTLVLCSAFVGMGDVVTKKIMEWVMSDAELVKSFGIFVRLSNDIVSTKREQREKHCVSTVQCYMKQHELTMDEACEQIKELTEDSWKFMIEQGLALKEYSIIVPRTVLEFARTVDYMYKEADKYTVSHTIKDMLTSLYVKPVLM

SEQ ID NO: 132166 - protein, 76 aa, Triticum aestivum
  Clone ID: PAT_TA_26584.pep
KLGCYKHSHSDNEEDNDEVHENTQTNSNEPDNDVEIEPPVDLDNPQPKNKRYDNRDFIARKHGENKRPAEKKKAAA

SEQ ID NO: 132167 - protein, 151 aa, Triticum aestivum
  unsure (1)..(151): unsure at all Xaa locations
  Clone ID: PAT_TA_26585.pep
MPWAGWPLPPLPRHHGVAVGREPSHLLAATSSGSGQRQRRSWRLKRSRRDRTRPRARGRTRTADASIQATSTPPYPSAARITDSSCFPQYTVSLKCLETNQDKSKXQQQFDDYKECKKREAPQHGNPPAPSPIKHHQRRWRDAGGECAAAS

SEQ ID NO: 132168 - protein, 85 aa, Triticum aestivum
  unsure (1)..(85): unsure at all Xaa locations
  Clone ID: PAT_TA_26586.pep
MAAAHAEAAASPTHRASIQATSTPPYPSAARIADSSCFPQYTASLKCLETNQDKSKCQQQFDDYKECKXEREARLERNRSRTLFG

SEQ ID NO: 132169 - protein, 100 aa, Triticum aestivum
  Clone ID: PAT_TA_26587.pep
ERKAREKQLKEQEESLQDWEKKLKESQNRLVDLQRSVNDREERANENDKLCKIKQEELEEAKKTVESTKIILKTKEDDIAKRLNELRSQEKDADAKHKIL

SEQ ID NO: 132170 - protein, 244 aa, Triticum aestivum
  Clone ID: PAT_TA_26588.pep
MAGAGGVREREEEEEDDFVCLDPSFFMNRNYEMKTFTYGSQELQLLCLSSACTDYDLTGQLVWPGAVLMNTYLSEHPETVKGRSLIELGSGIGITGILCSRFCKEVVLTDHNDEVLEIIKKNIEMQSCSGNADAVLTAEKLEWGNHDHLSNIIEKHPVGFDLILGADICFQQASIPCLFDTVVKLLRMQANKCRFILAYVSRPKVMDALVLKEAEKRGMVVKEVDGTRTTITDLEGVIFDITLK

SEQ ID NO: 132171 - protein, 138 aa, Triticum aestivum
  Clone ID: PAT_TA_26589.pep
SFSPALPLHGNDTSCAGSWRVPISIRVCQSSLRSRSKGLLRNTPVDIFEEMRDLHPIQSSPSTIADGCILPIQEAYNCHPALLHVICTLLSEKTTAVLLILSAAPVGTVHLAPGANIAATPLSIPTQAASLLVVGGLH

SEQ ID NO: 132172 - protein, 174 aa, Triticum aestivum
  unsure (1)..(174): unsure at all Xaa locations
  Clone ID: PAT_TA_26590.pep
MATAAGGGSMMTREQLLHLFSRFSFLTSLPEFKDRIADAVSDKQEAXVAVTTXMQEEILREMGIDPGFGISCLGKVNVVYENDMDLMIKFYQFVAKEEMAIDEAELEPLEFAEKMHSQQELQQQQLEMLVQIRKYSPESQSVILETLHKQLESADFDTSASILTPEQIQGIVEK

SEQ ID NO: 132173 - protein, 193 aa, Triticum aestivum
  unsure (1)..(193): unsure at all Xaa locations
  Clone ID: PAT_TA_26591.pep
FSVATRLAGTFGYLAPEYAVTGKITTKADVFSFGVVLMELITGMTAIDXRRIDEETRYLASWFGQIRKDEEKFRAAIDPTLELTDEIFESISVVAELAGHCTSREPSQRPDMGHAVTVLVPMVEKWKPSNNEAEDYMGIALHLPLLQMVKGWQESEASMTDGSIMSLSLEDSKGSIPARPAGFAESFTSADGR

SEQ ID NO: 132174 - protein, 102 aa, Triticum aestivum
  unsure (1)..(102): unsure at all Xaa locations
  Clone ID: PAT_TA_26592.pep
MIPSLGTILAGVRRSRHAIAKTTPVSALTALLFLAAATFWLLFLGPLRSPHNHLRHXGANTHGMGATSCDTTLGEWVRDPAGARPHYTNATCAFIQDYXELH

SEQ ID NO: 132175 - protein, 166 aa, Triticum aestivum
  Clone ID: PAT_TA_26593.pep
MAVPAPAKAARALAATAAALVLLWCVHFRGGLALSSPTNKGLIFNVHPVLMLIGFIIIGSEAIMSYKTLPWSHDTNKTVHLILHAVALFLGSFGVYAAFKFHNESGIANLYSLHSWVGLGTIILYGLQWVSGFLTFFFPGASPTLRRAVLPWHVRAGLVVYVLALL

SEQ ID NO: 132176 - protein, 110 aa, Triticum aestivum
  Clone ID: PAT_TA_26594.pep
LPTKAWHQQKVKFSVHLGLQQHCVSMPTPYPADELDHLWLSKRSSLASISSCFVLYSSSCLTLASYDSSTFLVKVLTISQSSALPFFSAASCASRLVPLVLSRTCWIPTC

SEQ ID NO: 132177 - protein, 198 aa, Triticum aestivum
  Clone ID: PAT_TA_26595.pep
MATTTPKATRRASIRGRAWRLLRLAALRARKGIVVRGLGLLKTLGCSGRSDRLRYGEREFSIDETPAFRFRAPSARVLRFIPCIAPAVPDTPDDYSGDRYFFCDPLERVAGSVGDGHGAGLSEYGVENLDDCAEEQLLQRAVMGASCADFGAVEQEDGEDAGVDVKAEEFIANFYSQMRMQRQISSLQYNEMMHRSIC

SEQ ID NO: 132178 - protein, 292 aa, Triticum aestivum
  Clone ID: PAT_TA_26596.pep
QSIPSLPCGRGDTIPSLLGSSTEGSSLPRLLVIAAGLTEVILLTAHPSRSFSSALSSSVRSLCGESSAATSFSVTAAGIILVGASAVSTVELKAFSLISSAATSFSVTAAGVILLGASAVSMVEWRASSLKSAAATSFSVTAAGVISLRASEALTVELKASSWKSSAETSFSVTAAGVIFSLRASEASTVELKASSFKSSPATSFSVTAAGIILLGTSDASAVELKSSSLMASFGTSTAATSFSSLALLISSTISNTGDHLLLSPSSVEAPSTLLIAGSGVALERTPKIGSC

SEQ ID NO: 132179 - protein, 260 aa, Triticum aestivum
  Clone ID: PAT_TA_26597.pep
ACSAASCIHIIDFDLGVGGQWASFMQELAHRRGTGGVALPLLKLTAFVSDASHHPLELHLTQDNLTQFAADLGIPFEFNAVSLDAFSPAELISSTGDEIVAVSLPVGCSARAPPLAVILRLVKQLGPKIVVAMDYGADRADLPFSQHFLHCFQSCMFLLDSLDAAGIDADSACKIEKFLIQPRVEDAVLGRRKTDKAVSWRNVFAAAGFTPVPLSNLAEAQADCLLKRVQVRGFHVEKRGVALTLYWQRGELVSVSAWRC

SEQ ID NO: 132180 - protein, 153 aa, Triticum aestivum
  Clone ID: PAT_TA_26598.pep
MAMTRGAMVAAVALVALLLFPATFAFPPAGQQQLDPHFYDHSCPQAQQIVASIVGKAHAQDPRMAASLLRLHFHDCFVKGCDASILLDSSASVVSEKRSNPNKDSARGFEVVDEIKAALEAACPRTVSCADVLALAARDSTVMTGGPGWIVPL

SEQ ID NO: 132181 - protein, 64 aa, Triticum aestivum
  Clone ID: PAT_TA_26599.pep
GRMLGQTLSRRHAYSGSSSKYFARKYWACRQHAAPAAAVKEERSYFSCRNLVAKQMLDVSSDVS

SEQ ID NO: 132182 - protein, 111 aa, Triticum aestivum
  Clone ID: PAT_TA_26600.pep
HERVQSSSVLVKLGGVALPSAPREVAGGHPTLVFDRLKGINDKVYPEEAHIIIPWFERPIIYDVRARPNLEEPTWSCLLVLIPTSPNSKRITWRIQGIAKLFLAFDMAGLR

SEQ ID NO: 132183 - protein, 55 aa, Triticum aestivum
  unsure (1)..(55): unsure at all Xaa locations
  Clone ID: PAT_TA_26601.pep
SNRKRXQSISLNXXNXGPTGXXQHNTAHIPLNQTQHKQHRHTKYAWLKHNLICRL

SEQ ID NO: 132184 - protein, 93 aa, Triticum aestivum
  Clone ID: PAT_TA_26602.pep
METVSTNEDTGKGAMRELEKSLDQPMDTEAGRLRNMYREKTYPTVLMLQLAFQCLGVVFGDLGTSPLYVFYNIFPEKIEDTEQIISSLLPPPP

SEQ ID NO: 132185 - protein, 243 aa, Triticum aestivum
  unsure (1)..(243): unsure at all Xaa locations
  Clone ID: PAT_TA_26603.pep
HTGLVKDGRRYFHNMTQLYNITPRIEHYGCMVDLLSRAGLLQEARQLIDDMPMQANAVVWGALLGGCKIHRDAELAEHALKQLVMLEPRNSGNYVMLSNIYSNSNRWEDAAKLRSDMKVKRVEKVRAYSWVEFSGKVHEFRVGDKSHPHMDQIYQKLDELGMEMKTMGYKPTTDVVMFDVEDEEKEHTLVYHSXEKLAIAFCLLTTQPGEVLRAPKTPGGSRLXXLXIHLIXRIIHREIMCRD

SEQ ID NO: 132186 - protein, 54 aa, Triticum aestivum
  unsure (1)..(54): unsure at all Xaa locations
  Clone ID: PAT_TA_26604.pep
SNLYFCYSKNSQKNLINVXDHIFIKCVKNIPCLVQNNSKIFIFLFCSWQHRAGP

SEQ ID NO: 132187 - protein, 89 aa, Triticum aestivum
  unsure (1)..(89): unsure at all Xaa locations
  Clone ID: PAT_TA_26605.pep
STTSAATAPAAALQPRPPPPRPPPPPLPPAGHSVSPRPAPHQERHSTPPPATAPRPPPPRASTXTVPPPPPPPPPPPPRPAPSSPPATS

SEQ ID NO: 132188 - protein, 96 aa, Triticum aestivum
  Clone ID: PAT_TA_26606.pep
MHCRLPRPWPSHIPCPSLLFGDGELYESGASPLVFLIQGGGMNLSRVGENLLSSVCCARSLALLPPTPAPSCVEVPARAIVAATAGFDVTEVLKIT

SEQ ID NO: 132189 - protein, 193 aa, Triticum aestivum
  unsure (1)..(193): unsure at all Xaa locations
  Clone ID: PAT_TA_26607.pep
YEPTQGRITVAXEDIRVFDKREWSQIVSLVNQDPVLFSASVGENIAYGLPDDVVSKDEIIKAAKAANAHEFIISLPQGYDTLVGERGSLLSGGQRQRIAIAXALLKDAPFLILDEATSALDTTSERLVQEALDLLMKGRTSLVIAHRLSTVQNAHRIAVCSDGKIMELGTHXELXXXXGSYAAXVGTQRLAFE

SEQ ID NO: 132190 - protein, 130 aa, Triticum aestivum
  Clone ID: PAT_TA_26608.pep
KKTPHDFIVGNTLQLHLIASITTLHLTELTTLSAYRHLIESDKANHHNTSPIPREPSPHISRHLRPLPRQLPPPPPQEQHALPPAQRPHLQCRRRWGLPPTWPPLSGPSLPLSAQQPHHQCGRRRGRPPT

SEQ ID NO: 132191 - protein, 618 aa, Triticum aestivum
  unsure (1)..(618): unsure at all Xaa locations
  Clone ID: PAT_TA_26609.pep
MGDETSTSASGSGQEPAAPALQGAGSVKQQISNLEALSLRATVPEADVQPIVEFCTXKFGDYQCNNAMGLWSKVKGTGTSFKNPKAIGQAIAKHLPGCDVIXNXSFAGPGFVNIFLSKCWLANRLQDMLGNCNKTWAPILRVKXWASILPVATVVLDFSSPNIAKEMHVVHLRSTIIGDTLARMFEFSNVEVLRCNHVGDWGTQFGMLIEFLFEKFPNWEELGSQAIGDLQVFYKASKQRFDEDAEFKDRAQQAVVRLQGGEEKYRAAWKKICEISRNEFDQVYKLLDVQLEEKGESFYNPYIPQVLEKLSSQGLIEESEGARVIFIQGHQIPLIVVKRDGGFNYASTDLAALWYRLNVEKAEWIIYVTDVGQQQHFDMFFKAARMAGWLPDPKEKKFPKTSHVGFGLVLGADGKRFRTRSTEVVRLGDLLDEAKSRSKSELLQRLTENGKIVDWTDEELEQTSKAVGYGAVKYADLKNNRLTNYTFSFDQMLSDKGNTAVYLQYAHARICSIIRKSNMDVEELKVSGNISLAHPDERVLGLYLIRYAEIVEEACTNLLPSVLCEYLYNLSEMFTRFYTNCQVVGSPEEPSRLLLCEATGVVMRQCFQLLGITPVYML

SEQ ID NO: 132192 - protein, 119 aa, Triticum aestivum
  Clone ID: PAT_TA_26610.pep
MASNYVDTTGEEGRFHTHGHHSNSTTPTGEAASPKNTRRRWPGSASAPSGAGHGPASKCVCAPATHAGSFKCRFHRTNSQGHGHGQGSRPSSPPSPVAANAVPRHPASPSSSSGTVTTQ

SEQ ID NO: 132193 - protein, 121 aa, Triticum aestivum
  Clone ID: PAT_TA_26611.pep
MASNYVDTTGEEGRFHAHGHHSNSTTPTGEAASPKNTRRRWPGSASAPSGAGHRLASKCVCAPATHAGSFKCRFHRTNSQGHGHGQGQGSRPSSPPSPAAANAVPRHPASPSSSSGIVATQ

SEQ ID NO: 132194 - protein, 108 aa, Triticum aestivum
  Clone ID: PAT_TA_26612.pep
VENGVYEKVQCSCTVQTNFLFFFHEPLRCPNTIKFCWDIRHLSVFVDKKNRFFEIFNYFLNLLFLGSRGLRNEYSCNKQVVLIILEYMVTLVLLESHHMMVKVCIHFP

SEQ ID NO: 132195 - protein, 64 aa, Triticum aestivum
  Clone ID: PAT_TA_26613.pep
DVKENQPAEIICMTSDANLQRCVNIEINHCQPNLFDVYINFIWKGFGDCMFFFEYVPTLRLFAF

SEQ ID NO: 132196 - protein, 191 aa, Triticum aestivum
  Clone ID: PAT_TA_26614.pep
RFCPQKVIPLWNHRGHTGYAIVEFGKDYACFCNAFKFENHFEAEGYGKRDWEARRYRGSKMFGWVARADDQRTLGPIGEHLQKNGDLKTVAELENEGTRKTDKLVANLASQIEVKAKHVQELECKYNETTNSLDKVMEEKEQVLQRYNDEIHKMQQLARKHSQMIINENQRLRSELGVQDAGSPKLKSRQP

SEQ ID NO: 132197 - protein, 112 aa, Triticum aestivum
  Clone ID: PAT_TA_26615.pep
SPPAPAARLPYLAGLPSPSVASPTLPAARLPYLAGPRLLRWFNRRRRRRRSSCDREQPPPTTTTTQAGPPLLPQERRGPPYKSTRPCNGGQLTRLIIIVLLNCDTLYLSDSI

SEQ ID NO: 132198 - protein, 196 aa, Triticum aestivum
  Clone ID: PAT_TA_26616.pep
KLCSFQLLRFVNSSASPHHHHSAGALGWPSIPAHRRFRHTPRAASPSSLLSTMESLLLRCRWPGSMIPSRFSLTRVSGHRRIPIAFIPLSHPTLPSFGARTSGGARCLSRHRVWLPFLQLQLLRMLNFLFSDMCSDGLGLLGFGPGRNTCILCWQWQHLRVSFSSWRRCHGHYLCPSSSIRGNPRYGFSDRTTMMS

SEQ ID NO: 132199 - protein, 63 aa, Triticum aestivum
  Clone ID: PAT_TA_26617.pep
RRRGRGGEAEERGRVLPQDGAVTGQQEEGRTPPIPPSLRTPTFACPTPTPYICVIMLLISYRS

SEQ ID NO: 132200 - protein, 173 aa, Triticum aestivum
  Clone ID: PAT_TA_26618.pep
SLEDIVSPHATDDQDISYCPICDCEVKLRSKHCKTCDRCVDGFDHHCRWLNNCIGRRNYAAFIMLMLFVLLMLVIEGGTAAAVFIRCFIDSKGLKTEMEHRLHVRLPKGAHAALSMVFVIFTLYSTAALGQLFFFHVLLIRKGMRTYDYILAMREAAQAYDPFDDSDFSSDES

SEQ ID NO: 132201 - protein, 439 aa, Triticum aestivum
  Clone ID: PAT_TA_26619.pep
MKITVYSSKAVTPEYGACGVAPGCTADVVPLTVLDKANFDTYISVIYAFHAPAPPNDVLEAGLAKALVDYREWAGRLGVDANGDRAIMLNDAGARFVEATADVALDSVMPLKPTPEVLSLHPNGDDGPEELMLIQVTRFPCGSLVVGFTTQHIVSDGRSTGNSYVAGSQATRGAAIDPVPVHDRASLFHPREPLHVEYEHRGVEFKPCEKVHDVVCGADGDDDEVVVNKVHFSREFISRLKAQASAGAPRPCSTLQCVVVHLWRSMTMARGLDGGESTSVAIAVDGRARMSPQVPDGYTGNVILWARPTTTAGELVARPLKHAVELIIREVSRINDGYFKSFIDFANSGTVEKERLVATADAADMVLSPNIEVDSWLRIPFYDMDLGGGRPFFFMPSYLPVEGLLILLPSFLGDGSVGAYVPLFSRDMNTFKNCCYTLD

SEQ ID NO: 132202 - protein, 99 aa, Triticum aestivum
  Clone ID: PAT_TA_26620.pep
HNDILSSYRAKIERANIGSRSARFLVELHKVFKLCLFIFELISSRVKKQVDLERLTSLELFLQPYLLHAQRDLRLFYFSYTFCWFCSMSTSSVVLGTVL

SEQ ID NO: 132203 - protein, 160 aa, Triticum aestivum
  Clone ID: PAT_TA_26621.pep
SCRIRHESDQVFRVNHYPPCHALQGLGCSATGFGEDADPQEVPVLRATGTCGRGMARQAGPRGTAAPDGGGLSGRGSRPEEVLTDGRFKSVKHRVVANSLKSRVSMIYFGGPAMTQRIAPLPQLLGAGEQSLYKDFTWGEYKKAAYNSRLGDNRLAQFHR

SEQ ID NO: 132204 - protein, 180 aa, Triticum aestivum
  unsure (1)..(180): unsure at all Xaa locations
  Clone ID: PAT_TA_26622.pep
GTRRCDRKAPFKPREAGDRALDNLMWRVERAEFAKAAADDGGAGRRLRLLDTYEMSLQRPDAHAGPYRAYQPFAKGGGAAAGKVQXNDCLHWXCLPGPIEAWKRHHHADAGRGLTSPPRSASSRGRAGGLVGGARHGGVSLLARRGSSGPGCGSSALAWASSALGRPCCHRSHLVCAWTS

SEQ ID NO: 132205 - protein, 123 aa, Triticum aestivum
  Clone ID: PAT_TA_26623.pep
ERRRFYRLVDPRLEGNFSIKGAQKTAQLAHACLSRDPKARPLMSQVVEVLKPLPNLKDMASSSYFFQSMRQERAASLGNPNGSQSMKAQSTFARNGVQPMRSLSYGPHASPYRQSPRPNGKQP

SEQ ID NO: 132206 - protein, 128 aa, Triticum aestivum
  Clone ID: PAT_TA_26624.pep
YKVINMKFVTRSYNRDSQPLVATLSTPGRWACAPQAHQYRRAAILPLPWPRTQEKTRNARESDPILLFLVLVFLALPPRAGPTTRRHSAPSDVGALLLAAGLVVVAAFFFLIHILRPVGRNYAKLLKA

SEQ ID NO: 132207 - protein, 111 aa, Triticum aestivum
  Clone ID: PAT_TA_26625.pep
SLGSSGFTWECTNRTLFHVESFVVSRTTDATMPLVFVPHPHRVWKNATMLCTRQHHVFLGLDMNGVSNIQLVILNKVEGEPHCSRNINMMRKSKFRCPPNLSNKSRCGALH

SEQ ID NO: 132208 - protein, 262 aa, Triticum aestivum
  unsure (1)..(262): unsure at all Xaa locations
  Clone ID: PAT_TA_26626.pep
MQAHLILYKFNEALMLTEVFSSMEAEADFDVEDSRSNNELQELWPVGEIDPKRGRFPCCIVWXTPLPXVSWLAPYIGHVGICQEDGSALDFAGSNLVSMDNFAYGSVARYLQLDRKKCCFPANLAAHVCEWSYKHTEVGTATSWDGALQLGTRHFQHKYYNLFTCNCYSFVANCLNRLAHGGSAXWNVLNVAALVWLHGGWVDPMXMVRSFAPFVTVACPGGQVAGWSFLIGILAFCLLLIGWFVFAVYCTKGLVCLILHCD

SEQ ID NO: 132209 - protein, 91 aa, Triticum aestivum
  Clone ID: PAT_TA_26627.pep
LLLAVLGRVVVALRQPAAAAPAPAGGGGDAGGDDDGGEGAGAAAHGRRRRHRQRRRRSRGRGDRVGQGEVLEPGLAFISSGTSMTGFEEPH

SEQ ID NO: 132210 - protein, 387 aa, Triticum aestivum
  unsure (1)..(387): unsure at all Xaa locations
  Clone ID: PAT_TA_26628.pep
MASAPAPPPRRVVVCGGGVVGACTAYFLSTHPASPTVPTLVEKSSPACAASGKAGGFLALDWSDSTPALSALARASFGLHHRLAAALDGANAYGFRPVHTLSICLPSQPAEPLSPHPLLPSWVDPSASAAPPRQLGTPDTTAQVHPGLFTKAVLAASGAEVVIGEVERVVVQAGSRVRLAAKGHGGVGPLPVVLALGPWSGRFEMVIEVFDVSGLKAHSIVLRPRNPDKITPHCLFLSYQPEPGAKMLDPEVYPRPTXGEVYICGMSKDEDVPDDPAAIDGEPDSIAMLHKIAGRVSSQLKTEEGAEVVAEQACYLPCTNDGLPVIGEMPGVKGCYVATGHSCWGILNAPATGAALAELILDGQAKIVDLVPFSPARFLKKKSRRGV

SEQ ID NO: 132211 - protein, 93 aa, Triticum aestivum
  Clone ID: PAT_TA_26629.pep
RQYHIVNKCHPAKKKDVVRLYHALFLLYSPLVRQTVQMQCGMRLPGVLLFPFFIVVQLSFDENPDIFFLLGHLRTASLADGYCPLVARSELDI

SEQ ID NO: 132212 - protein, 177 aa, Triticum aestivum
  Clone ID: PAT_TA_26630.pep
ANPKIASYSKPTFFFFFFFFLSHIQLFYSPSTGLPDADHGKDLLVCIMCPLQRDHDQHGHGGQVFRVVVHLAQRRLLPLRRGVATASAERVVAVGGGPPDGAHLGHVRLLPPGGQRVDGAVHHVQRLDVPPAARGQRGLLLVRPAPAPLQIFDCGHRRRVVGQRQVRGDHGQPFRVR

SEQ ID NO: 132213 - protein, 143 aa, Triticum aestivum
  Clone ID: PAT_TA_26631.pep
LTRCHPKLCFMPWNHWKSIIIKVLSHLCHTDGPELNDYAVVYEDLFAKYFGLRKDGEGDRYVVLNMNASWLSNAGRNSLQQDGNRCLLGASECHSCAQCFWMNELSSVGFSVLKKVESIVQISPKPASWGYPWCGTWSLSFLG

SEQ ID NO: 132214 - protein, 252 aa, Triticum aestivum
  unsure (1)..(252): unsure at all Xaa locations
  Clone ID: PAT_TA_26632.pep
MPCIPASSPSIQHHNHNHHHRVLAGVGVGMGCGAEAVVAAAGTAGMRCREHDCEVPAEVARHHEHAEPGSGQCCSAVVQHVAAPAAAVWSVVRRFDQPQAYKRFVRSCALVAGDGGVGTLREVHVVSGLPAASSXRSGLEILDDESHVLSFRVVGGEHRLKNYLSVTTVHPSPAAPSSATVVVESYVVDVPAGNTIEDTRVFIDTIVXCNLQSLDQDRPRRSPPCSLRAASIFLDVIHLFFPGGMYVCFFCA

SEQ ID NO: 132215 - protein, 220 aa, Triticum aestivum
  Clone ID: PAT_TA_26633.pep
PVVRAVVGTAVSRAAAPAAVASGAVVVDCSSAYRMDPDVPLVIPEVNPEAMADVRLGKGAIVANPNCSTIICLMAVTPLHRHAKVKRMVVSTYQAASGAGAAAMEELKLQTREVLEGKPPTCNIFSQQYAFNIFSHNAPIVENGYNEEEMKMVKETRKIWNDKDVRVTATCIRVPTMRAHAENVNLQFEKPLDEDTAREILRAAPGSYLCVDRAAIKAPR

SEQ ID NO: 132216 - protein, 242 aa, Triticum aestivum
  unsure (1)..(242): unsure at all Xaa locations
  Clone ID: PAT_TA_26634.pep
EAGISKDGQTREHALLAFTLGVKQMICCCNKMDATTPKYSKARYEEIVKEVSSYLKKVXYNPDKVPFVPISGXEGDNMIERSTNLDWYKGPTLLEALEQINXPKRPSDKPLXLPLQDVYKIGGIGTVPVGRVETGVIKPGMXVVTFGPTGLTTEVKSVEMHHESLLEALPGXXVGFNVKNVAVKDXKRGFVAXNXKXXPAKXGAXXTSQVIIMNXPGQIGNGYAPVLDCHTXXIAXXFAELV

SEQ ID NO: 132217 - protein, 108 aa, Triticum aestivum
  unsure (1)..(108): unsure at all Xaa locations
  Clone ID: PAT_TA_26635.pep
FAMHSKAYQVLVICKIPPTSSGSQAEGSSTANSPLPRGAVSPAEGSKSXRKAPPXKCSRGHETWAPCMSVHXQLTXTRQETLSRTXAAADSCCWRXEAGSRELRVHPC

SEQ ID NO: 132218 - protein, 139 aa, Triticum aestivum
  unsure (1)..(139): unsure at all Xaa locations
  Clone ID: PAT_TA_26636.pep
MSVEILDGRTVQSFVXRDEGAFNASVDRRFAALDADHDGRLCYSEMAGEIMSLRVLEKHFGVDDAGAVGPDELAKLYRVLFARFDRDGDGGVDREEFRAEMKEVMLAVANGLGFMPVQMVVEEGSFLKVAVDRELARAA

SEQ ID NO: 132219 - protein, 154 aa, Triticum aestivum
  unsure (1)..(154): unsure at all Xaa locations
  Clone ID: PAT_TA_26637.pep
MDGSKLKKXAXKKFGGPRKKSVTKSIKAGLQFPVGRIGRYLKKGRYAQRVGSGAPVYLAAVLEYLAAEVLELAGNAAKDNKKTRIVPRHLLLXAIRXDQELGRLLSGVTIAHXGVXPNINPVLLPKKAXEKAXKAGTAAKXPKKGTKXPKKTKG

SEQ ID NO: 132220 - protein, 125 aa, Triticum aestivum
  unsure (1)..(125): unsure at all Xaa locations
  Clone ID: PAT_TA_26638.pep
FXXVLXGHXYTQXXXXEXPXDRGAQXXXXXXDTXGPXQXXXXXXXKXXXAXXQTXGTRRRRXXTLYAXXXHIGARXHTETPSTRTHXRXNXNVNPTRNTRHVPXXXTQRXTSXXNRHYXFXXVHS

SEQ ID NO: 132221 - protein, 133 aa, Triticum aestivum
  unsure (1)..(133): unsure at all Xaa locations
  Clone ID: PAT_TA_26639.pep
CALLLALVVXSXVAGVAXGFSXLASSTSLLPVWRRCXRXWRXPLCPXAPSXSPGALCALXVXPALLLSGGXPSWXRSLXGPPACGGPPXCAVXXGPGLXLLVAXXGPPCCACPSAVXRCRXARWXRCRXPRWL

SEQ ID NO: 132222 - protein, 107 aa, Triticum aestivum
  unsure (1)..(107): unsure at all Xaa locations
  Clone ID: PAT_TA_26640.pep
XHXYXXXMGHSPLAVXXRLXPXXTLYGRRXLLFXRRIHLXGLLNVPRXXRHXRLALRLXDMXXGRVVVLALAXVXXPTWGXALAVXGXXRACSSXXVXLGMAAGGLG

SEQ ID NO: 132223 - protein, 144 aa, Triticum aestivum
  unsure (1)..(144): unsure at all Xaa locations
  Clone ID: PAT_TA_26641.pep
LPLLPNHTPVGANRSGDVGGAARAAKXFXXXXRKRTEXSATHPGHHQAGDPELARRGRVKRISGLIYEGDPRRCSRSFLEKRHPXGRQPKTEXARRXNRHRHGRRLSAQSXGRTLYGFGGLRFXGXPWWHHXXXFXPSXXXGPX

SEQ ID NO: 132224 - protein, 149 aa, Triticum aestivum
  unsure (1)..(149): unsure at all Xaa locations
  Clone ID: PAT_TA_26642.pep
MAPKAEKKPXXXXRETTRERXRREAARRQEAARRREKKXDERETYXIYIFKVLKQVHPDIGISSKAMSIMNSFINXIFEKLAGESAKLARXXKKPTITSREIXXSVRXVLPGEXAKXXVFEGTKAVTKFTSASSFVDVIKSGPSRLVVS

SEQ ID NO: 132225 - protein, 112 aa, Triticum aestivum
  unsure (1)..(112): unsure at all Xaa locations
  Clone ID: PAT_TA_26643.pep
ELICQTMFRPEVWLXFCTXGRGGXGXPLXWGXXXQXXRXXXAXWPKLXXXSXGXXAPXGXLQGXQNFXXXGVXXXXPXXXXXXXXXVXXXRGXXXKXFXXGGXGXXXPXXXG

SEQ ID NO: 132226 - protein, 104 aa, Triticum aestivum
  unsure (1)..(104): unsure at all Xaa locations
  Clone ID: PAT_TA_26644.pep
MSGRGKGGKGLGKGGAKRHRXXXXTHQDTSXIXVXRARDALGLIYERPRVLRSSRDVIXRVTYTEHAXQTVTAMDVXYALKRQXRTLLDSAGHANRPPPPPDLC

SEQ ID NO: 132227 - protein, 105 aa, Triticum aestivum
  unsure (1)..(105): unsure at all Xaa locations
  Clone ID: PAT_TA_26645.pep
FKKKAPNAIKEIREVCTEGHGEPTMSAFDXXAXXHIWSXASRVSQESPCQDCPXEGTTRRMLKRSCTLLVTSCWKSPXEXLKRFXXQRLLEDEGLNPLXVVSIXL

SEQ ID NO: 132228 - protein, 74 aa, Triticum aestivum
  unsure (1)..(74): unsure at all Xaa locations
  Clone ID: PAT_TA_26646.pep
XSRTTNLRAXXALLCYPPHXLERILEXSXXXXSFWLXXXGPXXTXXXXGDXXXXXYEXEXTXAALDSXHIXXGV

SEQ ID NO: 132229 - protein, 108 aa, Triticum aestivum
  unsure (1)..(108): unsure at all Xaa locations
  Clone ID: PAT_TA_26647.pep
DXAXXGRXLPXGXHPASXPLKXVXXCXVXXPXXXXLXAXFSCPXVXPFAAGXPLDAXAXLSPPWGXFPRXGSSPRPXGXXXPPPWVPCVLVVGACGEAGFGWDXXRAA

SEQ ID NO: 132230 - protein, 73 aa, Triticum aestivum
  unsure (1)..(73): unsure at all Xaa locations
  Clone ID: PAT_TA_26648.pep
RSDYDLQXGQWVTGFQAAADTVNGFSFHPYLPLATTSSGHRRFGMEDEFEEESSLAGDENCCSVWKFSCSQES

SEQ ID NO: 132231 - protein, 136 aa, Triticum aestivum
  unsure (1)..(136): unsure at all Xaa locations
  Clone ID: PAT_TA_26649.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVXIYKAQASVLNSCSPNCXXWLCTQQPNA

SEQ ID NO: 132232 - protein, 132 aa, Triticum aestivum
  Clone ID: PAT_TA_26650.pep
IQHTVHKTDVQNVAKRPNITCLQALHYYHSSNRTYQKQGGHWRTHTMENYSACAACWTDIQLLLFGVVILNPCWKLSASKSSCPSLLVGVMRQPSPASLPSPILLTTNIEFEILQAGHRSLPGGRSTGVSFA

SEQ ID NO: 132233 - protein, 139 aa, Triticum aestivum
  Clone ID: PAT_TA_26651.pep
SRFSSRWFACSRGVINYSDLVGCMHSAAANAVKGGWESRRAALAHRTDKPGPYNSGSPCNTAFSFAQRYFCQAWATQSISWRLRGGVLGTVGVAGLPWSPSAPRPARGLYYLANIKYHTLASNQHCTSTCNQLMHVELV

SEQ ID NO: 132234 - protein, 107 aa, Triticum aestivum
  Clone ID: PAT_TA_26652.pep
KACQCPECSCRDTWGGYDCSCGRPGRYIKEHDTCISKTTVQAKAAWAAVWGILVALVIVAAGSYVVYKYRIRSYMDSEIRAIMAQYMPLDNQGEVPNDSHEDHPLAH

SEQ ID NO: 132235 - protein, 292 aa, Triticum aestivum
  Clone ID: PAT_TA_26653.pep
EKSPYTWTFSPSLRHPVISPPRRTTAGADLPCPTSACSKCLLFLLLFGASPPCSAGYRPAADPAAPMPPPAAPTPPPAEPLPNSPDSTSPTEEAEADAGGTPSRAGPVGTVSWGTGTLVGVFTGLLYGGAKEANANVSKDAEVMLKMGSTTDKREQYRLMRDAMEKRFIRVAKGSLVGGARLGMFTATFFGIQNLLIENRGVHDVFNIAGAGSATAAAFGLILPGSPMWRARNVLVGSALGAGICFPLGWVQLKLAEKANLEIENSKSPSDLQGNQSRVGAAIDRLENSLRK

SEQ ID NO: 132236 - protein, 452 aa, Triticum aestivum
  unsure (1)..(452): unsure at all Xaa locations
  Clone ID: PAT_TA_26654.pep
GLYFLFVKSETKTPSGLTARPVLTSYYKSEQFKNRPYDPYHNYTSPTAAILCADAFQSMYAQMVCGLCQRHEVLRVGAVFPSGLLRAIRFLQXLNWKELAADIEAGALTPRVTDASVREAVAGLPGPLPPRAGGGRGPXGNDDWAGIVRRIWPNTTYLDVIVTGAMAQYIGTLKYYSGDLPMACTMYASSECYFGLNLRPLCDPSEVSYTIMPNMGYFEFLPVDSATGAASCVDAGNLVDLARVEAGREYELVITTYAGLNRYRVGDVLRVTGFHNAAPQFQFVRRKNVLLSIESHKTDEAELQRAVERASALLRPHGASVAEYTSQACTKSIPGHYVIYWELLTTGAGAATAVDKGTLDACCLEMEEALNTVYRQSRVADGSIGPLEIRVVRGGTFEELMDYAISRGASINQYKAPRCVTFPPIIELLDSRVVSSHFSPALPHWTPARRSD

SEQ ID NO: 132237 - protein, 122 aa, Triticum aestivum
  Clone ID: PAT_TA_26655.pep
HATMRSLQAVLVAVLVLLAVAATTDAAWAPIPDRDLNGMVVQQAGRFAVLVHDITHRTTLVFVKVERGEMERPVGGGNGTNYRLVVTAARAPGGNKGQYECVVWGVPGSRTSTWKLLSFKAL

SEQ ID NO: 132238 - protein, 100 aa, Triticum aestivum
  unsure (1)..(100): unsure at all Xaa locations
  Clone ID: PAT_TA_26656.pep
MAETEYRCFVGGLAWATDDHNLQQAFSXYGEILDAKIISDRETGRSRGFGFVTFGSEESMRQALAEMNGKELVGRFFAVCEALSRRSGGGGGGGGFGGLR

SEQ ID NO: 132239 - protein, 52 aa, Triticum aestivum
  Clone ID: PAT_TA_26657.pep
DAILCFVTLMHVTVRDYKLYMREFFSIGCRTVNLFMWTAIPHIFMFSIMLAI

SEQ ID NO: 132240 - protein, 450 aa, Triticum aestivum
  unsure (1)..(450): unsure at all Xaa locations
  Clone ID: PAT_TA_26658.pep
MARAALLRSLPPRRVRPFSSPAAAPSPLTGGGSSAPRAAQGREPGGAVGFRTEQVPEFSPESPMLRAAAEAALRRVSPAPAGPVHAQFRRGPVLRVAWLPLYRRLSKLPPAAPLGCVAAELDRWLRERQPLCEHQLLFYVRKLRNFRQHRRALELIDWMEARGAYLLPGDHALRLDLVCKVNGLEAAEEYFLSLPDMHKSVKTYSSLLNCYAEHKPEKGLELYEKMRTMNIVPNTLVYKNLMSLYLKAGQPEKVLKTFEEMRGNGIRTDNFTYCILTEGHIMLNGPESTEKFLEDXEKSIPVHWSMYTVLANNYNKVGQFDKAELALKKAEEVMDKGEMFAWHNLLSLYASSGNLSEVKRLWVSLKLALRICSNRSYLVMLSSLKKLDDFDSMQQVFREWELTQQSFDMRIPNVMIQAYLAKDMTDEAEALRQAAMAQGRSNPVTFYIFA

SEQ ID NO: 132241 - protein, 167 aa, Triticum aestivum
  Clone ID: PAT_TA_26659.pep
EGLDNYFSILNVLILVYGGSTYFHAGATIHLFCHITLLLSVLVCSAITSCTKMSIPSQDTWAHDDDVHGGESDGTNESTHSKLRLRLDRQPRSAAGDHKLNQGKQKASQGSKLTGGQRPVVQHGTGGRHDELAGDAHLLRPSSCGEGGRQFELPADAHLVVITHGGE

SEQ ID NO: 132242 - protein, 182 aa, Triticum aestivum
  Clone ID: PAT_TA_26660.pep
SRPSVGSAFLRTNVLGGLRLVAGESRVWGSPTRATTSRATPVKPVQVGTATAAPTSSGPDKPVSGGTATTHPVGHVPTMMLATSEPVREARHSQVGHTPTTRFSGFCKPVWPTRHSSTSLNLEAMKRRSWGGKASTETTATIESVQEAQHSLVGYAATPTRSGSIESVRDARDSVVGHDPAT

SEQ ID NO: 132243 - protein, 290 aa, Triticum aestivum
  unsure (1)..(290): unsure at all Xaa locations
  Clone ID: PAT_TA_26661.pep
MGAIPEQDEKVASLDTAVLASSSIQGNEPIYQGEEHVLGSGNMAFQTEEPVYEGEVVLAEQADKIAESSQCLENGAADHQWDLIDNFLQSTANQLTVYGLFCLQEGLKERELWVFFRNNHFNTMFKYNSMLKHFASESRFVTDQLFFSQTDLVWQKLDEVNGDXVFVTSNFTPFTAESPRNDSWNQQQAMTTTADYIAQFDNSTLPNSSGDSDLELAIALQQQEFGQQPQRQEPPPQQQQPQQQQQQQTQTHQTPNQSSGRPGLVVGPRQRSNVPPPARTESKKEKCIVM

SEQ ID NO: 132244 - protein, 313 aa, Triticum aestivum
  Clone ID: PAT_TA_26662.pep
MAESFVLNTGARIPSVGLGTATGKAEPGVVREAVYAAVKAGYRHIDCAPAYRNEKEIGLALKKLFDEGVVKREDLFITSKLWSGNQAPEDVPEGIDTTLQDLQLDYLDLFLIHAPLRSKKGAIPTPENFLPVDIPATWGAMEKLYASGRARAIGVSNFSCKRMEDLLAIASVPPAVNQVECHPGWQQMKLRELCQSKGVHLSAYSPLGKHGSPGSMGPSFLSNPIVISVAEKLNKTPAQVALRWGLQMGQSVLPKSTNETRIKENLSIFDWSIPEDLMANFSEIQQVKVLRAEFVVHPQGIFKTVEDFWDGEI

SEQ ID NO: 132245 - protein, 168 aa, Triticum aestivum
  Clone ID: PAT_TA_26663.pep
MDPAEGRRILVAVDEGDESVHALRWCLTNFATRGDGELAPPDTILLLYVRPTPPTYSVLDASGYLFVNEATAAIDGYSRAVADAVVDKAQKLCALHSKENGEVKVKVDVKVAVGDARSVICDMVDKLGADVLVMGSHGYGFFKRALLGSVSDYCVRNANCPVLIVKLK

SEQ ID NO: 132246 - protein, 183 aa, Triticum aestivum
  Clone ID: PAT_TA_26664.pep
FPAHYCRWPAAAACHCYGWVGSRSESGFANQPLAGSVPADPVVLGSPEPAEHQVGDAIPMEAVVASQSPCYSPHIRSAYNGVRISTVERASKQKATSVSSSSSGSSRRFGPSSSRGEKANAAAVAGLLELLLLETPTPMTRGKLKQIAHRCDLNTTTILDQAWVLANGAVSDGAVASPPVNGS

SEQ ID NO: 132247 - protein, 179 aa, Triticum aestivum
  Clone ID: PAT_TA_26665.pep
MPPQYVAERPDFLYIPSVTDHSLQVLALGCPMLQSVELTFHEGTFYLPDIGLTLECVRILIQSCQIRVLVLNGADFFDDEGMMVLSSSPFLETLELAVNDQVTDAGMHSIARTPCLRSLTLRLCSQVTDAGLTELVHSQKLDSLTIEGCACISPQVAQGAARSVHYSLESASRSRLSRI

SEQ ID NO: 132248 - protein, 102 aa, Triticum aestivum
  Clone ID: PAT_TA_26666.pep
GPRAGGRVFPFLDPSASPVGAAFLFFPSPARGGGVYSSSSSSSWEECVLESSDEGSDTSRWQALFRVPVAIFLTFFSGTTWGAETSSFAKRASAGPSGKGAG

SEQ ID NO: 132249 - protein, 354 aa, Triticum aestivum
  unsure (1)..(354): unsure at all Xaa locations
  Clone ID: PAT_TA_26667.pep
LLSCVAWLGTAMLLLTVYYFKRPRPVYLVEFACYKPEDQNKITKEAFLDMTESTGCFNDGPLAFQTKITTRSALGDETYLPPGVQARPPRLNMAEARLEAEAVMFGCLDALFESTGIDPRRDVRILIVNXCSLFNPTPSLASMIIHHYKMREDVKXFNLGGMGCSAGLIAIDLAKDMLQXNPNAYAVVLSTENITLNWYFGNDRSMLLSNCIFXMGGAXXLXSNRRADAGRAKYRXLXTVRTHKGATDELLXVRVPREDDVTXVGXXLXXWXLXXVARRETLTAWPLGPLNRSKLKVVELGLFPRVMAVLPFFSGRKLKANFFLDLASSAMKVKDIPEPGEIGLYTSGPYFANP

SEQ ID NO: 132250 - protein, 69 aa, Triticum aestivum
  Clone ID: PAT_TA_26668.pep
MRPPKEVAVAPTEQFAGDPYYGMDDGMDFGMQGYLDMAQGMLIAPPPMAGPSATVGDGDDDGEVSLWSY

SEQ ID NO: 132251 - protein, 102 aa, Triticum aestivum
  Clone ID: PAT_TA_26669.pep
MGGWAPFGRRGPLGGLFSHPRLGEKKGGGLSGAGVKKVGAEGPRGDAPKRRNELGKRPGPAQSGRTSPPAQGTEIRGTQGRTGDPPPGGAARGGKGPGGRAP

SEQ ID NO: 132252 - protein, 92 aa, Triticum aestivum
  Clone ID: PAT_TA_26670.pep
WGIHQSSSAVLPKASTRRQMMKRAMCLKGGCYGNAVIIFSLTEAGKTMLNSMGSPQVVLPLSLRFFCIYGVYIAFVSSCRLNSMISPQVVTE

SEQ ID NO: 132253 - protein, 189 aa, Triticum aestivum
  Clone ID: PAT_TA_26671.pep
SARGALAGPGNSSPTAVPPNAPSAGNGNKGETPLADALRYQIEVQRKLHEQLEVQKKLQMRIEAQGKYLQTILEKAQKNLSYEAGGDATLETTRSQLTDFNLALSGFMDDATQACQQNGGELAKALSDDGLRAGNLGFQLYHGGEDVKCATDEDLLLLDLNIKGGYDHRLSAHGMPRGAVDLAVGQHRR

SEQ ID NO: 132254 - protein, 115 aa, Triticum aestivum
  Clone ID: PAT_TA_26672.pep
GSELQSTMNLTRHSKFNYVDPKIQTKSSIQTSCSSTLQSCTKSIESNRDLHFGLPVHPPVSLHQTKSSFAPMPLNLSIVKAGDLLDLLGLPNPFRSTVHQTTITCYLNIVSNLAC

SEQ ID NO: 132255 - protein, 68 aa, Triticum aestivum
  Clone ID: PAT_TA_26673.pep
RDERLTLKDEQGVESETLYLALKNGLSAGWRGFAIQHNLVDGDCLVFELINRTTFKVYIIRQSSYYER

SEQ ID NO: 132256 - protein, 110 aa, Triticum aestivum
  Clone ID: PAT_TA_26674.pep
DRSLLLIEQTYQYMYNLAIAGLRSTIPHQNLQQHPSGPSKLPYVMYSRTKESVKPKLERRRMGSRGEEHDDASADDVEPGLVLPQHLAQPPSYILLIPCACCHGSSPCPS

SEQ ID NO: 132257 - protein, 174 aa, Triticum aestivum
  unsure (1)..(174): unsure at all Xaa locations
  Clone ID: PAT_TA_26675.pep
AKDGRSGEGRGDSTRVMGTQGYAAPEYLATGHLTXTKSDVYTYGVVLLELLTGRRALDKNRPAGQRNLVEWARPYINSKRRVIHVLDPRLGSQYSVPAGQTAAAHAMQWLAMDARCRPGVDQVVAALEKLQEGEGTWKQGASLASLWPPLPLGSNAYGSKAREELADMGQRSRT

SEQ ID NO: 132258 - protein, 174 aa, Triticum aestivum
  Clone ID: PAT_TA_26676.pep
PSVRPASGGGRTHREATKKIPTRVTFSSSTPGPHPSPSLPPWSSGALHSVLPAGGGSGKRRKATRFMAKSGARKDTAQVRPSATSPPLQHSPGATASSFASRSPQLLFYPGAPTRSSASPSTPPHLYPPLMESSSANPTWRPMYTSAPEGLLSFGQLPPMNPYNFQPQPMATHQ

SEQ ID NO: 132259 - protein, 79 aa, Triticum aestivum
  Clone ID: PAT_TA_26677.pep
PRVRSAPTKVDSKKKKRKVKSVDADESGARTAHRLPYTPEEHERLAGAWLECSLNPIDGNKKKSEQFWDDIAALYSSSR

SEQ ID NO: 132260 - protein, 159 aa, Triticum aestivum
  unsure (1)..(159): unsure at all Xaa locations
  Clone ID: PAT_TA_26678.pep
MGWKAAEKLIRHWKILRGDNVMIIRGKDKGESGLIKRVIRSQNRVIVEGKNLVKKHIKQGEGQTGGIFSMEAPLHVSNVQVIDPVTGKPCKTTYKYLPDGTKVRVSRXNECVWCVIPRPEILKERKKPRPTSHGPKDTPIEHVLEKTYDAKAGIGMPDL

SEQ ID NO: 132261 - protein, 142 aa, Triticum aestivum
  Clone ID: PAT_TA_26679.pep
MAAATAPATATKLAADEYTAELAGVPVGAPTGAPAGVAETADGVIAEGASVVGAGGDAIGDGDAAVGGVATGAGAVAGDLAGGAGRGAVLGAGMGPCAAAATARRARRAATTAKRAIWLRSTVKDLPEKIRRGDGGRWRANA

SEQ ID NO: 132262 - protein, 122 aa, Triticum aestivum
  Clone ID: PAT_TA_26680.pep
MAAATAPATATKLAADEYTAEFAGVPVGAPLGAPEGVAETADGVIAEGASVGASVGGAGGEAIGDGDAAVGGVASGAGALVGDLAGGAGSGAILGAGMGPCAAAATARRAMMAAATARRAIW

SEQ ID NO: 132263 - protein, 147 aa, Triticum aestivum
  Clone ID: PAT_TA_26681.pep
MAAATAPATATKLAADEYTAELAGVPVGAPMGAPEGVAETADGVIAEGASVGASVVGAGGDAIGDGDAAVGGVATGAGAVPGDLAGGAGSGAILGAGMGPCAAAATARRAMIAATTAKRAIWLLRRFREETVASECLAGETMVSCEL

SEQ ID NO: 132264 - protein, 149 aa, Triticum aestivum
  unsure (1)..(149): unsure at all Xaa locations
  Clone ID: PAT_TA_26682.pep
MAAATAPATATKLAADEXTAELAGVPVGAPMGAPVGVAETADGVIAEGASVVGAGGDAIGDGDAAVGGVATGAGAVAGDLAGGAGSGAILGAGMGPCAAAATARRARMAATTAKRAIRFLSTVKALPETWRGEGATASECFGSARSSSA

SEQ ID NO: 132265 - protein, 209 aa, Triticum aestivum
  unsure (1)..(209): unsure at all Xaa locations
  Clone ID: PAT_TA_26683.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMKCRXSWKSGNARKSQPKLHQAAVPVRLAGH

SEQ ID NO: 132266 - protein, 232 aa, Triticum aestivum
  unsure (1)..(232): unsure at all Xaa locations
  Clone ID: PAT_TA_26684.pep
PPSAVRRALHEDLGIGKTSSSTHDYRSSSGGGSVVLDDCNFHESVQLDSFDIDRTLHLIPPDGEFPVMNYRLTQEFKPPFRVTALIEEAGPSRAEVLLKIRADFPANVTANTITVQMPVPSYTMRASFELEAGAVGQTTDFKEGTRRLEWNLKNIVGGSEHTLRAKLTFSQETHXGNLTKEAGPVNMNFTIPMYNASKLQVRYLQIAKKSKTYNPYRWVRYVTQANSYVARL

SEQ ID NO: 132267 - protein, 282 aa, Triticum aestivum
  Clone ID: PAT_TA_26685.pep
TGGPLLASFPQFSLAEGFRQINTMDAAAAADAAAAAAAAADPTLDFDPDELRAAYESTSPYIAGFFPSYPGVIVMSTNRHDVVAVHSELISDDPEYLPKIVRNYSNNTEACVDAVAKLPADVTVLFAKRKGERLPDIGFSNLDPQEGVSEKVVTFFPYMDTVAMFKGHIGLRNATSRDVRAPEQEVQPSSINTFTFTAPYASVSFRKDGNEHDPDLLETRLMTLGAPVFNLNGQIVGILSDVGIDCSLKFARKAVYLGEVRSQLRGEQVNWLKGEEKVKRGL

SEQ ID NO: 132268 - protein, 87 aa, Triticum aestivum
  Clone ID: PAT_TA_26686.pep
VQEVNPVSSFCCDVRASTDVARQIFLGHVITVITFPNNNKRRHWTWYSSRASPTCPSSTSTSNSCSQISAEAYIMSTTMIHFKAKKN

SEQ ID NO: 132269 - protein, 198 aa, Triticum aestivum
  unsure (1)..(198): unsure at all Xaa locations
  Clone ID: PAT_TA_26687.pep
ARGATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGXDYXGNPSLVHAQSIXAIWACQVVXMGAXEGYXXXGXPXXXIXDPXXPXXXXXPXX

SEQ ID NO: 132270 - protein, 90 aa, Triticum aestivum
  Clone ID: PAT_TA_26688.pep
FGTRAPWVAEDLVKDFEAGLEYGVAEAVVDRRQAADGDGDGRWEYLVKWVDTEEATWEPAENVDAELVQEFERQQAGNGGAAPPAETFAG

SEQ ID NO: 132271 - protein, 201 aa, Triticum aestivum
  unsure (1)..(201): unsure at all Xaa locations
  Clone ID: PAT_TA_26689.pep
PTSPIYTSRKFTLSHTRWRLCVEMLIAAHGHLFAFPYKPSAGANARPSGCFTESLLHALKFKDLCLDLSRQETTFLKTVPCPDLVIIGPILMLYVPTYNEYVLYNHNEGXSAPTKFPSGSAVPSVRDVXELAGITVMPPSNNSPVTSSVSSNHVDQDESMTTPIRNKVDPPGGMYDLTDLLDVDLSSYPAKVPAISDVRKQ

SEQ ID NO: 132272 - protein, 210 aa, Triticum aestivum
  Clone ID: PAT_TA_26690.pep
MIRASHITVIMNSKDSPSPLKGTHPYTYGHNFFMSMSGIDLSANMLSGEIPMEMGNLSHIKSLNLSNNFFTGSIPATFANLTEIESLDLSENRLSGSVPWQLTRLSSLEVFSVAYNNLSGCLPASGQFSTFGMDSYKGNNNLRSCTSSSGPMAANGVAGSVADDSDPILYVVSAVSFILAFWATVAFVFCHALGRRVVPELAAVKRRRAR

SEQ ID NO: 132273 - protein, 341 aa, Triticum aestivum
  unsure (1)..(341): unsure at all Xaa locations
  Clone ID: PAT_TA_26691.pep
ALLVSPVAAQPAALPSPSSVSRTPRPHHQQNRLGLPHLSPAPASSSVHLRHPPRRCIRRRGARFLAAASTSKVAAPADAPGGSADAFEVIRAHHXKAARLPPVEEIRTVLDQSVRGVLATHSQEHVGYPSGSMVDFACDQDGSPILAVSSLAVHPKDSAGGTKCSLLVAISAVDRTDSVITVXGDATPVPDEEKHPVTTAYLRRHPEAFWVDFGDFRFLHIKPKAVRYVSGVATAILGSGEFSAAEFKEAKVDPISQFSTPIAGHMNKDHADDTKLIVQHSTSVKVDFASILDVDSLGINVKAGYDGTVLKLRIPFPRRAQDRKDVKTLIVEMLQAAKASS

SEQ ID NO: 132274 - protein, 693 aa, Triticum aestivum
  unsure (1)..(693): unsure at all Xaa locations
  Clone ID: PAT_TA_26692.pep
MSSPRLLLKGYPEPRSILRTRIPAYHYAPAAQRFSPAPPLLARPLWAADRGRAWARSLRGRRGFGRAGVPRRHARRMHSEDLESAFDMAGLADTHFEYSPEARAQADLKFTYVVTCQIYRVQNGEGKPEAADIALLMQRNEALRIAYIDVVESVKNGKPSTEYYSKLVKADIHGKDKEIYSVKLPGNPKLGEGKPENQNHAVIFTRGNAVQTIDMNQDNYFEEALKMRNLLEEFSQNHGKFRPSILGVREHVFTGSVSSLASFMSNQETSFVTLGQRVLSNPLKVRMHYGHPDVFDRIFHITRGGISKASRIINISEDIFAGFNSTLRQGNITHHEYIQVGKGRDVGLNQIALFEGKVAGGNGEQVLSRDIYRLGQLFDFFRMLSFYVTTVGFYFCTMLTVLTVYIFLYGKTYLALSGVGESIQNRADIQGNKALSVALNTQFLFQIGVFTAIPMILGFILEEGVLTAFVSFITMQFQLCSVFFTFSLGTRTHYFGRTILHGGAKYRATGRGFVVRHIKFAENYRLYSRSHFVKGLEVALLLVIFLAYGFNNSGAIGYILLSISSWFMALSWLFAPYVFNPSGFEWQKVVEDFRDWTNWLFYRGGIGVKGEESWEAWWDEELAHIHTFRGRILETILSLRFFIFQYGVVYHMHASQXSTALSVYWVSWAVLGGLFVLLMVFSLNPKAMVHFQL

SEQ ID NO: 132275 - protein, 72 aa, Triticum aestivum
  Clone ID: PAT_TA_26693.pep
NSSKIIAIAIPSLQMVVVACLCSEECHNSPGLLQGNQNLLKILQNAKRKCHIKPFIAPGNTRGEGRGGRTAS

SEQ ID NO: 132276 - protein, 144 aa, Triticum aestivum
  Clone ID: PAT_TA_26694.pep
LLPLMNADRNVFSCLRFLVPLPGRLRIPRQPPRRGHRHARDPDAYDPVTTGGRHPTSGEFPADAATAAGRRQTHPICMTGDARVAGVIRPGSLCRPSHCCHRTHKCHWPPVCRCFAKSRQRRAAGAPLAAPPTSSPTSLGSIRS

SEQ ID NO: 132277 - protein, 150 aa, Triticum aestivum
  Clone ID: PAT_TA_26695.pep
DNFRASLVGVARPLPSAPAALPLACCPAAVARPPRPPSAPGLHPPCSFHADSPRRSPPAACAPPPLASPPASFATPAAAAPPAAAAAARGLALGAGRALPAIGLPLPGLPLPGLFACSVVVLLPVVRLPPCRPLPPPPYPPPGCHPPFPI

SEQ ID NO: 132278 - protein, 112 aa, Triticum aestivum
  Clone ID: PAT_TA_26696.pep
ESIPPASAAVSLLSPCCRYRTRPGRYHPSSSVDNAGCSGLNLHLRCRCSSPRSSVGGGGARCSGLNLRRRRRRRVSSIPLLMLPLSFSLLSCTGGEEDALGFMASSLGPSGG

SEQ ID NO: 132279 - protein, 171 aa, Triticum aestivum
  Clone ID: PAT_TA_26697.pep
GKVVGLVNNQIDETFVPSSILHKCFDFWRRFNCMPRLHLGMTFSPIKFLDPICIERMTRKHNIDSGLIVEQVSKESHAEKIGIRKGDVIESFNGKHISTTIELESMLIDLCWDHFDQRKKLNTEKDVSVKIFDATKLCPRIRNLTAIVSDRGEDIVKGAYPIMGEEAMSVL

SEQ ID NO: 132280 - protein, 198 aa, Triticum aestivum
  Clone ID: PAT_TA_26698.pep
RVHRSPSRLPPSPAEAAAHEVGKMSRAVRVRGDELETERGARAKKRSLAVDRSTSPRSPGDLAVRSSHSHPEILFAIFEPDEAQSGAKQGRVCDVVESATEESSDPPSSPIYEPYIPDELAADPVVRSAFKHAMAKYEAEEDRLADLFTMDHYTTGTNHLPACARTVVSFPSVNSQEMQYFLLQNPSSCSRPFSTTNR

SEQ ID NO: 132281 - protein, 136 aa, Triticum aestivum
  Clone ID: PAT_TA_26699.pep
EFGTRPSIFLVSPSTMRLNSAATSPRMSAHGLPRGTEGATKRRQSGFIETERVSPWPDEGGRQMAGWIGCPRPMLSASSCCSPSPSPSSSPSATPPSPCPDRGKKPRREADRRQPRSTTSSPSHQGRGSRLCVPHL

SEQ ID NO: 132282 - protein, 131 aa, Triticum aestivum
  Clone ID: PAT_TA_26700.pep
INWVHDPPKYDEGFAVLGNGYRAWAPILVQLHTSTNVPLGSLCVRSCLQSLISLLGISKVRLHTSARRGRQIWKSPTREADLDVSSKEGGHERQRQGALDGEVGTSRFGGRRQTKTSKADMGGVASVGRWR

SEQ ID NO: 132283 - protein, 286 aa, Triticum aestivum
  Clone ID: PAT_TA_26701.pep
MATASSFAAVFISSAIASCFAEVCTIPLDTAKVRLQLQKKTAAGPAATVGMLGTMMSIAREEGVSALWKGIIPGFHRQCLYGGLRVGLYEPVKALFVFVGDATLMNKILAALTTGVIAIAVANPTDLVKVRLQADGKSTAVKRHYSGALNAYATIVRQEGIGALWTGLGPNMARNALINAAELASYDQFKQMFLGLPGFTDNVYTHLLAGLGAGIFAVCIGSPVDVVKSRMMGDSTYRSTFDCFAKTLKNDGLAAFYKGFIANFCRVGSWNVIMFLTLEQVRRFFQ

SEQ ID NO: 132284 - protein, 181 aa, Triticum aestivum
  Clone ID: PAT_TA_26702.pep
AGGVASLVSPCPVTPAVLPTPRLSPAREVLVEMAKEAWGVDGYGSMKGLIRLRPQAAGPDAGDGDGADSGSGESDVEEHVEVERRLDHDLSRFEMVQLPAAPAGEDDEDEDARAARLEEENLTLRARLFLVERDMADLRRRLVAVESLCRDRHRDGCVVDAALPPPSNSDEADATEDAMVL

SEQ ID NO: 132285 - protein, 119 aa, Triticum aestivum
  Clone ID: PAT_TA_26703.pep
TRVSVPPIYTRLSRPVSSSPNPSLSPSPHSASCCPHPPHHRLEPELERWWALSHIRTAAMMSFKNHHEGFAGQQLLAAAAAAASQVSGGAPLPWWVGSQLLYGEPMGHGKAPPAVPMSM

SEQ ID NO: 132286 - protein, 140 aa, Triticum aestivum
  unsure (1)..(140): unsure at all Xaa locations
  Clone ID: PAT_TA_26704.pep
MPPHKIETGHQDVVHDIAMDYYGKRLATASSDNTIKIIGVSGSSQQQLATLSGHQGPVWQVAWAHPKYGSMLASCSYDGRVIIWKEGGKPDEWTQAHTFTEHKSSVNSIAWAPHELGICLACGSSDGNIXSVSTARSDXW

SEQ ID NO: 132287 - protein, 304 aa, Triticum aestivum
  unsure (1)..(304): unsure at all Xaa locations
  Clone ID: PAT_TA_26705.pep
MPPHKIETGHQDVVHDIAMDYYGKRIATASSDNTIKIIGVSGTSHQQLATLSGHEQIAWAHPKYGSMLASCSYDGRVIIWKEGSKPDEWAQAHTFNEHKSSVNSIAWAPHELGLCLACGSSDENISVFMARSDGXWETRSPARIDQAHPVGVTSVSWAPAMAPGALISPGPSGQFEYVQKLASGGCDNTVKVWKLTNGSWRMDCFPALQMHRDWVRDVAWAPNLGLPKSTIASASQDGTVVIWTAPKEGEQWEGRVLNDFRTPVWRVSWSLTGNILAVSDGNNNVTLWKEAVDGEWQQVTTVEP

SEQ ID NO: 132288 - protein, 163 aa, Triticum aestivum
  Clone ID: PAT_TA_26706.pep
MDAPFFHELRRQASSYLTGKIRSARLVLTDVTPTQLMTEEATNGDASLPNAKTMSLIAREAFEIDEYLRISDILHTRLATFDRRQWREPYKALLPLEHLLTHGPRSVALEFQKDREVIRQMATFQHIDERGFNWGLTVKGKSERVLKLLERGPFLEEERERAP

SEQ ID NO: 132289 - protein, 141 aa, Triticum aestivum
  Clone ID: PAT_TA_26707.pep
AGRGAHEGGAEGSAGAGSGARGHGVRDSGKRNGAELVEEFNTLTGAHFTYINAYGIFQDIIRSPGANGLTELTKGCCGVGRNNGQVTCLPFQTPCANRNEYLFWDAFHPTEAANILVGRRAYSAAQPSDVHPVDLQTLARL

SEQ ID NO: 132290 - protein, 85 aa, Triticum aestivum
  unsure (1)..(85): unsure at all Xaa locations
  Clone ID: PAT_TA_26708.pep
PSSSYGAILGFWFTACPFTFSSGDLSTHHSTALGYISLAAYISSNALRHAKCTPYEHLSLLGQAESDRTLVAGNXWRLFTEGGGE

SEQ ID NO: 132291 - protein, 389 aa, Triticum aestivum
  unsure (1)..(389): unsure at all Xaa locations
  Clone ID: PAT_TA_26709.pep
PGGCPSGDNCEFSHGVFESWLHPTQYRTRLCKEGAACARRICFFAHDEDELRHVPHNSGAGLLXPRATSSIHMTAAAALGLLPGSPRHFVPPPGSPSAVNNGGAASAHWLQGSRLRSSFNAGDATVEDLGLLLDWESQYLGALCLPPSSRPQPRLSTGLSIRPTAIAPTSLEDMYASEMAMSPRFTNDQGHSAYSPAHKSAILNKLHQQKGLLSPVNTNRMYSPRALDPAALVHSPIGGMSPRSPRLMEPTSPMSARFGATVPQREMYEQFSSLNKHQLPSVGSXPRNSNAASWGNVGSSPMGKXVDWGVEXEELVRLRMPXIQPGFPEKGPDAPWGRSLXSNRGEMPLALPGGGPAGAANPPGWTNQADLLDQMAIGAWLEQLQTDQK

SEQ ID NO: 132292 - protein, 75 aa, Triticum aestivum
  Clone ID: PAT_TA_26710.pep
LQCEVSSPNGEVQRLLPTVKSNNMSADPAFPDPMKPMSAVPSEDINSQAVTSVTSVRAITKRIKIVSPVKGRSAS

SEQ ID NO: 132293 - protein, 77 aa, Triticum aestivum
  Clone ID: PAT_TA_26711.pep
NVHESPVAFRPTRAAGPPSARVAVQISNRHPPYGTAPQCRPALNMPWIRQADASGRSSRMLSCLHSSPGALHLLHNF

SEQ ID NO: 132294 - protein, 207 aa, Triticum aestivum
  Clone ID: PAT_TA_26712.pep
MAKQNADSQEGHNKSAQELPPGWAETKDPTTGASYFYNQSTGVTQWDRPGGTVNTVQHQAAPSLPENWEEALDKSTGQKYYYNTKTQATQWEPPTSVNPVIVPQAPTLVAVQPTTQNTDLWNPHIQRCSGCGGWGVGLVQPWGYCNHCTRVQNLPFQQYPSYSNNIVPSSVANAPKSQGNIAAKDRSSSKPLQEKKKKKKKKSTRPR

SEQ ID NO: 132295 - protein, 113 aa, Triticum aestivum
  Clone ID: PAT_TA_26713.pep
DEGPEGRKGGATPPPTRWEGAAGPQPRILPTTLPRPPPAEAQPRSHQTPEPQRRATRGPDSPTVSPRKAPDPCRRRPARPSRAPARPLGPPHAPTHAFPNAAAHASASASCRI

SEQ ID NO: 132296 - protein, 156 aa, Triticum aestivum
  unsure (1)..(156): unsure at all Xaa locations
  Clone ID: PAT_TA_26714.pep
NSARVCPLFLISSSPDLSGGGGDARIRQRFHPSAHLFLPPLHHHPHIAADFPCGGGPVAPMPLASCRRRHFLFVPKRPVRPPLTSLLWCHRPQPIRSFLFPAPMVADLSGTRSLRSWWFGMRRAASAPLSSGGWLVPQSLLXIYGGNDIRKLSLSL

SEQ ID NO: 132297 - protein, 147 aa, Triticum aestivum
  Clone ID: PAT_TA_26715.pep
SAQNVTMILYEVLRLYPPATVFTRKTYKKIEIGGITYPAGVMFEMPVLYIHHDTDIWGEDVHQFNPDRFAKGISKASKDPGAFFPFGWGPRICIGQNFALLEAKMALCMILQRFEFELAPSYTHTPHSVMMLRPMHGAPIRLHTISS

SEQ ID NO: 132298 - protein, 139 aa, Triticum aestivum
  Clone ID: PAT_TA_26716.pep
MQHYKDATLASAELPVACVSSVADQVDSRNSAHANEGVPRHFDLLTRGLREIPVPLWDGIDMSDRKATEFQYPRRTDSIGYVLDEWDEGYDRGKRKKVRKPREEPNGPNPFQEAADVRARPRKRPRCDQARWGNQPRRI

SEQ ID NO: 132299 - protein, 103 aa, Triticum aestivum
  unsure (1)..(103): unsure at all Xaa locations
  Clone ID: PAT_TA_26717.pep
ADGNPARIPVVMPLSAALAACSQLLVXRYGEKSDGLVTRKDAEVPGSVAVRPERKLDHAWMVYSSMNEEPGDQANTSQVCEAXLTLLVEVXQRRRHQTAMKDE

SEQ ID NO: 132300 - protein, 191 aa, Triticum aestivum
  Clone ID: PAT_TA_26718.pep
VQLISEIDEGYIVGVKCVWDLLRHRFMLEENAQLSELSPEQPTINCFAYRYYLSNIWANDNSTRDALGVKHGTIGEFKRCRKSMPYSFDLLSSIEYHFNLTIRGYRALVFSGDHDLVIPFLGTHAWIRSFNFSIVDDWRAWHLGGQAGGFTITYANHLTFATLKGGGHSAIEYRPRESLAMAQRWLDNKPL

SEQ ID NO: 132301 - protein, 248 aa, Triticum aestivum
  unsure (1)..(248): unsure at all Xaa locations
  Clone ID: PAT_TA_26719.pep
MAEEEGTQQLPFVRETVLKKRKDNEEWPTKNRERKAATGQRRCRHAKDASKRREDFVKAVSNREPDCRRARTPLKVRYLRPRASTESYPPFAAPIPGTADFPPHSRNISARLLLTQLLTGVLITATADIHKRLAAVGPFVTYGLPNMKVVKELIXKKRRGYVDEEPFPPTSNHLIKNVLGEHVVIWVEDVVDKISMVGPHLRATASFLMPFKLKCPERRLRMKKKPFKDGGDSGNRGDKINELLEKLN

SEQ ID NO: 132302 - protein, 170 aa, Triticum aestivum
  unsure (1)..(170): unsure at all Xaa locations
  Clone ID: PAT_TA_26720.pep
GTSAHWTAAKRIMRYVRNTXVGLTFSKSSSTLVSAFSDSDWACCLDDRRSTGGFAVFFGPNLISWCAKKQATVSRSSIEAEYKALANATAEIIWVKSMLKELGIFHTQISCLWCDNLGATYLSVNPVFHARTKHIEIDYHFVRERVANKELEIRFVHSKDQVADGFTKAL

SEQ ID NO: 132303 - protein, 113 aa, Triticum aestivum
  unsure (1)..(113): unsure at all Xaa locations
  Clone ID: PAT_TA_26721.pep
DFSPXWWDLITTTAWFRDHWSREHAHLDEIAEQLELVALLAYDEDEDLFYGEQAPAAAAALKTDSVLKALNLGSPKSGDAPRGFREKPRHSEKPTKYAGSPKSSAPRVIHQPR

SEQ ID NO: 132304 - protein, 190 aa, Triticum aestivum
  Clone ID: PAT_TA_26722.pep
MDAMRKQLDVLMGANRNGDVREVNRKYFDRDVCRLFLAGLCPHDLFQLTKMDLGPCPKVHSLQLRKDYEEVKAKGTENFDRELEDMIDRLIVECERKIQRALKRLADEDAKAAIAISVSEVTQSEEVAQLSKEIKEKMKEADIFDFEGKTDDKIKTMELVEELRSKRADLQATLLLDAFNKDRAAIPQPI

SEQ ID NO: 132305 - protein, 254 aa, Triticum aestivum
  Clone ID: PAT_TA_26723.pep
DEELRIKRADLQATLLLDAFNKDRAAIPQPIPPPQMATLPAPPPPDARTQELINEKLSKAEALGEQGMVEEAQKALEEAEALKKLAAARQEPVADPSKYSVADVRITDQKLRLCDICGAFLSVYDNDRRLADHFGGKLHLGYMLIREKLKELQEERTKKRTEKPEDDRRSRENSRDRNGRASRDRDAERKDRVEPRDSRRDHDRDRDRRHDRDRRHDRDRDRDHDRSSRGREHDRDRRRERSRSRDRSRRHERY

SEQ ID NO: 132306 - protein, 70 aa, Triticum aestivum
  Clone ID: PAT_TA_26724.pep
TFRHQEHLFFQDSLLRKSMSELGANKLTDHRHETPDSIQQVTSLFLLTILHSRSLGQTCHLEKQAPNSTW

SEQ ID NO: 132307 - protein, 53 aa, Triticum aestivum
  Clone ID: PAT_TA_26725.pep
NAKKIAKLIKCNITWIQPLKIQCIGVIVSRKNHYLGQRVKGQFIVTLPSYSAS

SEQ ID NO: 132308 - protein, 67 aa, Triticum aestivum
  Clone ID: PAT_TA_26726.pep
QPSTPAKPKELSKEVARRISSEARTMATISSCSRLCGGGSSTAFHRRRSRPARAAVVTCRRFSAVVR

SEQ ID NO: 132309 - protein, 312 aa, Triticum aestivum
  unsure (1)..(312): unsure at all Xaa locations
  Clone ID: PAT_TA_26727.pep
GVCYGIIANNLPPPREVVQLYKSMGITNMRIYSVQLQALDALRGSGISLMLGTTNNDVAALAGSLSAATSWVQAHVKPYHSAGVTIRYIAVGNEVTGGTAQPILAAMRNLNKALAAAGLGGAIKVSRRVRXFDVLTNSYPPSXXVFAQPYMVDIARHLVSTSAPLLANVYPYFAXSSNPRTIKLSXATFQPNTTPVNDNGSGLVYTNLFDAMVDAMYTAMEQAGASDVPIVVSESGWPSAGDDLATPTNAQAYNQNLIDHVGKGTPKRAGPLETYIFAMFNENQKGGLETERNFGLFNGPDKTPVYPIRFTN

SEQ ID NO: 132310 - protein, 174 aa, Triticum aestivum
  Clone ID: PAT_TA_26728.pep
ALRNSGIGLILDIGNDQLSNIAASTSNAASWVQNNVRPYYPAVNIKYIAAGNEVQGGDTQSIVPAMRNLNAVLSAAGLSAVYAALEKAGAPGVKVVISESGWPSAGGFAASADNARTYNQGLINHVGGGTPKKRQALETYIFAMFNENQKTGDATERSFGLFNPDKSPAYNIQF

SEQ ID NO: 132311 - protein, 203 aa, Triticum aestivum
  unsure (1)..(203): unsure at all Xaa locations
  Clone ID: PAT_TA_26729.pep
LPTWAEFELGNSPXYWKTTNGLPPAPGEGLKIFYNPGTSKLTPNEQFGIAFNGGFNQPIMCGGEPRQMTLQERGKACPPIYTIRIRVPQHAMTLVFSFTNGNTGPGAYTLKFKVPKPWLDKPLSFFNEGLADELNMEGACDRAIFPDENIVITSCDIGGFYEEGGDRCKLDIVSGCMDPTSHMFDPLATIDDGSCPLDSDTEE

SEQ ID NO: 132312 - protein, 470 aa, Triticum aestivum
  unsure (1)..(470): unsure at all Xaa locations
  Clone ID: PAT_TA_26730.pep
VHSAAGVDRELGNSEPCRVQQDAGDARLCSGACTGAARRSLHRPGPCRCAIRWRVLLHHRKQPPAAERRGPVLQIVGDHQHARLLRPAPGARRAPWLRHQPQPRDHQQRRGRSRSRLYAAVAWVQANDKAYYRAATSFRYIAASLAPCVYAALPMSVQSIGVCYGVIGNNLPSRSDVVQLYRSKGINGMRIYFADGQALSALRNSGIGLILDIGNDQLSNIAASTSNAASWVQNNVRPYYPAVNIKYIAAGNEVQGGDTQSIVPAMRNLNAVLSAAGLSAIKVSTSIRFDAVANSFPPSAGVFAQSYMTDVARLLASTGAPLLANVYPYFAYPTPTRTTRXDIQLNYATFRPGTTVRDQNNGLTYTCLFDAMVDALVAALERAGAPGVRVVVSESGWPSASGFAATADNARAYNQGLIDHVGGGTPKRPGLLETYIFAMFNENFKTGELTEKHFGLFNPDKSPAYPIQFH

SEQ ID NO: 132313 - protein, 311 aa, Triticum aestivum
  unsure (1)..(311): unsure at all Xaa locations
  Clone ID: PAT_TA_26731.pep
MTIGVCYGVVANNLPPANEVVQLYRSKGLTGMRIYFADAKALSALRGSGIALILDVGGTDVLASLAANASNAANWVRDNVRPYYPAVNIKYIAAGNEVLGGDTQNIVPAMRNLNAALNGAGLGAIKVSTSIRFDAVTNTFPPSNGVFAQAYMTDVARLLASTGAPLLANVYPYFAYKDNPRDIQLNYATFRPGTTVXPERQNGLTYTCLFDAMVDALVAALEKAGAPGVRVVVSESGWPSASGFAATADNARAYNQGLIDHVGGGTPKRRGALETYIFGMFNENFKRGELVEKHFGLFNPDKSPAYPIQFK

SEQ ID NO: 132314 - protein, 334 aa, Triticum aestivum
  Clone ID: PAT_TA_26732.pep
MARKDVASMFAVALFIGAFASVPTSVQSIGVCYGVIGNNLPSRSDVVQLYRSKGINGMRIYFADGQALSALRNSGIGLILDIGNDQLANIAASTSNAASWVQNNVRPYYPAVNIKYIAAGNEVQGGATQSIVPAMRNLNAALSAAGLGAIKVSTSIRFDAVANSFPPSAGVFAQSYMTDVARLLASTGAPLLANVYPYFAYRDNPRDISLNYATFQPGTSVRDQNNGLTYTSLFDAMVDAVYAALEKAGAPGVKVVISESGWPSAGGFAASADNARTYNQGLINHVGGGTPKKREALETYIFAMFNENQKTGDPTERSFGLFNPDKSPAYNIQF

SEQ ID NO: 132315 - protein, 128 aa, Triticum aestivum
  Clone ID: PAT_TA_26733.pep
LTLLHQDDVGGLEVFTGGAWRAVRPRSDAFVVNIGDTFSALTNGRHISCLHRAVVNSSLARRSLTFFLNPQLDRPVAPPAELLAVDGRPRAYPDFTWREFLEFTQKHYRSDWRTLDAFAAWINQGRKG

SEQ ID NO: 132316 - protein, 88 aa, Triticum aestivum
  Clone ID: PAT_TA_26734.pep
FAVLLLECACFIIWCGNLPIIWCGNLPTEVSRSGSDRSGPSKWKCCVIQCMPVFGVFFYGSKFVCGNLQLFQICCTPDSKVCSFMLDL

SEQ ID NO: 132317 - protein, 65 aa, Triticum aestivum
  Clone ID: PAT_TA_26735.pep
RGFRLGGQLSIATGLKLQGHSTSLKAQYFPSASAVSQMRFIYLFTVYDAIFQRFLMLHVELGAVV

SEQ ID NO: 132318 - protein, 274 aa, Triticum aestivum
  unsure (1)..(274): unsure at all Xaa locations
  Clone ID: PAT_TA_26736.pep
SCVRPVSEVNVGVLAACAPSKLLASLPRGSTGVAGLANSGLALPAQVASTQKVANRFLLCLPTGGPGVAIFGGGPXLPWPQFTQSMAYTPLVTKGGSPAHYISAXSIKVEDTRVPVSERALATGGVMLSTRLPYVLLRRDVYRPFVGAFTKALAAQPANGAPVARAVKPVAPFELCYDTKSLGNNLGGYWVPNVGLAVDGGSDWAMTGKNSMVDVKPGTACVAFVEMKGVEAGDGRAPAVILGGAQMEDFVLDFDMEKKRLGFLRLPHFTGCGS

SEQ ID NO: 132319 - protein, 459 aa, Triticum aestivum
  unsure (1)..(459): unsure at all Xaa locations
  Clone ID: PAT_TA_26737.pep
MARVLLLVLAASLAALASSKGLPVLAPVTKDTATSLYTIPFHDGANLVLDVAGPLVWSTCDGGQPPAEIPCSSPTCLLANAYPAPGCPAPSCGSDRHDKPCTAYPYNPVTGACAAGSLFHTKFVANTTDGNKPVSKVNVGVVAACAPSKLLASLPRGSTGVAGLADSGLALPAQVASAQKVANRFLLCLPTGGLGVVIVRPGGPXLPWPQFTQSMDYTPLPPRGMSFRAXHLPSRSIKAXNIRVPLSKGGPPPPGAGCRARATGGVMLRTRVPYVLLRAYIYRPAVDASTKALAAHAANGAPAARALEAVEPLGKCYGAKWVRNNRVAYAVPNGQGGHGGGSDWRRTARNSVVDVKQGRGCVAFAAMGGVRGGDGGAPAGILXGGARMGDFVLGFDMXSKKRRGFTRLPPFTGCGGLAIINLFNVRWIRPLLRVIVKGISTFEQSFQKKNKMENENKKK

SEQ ID NO: 132320 - protein, 231 aa, Triticum aestivum
  unsure (1)..(231): unsure at all Xaa locations
  Clone ID: PAT_TA_26738.pep
MEHGLWSSGASDKSKAMVEQLQRYGVIKSSKVAEVMETIDRGLFVPPGGSPYFDSPMAIGYNATISAPHMHAACLELLEDHLQPGMRALDVGSGTGYLTACFALMVGPGGRAVGVEHMPELVASSTENIKKSAAAPQLNDGSLSIHIADGREGWPELAPYDCIHVGAAAPQIPKALIEQLKPGGRMVIPVGTIFQDXKVLDKKLDDGVSIRNKTSVRYVPLTSKDAQLHSN

SEQ ID NO: 132321 - protein, 138 aa, Triticum aestivum
  unsure (1)..(138): unsure at all Xaa locations
  Clone ID: PAT_TA_26739.pep
IFTTAEPDGAGIYVYLEVALLAKCIGRRKCSQCGGNFNVASIDIEGENGGPXRMYMPPLLPPPRCESKLITRADDTEEVVKERLRVYHDLCEPVEDFYRARGKLLEFNLPGGIPESWPKLLQALNIEEDPDNNRSAAA

SEQ ID NO: 132322 - protein, 208 aa, Triticum aestivum
  unsure (1)..(208): unsure at all Xaa locations
  Clone ID: PAT_TA_26740.pep
MGQAWASLQEKLQGRHWKERQVRKITDKVFDRLTEDTQKPEKDALKFEEVYIAVLCVYNDINKVLATGPNXTNPPSKERLKELMREFDIDMNAFLGREEFAEFIRKLTAVSLCAIRLNLIITLAAAPCAGAGDLKGTPGXGPGDGKGIRKVPNAIEASGITWARRSNPPPSRWLAVDIPSAAGTVDATGSRSGCCCSIRRRGRGIKVL

SEQ ID NO: 132323 - protein, 58 aa, Triticum aestivum
  Clone ID: PAT_TA_26741.pep
CCALCGGDKGCVMCLCGERRGVAFPFCGRLFIFVYSIFIFKIHTIIYHHYNRDNKYLF

SEQ ID NO: 132324 - protein, 137 aa, Triticum aestivum
  Clone ID: PAT_TA_26742.pep
MDACSPALVVVGALLLLLGASAPTASAARAFFVFGDSLVDNGNNNYLMTTARADAPPYGIDFPTHMPTGRFSNGLNIPDIISEYLGAEPALPYLSPYMRGENLLVGANFASAGVGILNDTGVQFVNIIRIAQQLQNF

SEQ ID NO: 132325 - protein, 103 aa, Triticum aestivum
  Clone ID: PAT_TA_26743.pep
MAALGVLLVTMAAAMVAAAAAAAATARAPRPFFVFGDSLVDSGNNNYLATTARADSPPYGLDYPTHRATGRFFNGLNVPDIISEHLGAEPVLPYLSPHLDGHK

SEQ ID NO: 132326 - protein, 125 aa, Triticum aestivum
  Clone ID: PAT_TA_26744.pep
MGALGLLLVMAAAMVAAAAAAAATASAPRPFFVFGDSLVDSGNNNYLATTARADSPPYGLDYPTHRATGRFSNGLNVPDIISEHLGAEPVLPYLSPHLDGHKLLGGANFASAGVGILNDTGIQFV

SEQ ID NO: 132327 - protein, 68 aa, Triticum aestivum
  Clone ID: PAT_TA_26745.pep
GQGPYNGIGLCTPASNVCANRDVYAYWDAFPPPDVRPRVRVANFMHGTTDHISPMNLSTILAMDNTRN

SEQ ID NO: 132328 - protein, 176 aa, Triticum aestivum
  Clone ID: PAT_TA_26746.pep
MTKDLNAQFGADVFVLDMGARRVLVTGTGPLGCAPAELALRSRDGECDRDLMRAAELFNPQLSQALEELNARYGDGTFIAANSFRVHFDFISDPAAYGFRTAKEACCGQGPHNGVGLCTAVSHLCANRDQYVFWDSYHPTERANRIIVSQFMTGSLDYVSPLNLSTALHIDASLMD

SEQ ID NO: 132329 - protein, 343 aa, Triticum aestivum
  unsure (1)..(343): unsure at all Xaa locations
  Clone ID: PAT_TA_26747.pep
MDACSPVLVVGALLLVLLGASAPTASAARAFFVFGDSLVDNGNNNYLMTTARADAPPYGIDFPTHMPTGRFSNGLNIPDIISEYLGAEPALPYLSPYMRGENLLVGANFASAGVGILNDTGVQFVNIIRIAQQLQNFQDYQRRLAAYIGEDAARERVSQSLVLITLGGNDFVNNYYLVPFSARSQQFEIHDYVPFIISHXSDGCRRSATPRARRAELTAPRGEPGSKPASRPPPGSASTSSPPRSRPPPWDETKLTETGGGLPASASAKPACCAQAGPXHNRPLQGRVSHLCANRDQYVFXARIHPTERANRIIVSQFMTGSLDYVSPLNLSTALHIDASLMD

SEQ ID NO: 132330 - protein, 123 aa, Triticum aestivum
  unsure (1)..(123): unsure at all Xaa locations
  Clone ID: PAT_TA_26748.pep
YRLGRPDPFLMQLRDKLSELYVEACRAEKGAPIPAGVVNMXPLRRYANMYYRYVGSLTTPPCTENIIWNIHGRVREMALGQAAALIAPLEEGYRRNNRPTQPLNGRTVQFYRRFWKKKGSGKP

SEQ ID NO: 132331 - protein, 144 aa, Triticum aestivum
  unsure (1)..(144): unsure at all Xaa locations
  Clone ID: PAT_TA_26749.pep
APATPPPAPAPAAPAPAPMVPAPTPSTMAPTPEISSPPEPSMXRPRPPRPWTRPPPRPAPPAPSTPPPRGPPPPPWPPPPPSTERSADRLRFNLSEGPRPLSFCGGVLRAVHLPSFCCFDDDYIRHSIRLSSSSMCVLGVDGQI

SEQ ID NO: 132332 - protein, 154 aa, Triticum aestivum
  unsure (1)..(154): unsure at all Xaa locations
  Clone ID: PAT_TA_26750.pep
MGGTGLVALAQTERSAAAAAQAPAARAMPAPVAPVSPPPTMPPPTPAPVSPPPAVAPATPPPAPAHVTPAPAPMVPAPTPSTMAPTPEISSPPEPSMMTPTPAPSMDXPPPPPAPQAPSTPPPRGLPPRDWPPGRDLIERSAPAADRLQVIPSI

SEQ ID NO: 132333 - protein, 166 aa, Triticum aestivum
  Clone ID: PAT_TA_26751.pep
LKTYKPHKQTGGFRRETRGLRRHVPSIRSANLTSTEESFSPSVSLSSCSFLVAIASLHRRSSSITVPRLSAPSFLASRTILIAINFLHTSRLTVLTFRRLCDLHRCSFFLVIRNFHHCSSFIPVRSFSAHSFLGSRTILRSIKFPYPSGLTALSFRNLRRCSDFVF

SEQ ID NO: 132334 - protein, 154 aa, Triticum aestivum
  Clone ID: PAT_TA_26752.pep
MHHAKTDSEVTSSMAPSSPSRAPYYVQSPSHDDGENHSKTAASSFHSSPAASPPRSLGNHSRESSSSRFSGKVPSAGSSRRGVAGGGGKRGGGGGGGEAARRSPWMKEAAIEEEGLLMEDDDDADGRAGGFSALPKKVRYGLAFVGAFLVLFTF

SEQ ID NO: 132335 - protein, 257 aa, Triticum aestivum
  Clone ID: PAT_TA_26753.pep
MKHAKGTLRDHLSSKAKLSPGFGLRLHIALGASKGILYLHTDANPPIFHRDVKASNILLDSKFVPKVADFGLSRLAPVPDIEGTLAGHVSTVVKGTPGYLDPEYFLTHKLTDKSDVYSLGVVFLEMLTGMKPIEHGKNIVREVNKAYQSGNISEIVDRRMGLCPPDCINRFLLLATKCCQDETDARPSMSEIVRELEVILRMMPEADLVLMDTTDTDSGDMSKSLSTSSATGTSFVTQTSGSVNASSGVLSEVLAPR

SEQ ID NO: 132336 - protein, 164 aa, Triticum aestivum
  unsure (1)..(164): unsure at all Xaa locations
  Clone ID: PAT_TA_26754.pep
LRKYIARHNDADKREKWSKVDFEVSISDDGDWFDCECGQFAHMGMQCCHGLKVIFSMXEIPKRHIIKRWMKDARDILPQHLAHFQKDQAAXSIFSSRSLTPYLHAMGLVRIGDSSVATYELVLARIKDLIMEASPPAETKDGLGIEDRLAAESNRKNIGSACSP

SEQ ID NO: 132337 - protein, 112 aa, Triticum aestivum
  Clone ID: PAT_TA_26755.pep
AVGPLVPASAPPSSPARGPASPAGTHVWKVATQYMLPELAGKSLTPKLSIVVADAFVAKFGEYAGWAQNVLFIGQLPAKKLVATAVTIALLRTYQEETCDKESLYAARCWSI

SEQ ID NO: 132338 - protein, 347 aa, Triticum aestivum
  unsure (1)..(347): unsure at all Xaa locations
  Clone ID: PAT_TA_26756.pep
MAKVNAGAALLSLCLLLACSAGGTQAAYVDVEGTVRTEVEKAIKSNPGIGAALVRLVFHDCWVNGCDGSVLLDKTTSGGNTEKKAINNIGLDGFNLIDTIKYKLGNSVSCADIVVFAARDAARQMSGGKFTYSVPDGRISSIVSSAAAAPAILPQSTFAQQQLVDNFAKKNGTXILSSAHSIGVSHLSSFQGPPXRFNRDPDATTATSRRSVKDVKGSGEEQKPICADRGRKEHRDRHLNFHEDHRRVRPHRCEHRGQRAXDNNYYYHALQKNMVFITDDWVMRTDSNGGDDMAVYMKNATKWNKVLPAAMVKLSKLPAEGSTRYEIRKNCRVTNQELLLLGSNGIT

SEQ ID NO: 132339 - protein, 189 aa, Triticum aestivum
  Clone ID: PAT_TA_26757.pep
FISGTANDADLGPVISRQAKDRICKLVQSGADSGARLVLDGREIVVPQFEDGNFIGPTVLADVKGDMECYQEEIFGPVLLLMKAESLDDAIQIVNRNKYGNGASIFTTSGVSARKFQTDIEAGQVGINVPIPVPLPFFSFTGSKASFAGDLNFYGKAGVQFFTQIKTITQQWKESSPQRVSLSMPTSQK

SEQ ID NO: 132340 - protein, 536 aa, Triticum aestivum
  unsure (1)..(536): unsure at all Xaa locations
  Clone ID: PAT_TA_26758.pep
MLRAVLLRSASGLRRSPMAAPYHLTCFSPPPAETSPASARQRCPRSGDVVEPRATEHVHGTNPARGAPVSASPPSTVQGRSPSVEAARTAIPGWRSSPVTAPQRIMLXKYQEXLIRANMVKLAENITTEQGKTLKDVGXYVFRGLKVVEHACGMGSLQMGEYVSNVSHGIDTFSIREPLGVCAGICPFNFPAMIPLWMFPIADTCGNTFALKASEKDPGAAMMLAELAMEAGLPKGVLNIVHGTHDVVNNICDDEAIKAVSFVGSNTAGMHIYSRASASGKRVQCNMGAKNHAIILPDADRDATLNALIAAGFGAAGQRCMALSTAVFVGGSEPWEDELVKRASSLVVNSGTANDADLGPVISRQAKDRICKLVQSGADSGARLVLDGREIVVPQFEDGNFIGPTVLADVKCDMECYQEEIFGPVLLLMKAESLDDAIQIVNRNKYGNGASIFTTSGVSARKFQTDIEAGQVGINVPIPVPLPFFSFTGSKASFAGDLNFYGKAGVQFFTQIKTITQQWKESSPQRVSLSMPTSQK

SEQ ID NO: 132341 - protein, 125 aa, Triticum aestivum
  unsure (1)..(125): unsure at all Xaa locations
  Clone ID: PAT_TA_26759.pep
PYDIRQAVTLLIIXKSHNKSLSGWSLDFCPALSMQQLWLISTMYCDDKFGTLGIPSDVVASMRAKMIGGSSSPSVQDDINSFLLDDDFSIPFSVDDIARLMVHVDIADMDLPPLIQEKNGSPFKA

SEQ ID NO: 132342 - protein, 232 aa, Triticum aestivum
  Clone ID: PAT_TA_26760.pep
EMDSSRDRLLALAEEYPEYDMELLGHVLDNENLRVKYIPEAIKVLFETPSGFAIFAIDSGYLYDNDRDFTGIDTIWVHCVKKESADFFLWPKGFLKLDKATKAIAINSDGIHKSLAEFIEQKVGMEDILLVGESAYVEVIEAHVGVTCRCDANAIELMWGLQNLLHDLVPEEESEFGKNDRKYYSQKLLAYLRHIDNEVRPEMINGEIALLASIIHRCNVTNKNYRDNMHKP

SEQ ID NO: 132343 - protein, 142 aa, Triticum aestivum
  Clone ID: PAT_TA_26761.pep
RPTRPNPLRRSAHISSTGRHGCPLCKDLLARFPPPSVRMKQPFPTKPWESSPEMVKKLFQVVRFVYTHFGSMDVHPFTFDEFAQAFHEKDSSLLGKVHVSLLKLLMLNTERSSGSVFVPRSSKDSRFLSFLNFVSFEMCCTL

SEQ ID NO: 132344 - protein, 152 aa, Triticum aestivum
  Clone ID: PAT_TA_26762.pep
FLLPALTVPLTICLPQFMLSYLPCKILFPWNQSTGFTYLTCFCLSLYDMMVVIKEILDIVHPTEQGCHGGEDIARDRGGTAPGGPGRSGLPRTAVAAAAGVGVRAGRRRCGEKEERAAHGRKGGRPEVYSLSWVVIVVVVCIGQPSGTVVYL

SEQ ID NO: 132345 - protein, 153 aa, Triticum aestivum
  Clone ID: PAT_TA_26763.pep
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGQ

SEQ ID NO: 132346 - protein, 160 aa, Triticum aestivum
  Clone ID: PAT_TA_26764.pep
MGVRKKQDLRQARCNGKTITLSRSRVAPRFGNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGQ

SEQ ID NO: 132347 - protein, 178 aa, Triticum aestivum
  Clone ID: PAT_TA_26765.pep
MGQGAFAGIPLQLAGTRKILEFMVRGDYGAMGAFINIGAVGASEVDKEDDMFVLIAPQNAVGNCIIDDMRAMTDAAGDRPVILVNPRLKDMPASSGVMQTMGRDVRLQYAASFETCYSFRLLFYAGTFYPIMGALRMAYPNKYEIFRRVDEPNGEKYDLLAEFTGNPTADDITNAFVG

SEQ ID NO: 132348 - protein, 98 aa, Triticum aestivum
  Clone ID: PAT_TA_26766.pep
RGQRTAGARASRLWSASCTSLRLTPTGISWGWKPWHHPLPETAAGMILLRWTKICTRYKVITAVFDEAQAYLCRLVLPSILLSRSISQSVSWCFCFFF

SEQ ID NO: 132349 - protein, 464 aa, Triticum aestivum
  unsure (1)..(464): unsure at all Xaa locations
  Clone ID: PAT_TA_26767.pep
RPAAAPDRTGTSSEAGGPDGLKKCKSDSKAISSVLAPPKDVEDLQTEGYGNVNIFTYNELRAATKNFRPDQILGEGGFGVVYKGVIDENVRIGFPSRQVAVKELNPEGFQGDKEWLAEVNYLGQLTHAXLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVEWARPLLVHNRKLFRIIDPRMEGQYSTKAAIEVASLCYRCLSQNPKGRPTMSQVVETFEEVQSMPECQDILLQNCMTGSVTLYEVPKEPVEHVETEKAKQEPTAKTDAVAVAVPPPNGKPVPQSKTPPANGKSKSEPPLECKLYIPSPDSDGHQLGLGALASPPSRNTTGHAPPAPGL

SEQ ID NO: 132350 - protein, 382 aa, Triticum aestivum
  Clone ID: PAT_TA_26768.pep
MPISAGIRAPPQGASVYVPGSRLLRVPVPQLAAGGVRRRRLGVVVAAASSAASPDELHARGRHLHGFPEKSLLWNLIKDVEPLDLSVVQRDVPPETVDAMKRTVSGMLGLLPSDQFRVVVEALWDPFFKLVISSIKTGYTLSNAEYRLSLERILELSDDETECKERDSTEYSHGALGWGGSILRLSEDDEAANESEKRDDNLLSENMGGLDSLNAQAKEHILQLQSRLDSMERELHELKKKNSSLQMQQFAGEEKNELLDYLRSLSPDTVIELSEPSCPGVQEAIHSVVHGLLATLSPKMHAKPPPPSENMAGGTLNYGNGDDDRAELVEDVSLPFQPLISIPRDHLARLLFWCMLLGHYIRGLERRLELSQLLEMSCDTRL

SEQ ID NO: 132351 - protein, 171 aa, Triticum aestivum
  unsure (1)..(171): unsure at all Xaa locations
  Clone ID: PAT_TA_26769.pep
MNAFRFLGDMTHLFSVIVLLLKIYANKSCSGVSRKTQELYLAVFVARYLDLFTDYISLYNSVMKIVFITTSAAIVWYMRRHPQVRRTYDRDQDTFRHVFLVAAAFALALIFNERFTLREICWAFSIYLXESVAILPHLVLLQRSRNVHNLPGYIGFSLMGTYPAVYILNRI

SEQ ID NO: 132352 - protein, 200 aa, Triticum aestivum
  Clone ID: PAT_TA_26770.pep
MDDDGAASPSPSPSPSRSPSPLPVADPVTVAAVPPGHLALAIPIHKHGPSSSGGGGGGGREDAWSDGATSTLIDAWGERFVALGRGSLRHPQWQEVAEVVSSRDGYSKPPKSDVQCKNRIDTLKKKYKVEKAKSDSSWPFFDRLDFLLAPVQKLLGNSGGAAGNSGSSNPSNRSTAPMAPRVNFPQRTRTAFPSSGMKRR

SEQ ID NO: 132353 - protein, 424 aa, Triticum aestivum
  unsure (1)..(424): unsure at all Xaa locations
  Clone ID: PAT_TA_26771.pep
SADAWVRRDDTNPSKESNEFVENVLKDIETLGVKYDVVTYTSDYFPKLMEMAESLIKQGKAYIDDTPKEQMRSERMDGVESKRRNSTVEENLSLWKEMVNGTIRGTQCCVRGKLDMQDPNKSLRDPVYYRCNPDXHHRXFSRLNMVYTVLSKRKLLWFVQNKMVEDWTDARFPTVQGIVRRGLKIEALIQFILEQGASKNLNLMEWDKLWTINKKIVDPICGRHTAVLKEKCVLFTLTNGPEEPFVRILPRHKKHEGAGKKATTFANRIWLEYADASVVSVGEEVTLMDWGNAIIREIKTDNGTVTQLVGELHLEGSVKMTKLKLTWLSDIEDLVSLSLVDFDYLINKKKLEEDEDFLDNLNPCTRREALALGDPNMRNVKKGEVIQLERKGYYRCDVPFIRSSKPIMLFAIPDGRQKSTSIGA

SEQ ID NO: 132354 - protein, 250 aa, Triticum aestivum
  unsure (1)..(250): unsure at all Xaa locations
  Clone ID: PAT_TA_26772.pep
MESYANGAKFDCLLFDMDDTLYPLSLGINLACRKNIQDYMLNKLQIEESLVPKMCLDLYKEYGTTMAGLKLMGYDFDYDEFHASVHGKLPYEKLKPDPVLRNLLLSMPQRKIIFTNSDEAHAATVLEKMGLEGCFEGIICFETLNQKNSGDKRVLCKPSLESMEAVVEIAKLDPKKTVFFDDSPRNIASGKAAGFHTVIVGSSALVPGADVALESIHNIREALPELWEAXAGDHVVHIRSAAVPETTVLP

SEQ ID NO: 132355 - protein, 234 aa, Triticum aestivum
  unsure (1)..(234): unsure at all Xaa locations
  Clone ID: PAT_TA_26773.pep
CGRRGRRAGDFCLLCPRHSSLLSSSSFICCRVSTREMEPQEGRKGIPSLLSSQGECIATNITQLIGWTPLIELRNITEKDSIGARLIGKIEPYQPLSSVKDRSALRLIEDAEEKGLITPGITTLLGVTSGNLGIGVAFIAAQKGYKFIALMPAKLSLDKQILMRYLGVEVVLVDAVQHGFKALLDRVEQMKKDVEDVYVLDQFTNPANPDAHFKWTXGPEIWKNTARQGDIFIA

SEQ ID NO: 132356 - protein, 228 aa, Triticum aestivum
  Clone ID: PAT_TA_26774.pep
LELLGRGDTGGGRGRGGRGGRGGGRDGGRRPADVNEQEKIFLGDNADGEKLEKRLGPEKMKIWDEAFDEAADEALPNPENDKLLDDIHTDNMIEFEPGYNVSFGNPDIEEKPPMSLQEMLEKVKPFIVAYEGIQDQEEWEDAVADIILKAPHMKEMIDMYSGPDVVTAIQQEGELQRVANTLPANIPNSVKRFTDKTLLSLKNNPGWGFDKKCQFMDKFVREVSEQYK

SEQ ID NO: 132357 - protein, 434 aa, Triticum aestivum
  Clone ID: PAT_TA_26775.pep
SHHCSGSRRSALPLSPNQGVPGAAAAAAARRASMAFLFNKFQEAIKTLAKSPSFARDPRHLQFDADVNRLFLYTSYNRLGKHSEEKDAEEIIELASKASVTDQQKQVQQNVHYQLKHICKSMDSILRPDTKDPSQSPSDAYNNSRRSGLSLAVGTGVAAANKPAVPATRPLTRTELSNKFRDQFGYTLVIKPSLIPHKDAGQGLFLSGEALPGPALTTAPAHTCPPAPHPFFPADPRIAPVPSYLITRYDGTIINAKPWHLGGETREIWDGSDPVDYNTTPPINPESNSDRAWRMLNKPLQKSGSENFGDVLERRNPLAFGHFANHPPGGSTPNVMICPYDFPLTEKDMRAYIPNIAFGGEEPVTMKRFGSFWFKSRAPGKQTGESPVLRTLVLVSTRSVCDEELFLNYRYSSSKGRPEWYTPVDEEEDKRRWS

SEQ ID NO: 132358 - protein, 70 aa, Triticum aestivum
  Clone ID: PAT_TA_26776.pep
KGRADDAARREWEGPGETQLNRLAAHPPFASWRNSEEARTDRPSQQLRSLNGEWQIVSVNILLKFALNFC

SEQ ID NO: 132359 - protein, 326 aa, Triticum aestivum
  Clone ID: PAT_TA_26777.pep
MATLQHQNQGAAAPMTTTGGGLRAMDLYEKLEKVGEGTYGKVYKAREKATGRIVALKKTRLPEDDEGVPPTALREVSLLRMLSQDPHVVRLLDLKQGQNKEGQTILYLVFEYMDTDLKKFIRGHRQNHEKIPAHTVKILMYQLCKGVAFCHGRGVLHRDLKPHNLLMDRKTMALKIADLGLSRAFTVPLKKYTHEILTLWYRAPEVLLGATHYSTPVDMWSVGCIFAELITTTALFPGDSEVQQLLHIFKLLGTPNEDVWPGVGKLPNWHEYPQWNVSKLSSVIPSLDADGIDLLEKMLQYEPAKRISAKKAMEHPYFDDVDKALY

SEQ ID NO: 132360 - protein, 256 aa, Triticum aestivum
  Clone ID: PAT_TA_26778.pep
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREAGTTMEVVSAQTKAIAEKTSDWTNVVLAYEPVWAIGTGKVASPAQAQEVHDGLRKWLHANVGPAVAESTRIIYGGSVNGANCKELAAQPDLDGFLVGGASLKPEFVDIIKSATVKSSSA

SEQ ID NO: 132361 - protein, 288 aa, Triticum aestivum
  Clone ID: PAT_TA_26779.pep
EDHKTLMGSPNGNENLDACEIHHQETAVTREIVLGSGTAAVCETYIPMGSGCHNMKLEYPSDTTGGSGTEGRDSMKDEESFSLNEAPCYVERHVGASRSMPDNILAKKKALTSLTEVSLQHQSESILKADFVLHDSESSYKRQKIVNGDEQLPNERLSKIHSLPAGWHTPFDDSRYAYKGLSDLGSTTKAISDQVVHVLSSDDEGSPEHTTMNKAPLKAEQGSSSPLLSLSLSTAAKTRKLASSDAGNDRSLSLSLGLPLPGVAKGNQAMEIKQFLPEKPGINTSFHL

SEQ ID NO: 132362 - protein, 131 aa, Triticum aestivum
  Clone ID: PAT_TA_26780.pep
FFKTKNPSVKLICVEPAESPVISGGEPGFHNILGIGPGFVPEILDRSQIDEIVTVTTQEAMDMARRLAREEGLLVGISSGANAAACLKVASREENRGKMIVTMFSSGAERYLNSELFAQVKEECVNVNMTF

SEQ ID NO: 132363 - protein, 185 aa, Triticum aestivum
  unsure (1)..(185): unsure at all Xaa locations
  Clone ID: PAT_TA_26781.pep
LPSPRAPPSPSSSSIPMQQRRGRPSGTDGSDFSYRMVVDSRRRRVGERRSRLARLMLQALHQVAGGRVXLLSVGGGTEGNRIAVVFLARGATXALCLGEFGRRRTVAVFLXRLYTSLSSIAIAFSVTGIIHADWFVKITKQNTAAITSYEMLVVIRVALGVLLQLVVIATTTRLLQNMSPPKRTS

SEQ ID NO: 132364 - protein, 146 aa, Triticum aestivum
  unsure (1)..(146): unsure at all Xaa locations
  Clone ID: PAT_TA_26782.pep
MARLNSKAVVAAVVLAAVVLMMAGREXASAALSCGQVGLQSSRRCVXTXRGRASSIKQRIAAPGVQGAERMARSNSGPQNTCKGLKXLPTSIXPSNGKSPGXSRKFGSVAFPINIQQLKLQFNKTSQVQWTLFGLQVGATMLKINC

SEQ ID NO: 132365 - protein, 65 aa, Triticum aestivum
  Clone ID: PAT_TA_26783.pep
TSRSGTSHVHISARLEYSKELTVHSRIRTCAYMSHKYICTHSVCARYRHRHTTEITHAGNFILFF

SEQ ID NO: 132366 - protein, 111 aa, Triticum aestivum
  unsure (1)..(111): unsure at all Xaa locations
  Clone ID: PAT_TA_26784.pep
MARLNSKAVVSAVVLAAVVLMMAGREATALSCGQVDSKLAPCVSYVTGKAPSISKECCSGVQGLNGLGPATTRDRKDSVARCLKEASANQAIKVPIKQLDKGSPGRXPXKL

SEQ ID NO: 132367 - protein, 98 aa, Triticum aestivum
  Clone ID: PAT_TA_26785.pep
MARLNSKAVVAAVVLAAVVLMMAGREASAALSCGQVDSKLAPCVAYVTGRASSISKECCSGVQGLNGMARSSSDRKIACRCLKSLATSIMSTNCDTVN

SEQ ID NO: 132368 - protein, 121 aa, Triticum aestivum
  unsure (1)..(121): unsure at all Xaa locations
  Clone ID: PAT_TA_26786.pep
MARLNSKAVVAAVVLAAVVLMMAGREASAALSCGQVDSKLAPCVAYVTGRASSISKECCSGVQGLNGMARSSSDRKIACRCLKSLATSIXSINMGKXSGVPGKCGSVCPSPSTFHNCDTVN

SEQ ID NO: 132369 - protein, 252 aa, Triticum aestivum
  Clone ID: PAT_TA_26787.pep
MGRGRIEIKRIENTTSRQVTFCKRRNGLLKKAYELSVLCDAEVALIVFSSRGRLYEYSNNSVKATIDRYKKAHACGSTSGVPLIEVNAQQYYQQEAAKLRHQIQMLQSTNKHLVGDSVGNLSLKELKQLESRLEKGIAKIRARKNELLSSEINYMVKREIELQSDSIDLRTKIAEEEQRLQQVTIARPSVAPELNPFTALDMKCFFPANLFEAAVHAHAQAQAQAQAQASLQLNLGYQQLAPPGAGDVAHQF

SEQ ID NO: 132370 - protein, 255 aa, Triticum aestivum
  unsure (1)..(255): unsure at all Xaa locations
  Clone ID: PAT_TA_26788.pep
MGRGRIEIKRIENTTSRQVTFCKRRNGLLKKAYELSVLCDAEVALIVFSIRSRLYEYSNNSVXATIDRYKKAHACGSTSGXPLIEVNAQQYYQQEAARLRHQIQMLQSTNKHLVGDSVGNLSLKELKQLESRLEXKGIAKIRARKNELLSSEINYMVKREIELQSDNIDLRTKIAEEEQXMQQVTIARPSAAPELNPFTALXMKCFFPANLFEAAVQAHAQAQAQAQAHAQASLQLNLGYQQLAPPGAGDVAHQF

SEQ ID NO: 132371 - protein, 255 aa, Triticum aestivum
  unsure (1)..(255): unsure at all Xaa locations
  Clone ID: PAT_TA_26789.pep
MGRGRIEIKRIENTTSRQVTFCKXRRNGLLKKAYELSVLCDAEVGLIXSFSSRGRLYEXYSNNSVKATIDRYKKAHACGSTSGVPLIEVNAQQYYQQEAAKLRHQIQMLQSTNKHLVGDSVGNLSLKELKQLESRLEKGIAKIRARKNELLSSEINYMVKREIELQSDNIDLRTKIAEEEQQLQQVTIARPSAALELNPFTALDMKCFFPANLFEAAVQAHAQARTQAQAQASLQLNLRYQQLAPPGAGDVAHQF

SEQ ID NO: 132372 - protein, 121 aa, Triticum aestivum
  unsure (1)..(121): unsure at all Xaa locations
  Clone ID: PAT_TA_26790.pep
MARLNSKAVVAAVVLAAVVLMMAGREASAALSCGQVDSKLAPCVAYVTGRASSISKECCXVQGLNGMARSSSDRKIACRCLKSLATSIKSINMGKVSGVPGKCGVSVPFPISMSTNCDTVN

SEQ ID NO: 132373 - protein, 143 aa, Triticum aestivum
  Clone ID: PAT_TA_26791.pep
MATSTAAVLSPPTVAGLRLAPSHRAAVSFRGASSPARRSVAARAALEPSVVISLSTGLSLVMGRFVFFNFQRENVAKQVPEQNGKTHFEAGDERAKEFAGILKSNDPVGFNLVDVLAWGSIGHIVAYYILATTSNGYDPPFFG

SEQ ID NO: 132374 - protein, 122 aa, Triticum aestivum
  Clone ID: PAT_TA_26792.pep
MARLNSKAVVAAVVLAAVVLMMAGREASAALSCGQVDSKLAPCVAYVTGRASSISKECCSGVQGLNGMARSSSDRKIACRCLKSLATSIKSINMGKVSGVPGKCGVSVPFPISMSTNCDTVN

SEQ ID NO: 132375 - protein, 144 aa, Triticum aestivum
  Clone ID: PAT_TA_26793.pep
MAASTAAVLSPPTVAGLRLAPSPRAAVSFRGASSSAARRSVAARAALEPSVVISLSTGLSLVMGRFVFFNFQRENVAKQVPEQNGKTHFEAGDERAKEFAGILKSNDPVGFNLVDVLAWGSIGHIVAYYILATTSNGYDPPFFG

SEQ ID NO: 132376 - protein, 140 aa, Triticum aestivum
  Clone ID: PAT_TA_26794.pep
MATSTAAVLSPPTVAGLRLAPSPRAAVSFRAPARRSVAARAALEPSVVISLSTGLSLVMGRFVFFNFQRENVAKQVPEQNGKTHFEAGDERAKEFAGILKSNDPVGFNLVDVLAWGSIGHIVAYYILATTSNGYDPPFFG

SEQ ID NO: 132377 - protein, 162 aa, Triticum aestivum
  Clone ID: PAT_TA_26795.pep
MARLNSKAVVAAVVLAAVVLMMAGREASAALSCGQVDSKLAPCVAYVTGRASSISKECCSGVQGLNGMARSSSDRKIACRCLKSLATSIKSINMGKECCSGVQGLNGLARSSPDRKIACRCLKSLATSIKSINMDKVSGVPGKCGVSVPFPISMSTNCNNVN

SEQ ID NO: 132378 - protein, 211 aa, Triticum aestivum
  Clone ID: PAT_TA_26796.pep
MARGGAHVVAAAALLLLLLLAAGGGGVHCLRSRAVSGATVLELRHHASLGPGGRSGSAEEARGVLASDAARVSSLQRRIGSYGLIRSSDAASKLAQVPVTSGARLRTLNYVATVGIGGGEATVIVDTASELTWVQCKPCDACHDQQEPLFDPSASPSYAAVPCNSSSCDALRVATGMSGGQACDQPAACSYALSYRDGSYSRGVLAHDRLS

SEQ ID NO: 132379 - protein, 89 aa, Triticum aestivum
  Clone ID: PAT_TA_26797.pep
ALGFCGISPSREGSLRGNLRGRAGTGSPTIHWHHHLAKRTTPRAAQACTVSHMRQRGDKTCERRTRGHVHIWLIKNACNLITYYTTVLV

SEQ ID NO: 132380 - protein, 102 aa, Triticum aestivum
  Clone ID: PAT_TA_26798.pep
RGRGRGTLTVPAKIYGAAVAAVSQAVNLTSHAENAGISAVTNAGTNKVLSSENSNLRKHPRTEQAAFSGAFGPKTQRSSGKVGEACQAGIVLEDPKHEVEQS

SEQ ID NO: 132381 - protein, 105 aa, Triticum aestivum
  Clone ID: PAT_TA_26799.pep
RRLLLHVQIQLHRRDHHFGTSNQSTRTHLYMYQTQTISITSRRLDRSLALLLFQEEEPEEVQVEAGECRRVLAVHLAAAASVPILDEHPTRRRRWRDDPIPTAAS

SEQ ID NO: 132382 - protein, 120 aa, Triticum aestivum
  Clone ID: PAT_TA_26800.pep
DCKPARSSVVHRVGMDKIESGGDATRRKQGGCLGVGASMTTSGGRGRADGPQIRRTDEARKHRRLPRHRVLLSSSASRSQLLLPSSGSRQHSPLHGRPPRLRPFLRRRPAETAASASVLR

SEQ ID NO: 132383 - protein, 88 aa, Triticum aestivum
  Clone ID: PAT_TA_26801.pep
ERNSGKPTVALGSAGTHPRTADGIHPLKAQTLAKRAASLHQMQTGATVLEATVVSGESLLPLHRCSSLSDFVLALLVPCMSCKRRQPR

SEQ ID NO: 132384 - protein, 168 aa, Triticum aestivum
  Clone ID: PAT_TA_26802.pep
DETNIHREAGSTASTAIFVSNHLYVANVGDSRAVISKAGKAIVLSDDHKPDRSDERERIENAGGVVTFSGTWRVGGVLAMSRAFGDRLLKPFVVAEPEIQEQEIDDELEYLILASDGLWDVVSNEHAVAFVKEEVGSEAAARKLTQIAFTRGSTDNITCIVVEFHRAK

SEQ ID NO: 132385 - protein, 170 aa, Triticum aestivum
  Clone ID: PAT_TA_26803.pep
QHPDSGEINLLLRRRGSDPSMAGEEGTMILSAIHSPARKFGITKRKVEETAVAGDKGCATKRKAVGGVGGGKVAPKEAEVQPFGGSEVLQTLILCPDISQREELEILIPYNNDESKTFGHDSSAPDDSDTDGSEPEDLREYVAEYWENMMAELGFEESDFSDYQGVAEYA

SEQ ID NO: 132386 - protein, 206 aa, Triticum aestivum
  unsure (1)..(206): unsure at all Xaa locations
  Clone ID: PAT_TA_26804.pep
GSPRRPXKFNQLVYNYPIRIPERFXLVIRSLLTQEGICFTLKPEFKFLEVAYPYIANRLLTDPNPALRERLIQVLFKDGLFQWKRLENLIVLAKENVSKMSTNPALKSNSLQTVSSQKLEKKLDLTDTIKDGARLFLIDSGIRRQLVMAFTEDSRLHVDELVDVYKLVEDQIDIPSVALEVLQDLPSVARDFMLSWSDSVLSDRQN

SEQ ID NO: 132387 - protein, 278 aa, Triticum aestivum
  Clone ID: PAT_TA_26805.pep
AAARAGRSDSNNSRLCASAYETLNEIARCSSIADTLNMIVLLLQEILKRLNQTFEFQITSSEDKEKQSDLQALLCGVVQVILQKFSNCDDKSVIIQFADQIMVLFLRVFSCDSSNVHEEAMLAIGALAYATGPEFVKYMPEFHKYLEMGLQNFGAYQVCCVSVGVVADICRALDDKVLPYCDAIMSALLKDLSSPELHRSVKPPILSCIGDIALTIGENFEKYVPYTVPMLQGAAELCSRMDLPDDDSTEYKNELRRSIFEAYSGILQGVKNSKSELM

SEQ ID NO: 132388 - protein, 80 aa, Triticum aestivum
  Clone ID: PAT_TA_26806.pep
MGDMSFKESIQAYAADQGLLFMPRVNKFYNGMPVYEFGTVSICIDSVKRLLYAQLQEGTERWSSVSLTQLLEMNRMARPR

SEQ ID NO: 132389 - protein, 272 aa, Triticum aestivum
  Clone ID: PAT_TA_26807.pep
TGWQDHTSKSSEAEAYALLSPWKGVFDPASWEDLIVRYIIPKLKMALQEFQINPANQKFDQFNSVMIWASAVPVSHMVHMLEVDFFSKWQQVLYHWLCSEIPDFNEITNWYKSWRGLFPPELLANKRIRMLLTAGLEMMNQAAEGVDLVQPGASENVGYLRATEKWQFDAAQQASQYPAYHSVPGATMGDMSFKESIQAYAADQGLLFMPRVNKSYNGKPVYEFGTVSIFIDSVKRLLYAQLQEGTDRWSSVSLTQLLEMNRMARSPSNLLS

SEQ ID NO: 132390 - protein, 158 aa, Triticum aestivum
  unsure (1)..(158): unsure at all Xaa locations
  Clone ID: PAT_TA_26808.pep
GPGRRGPRSRRLTGRPNNDHHGPQGCSVTAPRLRRRRHRLRHPACSIEERRRPAPRTPPLPPKKRGAGLLLLSKRSRISAQLGGGGGGDGETKPDGKKFITREQEPEQYWQTAGEXRKGENPMMTPLPYIVIFGFSTPFIILAIAFGQSDGIKAPLIR

SEQ ID NO: 132391 - protein, 76 aa, Triticum aestivum
  Clone ID: PAT_TA_26809.pep
MVLHFSIYQCKVWVLLGKILQLYLFHPTEEFSSTSIMLLSNLQKINGPYRLNIHKYNFGIWKKRLQLQKLKVGQLS

SEQ ID NO: 132392 - protein, 198 aa, Triticum aestivum
  Clone ID: PAT_TA_26810.pep
MAMSILGALKLAPSPPATTAQPACRAPSSLHFHLANAGAVALVAASLLVADPALAFRGGGPYGQQVTRGQDLTGKDFSGQTLIKQDFKTSILRQTNFKGANLLGASFFDADLTGADLSNADLRNADFSLANVTKVNLTNANLEGALVTGNTSFKGSNIYGADFTDVPLRDDQRDYLCKIADGVNTTTGNATKETLFCK

SEQ ID NO: 132393 - protein, 368 aa, Triticum aestivum
  unsure (1)..(368): unsure at all Xaa locations
  Clone ID: PAT_TA_26811.pep
MSAFVGKYADELIKTAKYIATPGKGILAADESTGTIGKRLASINVENVEPNRQXALREMLFTAPGALEXLSGVILFEGDARSQTACPTATPRSSDIRSRPDNVIPGIKVDKGTVDIAGHXGETTTQGLDSLGARCAKYYEAGARFAKWRAVLKIGPGAXSRSERAVKAGTPRGWQRYPLICQENGLVPIVEPEILTDGPHDIKACAAATERVLAALLKSLNDPTVLVSPKVLTAIMVAPAVRAPRRSVPAAVPGVVCLVXRPGAAPAPRNVGLPDGHSQCPSPRNLTSLNKLGLLKPWTLTFSFGRALQQSTIKTWAGKNETVPDAQATFPARRKGKSEPTLGKYGGAAAGGDARRVLRAYTSRGTKY

SEQ ID NO: 132394 - protein, 70 aa, Triticum aestivum
  unsure (1)..(70): unsure at all Xaa locations
  Clone ID: PAT_TA_26812.pep
EQSICLPSLPPDKKINSFQPAYPPIEIEQSLASLLQAVCTAAMXPXLAXLXPSAAVWRECPVTAAGRPGA

SEQ ID NO: 132395 - protein, 80 aa, Triticum aestivum
  Clone ID: PAT_TA_26813.pep
SCGSCTCACLRACVAGVCVCLECRFTHFAPPVAHIEISKKELCLGTERVIFNPTRPFSELSCSSLYTSKFLVILVCSDPP

SEQ ID NO: 132396 - protein, 186 aa, Triticum aestivum
  unsure (1)..(186): unsure at all Xaa locations
  Clone ID: PAT_TA_26814.pep
MHTTSSPEEDDPVKNCGEQKPVLEKVMFLTAVARPRYDAEGNMTFSGKIXGVWPFVQEIPAARRSEYRARGTIEIKSVNVNRRVMRRYMIEKVVPGIKEVWPADDTNPILIQQDNARTHILPGDAEFAEAVATTGLDIKIINQPPNSPDLNALDLGYFRSLESLTDCRAPTTIKELIQGVQAEFHE

SEQ ID NO: 132397 - protein, 168 aa, Triticum aestivum
  Clone ID: PAT_TA_26815.pep
SRHFFPVISAKHGKFMVLSLGTGTAKVEEKFDAAKCSKWGLLGWLYKGGTTPIIDSFSQASADLVDIQASVLFQALHCDYDRRYLRIQDDELTGETASVDVSTMENLKRLIDVGKALLKRQVCKVNIETGKNEPDLERGTNEEELTHFARVLSEERKARSTCGGGFET

SEQ ID NO: 132398 - protein, 125 aa, Triticum aestivum
  Clone ID: PAT_TA_26816.pep
VQEEVEKKTAKGSSSCTNGLLWLTRAMDFLVELFRNLLDHPDWTMSQACIDSYPKTLKKWHGWLASSSFTVAMKLAPNKEKFMEVISGTGDIKADIEKFCTTFYPFLKENHDFLASVGLDDMKAS

SEQ ID NO: 132399 - protein, 213 aa, Triticum aestivum
  unsure (1)..(213): unsure at all Xaa locations
  Clone ID: PAT_TA_26817.pep
MAETVFAPCLEGMKHVRSDSGVMLAKPFLDVCKQILPVLXDKFGAAMAIVKSDIGGNITRLENKYSSDPTKYEHLYTMVQXEVEKKTAKGSSXCTNGLLWLTRAXDFLVELFRNLLDHPXDWTMSQACTDSYTKTLKKWHGWLASSSFTVAMKLAPNKDKFMEEISGTGDIKADIREIXCTTFYPFLKENHDFLASDGLDDVIPSQFNTHRQS

SEQ ID NO: 132400 - protein, 209 aa, Triticum aestivum
  unsure (1)..(209): unsure at all Xaa locations
  Clone ID: PAT_TA_26818.pep
MDEWVRQAEAWAGQAEHWIRQQPPEQIYVAVAVIAVTILVLVAASCLKSSKPNTIVLSGLSGSGKTVLFYQLRDGSSHQGTVTSMTHNNATFVLHSELERKGKVKPVHVIDVPGHARLKSKLDEVLPQAAGIVFVVDALDFLSSMQAAAEYMYDILTKATVVKKRIPVLIFCNKTDKVTAHSKGVIKKQLEKEVNKLRXIRNAISSADI

SEQ ID NO: 132401 - protein, 201 aa, Triticum aestivum
  unsure (1)..(201): unsure at all Xaa locations
  Clone ID: PAT_TA_26819.pep
MESRVKPGFSGAGSLSGSRRSYMGAAAPAPSKPAVDGCGVALRVFILXATLVAAVVMGLDRQTATVQVTIADTLPPLQVPVTAKWSYSSAFVYFVVANAMACVFSAVALAACRSRSAVVPLMVGDLVVQALLFSAVGAAAEFGILGERGNXHVRWGKVCHVYSSFCERAMAAVIVSLIAAFANLVHLMFAILDVHKNSTYY

SEQ ID NO: 132402 - protein, 217 aa, Triticum aestivum
  Clone ID: PAT_TA_26820.pep
MGEAPKHCFQRGADGHLYCEGVRVEDAMAAADRTPFYLYSKPQVVRNFTAYDKALQGLRSIVGYAVKANNNLSVLQLLRGLGCGAVLVSGNELRLALRAGFDPTRCIFNGNGKTLEDLILAAESGVFVNIDSEFDLENIVAAARVAGRQVPVLLRINPDVDPQVHPYVATGNKTSKFGIRTENLHFPLDSIKSYSNEVSPTLAATCSKRFPRGTPSS

SEQ ID NO: 132403 - protein, 114 aa, Triticum aestivum
  Clone ID: PAT_TA_26821.pep
MATATATTACLLAVWSLVAAGLFGTGLARSSVAPAAVGKEQREFDYFALALQWPGTICSSTRHCCAVNGCCRSEALHTFTIHGLWPDYDDGTWPSCCRHTSFDMDKLTPLKPAL

SEQ ID NO: 132404 - protein, 106 aa, Triticum aestivum
  Clone ID: PAT_TA_26822.pep
AGRSGLMKWILHDWSDEHCATLLKNCYDALPAHGKVVLVECILPVNPEATPKAQGVFHVDMIMLAHNPGGRERYEREFEALAKGAGFKAIKTTYIYANAFAIEFTK

SEQ ID NO: 132405 - protein, 168 aa, Triticum aestivum
  Clone ID: PAT_TA_26823.pep
MGSTATDMAASADEEACMYALQLVSSSILPMTLKNAIELGLLETLVAAGGKLLTPAEVAAKLPSTANPAAADMVDRMLRLLASYNVVSCTMEEGKDGRLSRRYGAAPVCKFLTPNEDGVSMAALAHAALALMNQDKGLMESWDYLKDAGLDGGVVVNKGGGMGGLERH

SEQ ID NO: 132406 - protein, 91 aa, Triticum aestivum
  unsure (1)..(91): unsure at all Xaa locations
  Clone ID: PAT_TA_26824.pep
SDVIDTIKHAXAGXPQIICKKGSVXXLRLCFTKDLKPRDCLTTSAMYKNLSKSKQXPRKISLPTYDPIVLTNSTLEIVPEASDNGLYFYTS

SEQ ID NO: 132407 - protein, 360 aa, Triticum aestivum
  Clone ID: PAT_TA_26825.pep
MGSTAADMAASADEEACMYALQLVSSSILPMTLKNAIELGLLETLVAAGGKLLTPAEVAAKLPSTANPAAADMVDRMLRLLASYNVVSCTMEEGKDGRLSRRYGAAPVCKFLTPNEDGVSMAALALMNQDKVLMESWYYLKDAVLDGGIPFNKAYGMSAFEYHGTDPRFNRVFNEGMKNHSIIITKKLLESYKGFEGLSTLVDVGGGVGATVAAITAHYPTIKGINFDLPHVISEAPPFPGVTHVGGDMFQKVPSGDAILMKWILHDWSDEHCAMLLKNCYDALPAHGKVVLVECILPVNPDATPKAQGVFHVDMIMLAHNPGGRERYEREFEALAKGAGFAAMKTTYIYANAWAIEFTK

SEQ ID NO: 132408 - protein, 279 aa, Triticum aestivum
  Clone ID: PAT_TA_26826.pep
MATATATCLLAVWALVAAGLFGTGLARASVAPAAVGKEQREFDYFALALQWPGTICSSTRHCCAVNGCCRSEALHTFTIHGLWPDYDDGTWPSCCRHTSFDMDKLTPLKPTLDKYWPSLYCSTSSTCFSGRGPFWAHEWEKHGTCSAPVVHEELQYFTTALDLYYKYNVTEMLATGDILVSNGKEYALSDVIDTIKHAFGGSPQIICKKGSVEELRLCFTKDLKPRDCLTTSAMYKNLSKSKHWPKKYSLPTYDPIVLTPSTLEGVPEASDNWPRSLTS

SEQ ID NO: 132409 - protein, 207 aa, Triticum aestivum
  Clone ID: PAT_TA_26827.pep
APHSSRPHTPKPAPIPSRRGPERRGKQQRRAMRPTATRPAAAGRRARPPSPLVRRPSAGLGATPPAATAPGRPGDPGGPEAPRAGRRGGRPPGHRGPARGGRPPAAHGPAPPPGLRRGWRPEERRAGRPPAAAARRQAPPRPRRQAPPGLHAQGGPRLPRRHGPSRSQPPPAGRPRSTEPANLSTAAATKAFKTPPPSGYPRAAAAT

SEQ ID NO: 132410 - protein, 159 aa, Triticum aestivum
  Clone ID: PAT_TA_26828.pep
MSVVVLDGSTVRSFVADEAAFARSVDARFAALDANGDGVLSRAELRRALESFRLLDGAGFGSAEPAPLPGEVAALYDAVFEQFDADHSGAVDRAEFRGEMRRIMLAVADGLGCQPLQVAVDDEGGSFLLEAAEHEAAMIAARVQEERDKAAAEEAADGK

SEQ ID NO: 132411 - protein, 335 aa, Triticum aestivum
  Clone ID: PAT_TA_26829.pep
GQGPDVKQLDAFLRTDLSALQMLSRNMGSQPYTPDDKLSVYEFGLEEPLQYLAKNQLIIPDDKLSIYEFGLEEPLQYLSENQLIIPDPLLEFAQSQGALAIDENGRVIFTGSGDEMRDLLSVFLEFNVPKREASGCKAAYLVPYFDRKRGRNSSQSNSKSASTAVDAPKSNANVKAKSPSKKKQKGKTINERDMYQNNYFHASEAFFSILLDKDRHSSTILSLKKAGPEITELLTQCSIGIAGTGLAVLLSVVCKVAIGGRTPFAATRLLHTGVGFGLFWLSHAVNGLRDTITSVFRGPVDTKLEDEVAVKIQRSMNDILLRAVTLLAITALRFA

SEQ ID NO: 132412 - protein, 359 aa, Triticum aestivum
  Clone ID: PAT_TA_26830.pep
RCLSLTFTGCRHLCILWLLLLAGHTPSLALSFALLPPPRPNATSPLGDLVSLSTLPLLPHPQSPWGAPSPPSLDLSPPRVRSPKSPRRSLALLPASSLLFSASSSFAIDNANAPSSSTIDTTITDRIFMDFSICPSFFSNDRTLGAELASCPDSEPLGRVVFGLYGRLLPITTANFKTTCTTSAYRGTLVHKVLQGQFFAAGRQGSRRDKGVVQPPSKLVRNVETVDPKAYQLRHARPGTLSLCLEQNDDDDSIKLSPDYHNVEFLVTTGPGPCPELDDQNIVFGTVLEGMDVITSIATIPTYKPGERIQFFNDFAQLIGDERAQSARAMWDRPQKTVYISGCGELKVTKPSLSPPSLP

SEQ ID NO: 132413 - protein, 188 aa, Triticum aestivum
  Clone ID: PAT_TA_26831.pep
GKDPVLGVDSVGTVSAALVTYASIQLLKPDLIINAGTAGGFKARGAGIGDVFLASDVAFHDRRIPIPVFDSYGIGARKTFQTPNIVKELNLKVGKLSTGDSLDMSPHDETAILSNEATVKDMEGAAVAYVADLFSTPAIFVKAVTDIVDGEKPTAEEFLQNLISVTMALDQAVLQVVDFISGKCISDL

SEQ ID NO: 132414 - protein, 204 aa, Triticum aestivum
  unsure (1)..(204): unsure at all Xaa locations
  Clone ID: PAT_TA_26832.pep
MAPLLPPYHNRCLFNAVGYVMEHNKNKASELRQVIAAAVASDPEKYNEAFLGEPQDANCARQVEAETWGGAIELSILXEYYGREIAAYDIQTTRCDLYGQGKNYNERAMLIYDGLHYDALAMSPAEGAPEEFDQTIYVVDQNRSIGPVEGLALNLAKEAHRKRSYTDTANFTLRCGVCQIGVIGQKEAVEHAQATGHVNFQEYK

SEQ ID NO: 132415 - protein, 126 aa, Triticum aestivum
  unsure (1)..(126): unsure at all Xaa locations
  Clone ID: PAT_TA_26833.pep
NXFGXXXXAXXXWKLXXXXIXXXWSFXAFPKXQCQSXDXAXVKFLXXFASLFPXVQGCXNGIRFHIGQICQQCXSFQIXPEPRXQQCAXQXRYVQSTLARLSCCYVRAQKRXRGELEVKEVEKGKR

SEQ ID NO: 132416 - protein, 61 aa, Triticum aestivum
  Clone ID: PAT_TA_26834.pep
TLQKVFMGATVVFGATSGIPADVQLRILLGAGALVSAALAYVFYDRQKHFVFVDYVHADID

SEQ ID NO: 132417 - protein, 541 aa, Triticum aestivum
  unsure (1)..(541): unsure at all Xaa locations
  Clone ID: PAT_TA_26835.pep
PRPSLPPPPRPAGPQTQSRCCRRHSHPSPSPPRGVGPCPACRLPRPPRPGASASAWPRRRRSPARRGGRRSRARARAPRLNRPGEKFVWRDHWYPVSLVEDLDPRVPTPFQLLNRDLVIWNDPNSGEWVALDDRCPHRLAPLSEGRIDETGGLDCSYSGWSLTGPGACTRIPQAAPEGPEARAVRSPRACATKFPTLLSQGLLFVWPDENGWDKAKATKPPMLPKEFDDPAFSTVTIQRDLFYGYDTLMENVSDPSHIEFAHHKVTGRRDRAKPLPFKMESSGAWGYSGANTGNPRITATFEAPCYALNKIEIDTKLXPIVGDQKWVIWICSFNIPMAPGKTRSIVCSARNFFQFTMPGKAWWQLVPRWYEHWTSNLVYDGDMIVLQGQEKVFLSASKESSADVNQQYTKLTFTPTQADRFVLAFRAWLRKFGNSQPDWYGSPSQDALPSTVLSKREMLDRYEQHTLKCSSCRGAHKAFQTLQKVFMGATVVFGATSGIPADVQLRILLGAGALISAALAYVFYDRQKHFVFVDYVHADID

SEQ ID NO: 132418 - protein, 111 aa, Triticum aestivum
  unsure (1)..(111): unsure at all Xaa locations
  Clone ID: PAT_TA_26836.pep
XMLDARXTGDFAFRDRXFKAAIDCYTQFVDVGTMVSPTVYARRSLCHLMCDQPDAALRDAMQAQCVYPDWPTAFYMQAVALSKLDMQSDATDMLNEASQLEEKRQKSARGP

SEQ ID NO: 132419 - protein, 76 aa, Triticum aestivum
  Clone ID: PAT_TA_26837.pep
ELGVLLDDLAVSNPSVGISTPPFFFFCAHLLYCHFAWYALIFLDLDFLVLSPPIFYLLFFSLFLICFFTSYFIYSF

SEQ ID NO: 132420 - protein, 72 aa, Triticum aestivum
  unsure (1)..(72): unsure at all Xaa locations
  Clone ID: PAT_TA_26838.pep
PGVGRMVKNHHPPDRNEFSNLIEGLCSVGRTYDALVWLEEMVDHGETPDVXVWSCLVSSSLGVGESVMVAAM

SEQ ID NO: 132421 - protein, 185 aa, Triticum aestivum
  Clone ID: PAT_TA_26839.pep
MEVLVSTTAASAPLSSARVHRRPLPASVTFRAPARRGWRCRSAAPTRPDPVPSEEPASASGSATTTVVTDKPDAPDGEVSGGFVEVTMEDAPVSSPEADGGVDDLLGKLDIQVTPTTVILGGGALIALLILSKIISGMDSVPLLPNVLEIVGTGYSVWFITRYLLFKESRDELFAKFEDLKNNII

SEQ ID NO: 132422 - protein, 103 aa, Triticum aestivum
  Clone ID: PAT_TA_26840.pep
MPMGPSRTRSRRLVVACAASGGGPPAEKPPQGPSLPPLSEIRWGQLLAPSPDNAAAVALTAALVWAGAALLLQLVLISASIFAAALKYSFVAALLLFVLIALL

SEQ ID NO: 132423 - protein, 206 aa, Triticum aestivum
  unsure (1)..(206): unsure at all Xaa locations
  Clone ID: PAT_TA_26841.pep
PQTAAGTRYVPTAGRRAPWQIRAPTLFSVDDNPTPLQVATSVMLTEGAVRRDGEXRNLSEEALEALRMVSTSPVETNKPPSPVQALLGGIAAGVIALFLYKFATTVEASLNRQTISDNFSVRQITVTIRTIINGLCYLATFVFGINGVGLILYSLQLTFNSLMDDETSSSSVEKISEQSSTMASSSSSTSDSISDSSDLQQISRQE

SEQ ID NO: 132424 - protein, 200 aa, Triticum aestivum
  unsure (1)..(200): unsure at all Xaa locations
  Clone ID: PAT_TA_26842.pep
SPGTVEGYASAHADRFAAKLPWKETLSFSHNHDDVGARGNSHVVVDYFTSALGDDFKHLGEVYQEYCEAMEEASLAIMEVLGVSLGLGRGYYRDYFADGSSTMRCNYYPRCPEPDRTLGTGPHCDPSALTILLHDGDVDGLQVLVDGAWRFVRPXTGELVVNIGDTFVALSNGRHKSCLHRAVVHREKERRSLAYFLAPR

SEQ ID NO: 132425 - protein, 232 aa, Triticum aestivum
  Clone ID: PAT_TA_26843.pep
RTRGLLHSLAPFAFAPLAAPPPPPLLDLLLAAAFGQELLLFAHRRPSTAAGIENRYFDLFLVPVAVCLGATLLAAHRPGAAPPRLARAAGLALQGTWMLQMGFSFFTDAIAAGCALHAQSRADYTIKCRTHEDYHRARSVATLQFNGHLALLVLAGAATYAAVISRGNGSPPSGYRMLDKEVQMEGMPLTSQFTLDSDEEKEDEGITTAVPPSANGVNSHQQISEQTPDDPK

SEQ ID NO: 132426 - protein, 187 aa, Triticum aestivum
  Clone ID: PAT_TA_26844.pep
MTTRRWWKRRDGSDDADDLVPMDTQEQEELVRSLEQKQVHQSRRWRHVFAGFLLSYTVFLVYSSFHHAWSPWELRYHAYFMEDLPSPMVIVADWIAALACLFAVKGLLQASNSSKKWMWYSFYVGMAVAIFWTYYLLKLPRIRWDVVWLPLGPLIASALSIYVDHTLMKSMQDISTLRGYMYNFKSL

SEQ ID NO: 132427 - protein, 99 aa, Triticum aestivum
  Clone ID: PAT_TA_26845.pep
AYEGLKPPSSPTPSRSSSKKNDDGDSPSPPPTAASPEAATSTTAEAAAAEPSSPLLDSNANGAPATAAPTADPGRPLSPYARYEDLKPPTTPTPSAPKV

SEQ ID NO: 132428 - protein, 354 aa, Triticum aestivum
  unsure (1)..(354): unsure at all Xaa locations
  Clone ID: PAT_TA_26846.pep
MCGGAILSDIIPPPRRATGGNVWRAGGKKRARADAAAGRPRRAPEEFEEEGDAEFEADFEGFVEAEEESDGEGKPFPVRRSGFSGDGLKATAAGDDDCASGSAKRKRKNQFRGVRRRPWGKWAAEIRDPRKGVRVWLGTYNSAEEAARAYGVEARRIRGKKAKXSISQKKLLWLLSXRCATAVKVPEFNTEQKPVLNTMGNADVYSCSAVDYTLNQQFVQPQNMSFVPTVNAVEAPFMNFSSDQGSNSFSCSDLSWENDIKTPDITSVLASIPTSTEVNESAFLQNNGINSTVPPVMGDANVDLADLEPYMKFLMDDGSDESIDSILSCDVPQDVVGNMGLWTFDDMPLSAGFY

SEQ ID NO: 132429 - protein, 409 aa, Triticum aestivum
  unsure (1)..(409): unsure at all Xaa locations
  Clone ID: PAT_TA_26847.pep
MARERHNSSSSSHTHTHQHHTNRPVSSRSRFTLSLSFRLALPAVPRAPAAMCGGAILSDIIPPPRRATGGNVWRADKKRRARPDAAAGRPRRVPEEEFQEEEGDAEFEADFEGFVEAEEESDGEAKPFPVRRSGFSGDGLKATAAGDDDCASGSAKRKRKNQFRGIRRRPWGKWAAEIRDPRKGVRVWLGTYNSAEEAARAYDVEARRNSWPRRQRSISQKKAPXWRPQQRCATAVKXPEFNTEQEARYSITMGXADVYSCPAVDYTLXNQQFVQPQNMSFVPTVNAVDGPFHRFXSSDQGSNSFSLGLGRENDSNTPDIISVLASFPTSTQVNESAFLHNNGINSTVPPVMGDANVDLADLEPYMKFLMDDGSDESIDSILSCDVPQDVVGNMGLWTFDDMPLSAGFY

SEQ ID NO: 132430 - protein, 169 aa, Triticum aestivum
  Clone ID: PAT_TA_26848.pep
PYICTFPSTRPCMLTNLNKKTSIQGGLTFLYYSSCLLQHFEQHQCRCTKQPSSGLRIHSCTNHHPGLIINRCTKQPSGLPSLLLLHVFGYISKRYCSKQLTGLATIYHHGKSALNAVTCSSRPILDGFLLRSCLTIQALSRFLPSHLEIQAFRRTCPFVGDDLDFRPGR

SEQ ID NO: 132431 - protein, 90 aa, Triticum aestivum
  Clone ID: PAT_TA_26849.pep
LARGDLGYNLSNGRLILSAHQTFHIVKNLLLSGAASFDSSCPPGGAASLDSRRWLKLPSDPCHKHFVCSRLGGTGQLFSFESLPVHPIVS

SEQ ID NO: 132432 - protein, 237 aa, Triticum aestivum
  unsure (1)..(237): unsure at all Xaa locations
  Clone ID: PAT_TA_26850.pep
MGLGVRAAPFTYVAHALAVVAAAMVLYWCIHFRGGLAFEAANKNLIFNVHPVLMLIGFIILGSEVIMVYKVLLTVIHDTIKLIHRILHAFALVLGAVGIYCAILYRMESGLAKLTILQSWLGIVTISLYGIQCIVGLLAFFLPLGXPNVWKSALPWHALLAIFVYILALATADLGFLQKLTFLQSSGIDKYGPDSFLVNFTALVVVLFGASVVVDAVAPSPLEEPQCYACIPQNSHV

SEQ ID NO: 132433 - protein, 150 aa, Triticum aestivum
  Clone ID: PAT_TA_26851.pep
MAASSWQVALLAVALCVLPAALPAASAARAFFIFGDSLVDNGNNNYLLTSARADSWPYGIDTPDHRATGRFSNGKNVVDLISEQIGSVPVLPYLSPELDGQNLLVGANFASAGIGILNDTGIQFANIIRISKQLTYFEQYKHRLAKLYGP

SEQ ID NO: 132434 - protein, 144 aa, Triticum aestivum
  unsure (1)..(144): unsure at all Xaa locations
  Clone ID: PAT_TA_26852.pep
MRGEADIEEASASPVWLRDGASTQPRTAGSSRRRRGPPPSWIHFPRGPAPPASPXTPPPPSSSSAPSTAPRRPRRGTPATPPPSPRRRPWPPRAALSSSPSWLLRRGWRPSPWFPLHMVAAAGCMFAQQGRLWSEEEVAATFVC

SEQ ID NO: 132435 - protein, 88 aa, Triticum aestivum
  Clone ID: PAT_TA_26853.pep
LPPPPPPAPGTALPPPPVLPPSLLPPPPILPPRPPPPPRDAPPWIREATQSSTSSSAQASLALPPSLKVMASLSSRSSRIPFLFRWGS

SEQ ID NO: 132436 - protein, 177 aa, Triticum aestivum
  unsure (1)..(177): unsure at all Xaa locations
  Clone ID: PAT_TA_26854.pep
MSRCPSLLLIRERQDRRQDEAGSGSGATAGDLVGLRLSRQPSPGRQQRPALAVPSTWSARAPAGELPESSGCRPFVGLEFLKCCLCCCKTMDGDMDVFVYKGEQAFCSDECRCQQIAREEKRETESPCRKRVVAFRXRCAAPGKKVGGPDRHARVLVARFCKLELDPCCTCSKPVIN

SEQ ID NO: 132437 - protein, 216 aa, Triticum aestivum
  Clone ID: PAT_TA_26855.pep
MATLVKHLILCSSTTTSSSASPSPSNRRPPSSPDGADKRAHLTQSSTRRLAVAASTAMVATAALSARRPAAPPPAMAAEAAAVRAPAPPGTVPRWGTRSYVRERFFEPGLTTEEAAARIRQTAEGMRTLRPMLETMSWKYVLFYVRLKSKYLDLDLTTAMAGVPEPRRPEYVLVANELVDNMTEFDRFVRTPKVYESYLYYEKTLKSLDDVAEFLG

SEQ ID NO: 132438 - protein, 170 aa, Triticum aestivum
  Clone ID: PAT_TA_26856.pep
MAAVTAAAISLSSSSASSPAAAAKAKAASPSSSPCRHLQFLSAASPRRRWRAGARAVRAQVSTTETAAAGPAKTSKKQDEGLVTNKYKPKEPYVGRCLSNTRITGDDAPGETWHMVFSTEGEIPYREGQSIGIIADGEDKNGKPHKLRLYSIASSALGDFGDSKTVSLCV

SEQ ID NO: 132439 - protein, 221 aa, Triticum aestivum
  unsure (1)..(221): unsure at all Xaa locations
  Clone ID: PAT_TA_26857.pep
HTRHHHXGPICQYRKGHSNQRHKMVHLGPRXGPSHXCEATRYGCVXXXSLPTTXESXDXRPXDDGDSTQXEPGSWASDPGLXXDTDMVNSSDLGTXXMVRPQAGEEVSHRAAQQAGVAXXVGQHTEQQSSRAGAAAASPAAAAAPLTLPGSRLPQASPGPRVQFXGTAXATLSXSRGRAGSTLCCTALHVAGXTRGGTAGETPARISWPPASARPSSTRAC

SEQ ID NO: 132440 - protein, 111 aa, Triticum aestivum
  Clone ID: PAT_TA_26858.pep
PFHLIFDYTFFCALDPSLRPAWAARMEELLRPDGELITLMYLPQDQDSGPPYNTTVHDYEEVLNPLGFVIQSIEDNDVAVEPRKGLEKIARWKKTAAGAETSTSDVPSDNL

SEQ ID NO: 132441 - protein, 187 aa, Triticum aestivum
  Clone ID: PAT_TA_26859.pep
LVSSRAHLSSYLPPLLPSARPRPRTTRSGGGSYRRAAVRAMGAAPSSPSPSGQAPGKADNASLSDEELKKRLTKEQYYVTRQKGTERAFTGEYWNTKTPGIYHCICCDTPLFESSTKFDSGTGWPSYYQPVGDNVKSKLDMSIFFMPRTESLCAVCDAHLGHVFDDGPPPTGKRYCINSASLKFKPQ

SEQ ID NO: 132442 - protein, 180 aa, Triticum aestivum
  Clone ID: PAT_TA_26860.pep
THLLGRAQQKGDPLLVSGPVATSSLPLSTRRRASSVSLPAPKKGGIGHGGLRIECIRIGGVEIPNHKRVEYSLQYIHGIGRNRSRQILLDLSFDNKVTKDLSEEEVITLRKEVTKYMIEGDLKRFNRVAIERMKEIRCYKGIRHKLGLPVRGQRTKNNCRTLKGKRASVAKKKSASSSDE

SEQ ID NO: 132443 - protein, 208 aa, Triticum aestivum
  unsure (1)..(208): unsure at all Xaa locations
  Clone ID: PAT_TA_26861.pep
MATLSMVSGPVATSSLPLSTRRRASSVSFPAPKKGGIGHGGLRIECIRIGGVEIPNHKRVEYSLQYIHGIGRNRSRQILLDLSFDNKVTKDXSPREEDHLQRFNRVAIERMKEIRCYKGIRHKLGLPVRGQXRTKNNCRTLKGNSGFRRQEEVGFVLRRISDTAMCICLLFGFCLLHHGATTIRYSVSSFHSVVDELWGYGRMLLQSL

SEQ ID NO: 132444 - protein, 300 aa, Triticum aestivum
  unsure (1)..(300): unsure at all Xaa locations
  Clone ID: PAT_TA_26862.pep
NQDESRAAAGVHLSNTVIGXQLLTLLASIPIIGAGLWLAHAASAAPGPTCQSALQAPLLAVGFVAFLVSLPGFVGARYHVSWALWLYLVAVLLLVLFLLGATVFGLAVTAGGGGRTVPGRPYREYRMRDYSPWLRGHVSADRYWRTALACVASSRACPPVAGWTPXDYMRRDLTPVQSGCCKPPTSCVYGGDGLTGHGXAVVAVQDEDCFRWQNDPAVLCYGCDSCRAGVMEQLRRHWHNVTIVNAVLLLLLIAVCSCGCCAFRNARRAEYAYGGRMSKIHPRWDYFWSRWWRGHREQIY

SEQ ID NO: 132445 - protein, 233 aa, Triticum aestivum
  Clone ID: PAT_TA_26863.pep
MSGSNQMASDGKFGKGPRELTGAVDLISRYRLLNHHSFFCKKPLPLAISDTHYLQNVVGDTEIRKGEGMEIDQLIQNPDLREKKTAYIKPFDMGTLGHAFQLRETAPVDLPSAEKGTPTISGKSKVKSRDKVKKHKKHKEKDKDKEHKKHKHRHKDRSKDKDKDKEKEKEKEKEKEKEKDKDKDKEKKKEKSVHHDLGGDNSKKHHEKKRKHDGMENLAAVRNHKKTQKRKIQ

SEQ ID NO: 132446 - protein, 197 aa, Triticum aestivum
  unsure (1)..(197): unsure at all Xaa locations
  Clone ID: PAT_TA_26864.pep
PPPQQRDLGYRPPPPPAAAVAPVPLPPPPSPPPPSAAASPPLPSLPPPNLSAHAIPPAPFPSLRRSAGHSRVVARASASGAAAEAETVFFDGGAHYGXDLAANLVLGXWTLLWLPLTLASVSRALLLRYRLDLPAGVTVISGALPVATARTSPARRGRIGSSSYRGSTAGGRSVPRRCEAAECCRSRAAAEGGLVAR

SEQ ID NO: 132447 - protein, 295 aa, Triticum aestivum
  unsure (1)..(295): unsure at all Xaa locations
  Clone ID: PAT_TA_26865.pep
MKTFLILALLAIVATTATIAVRVPVPQLQPQNPSQQQPQEQCXHLVQQQQFPXMQQPFPPQXPYPAXQPFPSQQPYMQLQPFPAACNYHILQPATTISCSLQLPYPAXLQPFXPQQSYPQPATTCILQPQQPISXSXHACMQQQQQQQQQILQQIXLQQQLIPCSGCLYLQQHSIAXHGSSQVXLQQSTYQLVQQXCVCQQLWQIPEQXRCQAIHNXVVHAIILHQQTNNQQXQKQQPPESPQHPACPLLPPLHSPSAPXAPLQLSSEAPGGPGSLHPLIRLRKPWLGTPCWSET

SEQ ID NO: 132448 - protein, 193 aa, Triticum aestivum
  Clone ID: PAT_TA_26866.pep
ADAERRGQQTRSPQRAAVQIRHEHSLRPGYQEGPPGNVCLNPARSWRLNDLKRGPQGKPPAALSSTSFLLGSSDVHKGFSYRMPAAAASRSGCSTEAPTSTARRRAPLVPLQAVIIAADCNPKWLTKHIPTLASTRQVPVLCLKDNKGSSLRLGQVANVRTALAIGIKAKDSIINKTVDEVLKDYYKPVADEQ

SEQ ID NO: 132449 - protein, 160 aa, Triticum aestivum
  unsure (1)..(160): unsure at all Xaa locations
  Clone ID: PAT_TA_26867.pep
HGATAGGAAAAASHRSLVVTGSSPMSPPHPKRRRRWWRPGAAKWLSKPRFAGAHEPXAGXLGRRSRAATARPKRRPKRCSVQMLGPAVASSGGGELTPAPSIPAPRQMTPEAPVGADTKPSAASSSTMARIGTGAYPGGPRLGPTASPTGVGVAGGSHAA

SEQ ID NO: 132450 - protein, 78 aa, Triticum aestivum
  Clone ID: PAT_TA_26868.pep
GHLSLFEQKKPGPSFLILHYQNQLIMKELPDTISQNDVHNSPWHAEGEVCPSLNTLTEQSDPPASSANVIFLRFAVDP

SEQ ID NO: 132451 - protein, 256 aa, Triticum aestivum
  unsure (1)..(256): unsure at all Xaa locations
  Clone ID: PAT_TA_26869.pep
LKHLTGGTXILXNKXFIILYRGKGFLPGGVKRSVIEQEARVDAQQVNEEEARLTVMDSLQMFAGLPSEETSAGTFREYLDFQLNHVHEITENNLGMVELEAEKHRLEKELKDQQRRLSILTKKIERSNEALAKLHSSWNPSGQSADKELLTEEERMXFRKIGLKMDEHVLLGRRGIFDGVIEEIHQHWKHKEIVKVITKQNQAYQITYTSMLLEVETGGMLIATQKLTNSHAIILYRGKNYRRPTKSSPSNLLTKR

SEQ ID NO: 132452 - protein, 141 aa, Triticum aestivum
  unsure (1)..(141): unsure at all Xaa locations
  Clone ID: PAT_TA_26870.pep
RNSARGRGASLFPHSIRSSAGKARPVRMSDPGHPTSNGDHRHYADNGXTNGHFFSGDSYGAVSRNGGSSTDSPDRGSFGTKETSLSELDIYGSSRYEAMLLRGEDVRNTSWLHGGFDDDKPDQSPLFDHRFEPLPEPFSPF

SEQ ID NO: 132453 - protein, 235 aa, Triticum aestivum
  Clone ID: PAT_TA_26871.pep
MTPAQDPFYIVKDEIQDSIDKIQDTFNQWKQAPENTGEYVHLTRELLTTCESVQWQVDELEKAISVAERDPAYYGLNEVEIGKRRNWTSTARNQVVSIRRNVEAGKHKTAFGRSVNPSELGRSKQHISQDNDDFIASESDQQMLLMKRQDDELDALSASVQRIGGVGLTIHEELVGQEKLLGELSLDMETTSNRLDFVQKRVAMVLKKASLKGQIMMIAFLVVLFIILFVLVFLT

SEQ ID NO: 132454 - protein, 235 aa, Triticum aestivum
  Clone ID: PAT_TA_26872.pep
MASLDAVRGDLALLILYLNKAEARDKICRAIQYGSKFISNGEPGPAQNVDKSTSLARKVFRLCKFVNDLHALISPPAKGTPLPLILLGKSKNAMLSTFLFLDQIVWAGRTGIYKNKERAEFLGRIAFYCFLGSNTFTAIIELAELQRLSTSMKKLEKELKHQELYKNEQYRMKLHKSNERLLALVKSSLDIVVAVGLLQLAPKKVTPRVTGAFGFASSLIACYQLLPSPPAKQSK

SEQ ID NO: 132455 - protein, 62 aa, Triticum aestivum
  Clone ID: PAT_TA_26873.pep
LVFQLPIEVGWMRKEIVTGVSVAIWGQDQRLAIFLLRGDSSGSLKALTILLRWFEQSMPPKF

SEQ ID NO: 132456 - protein, 120 aa, Triticum aestivum
  Clone ID: PAT_TA_26874.pep
SSVTPQRTKMISANCFASRNSYGKTQHQRPIKQHCGTVQCYRKCCSRHIFFNRTAPTRQTSHSYRLILHEFCQQKMSPKSLEIRLMHYNSTTFRDPPMVPAKKETSPLEDVLVMLSTPGG

SEQ ID NO: 132457 - protein, 276 aa, Triticum aestivum
  unsure (1)..(276): unsure at all Xaa locations
  Clone ID: PAT_TA_26875.pep
MAPFLNPSPELKHALLWSVPILIIAPTVIFLYMQAVGKKKNTIRLPPSPLRLLIIGHLHLMVHEPHRSLXEAGSQPGPVIHLQLGGIAAIVVSSPEAAKEVLKTHDVHCCSRPSSPGAKLITYGQQDIAFSPYNASWRERRKLFVSELVSSKRVQSFAYALEAQVGELIQSLSLRSPPTEAVNLNETLFTLIDGFIGRVAFGSMNGAKLMKYAKFQQVFSEAMIALSAFSAQDFFPASPMSRWVDKLVGLEARYQRIFLELDSYFEMGLSQHMDPG

SEQ ID NO: 132458 - protein, 178 aa, Triticum aestivum
  Clone ID: PAT_TA_26876.pep
MADSMQEWPEAVVRVQAVAESDVAAIPGCYVKQPRDRPDHVLHEPSDMSIPVIDLACLLAGRTDSLATDAVAAACRDWGFFQVVNHGVAPELMRAAREAWRGFFRLPIPAKQHYANLPRTYEGYGSRIGVQKSATLDWGDYFFLHLAPEDAKSPDKYWPHPGICKYVPMINIFFKQFC

SEQ ID NO: 132459 - protein, 137 aa, Triticum aestivum
  Clone ID: PAT_TA_26877.pep
DFIAEMVAKYSINIYTTIKQENMADENSARPTLPQEKQPTPVHKGNNQTHVQFIWREKKTIAKGKPHVRSACIVQQYRKKVAKLAATTLFFPAAAVVPRCHPGVQVNPRHRCPGHPARHPTTTATTSSSPTQVSRPD

SEQ ID NO: 132460 - protein, 65 aa, Triticum aestivum
  Clone ID: PAT_TA_26878.pep
ENSQIYYSLSREDGLCEGVSLALTKICASISLQPGYLKELLPDSAPNRPDTLDALFDGDLPSSLL

SEQ ID NO: 132461 - protein, 100 aa, Triticum aestivum
  Clone ID: PAT_TA_26879.pep
DEYISIQNTGIEIWRSFNTVSFKKKKERNMEVLRAWHLPIFLDVLLRTSIACAQRASDPPWKTTRPATTPYLLVIQRERRSQVGAFRRKRRHAGGTAATA

SEQ ID NO: 132462 - protein, 112 aa, Triticum aestivum
  Clone ID: PAT_TA_26880.pep
CVVVHTKYARSVLLASFTWMVVARTKISQLALFRVLCDYTSSDKVILIYLEQKRVNEILHGASWKVGISWSWITRTLQTKQESSHFFDKGHFIQLIYRGDTNKNHHMPSLFW

SEQ ID NO: 132463 - protein, 156 aa, Triticum aestivum
  Clone ID: PAT_TA_26881.pep
DVEVCTRHWSGNERTTRGETLIDHELMSVILRRYSQIDRQYDPECPYLTWRHPIEPDFPTLVLAEYDFLHTVSIQNQLVADSLKYDLTSVELFYTPVPRPEGWMAVFFNMLTRVIWVIDPLYHNKLACPPTGQRDEIIAWKLHDALFTCLNEFYTG

SEQ ID NO: 132464 - protein, 90 aa, Triticum aestivum
  Clone ID: PAT_TA_26882.pep
KRDDHRTDHTFSSSDPMDLSNGSPVISDPMSMSQSLMGVLPSNMMPFSVRPGGYSGAGGAGVNVSRRKIEEVLVSGLLDAMKSSSPRKKH

SEQ ID NO: 132465 - protein, 322 aa, Triticum aestivum
  unsure (1)..(322): unsure at all Xaa locations
  Clone ID: PAT_TA_26883.pep
AFARKLLASPILVEALHFQYDERDPNSAFNWLERWTISRVWKPVYQTKRNAIADAKPQTKRASYAMETESGKLKRNARKSSALSVEPIPLTNMPLETEKTRRTPRKFTSTPADSVPDSQLTELEKVKRSLRKVTNSMAEASKVSSPACDTPDHPEIECEKPQCTAQEVPVYPEIQEPNHDDQLENAKVDIFVPDLKPEGEVTPYAVTSEEKLDEPAVVATAAEVMPLQDIDNEENALVNDAEQRSREEPLSAESLKGGNRKXSFSTKPEYPENGSKNSPAVPSYMAATKSAKAKLRXQISPRLSADSAEKLSTXRXHSLPFP

SEQ ID NO: 132466 - protein, 211 aa, Triticum aestivum
  Clone ID: PAT_TA_26884.pep
MGKSPAKWLKSVLFGKKTSRSGSAKAKDLSKAGSNRGYVAGGKEPGFSESSPVISEPVLVTPRNNDAVPEVGKGENSSSQGEAAVQHEVNHDLEKQSTAGSDVLSNDPERLKEEQAAVKAQAAFRGYLARRAFRALKGIIRLQALIRGHLVRRQAASTLRATWLIVKFQAIVRGRNVRLSSDAIQFSWKLAEQKSVGAKPDAWRERLASNA

SEQ ID NO: 132467 - protein, 376 aa, Triticum aestivum
  unsure (1)..(376): unsure at all Xaa locations
  Clone ID: PAT_TA_26885.pep
MKSEIPIQGSKRLESYRIWRGWKPVDLTKGILISASMTQTQRARYATETESGKLKRNLWKMSALRLERIPLTNMQLQAERTTRPARRFTTAPEPTGPGNLVTELENVMRNHWHVLKATTGPMVVSDPPGVDKDKRKLGKVTHYLPEPTNPDNPETDTPDHPEIQCEKPQRTAQEVPVYPEIHEPHHDDLLENAKVDIFVPDLKPEVDVTPYAVTSEEKLNEPTVVATAAEVMPLQDIDNEENALVNDAEQRSREEPLSAESLKGGNRRSSFSTKPEYPENGSKNSPXVPSYMAATKSAKAKLRGQISPRLSADSAEKTVYTRRHSLPSPANGKQNSHSPRTQRPIHPGTKEGAKVDKSMLSSRDAAERPMKAEWRR

SEQ ID NO: 132468 - protein, 132 aa, Triticum aestivum
  Clone ID: PAT_TA_26886.pep
PTYTTVGAFQLPPQFLRYVTPVWCDSVTPIKSMTCARIASLIEMPHVDPLNTVTTGMKQLNKFYAPSVNDRTTFSCAQSCHTRIETDHPSINGDLIHHLAPFCQASPDGAAALGTSRVAKLVQPCTALLRTV

SEQ ID NO: 132469 - protein, 104 aa, Triticum aestivum
  Clone ID: PAT_TA_26887.pep
YCSRVDHRELMDHVFSESYRPMIPESGQHHENFFADFADLAELESDPMSLIFSKEYMEARPSGGAGDHGGQEKAVAKELDPFDMLDWSTTSSTAGSTFEQGKRG

SEQ ID NO: 132470 - protein, 86 aa, Triticum aestivum
  Clone ID: PAT_TA_26888.pep
LSWVCLSHDIHLPTLFRHSRMVGASTRIVVRSCCSLEVITVIRQAALLVGVGHDLVPWAKEVSHDGSNLERMIKEKNIKYNLKMRS

SEQ ID NO: 132471 - protein, 210 aa, Triticum aestivum
  Clone ID: PAT_TA_26889.pep
SGAMSPGFDTVERPTAQSALTQQRHTPAAEGIPVDVIMSDRTPLPGLNSLGTPYTAVSNKENVNNIDSANIDSAIGSSQLTVLRPPLQSYRGSSSYANEDCDWLHTNDTYQRQSFGTRMRPDNILTAPSCGHNPVDKYNGALIDYCLVHTLITEGPQNMLLDAVITNDGDTIPESTELPSDDESSEILNNNEVEENNCTESPEYTPILEE

SEQ ID NO: 132472 - protein, 140 aa, Triticum aestivum
  Clone ID: PAT_TA_26890.pep
TKPGGIVAVRECNYSAMDWYPEHPGMHKWKELYIKIAFGLKAHPNMGRYVHAIALQAGFPRSDIEASVAAWTFSTPEERQWWCGLWADRTVQSDYKQRALDSGYATEQDLEEIAATWREMEKKEDGWFAVINGQVICHVR

SEQ ID NO: 132473 - protein, 84 aa, Triticum aestivum
  unsure (1)..(84): unsure at all Xaa locations
  Clone ID: PAT_TA_26891.pep
RVHEYFXKNDQLTVYKRYRNGMLGPKYNSXWLASDSLSPCYICQEVMTYEKQRGSNDSTYWVLFELIWGATSDSFSAKYGNSIF

SEQ ID NO: 132474 - protein, 182 aa, Triticum aestivum
  Clone ID: PAT_TA_26892.pep
MLRSETRAKPQKDKFTSPNNAKLASTKQEVNKDIRKNNGRPLSQNGSAVMKKQMPRDIKRESATEGSSPPKLYKSSPSTPARTSPPKLRSSPPTPARTSPPRISVPAKANATSSPVSSVPNIKRRVTETVSWDTLPTCLIKSGKAVVRRKTIALIVAAEAQREATAAASLVKGLGIFTEILK

SEQ ID NO: 132475 - protein, 71 aa, Triticum aestivum
  Clone ID: PAT_TA_26893.pep
SFFFFFLYSLFWLIMTVMHRYYAINKIDPTSILPTQRKHATEKLLNREVFVWSNKITAQNILIRVKKDYQI

SEQ ID NO: 132476 - protein, 92 aa, Triticum aestivum
  Clone ID: PAT_TA_26894.pep
LQQLAHSTCKMNQGAQCAQLFDLNVSLILVNQEVKQENKIFLYFAGSTSTWAGGRSRGGRQREARAGRAPLLDYTNISKDPKLSSSTINKLP

SEQ ID NO: 132477 - protein, 118 aa, Triticum aestivum
  Clone ID: PAT_TA_26895.pep
SNSSRSSSFDVTVAAEQGQSSSLNGQHLGGQQQMETTAAADGLASPSSAGNSNIVTIEAELQELLYSATTTTTDSVVTQQGGVDWWSYDQGKSPVNCWDFTPETSSVLQDYAAVVYDM

SEQ ID NO: 132478 - protein, 206 aa, Triticum aestivum
  unsure (1)..(206): unsure at all Xaa locations
  Clone ID: PAT_TA_26896.pep
LPPPSPVRARPPPGPAAPSPLPPLASPPXCAPPSPPXPAPPRVPCRPPGQGRRPPPPPCLPASPVRRPRAARSAPLRLGRAGPPRARRPPPAGAPARPGPGPPPVPRALQAPVRAPPGAGSRPCPPAALPPLPCVFAGLPCSGCTAVRPFRCDRVVPCSACSVSPPWLSFLAQQFLSRITAGRPSMHGSMMMARVLSCYSMFYFYY

SEQ ID NO: 132479 - protein, 414 aa, Triticum aestivum
  unsure (1)..(414): unsure at all Xaa locations
  Clone ID: PAT_TA_26897.pep
PNSFRKIVSSPSMXRLDLISTSQGSPALTESSIFEISXNIWRSSAPTTLSSNFLIGSEVKMAGGAAGEDXVQAVCYEKNGWFICRIYDRFNGRDAADFLAVALYGSIVYYLYLLECRIKQQDGLYSSSEDSLNGVKSXLTLAMEIAENEDVKLSESFRAXGVLNCLTSAVEQAENDFLCMVEQDMDDRPDLVSVGSCVLVVLLQGTDLCILNLGDSRAVLASMPYAEMDTVKATQLTEIHSLENPLEYQKLLADHPNDSKVVMGNKVKGKLKVTRAFGVGYLKQKKFNDALMGILRVRNLCSPPYVYTNPHTLSHKVTEDDLFVVLGSDGLFDFFTNDEVVQLVYQFMHDNPTGDPAKYLIEQVVHKAAKEAALTAEQLMRIPVGSRRKYHDDVTVIVIILGNARRTVSASTSI

SEQ ID NO: 132480 - protein, 79 aa, Triticum aestivum
  Clone ID: PAT_TA_26898.pep
HLTCYGYTTSCPLLLLGSSHPASRVTCHIYLLASRTYSKSPKNPIRSSESGRLPPMAAQQPASRTSPTLVPRPREPARA

SEQ ID NO: 132481 - protein, 70 aa, Triticum aestivum
  Clone ID: PAT_TA_26899.pep
PTSELGSKPSLSPCPSSGSPLPPASASAGDPPPPPAPRPDAAADPRPPPAPPPRPRAPRRRRPGRSWPRA

SEQ ID NO: 132482 - protein, 184 aa, Triticum aestivum
  unsure (1)..(184): unsure at all Xaa locations
  Clone ID: PAT_TA_26900.pep
MVTGDNWATAKSIAKQVGISTVFAEIDPVGKAEQIKDLQTQGLAVAMVGDGVNDSPALAAADVGMAIGAGTDVAIEAADIVLMKSSLVDVITAIDLSRKTLAKIRLNYVWALGYNVLGMPIAAGVLFPFTGIRLXPPWLAGACMAASSVSVVCSSLLLQLYKKPLHVEEVPMTAGPGDGGSNLV

SEQ ID NO: 132483 - protein, 75 aa, Triticum aestivum
  Clone ID: PAT_TA_26901.pep
GGHGGATGSNVTVDPMEADDQESKKNGGGGMSCEQTPASSPFNGLESLNLMDNLNTDGGWKDLLEQVSWLNSSEL

SEQ ID NO: 132484 - protein, 65 aa, Triticum aestivum
  Clone ID: PAT_TA_26902.pep
KRSSNAMRCAMSSSHAISTHFGRSRVCLLFDSCQLFGQFNVCAIMVHCAHYVSAFISARTRISFQ

SEQ ID NO: 132485 - protein, 186 aa, Triticum aestivum
  Clone ID: PAT_TA_26903.pep
LTLTLWFTRDSSFDEDPKLLSFLSQTSLSYEPADQNSYIPLPASDNMYWFSYDQSGFDIRCARMHILGFSFRASSDEDSKSTSAAPADDPIELLGKPLRIGRADDVFGKIFANSLHALQVVQFYYWKAPELASRRNQTTGGSETVCYPTIQVQRSSGTELPLPCNHGLAQTIFGSYGNVDSVIDWG

SEQ ID NO: 132486 - protein, 191 aa, Triticum aestivum
  Clone ID: PAT_TA_26904.pep
WQCSQEYIPCVQDSWCGFWWPRYFSPLCLSLNELVIKNMSSLHTVTIFVTLRYLLVSKVDQRERVLIKRLGPRGVYQCTVQYGYADNLSLKGGDDLVAQVMRCLKRHIAMSTDRRSSVSTEEEIANLEAASLAGVVHVRGKMRFYVGDDAGCFDKVMLRFYEFLHSICRSALPALGMPLQQRVEIGMLYKV

SEQ ID NO: 132487 - protein, 89 aa, Triticum aestivum
  Clone ID: PAT_TA_26905.pep
IPCLSLSFLCENPKISEANRREIAVLLHSQREDGRRCADEEMVCRVCMSPCYRESRSSDISMYVWEFKNAGINQQPVFFHFFHCMILIF

SEQ ID NO: 132488 - protein, 143 aa, Triticum aestivum
  Clone ID: PAT_TA_26906.pep
LAPKTGCHPNKSSPRLVDPKPEPGTPVECQPEQGPEAPEQEQEEEHEQKPVIGLADPAAITTVTAAAEEEEESFDFGWFDQYPTWPRTALYVPAFDVAPPPEDWERELQGEDALFAGLGELPECAIVFGRRRELALAAPAPCS

SEQ ID NO: 132489 - protein, 103 aa, Triticum aestivum
  unsure (1)..(103): unsure at all Xaa locations
  Clone ID: PAT_TA_26907.pep
MPTGAVVIQVVPYGNLEHMAKVDFGDPVADMGLRYLEYSITAEESTLLEMLGPDHPVIKDPESVHRSGWDKVAEYYLGKQDVRVDVXRFAPTLALAIEHLRQK

SEQ ID NO: 132490 - protein, 92 aa, Triticum aestivum
  Clone ID: PAT_TA_26908.pep
MPPFSSFVVLRVLDLELYEYGGAKEDHLNLQELGSLLHLRYLRLFGRRTVELPEEIGKLQFLQVLVLPGRTRLPATVIKLTRLMYLLIDGGR

SEQ ID NO: 132491 - protein, 61 aa, Triticum aestivum
  Clone ID: PAT_TA_26909.pep
ARARSKTANTRRSKQLQSDEQSIDRDGISLIPAMLLVARGVGQLAPDINLDHAVTWRRRSR

SEQ ID NO: 132492 - protein, 87 aa, Triticum aestivum
  Clone ID: PAT_TA_26910.pep
MDSFSSPSMSSSGSPPNPEALMEQIKAQLAQAYAQELLETVGNKCFAKCVTKPGSSMSGSESSCVSRCVDRYIEATGIVGRALFSHR

SEQ ID NO: 132493 - protein, 87 aa, Triticum aestivum
  Clone ID: PAT_TA_26911.pep
MDSFSSPSMSSSGSSPNPEALMEQIKAQLAQAYAQELLETVGNKCFAKCVTKPGSSMSGSESSCVSRCVDRYIEATGIVGRALFSHR

SEQ ID NO: 132494 - protein, 178 aa, Triticum aestivum
  Clone ID: PAT_TA_26912.pep
VPPPQLRRLAFPAIQSWFETLPSWINPSSLPLLSYLEITLFEVRPEVIQFLGTLPALVYLEILDHSVFQEAHEVEAPVLSSNVALFPCATECRFYGIGAVPSMFPRGAAPRLKQLRFALPAKWVSRENIDLGMRHLPSLQRVTVTVSQGEANDQEVDEAKAAVRAAVEDHPNRPVLEI

SEQ ID NO: 132495 - protein, 217 aa, Triticum aestivum
  unsure (1)..(217): unsure at all Xaa locations
  Clone ID: PAT_TA_26913.pep
PWRIHASKSSANQEFMIKKXVGSHTCESETVKSNRLASQKWVASVIKEKLRDSPNYRPRDIANDLQREYGLSLNYSQAWRGKLIARKELYSPHEEACNQLPWFRDRIFATNPGSMATVEALEGSKFRFFVAFHASLHGFENGCRPLLFLDLITVKPNKHWKLLGATSVDGEXGDVFPVALSVVDDESQENWHWFLEQLKASLPMPGDITFISNGRSG

SEQ ID NO: 132496 - protein, 197 aa, Triticum aestivum
  unsure (1)..(197): unsure at all Xaa locations
  Clone ID: PAT_TA_26914.pep
SDQLIPDSSNYDLHRIMGAVPVTAVNFYKLLSEKQFVLLYPGGAREALHRKGEEYRLFWPEQSEFVRMASRFGATIIPFGVVGEDDICDMLLDYNDLMKLPFYDILDKKLNEEGLKLRTDSTGEIKNQDMHPVVLTPKMPGRFYFIFGEPIETKGREKELRDKEKAXHLYLHVKSEVESCIKYLKEKREEDPYRSIL

SEQ ID NO: 132497 - protein, 111 aa, Triticum aestivum
  unsure (1)..(111): unsure at all Xaa locations
  Clone ID: PAT_TA_26915.pep
GTSHTLKFSSDQRRXTFTEEQEQALQLLSSFQHLEFHDCNNLQSLPKVLCGLSSLKRLTIWGCEKILSLPPEEGLPASLEILEVMYCSPEVIEQAEKLAERDPWFSVEIYE

SEQ ID NO: 132498 - protein, 169 aa, Triticum aestivum
  Clone ID: PAT_TA_26916.pep
MATHPNFHTTPFGGSVQMTEFKFSSLYWRHIYSGPSPNQSNIIAADATTEWGQTLANNWTIYDGVGLNAKLVARAQGLHLYAGTWHNTFTIVFEIEGFKESTLQVIGASVEKEGEWSIVGGTGEFAMARGVVNKKLHGNIDGGDIIELTIHGFCRKQIALTKVGPWGGN

SEQ ID NO: 132499 - protein, 142 aa, Triticum aestivum
  unsure (1)..(142): unsure at all Xaa locations
  Clone ID: PAT_TA_26917.pep
FFMQAKSIXCPSDPLIYNELGVVAYNMKEYQNAVQWFELTLTHTSSSPNEMWEPTMVNLGHTLRKLKQYKKAISYYEKALTFPTKTLSAFSGLAYTYQLMDDFEAAITYYHKALWLKPDDQFCTDMLTLALETSCQSTARRK

SEQ ID NO: 132500 - protein, 111 aa, Triticum aestivum
  Clone ID: PAT_TA_26918.pep
ERLDDTVRVFCGDDFDRSHIIKHNNQTGRWISTFKAIWGWNDTDLFIGNMRRAIDIISVGGDDSSLSASNSASLESEHMTAIPCRFSAHPYKVGHLACASSGGKVFFWTRA

SEQ ID NO: 132501 - protein, 189 aa, Triticum aestivum
  unsure (1)..(189): unsure at all Xaa locations
  Clone ID: PAT_TA_26919.pep
PLIGGHGNLRTVVLAHGSTXKNTVVRGAPVVITSLDDLAPPPLLQRFEFSLHRSCIFSRIPPWVKKHENLSILKIAVKELQMICVGILRGLPALTALSLYVETAPVDKIILDMVGFSVLKYFKLRFLTGIAWLKFEEDSMPNLSKLKLVFNAIPQIDEYEHGIISIGHMPGLRDITVRFGGIAGGSEYD

SEQ ID NO: 132502 - protein, 180 aa, Triticum aestivum
  unsure (1)..(180): unsure at all Xaa locations
  Clone ID: PAT_TA_26920.pep
LRHAYSLPRDRPIKLGDVRPPGGRRRRPRMIILERTNSRKILNLPEVVAAAEAAGFKVTVAGRPKASYDEFTREMNSFDVMVGVHGAGLTNCVYLPTGAVFLQIVPYGRLEEIARTDFGDPARDMGLRYIEYSVAAEESSLMGVFGKEHPMIKDPAAIHLSGWGNVAXEWYLGKQDVRIN

SEQ ID NO: 132503 - protein, 63 aa, Triticum aestivum
  Clone ID: PAT_TA_26921.pep
GCCTHRCPKFAVISRFEYAGSTIISCDCLVKNIVYKLACLLMQINREPKYHCNRKLYACIISL

SEQ ID NO: 132504 - protein, 53 aa, Triticum aestivum
  Clone ID: PAT_TA_26922.pep
LIGTMRYDIKKDIGGVIEERAREKQVWEMVGTLVGNALNTMPYLVDYQPPPTA

SEQ ID NO: 132505 - protein, 177 aa, Triticum aestivum
  Clone ID: PAT_TA_26923.pep
NPCTGHRRSGSGSHDDRFFFCCCRCLSFLPSSGPSPPTSPPSFSPSGALGVAVRTSRRSTRRRPTAPAEDLCIDRTYWEQPPRRRLLLLLLPRRGRQGRAPLGRRRRVLGAGWVVVREARGLGQPLVIRQRHDLLLLRRALPVRAGLTAADAVHEQQLVVALRPRLLPPRATPLASA

SEQ ID NO: 132506 - protein, 160 aa, Triticum aestivum
  Clone ID: PAT_TA_26924.pep
RCQTKLLAMLFESHESDLQKLFTLTSQIKDQNKDTGSNDCKNNINVGSVPQGPVVLEEASFYYKAPVNKNFSKKDWTVCCCYAPSLPSSKRSRSSDKSNTARQRVWPSLRPNLTKLCYTYIMRERRCVHRNTQANQMTRCLEQANHSQLHSLVLCCIKAV

SEQ ID NO: 132507 - protein, 99 aa, Triticum aestivum
  Clone ID: PAT_TA_26925.pep
CLVQDQDTDMLLLLLWPNCSLAPKAIGIQDMLFCPAEFLCSYALGVGQLEMLSDKENPGSKISWIVRNLGYTFQFMFCFLLSQGPAMLTVWQHCTSKAV

SEQ ID NO: 132508 - protein, 347 aa, Triticum aestivum
  Clone ID: PAT_TA_26926.pep
MAGILAWAADVVGGAGDSDDEAAAERERAAAMTPEQRLRAADLDARASSLRRAIQDLRARVPPPNVAQRLPHLHAHSLASSAALALQLNAHSSTKEQALHREVKIQEENTAYEKAISDCRPRIQEKQMEAAVLQSNLKEMEIAELDLKAKVDNAIMEQEAAQHKASMAASEATGNALLEAESLMNLKSKDLEEKKGELKLLEDKIQRLEKVWSSVEEESLKNPSPAQREKVLEKQLHSLIEQLTAKQAQAERLITDIHAKEKDLERLNSIQRNLHSGSSEAGAARNRFGGGLLSGDEDSGSKAARRPGQSGGFRTEGQKRLMILRSAFVLYILVLHVVVFIKISVSN

SEQ ID NO: 132509 - protein, 84 aa, Triticum aestivum
  Clone ID: PAT_TA_26927.pep
FVDRRFVRFASGFSLAYAMLWSYMALLFASGYFVCVLVLVMCVLIMQRPCMFSSCLYQLDALFRVNKIHPLSKNASPWIDTETQ

SEQ ID NO: 132510 - protein, 78 aa, Triticum aestivum
  Clone ID: PAT_TA_26928.pep
ANGETEIAIRVSGSFITGNQFLIFGEGLQAEGMPSLEEIDIDIPSKRVGQFREQFTVHPGTSMGCYYIAKQDLYIVQS

SEQ ID NO: 132511 - protein, 159 aa, Triticum aestivum
  Clone ID: PAT_TA_26929.pep
SAAEVRRKVREDKPVTSPGNACRYVAPEVLRKEEYDNKVDVFSFALILQEMIEGCLPFQDKKIDEIEKAHSSKERPPFRAPAKHYAYGLRELIEKCWSENPADRPNFRVVIDRLSAIQIELARRNRWKVRPLKCFLSFEGLRKKDRNEGSTNRSSRSSR

SEQ ID NO: 132512 - protein, 139 aa, Triticum aestivum
  Clone ID: PAT_TA_26930.pep
MGRGKIAIERIDNATNRQVTFSKRRGGLMKKARELAILCDADLALIVFSSTGRLYDFASSSGMEAILERYQEAKQEHCGVLNPTSEAKLWQREVTTLRQQVQNLQHNNRQLLGEELSGSTVRDLQFLVNQVEMSLHSVR

SEQ ID NO: 132513 - protein, 82 aa, Triticum aestivum
  Clone ID: PAT_TA_26931.pep
NVIWMMALPFTLPSHDMSMYIQCALSLENNSSCCKFLLKFLPKITMLQPLVPGNCSGEEPIYQFQNQHFWVAYFVMCSTVWN

SEQ ID NO: 132514 - protein, 105 aa, Triticum aestivum
  Clone ID: PAT_TA_26932.pep
RERAYNLFRIGLFLFKATWDCIQDGLVSIQSDLGSQLLGDMLGDPYFLDASERVHSKKPSSLFHQCLRRSCWSLGIAPCSNSTNLMFPPTESSSTTRLRNASATK

SEQ ID NO: 132515 - protein, 116 aa, Triticum aestivum
  Clone ID: PAT_TA_26933.pep
SSKLEEKIHAQELEKNNMQAKSTGMEEAELRQLRKSLNFKAAPMPSPYQEPPAPKAGSQKDPTPSRHSSKYQSSKTTTSAEPPLKGLPKRPQGSTCLDEVPTEISPQIAVRADRFC

SEQ ID NO: 132516 - protein, 151 aa, Triticum aestivum
  Clone ID: PAT_TA_26934.pep
MAHERRGAAAASAAAHDAAGEALFVDVVHEAPLSGQRQPRSIVGGTLYCILLAGYAGVVIAAPWIFVLIPDMILPLLCSCNVLLLIITGIFQQYWVHQVTKVRLQGYYDLSQKLKRIARVPFAAIACGTALLLLILVWQPQVEVLSISVLL

SEQ ID NO: 132517 - protein, 191 aa, Triticum aestivum
  Clone ID: PAT_TA_26935.pep
MSRSVDLTDNFRQPVSSTVQPSRVSPRKMPSASSGSANGNGSQEENASSSPDAPSNNSERFAPPKQLARTLSSPSRGLLRPSSPTKASSTSSLASRRLPSPLRIRPSTPVSPCSSGRSDSPSSLLSYIGDATRGKKSPSHMEDAHQLRLLYNRNLQWRFTNAYVDEMLSIQKMGAETMLYSVWDSNSKMSD

SEQ ID NO: 132518 - protein, 81 aa, Triticum aestivum
  Clone ID: PAT_TA_26936.pep
SSGVKLRETRKEWRYGFSGESRSFALLPDSSLSLIALKDCSSSSASDVMRDMRELVEATVLDYIAGLTAWPVLSLRSDLPV

SEQ ID NO: 132519 - protein, 131 aa, Triticum aestivum
  Clone ID: PAT_TA_26937.pep
LCMYANKSPHQTSLDDFFWKPTSLDELNQNKITGYDSEGFGFLEALNLFHFFLEKTQKTLRFISLNRKRTTVQVQPPRTTVQVQPPRRRDAHTHHRPHRTSRAHRINENTCRRRVHYFCSSSSALSCLSNG

SEQ ID NO: 132520 - protein, 172 aa, Triticum aestivum
  Clone ID: PAT_TA_26938.pep
LLTGPFRAIVANGCIGFVLNLHDGSQDQKKANQSQILVDLYDPTTKYDELISTKLDTGYGPAEVRYAVLSNAIECDVEVKLVLGDDSAPAYAHGTITACSELLKQDIVLFDGEIMDATSPELILPLARSVLAAPLKWSLKIEVVLRGSSGEELARDHVMFYPVLDDEHVSHA

SEQ ID NO: 132521 - protein, 49 aa, Triticum aestivum
  Clone ID: PAT_TA_26939.pep
ENKINVETFKHTEPACQFCCLWIYVCLINHKVLFSKCILYRRWHTIHIF

SEQ ID NO: 132522 - protein, 72 aa, Triticum aestivum
  Clone ID: PAT_TA_26940.pep
PNVCMTRWSRKEIVSFHQLEKLPTFQNCNLMKIGVYLNKFTLLGHITYTHLLKSTLAHVELKPSLVPCITCR

SEQ ID NO: 132523 - protein, 57 aa, Triticum aestivum
  Clone ID: PAT_TA_26941.pep
AGAPIYLAAVPQYLAADALELAGNAASARDNKKTHIMHRHIQLAVRNGEELYISCWL

SEQ ID NO: 132524 - protein, 64 aa, Triticum aestivum
  Clone ID: PAT_TA_26942.pep
SLSTGYSICFMNSFCSLFEFLLLFWFLRAIWVSVVVLFFASNSSFYCCGTLSSLRVTWTLQERR

SEQ ID NO: 132525 - protein, 300 aa, Triticum aestivum
  Clone ID: PAT_TA_26943.pep
MAAARPALPSSPTSLLLARSTSAPDLAARRPRRWLVAAAGVPAVAGALAASASTPAASMLLRDGGATLLVTAGAYSLVRAFDALTERRLVQQSLSRKVVHVLSGVFFMASWPLFSNSTSARFFAAVVPFLNCVRLLTYGLGFYSDEALVKSVTREGKREELLRGPLYYVIVLLIIVLVFWRDSPIGIVSLSMMSGGDGFADIVGRRFGSLKLPFNKKKSWVGSAAMFISGFLLSALMLSYFSWLGYIHVSWDQALGKLVLVALAATVVECIPVTDVVDDNISVPLATMLVAFLLFGNTAN

SEQ ID NO: 132526 - protein, 87 aa, Triticum aestivum
  unsure (1)..(87): unsure at all Xaa locations
  Clone ID: PAT_TA_26944.pep
HILLTEVRVPSPQLVEKQKAHVAHQDQTQPXTSSSSSSFMLRDAPPAANTSIHSAATGERAEDAVVQQQAPLRIGGLPPWMLSHLNA

SEQ ID NO: 132527 - protein, 275 aa, Triticum aestivum
  Clone ID: PAT_TA_26945.pep
GRVGGKVQLKRIENKINRQVTFSKRRNGLLKKAHEISVLCDAEVAVIVFSPKGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAAASRQQQQQQQQMQWEHQAQTQTHAHTQNQPQAQTSSSSSSFMMRDQQAHAPQQNICSYPPVTMGGEAAAAAAAPGQQAQLRIGGLPPWMLSHLNA

SEQ ID NO: 132528 - protein, 275 aa, Triticum aestivum
  unsure (1)..(275): unsure at all Xaa locations
  Clone ID: PAT_TA_26946.pep
MGRGKVQLKRIENKINRQVTFSKRRNGLLKKAHEISVLCDAEVAVIVFSPKGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAAASRQQQQXQQQMQGEHQAQTQTHAHTQNQPXQAQTSSSSSSFMMRDQQAHAPQQNICSYPPVTMGGEAATAAAAPGQQAQLRIGGLPPWMLSHLNA

SEQ ID NO: 132529 - protein, 218 aa, Triticum aestivum
  unsure (1)..(218): unsure at all Xaa locations
  Clone ID: PAT_TA_26947.pep
MGRGPVQLRRIENKINRQVTFSKRRSGLLKKAHEISVLCDAEVALIVFSTKGKLYEYSSQDSSMDVILERYQRYSFEERAVLDPSIGNQANWGDEYGSLKIKLDALQKSQRQLLGEQLDPLTTKELQQLEQQLDSSLKHIRSRKNQLLFESISELQKKEKSLKDQNGVLQKHLVETEKEXXNVXSNIHHQXQLNGATXINHQEQLNGATTXSPSPTPA

SEQ ID NO: 132530 - protein, 244 aa, Triticum aestivum
  Clone ID: PAT_TA_26948.pep
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAQAAQQDQTQPQTSSSSSSFMMRDAPPAAATSIHPAAAGERAGDAAVQPQAPPRTGLPLWMVSHING

SEQ ID NO: 132531 - protein, 244 aa, Triticum aestivum
  Clone ID: PAT_TA_26949.pep
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHGAQQDQTQPQTSSSSSSFMLRDAPPAANTSIHPAATGERAEDAAVQPQAPPRTGLPLWMVSHING

SEQ ID NO: 132532 - protein, 115 aa, Triticum aestivum
  Clone ID: PAT_TA_26950.pep
HRSYGSCDRDAMERRLGSGSCDGDAIELRRSRNGASPDIVGATLQLLSRCLVRHESCKGASLGCHQCSAVRCAAAIGRPQIRQLARREVIRLRIIRGSSHEPTKISLCKSNTLAV

SEQ ID NO: 132533 - protein, 70 aa, Triticum aestivum
  Clone ID: PAT_TA_26951.pep
DTYHSGCNSKNQPLLTSKPPLQGFYYLVQMPCMVQQAQLSAVCDSLMAVPATYDIPFYNYFLPSAMFHAG

SEQ ID NO: 132534 - protein, 106 aa, Triticum aestivum
  Clone ID: PAT_TA_26952.pep
MRNVRKPGTGTHTPERRPSSEAQGQHTPGRGRTRQSNQSYNPDDEVAVPPFGEWDEANAASGEKYTGIFNRVRDDKLSPDSSARQQSSGNRKDENKVQQTCPCCIL

SEQ ID NO: 132535 - protein, 175 aa, Triticum aestivum
  unsure (1)..(175): unsure at all Xaa locations
  Clone ID: PAT_TA_26953.pep
PPRPRPRRPQRPRPPWPRRPXAPPASPAPRSPCSPPCLLWPGRPSSRAAPSPSGSPRAPRPTPGSCARRPPRPSRSPAPSPPAAPGFSPRGTRTPPCCPRFRSARSPCGCPPPPPARARSWPPAPPSTPSPPAPRGLPPRRRPSSGRSSRRSPRSRSWPRSPSPPGSPTPGRPSC

SEQ ID NO: 132536 - protein, 185 aa, Triticum aestivum
  Clone ID: PAT_TA_26954.pep
MPLDTSTYSLALLRVDGRRWNELRRLHAQIRTQDAADGSSYLEMGHTKVMCVVTGPSEQQQKRGGQQAPRDMAAINVNVVVAGFSSVDRKKRGRNDKRIQEIETTIENALASNLHTHLFPHSSISISLHVLSQDGSLLAALLNATTLALIDAGFPMTDYIAACTAGSTSTYAAGDDSADPLLDLN

SEQ ID NO: 132537 - protein, 132 aa, Triticum aestivum
  Clone ID: PAT_TA_26955.pep
LVEMWRLRSVAAGHNLSIAWQLPQFMLIACSDVFCGIAQLEFFYSEAPMSMRSLCSAFSFLAMSLGYYLNSMIISAIAALSKSGGGQGWLPADLNDGHLDYYFWLWAGIGAVNFVVYTAFAKNYTVKKVELR

SEQ ID NO: 132538 - protein, 566 aa, Triticum aestivum
  Clone ID: PAT_TA_26956.pep
MDAEAGEAPLLSHQHSPNQVPSANHNGKPFNWKAPAIILAFEFLESIAYAGIALNLVVYLGKVLHGTTASNAANVDTWNGTTFLTPVLGAFLADTYWGKYKTVAISIIFYLTGLLIITASAIIPSLQPAACEGTSCPPATGFQNFVFFTALYLVSVGTGGVKSALLPLGADQYDDSNLEQSKKKQAFFSWFFIAINLGVFISGTVVVWIQQNVAWSLGFGISSICLIIATVAFLAGTPIYRVQLPTGSPLKSLVAVFVASFKKRKVEVPADSSILFDGNETDLTNEAPNKLAHTEGFRCLDKAAVVLGDQEIKESLSGRPWMLCTVTQVEEVKILVRMLPIWFTSVFYAASMCQTATTFIQQGNKMNTKIGSFSVPPASMNSASVVFMMIFVVIQDSIVIPMARRYTGNVAGLTQLQRMGVGRFLAVPALAAAALVEMWRLRSIRAGHNLSIAWQLPQFMLIACSDVFCGIAQLEFFYSEAPMSMRSLCSAFSFLAMSLGYYLNSMIISAIAALTKGGGGRGWLPADLNDGHLDYYFWLWAGIGAVNFVVYTAFAKNYTVKKVELR

SEQ ID NO: 132539 - protein, 110 aa, Triticum aestivum
  Clone ID: PAT_TA_26957.pep
VRREAAASTPPVLGRWCRASAAGVRQSRWEAAAPLSPELQILGGSSSKVFLWNMDNFNMDTKPEEHTNFPTDIRFRPNSTQLATSSSDGTVQLWNVVEAFSSTFSICVSH

SEQ ID NO: 132540 - protein, 71 aa, Triticum aestivum
  Clone ID: PAT_TA_26958.pep
GAIDKKSREQFSTHVKKVFVVKKAETHELAKKFFWLKRLRVLGAQYEVNISFKTRLDKMIGCSKGGGLLRQ

SEQ ID NO: 132541 - protein, 491 aa, Triticum aestivum
  unsure (1)..(491): unsure at all Xaa locations
  Clone ID: PAT_TA_26959.pep
MATTDAPAAAPAAPAPAPAVSLDQTKAKNLLHQVEFYFSDSNLPRYGFLRKTMEESEDGLVCLALICPFTKMRSHLXADGDGVVVRGDLDTLDRVSEEAAKDCCRRIKGGRGRFNNNYRXQRGRKGLEDQQRCGQKARPVVGSRLVATMSNINGLTKSRRTAXSLDSLDRHIASFSPSEETKIRLRCLPAAASTALEAAVLVYWFKFYLCFLWSERRVXEPGCQLMKSRKTLNKNGLDAGYPAGLILSFKLKSILADGDTVLKGGDKGDDCFSSXRPIQADGDTEQNGGDKVDNSDDAKKEGASDSSEESGKASEEKAPENTDAKEEKSADAEELKGSDAQSVKKDDKSLSENDKEPVSREDFKEYFAKFGTVRYVDFSKGDISGYLRFEESTAAEKARAFAALADEGGLVMKGHLVTLEPVSGQAEKDYWSGIKGGQGRFNNNNRSNRGGRDWKNNRGGGGRHHGGGKRGGRHSDNHERANKVQKLDSSP

SEQ ID NO: 132542 - protein, 163 aa, Triticum aestivum
  Clone ID: PAT_TA_26960.pep
QICHPLWRVKKPELVLPAQATPHETLALSDVDDAIDLRFLQPAIEFFRAVDIDIDDHGLGRPATAAKVVKAALAKALVHYYPLAGRLREAAGGKLAVECTGEGVVFVEAEADVSMDELGKPSPLPPYPCVEELLCEVGDPRVVLGVPLFFMQEALDFRWAKRV

SEQ ID NO: 132543 - protein, 82 aa, Triticum aestivum
  Clone ID: PAT_TA_26961.pep
ACEEDFRGRSYYDYDKRLRFDLHCIEKQVQELQANKRQSFEKDVRFLLSSFFHKICCRLLFCMVVGFVIGMSYRPFVQFCLR

SEQ ID NO: 132544 - protein, 152 aa, Triticum aestivum; identical to SEQ ID NO: 126264
  Clone ID: PAT_TA_26962.pep

SEQ ID NO: 132545 - protein, 221 aa, Triticum aestivum
  Clone ID: PAT_TA_26963.pep
PHLLLLAALLQQLSATSAGDVATGRGGEKVHVAIYYESLCPYSVRFVANHLFKAYRDGLLDAANLTLVPYGNAVVRNDGTISCQHGPEECLLNTVEACAIDAWPDVKVHLGFIYCVSDLVLKNKHREWESCFQKQGLDPKPVTECYKGERGHNLSLEYGRQTAELVPPHQFVPWVVVDGKPLYNDYGNFKAYICKAYKGYPLLEACRSLGLEAHDDVYGRL

SEQ ID NO: 132546 - protein, 274 aa, Triticum aestivum
  unsure (1)..(274): unsure at all Xaa locations
  Clone ID: PAT_TA_26964.pep
MGEHHGARPPPSPAPRSAPPAPFGHLRGDGRRRRHWQGRRQRGRGDLHHLLLLAALLQLLSTTSSATAGDVALGSANQKVLLEVNYQALCPYGVRLVASHRLQANADVLLDAAAFTPVPSGDANVDGRGAGTCXHGPEVCLLSTVXACASNRAAGRERCASASVYYVSDLVMEPTSSREWGKSCFQKQGLDPRPVTECYKGERGHNLSLEYGKQTAALVPPHQFVPWVVVDGKPLYNDYGNFKAYVCKAYKGYPLLEACRSLGLEADNNVYGPL

SEQ ID NO: 132547 - protein, 38 aa, Triticum aestivum
  Clone ID: PAT_TA_26965.pep
QPLSFEVTGGKGRTITMYNVAPSDWMFAQTFAGKQFVE

SEQ ID NO: 132548 - protein, 58 aa, Triticum aestivum
  Clone ID: PAT_TA_26966.pep
ESPDAPPSESLSQLTYGMNTAQASRLFYQTCVLATLDRIKVTQVEPYGPILISRGANM

SEQ ID NO: 132549 - protein, 213 aa, Triticum aestivum
  unsure (1)..(213): unsure at all Xaa locations
  Clone ID: PAT_TA_26967.pep
GLRNSDEAFLRLTGPSRAILACNPVTFEVELKTVYPGAEPDPQGALLSCVYDWRAVQDTTPMFLGYACSAQLSLEQLPRAIQATIMGVHIVDGSWPPKYGCRVSCSLSAPDDPTPREVLLLDCSRSDAEKKXPVGSDGYFGLARNVVSAELQSTLKVVIQAQSWRHGGAQGHVEFPVQQYCQTSKGSCVVGMCKVEVVVAWSLLVENKLNLML

SEQ ID NO: 132550 - protein, 197 aa, Triticum aestivum
  Clone ID: PAT_TA_26968.pep
WLSSLSCVDSWHRSFEKGVSIPASEPKHRRHHQEGCEADDGGEESPALAALYLYGDVLESVVERVPAPDLAAAAGVSREWLRAVRSALRRRPRRLPWLVVHLHGRRRRTAAYDPHSGAWLTVQAPRHATPSHVRLLRGARGDRVCALSCSGLDVAGDPLGTSACVAMKAPGVWRVDPVLAAVGDRVVALGGACQLAL

SEQ ID NO: 132551 - protein, 483 aa, Triticum aestivum
  unsure (1)..(483): unsure at all Xaa locations
  Clone ID: PAT_TA_26969.pep
HEEDEEEKWSKELDGFTPPGVGYGSITEETLERMRKEKLSKAERKRRAREAKQAEAREDSAVVCARCHSLRNYGHVKNDRADNLIPDFDFDRFISSRLMKRSAGTPVIVMVVDCADFDGSFPKRAAKSLFRALEGRGNSKXLLLSSGVSWDVNSTDIAVSGLGWYSLGLKGNATVAVHTFDGIDVTQRDAMILHRAKFLERPRFLLPIAIANAIGEETRKYSERXLPNACAMTPAATITTLTEAAVPGTTLGILRMTGVLPEMYDTSEWGPGLLHPYIMSMRLNTEERKMVEIRKELRPRTFRVKAGQSVHIGGLTRLDLLEASVQTIYVTVWASANISLHLGKTENAEELRDKHVGIRLQPPVAAERATELGQWTERRIDVSGVSWDVNSTDIAVSGLGWYSLGLKGNATVAVHTFDGIDVTQRDAMILHRAKFLERPGFLLPISIANAIGEETRKKNERLNAQQQSDGEDDDDDLSDDESA

SEQ ID NO: 132552 - protein, 50 aa, Triticum aestivum
  Clone ID: PAT_TA_26970.pep
QYFIQNYYMVRKLVCKIFLTQRSYGSTTCPAQPRAEHTLRHLCHANGISQ

SEQ ID NO: 132553 - protein, 250 aa, Triticum aestivum
  unsure (1)..(250): unsure at all Xaa locations
  Clone ID: PAT_TA_26971.pep
MALVFCVPVAALRALWLGLGTTAGAAHAAAFSLLLAACFFSFLCAAAADPGSVPSAFSPDAEDPQGTGTEXRYCDKCCIHKPARTHHCKVCKRCILKMVHHCVWXINNCVGYANYKAFIICVLNATIGSLYSSVIFVCDLLRTEHDFSILYVKIIHILAGVVLFSLCLTIGSLLCWHIYLICHNMTTIEYREAVRAKWLAKKSGQKYRHRFDQGTRKNIQMIMGPNVFCWLCPTATGHLKDGTEFQNTNN

SEQ ID NO: 132554 - protein, 103 aa, Triticum aestivum
  unsure (1)..(103): unsure at all Xaa locations
  Clone ID: PAT_TA_26972.pep
PXTHGSARGARAALSGTTTWTALMASYSSLASPVIRPAWITSPLRRKPTWHRRQGQARPVPLPLLLFLPVLPSCGRTRHAYPSLNISHIEPTYAVRCTQAADF

SEQ ID NO: 132555 - protein, 128 aa, Triticum aestivum
  Clone ID: PAT_TA_26973.pep
PASSRWQVRELLDRASLPERERTTRAGSTEGSRGTGVDFARSSVGLCERTDSTLRVGGGRIRRLWPHQWSWRLDPVAEAALGAEGRPDPAMTADGEGERKGGGWRRRWCRGMRPEKVVAAPPEKVGRV

SEQ ID NO: 132556 - protein, 136 aa, Triticum aestivum
  Clone ID: PAT_TA_26974.pep
MDFLEPTLALDETHYQEGYTNGYDDGLVSGKEEARQVGLKNGFQAGEELGFYQGCLDVWMSVIRLDQDAFSARVRKYMEQLAALVSNYPLSDPEDEQLQGMMREIRLKFSVITGSLGAKLGYEGRPTSSEQDIEDM

SEQ ID NO: 132557 - protein, 56 aa, Triticum aestivum
  Clone ID: PAT_TA_26975.pep
PGIKFGEVGKVLGEKWKALNEKQRTPYEAKAAADKKRYEEEKAAYQNAEEEEEESE

SEQ ID NO: 132558 - protein, 318 aa, Triticum aestivum
  Clone ID: PAT_TA_26976.pep
EQHAQLYAHILITADLKQGKPPSKAAMLRAFGQPVEGQKHAWEEVWRAAVDRYQNQMSPLGFETPFSSQNGPLEPSPNSMKNFEEFELKEAHSELVDAQTSKWQNQKSPMTGFETPIKSVIGNCAAQGLDVQNGGEVQLAVSCADKLDQEPPDDRKIKNTIYGGLESRCGSTPSESSESLTEQDSCVKCGKDGQLLKCSSCFLAAHATCFGSSVTFDDSGHFDCPVCYCRKAAKALEKAKKTYSEARKKLSVFCSGWKQFSKEHSELMNGFHTAKKQGNHQSEAAELCRKDGEPSHLKENGTSDACPENAVTTKTTIF

SEQ ID NO: 132559 - protein, 184 aa, Triticum aestivum
  unsure (1)..(184): unsure at all Xaa locations
  Clone ID: PAT_TA_26977.pep
DPSMXRWGPTRRLKPDAGVSTWGVAPGRAGAEQLXLFGAKREGEGAKNKVVIQAWEVDGDTLDLPPGAGHDAMPSEMSARLFPHDEDEEDDGETLPSIAVCGNATGGYVYNSAEPANGAVLYELQEGKTGGAVERWEWVPCAPSVRAEPLGRVILACSPVGLDELELSRGLSPLGPQRACADVQ

SEQ ID NO: 132560 - protein, 88 aa, Triticum aestivum
  Clone ID: PAT_TA_26978.pep
NHSFLICSCMPAKLSGKKKKGSNAYFTEQQSTCFMFVSTSKICARLSLCLRVCARACVCGLFKEPYVLMCAAHHGHVCRSSITLLSET

SEQ ID NO: 132561 - protein, 226 aa, Triticum aestivum
  unsure (1)..(226): unsure at all Xaa locations
  Clone ID: PAT_TA_26979.pep
MASQGVASMFALALLLGAFASIPQSVESIGVCYGMSANNLPAASTVVSMFKSNGINSMRLYAPDQAALQAVGGTGVNVVVGAPNDVLSNLAASPAAAASWVRSNIQAYPKVSFRYVCVGNEVAGGATQNLVPAMKNVQGALASAGLGHIKVTTSVSQAILGVYSPPSAGSFTGEADAFMGPVVQFLARTGAPLMXNIYPYLAWAYNPSAMDMSYALFTASGHRGPG

SEQ ID NO: 132562 - protein, 320 aa, Triticum aestivum
  Clone ID: PAT_TA_26980.pep
LTKVTCTLRAGVESIGVCYGMSANNLPAASTVVSMFKSNGINSMRLYAPDQAALQAVGGTGVNVVVGAPNDVLSNLAASPAAAASWVRSNIQAYPKVSFRYVCVGNEVAGGATQNLVPAMKNVQGALASAGLGHIKVTTSVSQAILGVYSPPSAGSFTGEADAFMGPVVQFLARTGAPLMANIYPYLAWAYNPSAMDMSYALFTASGTVVQDGSYGYQNLFDTTVDAFYTAMAKHGGSNVKLVVSESGWPSGGGTAATPANARIYNQYLINHVGRGTPRHPGAIETYVFSMFNENQKDSGVEQNWGLFYPNMQHVYPISF

SEQ ID NO: 132563 - protein, 334 aa, Triticum aestivum
  unsure (1)..(334): unsure at all Xaa locations
  Clone ID: PAT_TA_26981.pep
MASQGVASMFALALLLGAFASIPQSVESIGVCYGMSANNLPAASTVVSMFKSNGINSMRLYAPDQAALQAVGGTGVNVVVGAPNDVLSNLAASPAAAASWVRSNIQAYPKVSFRYVCVGNEVAGGATQNLVPAMKNVQGALASAGLGHIKVTTSVSQAILGVYSPPSAGSFTGEADAFMGPVVQFLARTGAPLMANIYPYLAWAYNPSAMDMSYALFTASGTVVQDGSYGYQNLFDTTVXAFYTAMAKHGGSNVKLVVSXPGWPXGRRTAATPANAGMYNKYLINHVGRGTPRHPGAIETYVFSMFNENQKDSGVEQNWGLFYPNMQHVYPISF

SEQ ID NO: 132564 - protein, 181 aa, Triticum aestivum
  unsure (1)..(181): unsure at all Xaa locations
  Clone ID: PAT_TA_26982.pep
MSSSSAAPGGGRKPNRLAAEHSPYLLQHAHNPVDWYPWGDEAFEKPRKLDIPIFLSIGYSTCHWCHVMEVESFENEEVAKILNDWFVSIKVDREERPDVDKVYMTYVSALYGGGXGWPLTVFLSPNLKPLMGGTYFPPDDKYGRPGFKTILRKVKEAWDTKRDALEKSGNVVIEQLRDALS

SEQ ID NO: 132565 - protein, 247 aa, Triticum aestivum
  Clone ID: PAT_TA_26983.pep
GRVDRGRVDRCSAFMALAAKFPAKPEVSKISADRMFHTASENVGCSGLFGDSVKLPGGILVEEASNTTGSLVTTEEKEGSNSSGLFGNSPGDGVDCTAGVYYNSYGTLLVRLHEGKTPAVGTESVVEVEDGALEDVVSSQNSAISSQSSPDYLFHMTDHMFPSTLLNFTAGRRGRRNMANGTSNSTTYTELLKMQELKSKPNEKEYDGVPIQCTNRGSIPSEVHNLNSKTQPLHASGSYHQNGRAHL

SEQ ID NO: 132566 - protein, 230 aa, Triticum aestivum
  Clone ID: PAT_TA_26984.pep
ATAAAPFPPPNAEYLAAEFSGHGVTFEAVGDSCAVKMAVRNGSAAHLLLPSGLVTSYKPAMWHGAATEVLHTTVGEGPGGRPVIRGGVSMDFRCARDGPSPWSPGGAWSLRAVRGGPTGSISVELVSVEPPGSGDGAEARCVVTLQPEALASEYAVTNAASSPSAVALSGAVCNHLRVSTPDATYAVGLQGSDYRGREPLLSEFSILPPDYYATAPSSPQPRWVSKGLDM

SEQ ID NO: 132567 - protein, 89 aa, Triticum aestivum
  Clone ID: PAT_TA_26985.pep
NIFVNGMILFFRFFKMNFCTRQAKKKREEMWQSRTRRCTPERPRIRRGTGHMPHLHGGFQASDQFAEPNFVLRLVKRIKYILSFWFLAG

SEQ ID NO: 132568 - protein, 129 aa, Triticum aestivum
  Clone ID: PAT_TA_26986.pep
MGDQSTLITGYFAHAFLWKTSELTCVLRHFIVVCNELLYGNTDVERFVLEVSLTLDWILNHCFSLQDVSEMRETIIKHLHLDSTDVHEAVAAKQIGVQATNGLDEPGTPNSVQMSLVSQSSPMDIGLKA

SEQ ID NO: 132569 - protein, 63 aa, Triticum aestivum
  Clone ID: PAT_TA_26987.pep
SSLLYLLNKLDLGLIMYIGTYKIHVELVKLISSTFVACSISGLYLKPGLSFLVNITSSKLFYA

SEQ ID NO: 132570 - protein, 88 aa, Triticum aestivum
  unsure (1)..(88): unsure at all Xaa locations
  Clone ID: PAT_TA_26988.pep
EAPPRPPRGPGSTSSQTASRRTAWPQTPSRRPRRPAPPSTPRPPRRGPRGGSSGPAASMMTCRXTPPPPPRRHRVALAAGRRRPVPRP

SEQ ID NO: 132571 - protein, 44 aa, Triticum aestivum
  Clone ID: PAT_TA_26989.pep
FFFFFLFKFRFSRGARQNNVDRTNHQLRKVKRTIEIIISSQNKT

SEQ ID NO: 132572 - protein, 45 aa, Triticum aestivum
  Clone ID: PAT_TA_26990.pep
VYRLIATGWLWGPYAHPPILKAVPGSLELMTSSISEINTFSYASS

SEQ ID NO: 132573 - protein, 132 aa, Triticum aestivum
  Clone ID: PAT_TA_26991.pep
FGTRPVKAPATPAPAAAPITAPVTPAPVTAPAAAPPTPKPKAKAPAAAPPAKATAPAPAALPPTVEAPAAAAPTLIPEVPSAAPAPLTKPTDAPAPAPSKKKRSSKKKTKAPAPAPGAAAPVKAKGVAPTTA

SEQ ID NO: 132574 - protein, 208 aa, Triticum aestivum
  Clone ID: PAT_TA_26992.pep
MAIQPKLPFTQLFLLILYFLAVVAVRPESSHEINLQPADFPNERLYRAYLAIQRFKSTITSDPNNITSTWSGNDICGDKTYVGFYCATPPGLNEKLTVTEVILNGFGLHAPRLQRFVDQLPDLALFHASSNNFGGDIPHLDSLPYLFEFGVAKYDLQPLHPSGRVYGSAEGGATGQVITKDEGKKKKKKRVNFSRFSAHILFLILRFT

SEQ ID NO: 132575 - protein, 173 aa, Triticum aestivum
  Clone ID: PAT_TA_26993.pep
MATGIRSSEVEGHDSAKPDTRLLTTSAHEHSAITQGMNNMSRTKEFISCYGEIIDGKRDTWGKTVGCGEEIVVSDDEEYESWDALMARYPFEGVLPLDVFPKSRHRDGSIYKCTHPWTRKCLITDRSETVFEAMMFTEPSNCFILNGTCMRHAPSHMFQILSIKLAKLDVDGG

SEQ ID NO: 132576 - protein, 69 aa, Triticum aestivum
  Clone ID: PAT_TA_26994.pep
ISSTFTPAKQGSLINQSGEPWSIDKKRTTSKSKQCHHGAKERFSSSSMLWYYCCAGQTRKQLCSCSTVV

SEQ ID NO: 132577 - protein, 84 aa, Triticum aestivum
  Clone ID: PAT_TA_26995.pep
QYIYYSKIILLCTAEVFFLFQPHLVLGLLSQIIKIQLLADLNLKKTPELLELVADDNSKEVEDLVNLAPDKMLLKWMNFHIKKA

SEQ ID NO: 132578 - protein, 148 aa, Triticum aestivum
  Clone ID: PAT_TA_26996.pep
GTSSLSSMLHGNRGAGRSPLSWESRRRIALASARGLEYIHATGSKVAHGNIKSSNILLGRSVDARVADHGLASLVGPAGAPSMRVAGYRAPEVVADPRRLSQKADVYSFGVLLLEMLTGKAPTNAALHDEGVDLPRWARSVVREEWTS

SEQ ID NO: 132579 - protein, 92 aa, Triticum aestivum
  Clone ID: PAT_TA_26997.pep
LKSFKSIARGVLVRQSIAVLSAQNSFSLNFLVQHQHLVRSHRISLLSSGSRTHQRSISIKIHAEDLHQQSRHFDSASISSCPHALGLLYLNF

SEQ ID NO: 132580 - protein, 127 aa, Triticum aestivum
  Clone ID: PAT_TA_26998.pep
IKFLVELILDKLKSITGLGLVSDVLRDLAHVNSPHGQATIGHIRYSTSGGDAQLCNVVPFLAGHRFGQLAVEHNDNLVNYLPLRHKLEAHGSIFNNSEVILHLITRSSTIWMHGFYLGFMEVCVCRM

SEQ ID NO: 132581 - protein, 184 aa, Triticum aestivum
  Clone ID: PAT_TA_26999.pep
MVMWVFGYGSLVWNPGFAYDARLVGFVRDYRRVFYQGSTDHRGTPEFPGRTVTLEHQPGSTCWGVAYKISREQDKQTALEYLEVREKQYDEKVYLDLYTDSSPKIPEVQDMMVYLATTNKEANQNYLGPAPLEEMAKQIYLAEGPTGPNKEYLFKLEDALNKIGVVDQHVQDLANAVRNYADSL

SEQ ID NO: 132582 - protein, 199 aa, Triticum aestivum
  Clone ID: PAT_TA_27000.pep
PGKAAHSSAVVASCKHDPAAVAQVEVAYDMLLMVPLSRQAPGKVVDNSVRYVYGKPVVFADAAPQSMQSAMKNVPLTLEAPASSSLGIQSSIYGALMVFTYASGTSTSLPSAYTSPDVPGFILATGFGASLYFLSKKNMNLGKAALITVGGLAVGATVGSGVESWLQVDIVPFLGIHSPAVVVTEFILFSQLLVSLFVR

SEQ ID NO: 132583 - protein, 106 aa, Triticum aestivum
  Clone ID: PAT_TA_27001.pep
MFPAEASFAGAEAAMLPPFFVGSMWQSAPGGGAAALSEEDEVAAAAAAEAAHDRAVAATRNHREAEKRRRERIKSHLDRLRAVLACDPKIDKATLLAKAVERVREL

SEQ ID NO: 132584 - protein, 60 aa, Triticum aestivum
  Clone ID: PAT_TA_27002.pep
YLSRWMFPSWMCYCDLSYALCLLTRQQVRMYETFPCVPLLAQPELFMFYYGCVQDTWYEL

SEQ ID NO: 132585 - protein, 178 aa, Triticum aestivum
  Clone ID: PAT_TA_27003.pep
MGSNGGADGAGFNTDALEGVRAILLKPSESLDESTRIAGPDFNDAGLGLAGMLGSLASTGFQASHLGDAIDVVNQMLDWRLSHEKPSEDCDGAELEPKYRESVKCKIFLGFTSNLVSSGIRDVIRFLVQHHMVDVIVTSAGGIEEDLIKCLGPTYRGDFSLPGALLRSKGLNRIGNLL

SEQ ID NO: 132586 - protein, 480 aa, Triticum aestivum
  Clone ID: PAT_TA_27004.pep
MVKICCLGAGYVGGPTMAVIALKCPDIQVVVVDITKSRIDAWNSDTLPIYEPGLDEVVKQCRGKNLFFSNDIEKHVSEADIIFVSVNTPTKTRGLGAGKAADLTYWESAARMIADVAKSDKIVVEKSTVPVKTAEAIEKILTHNSNGINFQILSNPEFLAEGTAIQDLFNPDRVLIGGRETPEGQKAVQTLKAVYAHWVPEDQILTTNLWSAELSKLAANAFLAQRISSVNAMSALCEATGANVSEVSYAVGKDSRIGPKFLNASVGFGGSCFQKDILNLVYICECNGLPEVANYWKQVIKINDYQKSRFVNRVVSSMFNTVANKKIAVLGFAFKKDTGDTRETPAIDVCKGLLGDKAKISIYDPQVTEDQIQRDLAMNKFDWDHPVHLQPMSPTTTKQVSVTWDAYEATKDAHGICIMTEWDEFKTLDYKKIYDSMQKPAFVFDGRNVVDSEKLREIGFIVYSIGKPLDGWLKDMPAVA

SEQ ID NO: 132587 - protein, 222 aa, Triticum aestivum
  Clone ID: PAT_TA_27005.pep
LLFHPGIYPTEHDDDTSYGYSVPASPNSSTNSSLAQGVSQQDSKKNPFSWHRYPFLSRFRSSGDKKDTSQHVNSMDSECEGTPISSASFISSDKFHFSFYKWAGKGALLMLPASVQEKDGNIIGVRSFPQVIVQGIDLIDEEESMSTATPASKSQTDYEDYKSGKDGLFERKHSINSTTKEESSVFDEYLQGDKSKEAGTKKSINNAKSNVSAGSPRTQSSR

SEQ ID NO: 132588 - protein, 136 aa, Triticum aestivum
  Clone ID: PAT_TA_27006.pep
GSTAGSGCCEKFLQGVPAVHSIFEPGPSDVLLASFPKCGTTWLKALAFATRNRAEHPLRGLDHPLRRRNPHHILQYLELQYAQSMGPGWAALPSPRVLSTHLPYSLLPGRITAEESGCRIVYICRDPKDAFVSSWV

SEQ ID NO: 132589 - protein, 46 aa, Triticum aestivum
  Clone ID: PAT_TA_27007.pep
CVTYIGIHCLRSEFSAPGVSCVICLLLYNVEREGRESIHTQRCKLD

SEQ ID NO: 132590 - protein, 196 aa, Triticum aestivum
  unsure (1)..(196): unsure at all Xaa locations
  Clone ID: PAT_TA_27008.pep
PRVRHMFLKASVPPDTPIDGTTEYYQDLFHALWEACNSSSNTGRETFPLSGGKGLAAISGTRSVKLLEVTPKVLIGALERYLAPFVVSVAGRSLITILRGNGVIENVVWEESDSDAAVGADALVPYSMENNLQLQHIDDDEIGIGAQRFAHLSKXDMGVVSILIFLPPRYHLLFSMEVGYASTLVRIRTDHWPCLA

SEQ ID NO: 132591 - protein, 90 aa, Triticum aestivum
  Clone ID: PAT_TA_27009.pep
LLNPLSCTDDGMFATHTFYPKDPYVETMATSRLLVCIFTPYVCLCLPPYVCLCLPHPPRHIQSKFDQILKMVHLWVLRAMHLAQSHGNNQ

SEQ ID NO: 132592 - protein, 87 aa, Triticum aestivum
  Clone ID: PAT_TA_27010.pep
MLYVAPRWRCLLAVAMAIAAVLSAAGGAGAQETCSGAVPPPPKRGAWMSIASFGGAGDGRTLNTAAFAAAVASIQRRRARGGALLYV

SEQ ID NO: 132593 - protein, 141 aa, Triticum aestivum
  Clone ID: PAT_TA_27011.pep
LHRPLQLAFSSPRSRAPAASTMASRAAVSAALALLVASASAWLHEEFTTEGNVRAGYDARGQQVASIVLDRQSGGAFRSRRRYLYGQFSVQIKLVPGNSAGTVASFYLSSGEGPGHDQIDMEFMGNTTGQPVALNTNVWAN

SEQ ID NO: 132594 - protein, 139 aa, Triticum aestivum
  unsure (1)..(139): unsure at all Xaa locations
  Clone ID: PAT_TA_27012.pep
SFCDQHKSIRYLFLDCXYGKNMWRSVHIAFNITPPNSINTLFGTWVDGINYDIARHIRVGVCALLWAIWNCRNDLVFNRTTNINFLQVIFRATALIHIWSLLTPTEAREHLVTGSTRWETVARDIFNRFGWRSYNRIDM

SEQ ID NO: 132595 - protein, 112 aa, Triticum aestivum
  Clone ID: PAT_TA_27013.pep
VKTRDSESRVLPFAASEVNNKKDLHTDVPSLEIPWDITWPELPGNKMDFGYFCCWRLQLVSSVITSLITATLFAAASQATILFGSTWMSFPSLRISHLFISTIYKMGVNTTL

SEQ ID NO: 132596 - protein, 182 aa, Triticum aestivum
  Clone ID: PAT_TA_27014.pep
RARSLGNELFKSGKFSEACMAYGEGLKHHPVNPVLHCNRAACRFKLGQWEKSIEDCNEALMIQPNYTKALLRRAASYGKMERWAESLKDYEVLRKELPGDTEVAEAYFHAQVALKSSRGEEVSNLKFGGEVEAVTGMEQFQMATSLPGVSVVHFMTSSNQQCGKISPFVNALCTKYPSVNFL

SEQ ID NO: 132597 - protein, 116 aa, Triticum aestivum
  Clone ID: PAT_TA_27015.pep
PTFAIFGYVLRYSLRGWVFFLVLHFVHVMHLISCHHVHHICIRVRLMHLSIFPVVHFTIRHSLMHRSTPLVSFRERVLNVLGMDRGLSSGLGIPPVDHLSSFVPFGGHLVLQRLTG

SEQ ID NO: 132598 - protein, 133 aa, Triticum aestivum
  Clone ID: PAT_TA_27016.pep
GGGAGRAPPPYASPSPSCCSSPPSTARAPRPGRRPSPRARAAALRRGGPRCPCTTLCQSPVQEPEPARSRSTPPPPPPPRPLGARARARPARRGSGSRPPAAATTPRATRTTSGASRRARTRCTTGDRAFLRN

SEQ ID NO: 132599 - protein, 78 aa, Triticum aestivum
  Clone ID: PAT_TA_27017.pep
RGSPPSIATSAPSHPRPSLPSSTSCSPPPHPPPRPPSSSAHSSSPSRRCRTTVTAMPPASAIRSPASATPGTLCVHFS

SEQ ID NO: 132600 - protein, 254 aa, Triticum aestivum
  unsure (1)..(254): unsure at all Xaa locations
  Clone ID: PAT_TA_27018.pep
LCHHLHITFPSEVEFSKLKVSGLLQRIGXQXHWTTRNNKCFDDFLMDLKQPKRKNIRQERKKIPAQNLEMKXLRGDEIKSXHWDXFYKFYRNTTDNHWGRAYLTREFFXLLGEKMGDKVMLIVAEHDDKVVAGALNLIGGDTLYGRLWGCLPDAHFPXLHFEACYYQAIEAAIELNLSKVEAGAQGEHKIQRGYLPVTTYSCHYFLEPGFATAIGNFLVHETAQVKHVINVLHESGPYKEDILKEFAPQPDGEM

SEQ ID NO: 132601 - protein, 92 aa, Triticum aestivum
  Clone ID: PAT_TA_27019.pep
LRVLERSRQSPVAIAGVPPPLGTEKEEGEDWSNLTSGPRGPTVSDPLRRHACLSEDIIHPVRFPRSESVFLSETFSFLFYFKNRFDQIFDWL

SEQ ID NO: 132602 - protein, 139 aa, Triticum aestivum
  unsure (1)..(139): unsure at all Xaa locations
  Clone ID: PAT_TA_27020.pep
VRFTGHIPKFQPIQQITDARASKVSIHGDSRNKLRDLSFYLNGNSEEPEFYEGHFHIDSNSTIKDTFISFRGWNKGVAFVNNFNIGRFWPVMGPQCALYVPAPILRSGDNIVXFELHGPNPERTINLVEDPDFTCGPNR

SEQ ID NO: 132603 - protein, 124 aa, Triticum aestivum
  Clone ID: PAT_TA_27021.pep
MAQLLPLSSAAPSFRLAATPGNGVPRLSVTSARSAARVSRRSMRLKSLRVRCEQGSKGGPGLDVWLSRGAMLAFFGAVGVELTTGKGVLQNVGLMAPLPALALGLTGVVGVVTAFIIFQSGSSD

SEQ ID NO: 132604 - protein, 130 aa, Triticum aestivum
  Clone ID: PAT_TA_27022.pep
MFLSALGYSLTGGVGLCSNFTSPRRRELGLRQNSAFYLPLYLVVSRRNMRPKSLSVRCEQGSKGGPGLDVWLSRGAMLAFFGAVGVELTTGKGVLQNVGLMAPLPALALGLTGVVGVVTAFIIFQSGSSD

SEQ ID NO: 132605 - protein, 126 aa, Triticum aestivum
  Clone ID: PAT_TA_27023.pep
MAMTVEVLAGLACMFSTSVLLQILACALYNNWWPMLAALMCIIVPMPCLFFGDGSTRFLSSGEGGAWMKAAKFLTGMSAMGSLAIPAILRHAGLIETGAMFIEFTSFFILVCTVLCFHRATLDEEW

SEQ ID NO: 132606 - protein, 126 aa, Triticum aestivum
  Clone ID: PAT_TA_27024.pep
MAMTVEVLAGLACMFSTSVLLQILACALYNNWWPMLAALMYIIVPMPCLFFGDGSTRFLSSGEGGAWMKAAKFLTGMSAMGSLAIPAILRHAGLIETGAMFIEFTSFFILVCTVLCFHRATLDEEW

SEQ ID NO: 132607 - protein, 105 aa, Triticum aestivum
  Clone ID: PAT_TA_27025.pep
DRRRLMICITWRPESGAVRRRANCDLHLEHQISGCHHGRRQIELHGPPPLKSSINVAPSSIPIAGLPREEGKQGTTAVSGLFGSAMSMRDLGIDFFFRNNISRNR

SEQ ID NO: 132608 - protein, 324 aa, Triticum aestivum
  Clone ID: PAT_TA_27026.pep
RLLTLNHAPGIKSNNLAVLDSRGYSRSLIASRSIESYLIQILKTGFFHADPHPGNLAIDKDGSLIYYDFGMMGEIKSFTRDRLLSLFYAVYEKDANKVIKALIDLEALQPTGDLSPVRRSVQYFLDNLLSQSPDQQQTLAAIGEDLFAIAQDQPFRFPSTFTFVIRAFSTLEGIGYILDPDFSFVKVAAPYAQELLDLKTRRRAGPELVQEIRKQANDARDSTISMPYRIQRIEDFVGQLESGDLKLRVRVLESERAARKANVLQMATMYTAMGGTLLNIGVVMGSQGNQIVANGSFIGAGIFLALLVASMRRVKKLEKFETMM

SEQ ID NO: 132609 - protein, 77 aa, Triticum aestivum
  unsure (1)..(77): unsure at all Xaa locations
  Clone ID: PAT_TA_27027.pep
TKIERGAENIEVLMECCSKNKIAPARRREGLTPAGHAVAKQLRAPARHIQHTTEEGHYLLSWIKGATPSMDGADXRV

SEQ ID NO: 132610 - protein, 141 aa, Triticum aestivum
  Clone ID: PAT_TA_27028.pep
SPRRPTSPSPEAETAAATPPPAPPPATRPKLSGGLEPLDARIKELTSSQGELLARIQKLKQDVQKWRSDVEAQVKTCHNELVEVKEGLASEVQHLKSDIKEIRAALQEEKASSKTEQARKTQDQVLKTGDEQTEQQTAVQA

SEQ ID NO: 132611 - protein, 68 aa, Triticum aestivum
  Clone ID: PAT_TA_27029.pep
QYRSNPTKMVQIVKAKTFSYCRGKNPSPVGKIRSICLYNVRRRRKRKCINLCSSCSLKARPSIHFRYR

SEQ ID NO: 132612 - protein, 121 aa, Triticum aestivum
  unsure (1)..(121): unsure at all Xaa locations
  Clone ID: PAT_TA_27030.pep
CPPPRPGPWLAPPRPPAWLKPPPPPPRPPLKPPPPPPRPPLKPPPPPPRPPLKPPPPPPPPPLXPPPPPGLVPPLPLFFRPLPFFPPLALLAPLWFAGMSLASVACGFGGVGLMDQRRVQP

SEQ ID NO: 132613 - protein, 83 aa, Triticum aestivum
  Clone ID: PAT_TA_27031.pep
TCASLCGCKILDKCARPCDRFNLYPEADEAKVIEYCKLGCMSSVCNTTNPFIVGEQEKDVIENCTTGCDRVCTKDVEFAAAIS

SEQ ID NO: 132614 - protein, 183 aa, Triticum aestivum
  Clone ID: PAT_TA_27032.pep
HPYLHYIFGEENEPEQVGEQELHRPVQAPWPIGSDISVTVLGRTIDILQRRCDEQFAIHHAKDPELLGGMIDDPPEEPPSPVLIESLMPRKEWAEDLCDSVKTKAACGFIIACGGRVNLDPDDVVARLERILGGVDVPDEVEHRQRDILRMQVIDGICYQARDMEMERSRGVVMRVIARYQAL

SEQ ID NO: 132615 - protein, 97 aa, Triticum aestivum
  Clone ID: PAT_TA_27033.pep
GAVVMFGIPGSFDLFLRTNFLEEQASHVRDLSGGPADLFVRVTGDCAVCGFATGDVDSGERGPARLVLVGRSGIARAPGQLCKIEHFDWSQKVLGVS

SEQ ID NO: 132616 - protein, 153 aa, Triticum aestivum
  Clone ID: PAT_TA_27034.pep
MAPKAEKKPAAKKPAEEEPATEKAEKPPAAKKPKAEKRLPAGKTASKEGGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 132617 - protein, 190 aa, Triticum aestivum
  Clone ID: PAT_TA_27035.pep
ILPSLAFTFARLRLPFVTLVEGRRSFSTTPCNNRVIPITIARYQKIYYSHDTPRLNKMSLKVFSLALAAVATASPFDSMAKATNDDPYEACQPQGATGTTPPAVGTELSSLYTDILSSIQGISFDKRSVHGRADGFGCRQSLDCVNVKNINIPMCYDKFTTNFQFPDGSYGNVAAGTYSSGGTDVNLVSG

SEQ ID NO: 132618 - protein, 77 aa, Triticum aestivum
  Clone ID: PAT_TA_27036.pep
LIVCLFLGICSWRMAEPDRLHDHRHHLPLHRASRTLLLLCLLLHMMQYICPASLPTVRTIKLGSFPTFSDMNSSSDA

SEQ ID NO: 132619 - protein, 117 aa, Triticum aestivum
  Clone ID: PAT_TA_27037.pep
MGCLFDCFRAAGGEPRAGRARAQLVSSSVVPSPKVGGERRAPPSRNALSAVFLREDEGSQATSSGSDRDAGSNRVDPELMHEEEGKLSHLENLPIRGSNEDFVRIVPDVLLRVEQCY

SEQ ID NO: 132620 - protein, 159 aa, Triticum aestivum
  Clone ID: PAT_TA_27038.pep
MLRKFGTQRRQPALWRRCRSLRQIKQVHTLLVLRGFLSDPSALRELLFASAVAVRGAIAHAYHVFDQIPHPDLFMYNTLIRGAAHTSAPRDAVSLYARMARLSSCGGVRPDKITFPFVLRACTAMGAGGTGAQVHAHVVKAGLESDAFVKNALIGMHAS

SEQ ID NO: 132621 - protein, 71 aa, Triticum aestivum
  Clone ID: PAT_TA_27039.pep
FSDDVEEHMLEIIAGEWEDLNRECFSGTNSALSHAFVGTSLNFARMVRVMYGYDDEHRLPILEDYTRMLLF

SEQ ID NO: 132622 - protein, 224 aa, Triticum aestivum
  unsure (1)..(224): unsure at all Xaa locations
  Clone ID: PAT_TA_27040.pep
MGAAARRAPEQEQSCKATEDFDAAKPPPFRIGDVRAAVPAHCWRKSPLRSLSYVARDVAVVAALAGAAWWLNSWAVWPLYWAAQGTMFWALFVLGHDCGHXGHQDLPWYRGEEWSYLRGGLTTVDRDYGWINNIHHDIGTHVIHHLFPQIPHYHLVEATKAARPVLGRYYREPEKSGPLPMYLITVLLKSLRVDHFVSDVGDVVFYQTDPSLSGDKWTGTDKQK

SEQ ID NO: 132623 - protein, 328 aa, Triticum aestivum
  unsure (1)..(328): unsure at all Xaa locations
  Clone ID: PAT_TA_27041.pep
MAPAMRPEQEASCKATEDHRSEFHAAKPPPFRIGDVRAAAPXHCWXKSPLRSLSYVARDVAVGAALATGAWRAATQVPXPVCWAVQGTLLSAPFVLXHDCGHGTFSDSGPLNSVDGHPMQTLILVPYKRWRXISERTHPKNLGHLERYEPWQPIPDQVFEKLELRTKKQHFSYPLPQRACHVKVRNRGPAKEVSXLXPSNYELTTTERRGVFISTTCWLKLIALLTGLACIFGLVPVLKLYWVPYIVNVMWLDLVTYLHHHGNXVLPWYGGXKCKALCGGMTTVDRDYGWINNIHHDIGTHVIHHLFPQIPHYHLVEATKAATPVLVD

SEQ ID NO: 132624 - protein, 147 aa, Triticum aestivum
  Clone ID: PAT_TA_27042.pep
VDVHAGFLTFDDPLEAAQLHGGCGAWGIIFTALFAKKQYVEEIYGAGRPYGLFLGGGGRLLAAHIVQILVIAGFVSCTMGPLFLALKKLGLLRISAEDEMAGMDLTRHGGFAYVYHDDDEHDKSVGGFMLRSAQTRVEPAAAANSQV

SEQ ID NO: 132625 - protein, 249 aa, Triticum aestivum
  Clone ID: PAT_TA_27043.pep
MAPLGDAVAPASAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWKEADFIKVSDDEVAFLTQGDATDEKNVLSLWFEGLKLLIVTDGEKGCR

SEQ ID NO: 132626 - protein, 366 aa, Triticum aestivum
  Clone ID: PAT_TA_27044.pep
LSCRPPYLQAGRARSRSVRRVLRRRRRPPAPEEMPRYDDRYGNARLYVGRLSSRTRSRDLEYLFSKYGRIREVELKRDYAFIEYSDPRDADEARYNLDGRDVDGSRIIVEFAKGVPRGSGGSREREYVGRGPPPGTGRCFNCGIDGHWARDCKAGDWKNKCYRCGERGHIERNCQNSPRSLRRERSYSRSPSPRRGRARSRSYSRSRSYSRSRSRSYSESPRGRRTERDERRSRSISYSRSPRRSLSPGGKEMDRSPTPDRSRSPRRSISPVAKDNGDSPRGRETSRSPSDGYRSPVANGRSPRSPVNNGSPSPTRDNRASPSPRGNNGSPSPKGNGNGGSPSPRGNGDDDGRRGSGSPRGRSVSP

SEQ ID NO: 132627 - protein, 221 aa, Triticum aestivum
  Clone ID: PAT_TA_27045.pep
FMFYRNPSADMLLTEAELNLDLIRRARIFHYGSISLITEPCRSAHVAAMRAAKSTGILCSYDPNVRLPLWPSAQAARDGIMSIWKEADFIKVSDDEVAFLTQGDATDEKNVLSLWFEGLKLLIVTDGEKGCRYFTKDFKGSVPGYSVNTVDTTGVLSRATLLHFFHLGCIRDDSMFYNGAKLREVLQFSNACGAICTTKKGAIPALPTTATALELISKGSN

SEQ ID NO: 132628 - protein, 68 aa, Triticum aestivum
  Clone ID: PAT_TA_27046.pep
RRGSHHGSSPRRHQRPRKEKLLHSHPVAMDGTHSMCEVCSFPAWLVSTSPAHGSSRHPPPMTWTPCPS

SEQ ID NO: 132629 - protein, 105 aa, Triticum aestivum
  Clone ID: PAT_TA_27047.pep
MILRYNLALETLHVMSVFGHSLSQHYNKLKRGYNFLILVAKLYAPYAFFKGCFDDTNMRNLWAITSTDQLKDGSTFDCDPACIDWGSYLINTHIPAALTYARNNN

SEQ ID NO: 132630 - protein, 193 aa, Triticum aestivum
  Clone ID: PAT_TA_27048.pep
PNCHLFPVLESIDCRNCPNLLSLPFFPECYVSCARGIHCASLHALKIIDCPKLLVSPMPPAPALTSIELVDTHRSVTLGKWEMKMSGYSGALAFQNMVNLHRLLCEGGSITLWSYLQKVTSPMELTIPEGSGIKFVCFAGCKILTVGGVSSLITSVSLKRLWANGGGDPPNSATMNLLSEVARRTKELPAGSF

SEQ ID NO: 132631 - protein, 79 aa, Triticum aestivum
  Clone ID: PAT_TA_27049.pep
RHTKDSCIYSPAFLAEPARMRQDLLDFVALLELTPPSQGWSGGLYSSAPHRTLLCMRCATRTDPSPHTTLSLLSSSAAF

SEQ ID NO: 132632 - protein, 91 aa, Triticum aestivum
  unsure (1)..(91): unsure at all Xaa locations
  Clone ID: PAT_TA_27050.pep
IRPSHDYTVHNGPYELQNASSLHHLDLVGWVRDMXRISISGICFVLYVQYNRQVPDLDDIMEKLNNAGYIVQNGEDIYQILTSSWPRTQPA

SEQ ID NO: 132633 - protein, 172 aa, Triticum aestivum
  Clone ID: PAT_TA_27051.pep
CLGVSPDTRKEVGDGYIRHPPRRDGGNRRSHRIGAGREPARDFSRTPSPTAQPGRSQPATSPPTSMRHRGLDATHAASPRSPPRGQEEGERRTRRQEQQHRNHAGGNYLHRSRAGGPSLRHHRGRRPDAAAGHTRPPLARPGPIWARKAPPATLQQGGTSAASIHPLIAAPL

SEQ ID NO: 132634 - protein, 253 aa, Triticum aestivum
  Clone ID: PAT_TA_27052.pep
GSCAARANSCDFQGSTPAGSSSFASRWEYNCSSKQARSGDATGPSEEMQAPRAPVLVQNENLPIFRGVDGKKAGVARGPAARAGRRALGDLGRAGKAPPAGAAGKAAPAAAAAGSVQGSKGVAKPSSLSDGDWMRCCEWAKGGIETASFTGNDMQRLMADEQEERIRKKVEKAMATLQVSMNSIYDINVPSKISLDDPDDETTLELDPEFLPPTAYLSSRLGEHDGNYLLSDLEFEHDPFSGCNFDLKLKDDY

SEQ ID NO: 132635 - protein, 109 aa, Triticum aestivum
  unsure (1)..(109): unsure at all Xaa locations
  Clone ID: PAT_TA_27053.pep
VGFTVPVLDGEDLSLRVLVDHSIVETFAMGGRSTAXVEGVSDGGHLRRRWRVPFQQRHWRRRHRREARGARDGRLLQPDLHGRRCLGRLVAESNQALGPVMHIHLYYIL

SEQ ID NO: 132636 - protein, 376 aa, Triticum aestivum
  unsure (1)..(376): unsure at all Xaa locations
  Clone ID: PAT_TA_27054.pep
RLVPDQXYDINGVLTGSATMLPNGTVILLYTGNSDTFAQVQCIAFPADPADPLLRTWTKHPANPVIFPPPGIGDRDFRDPMAAWFDKSDNTWRTIIGSKDDHGHAGIALMYKTKDFIKYELIQDPVHRVEGTGMWECIDLYPISGGSDSSEEVIHVMKASVNDEWHDYYALGRFDAEANRCTPFDAEADVGIGLRYDWGKFYASKTFYDPSKNRRVLWGWIGETDSERADVAKGWASLQSIPRTVELDEKTRTNLIQWPVVEIETLRINSTDLGGTTIDTGSVLPLPLRRATQLDIEATFHLDTSAIAAVNEADVGYNCSTSGGAANRGALGPFGLLVLADGALKEQTAVYFYVSRGLDGGLQTHFCQDESRSSLA

SEQ ID NO: 132637 - protein, 163 aa, Triticum aestivum
  unsure (1)..(163): unsure at all Xaa locations
  Clone ID: PAT_TA_27055.pep
MAVKDQPVDDINDKCSLGGGPRAHGGLGPSRLLIHATDSGREEVAVVPFLYKGLDGGTSGTPVLPLMESGSSRAKELLKRCGGKAPCPCSYGEALSARALVDHSIVESFVMGGRMTXDVARVPYGGYPCGWXGVRFQQRHRVCRYRREARGARDGVSTNTTIP

SEQ ID NO: 132638 - protein, 175 aa, Triticum aestivum
  Clone ID: PAT_TA_27056.pep
NALILPSHDDPSPVRTMAGGSVANTVRGLSAGFGISTGIIGARGDDDQGILFVNNMSFSGVDLTRLRAKKGHTAQCACLVDASGNRTMRPCLSSAVKLQANEFTKEDFQGSKWLVVRYAQQNLAQIIEAIRVAKQEGLSVSLDLASFEMVRDYKSQLIALLETGNIDLCFANEYE

SEQ ID NO: 132639 - protein, 153 aa, Triticum aestivum
  Clone ID: PAT_TA_27057.pep
LGQGQQPGQWQQSGQGQQGHYPTSLQQPGQGQQGHYLASQQQPAQGQQGHYPASQQQPGQGQQGHYPASQQQPGQGQQGHYPPSQQEPGQRQQRQIPPSQQHPRQRQQRHYPPSLQQPRQQGHYPTSLQQLRQGQQIRQPGQKHQPRQRLQTR

SEQ ID NO: 132640 - protein, 83 aa, Triticum aestivum
  Clone ID: PAT_TA_27058.pep
KNQTVQISQATFRMLFLLAGPFQHISTSNHSHPIYCAEFQLHLIQRQWLCQRDGYVMHKMEMKGDLIITMSRNLAKLIYLPAT

SEQ ID NO: 132641 - protein, 51 aa, Triticum aestivum
  Clone ID: PAT_TA_27059.pep
FFLLSECDRTLSPSLLNSTQYVHKFFMCVLFETRSKASMCPCQLKKLRTKL

SEQ ID NO: 132642 - protein, 157 aa, Triticum aestivum
  Clone ID: PAT_TA_27060.pep
GSFYNSGEADIVAQHVINLVLCGVSPTSIAVQSPYIAQVQLLRDRLEEYPEALGVEVSTIDSWAGRWADAVVISMVRSNSLGAVGFLGDNRRMNVAITRARRHVTLVCDSSTICNNEFLARLLRHIRQHGQVRHVEPGSYGGDYGLGFSPPALPSIS

SEQ ID NO: 132643 - protein, 104 aa, Triticum aestivum
  unsure (1)..(104): unsure at all Xaa locations
  Clone ID: PAT_TA_27061.pep
FMSYPLSFSPSRSSTFLSSAPSNSRRCSATCPRLRLLPLGLRLETGAGQRIGGSAALQQSKVFPRLVPVARCPGVEWKWGDGGEPATSAVPDGEGAYGXNYEXA

SEQ ID NO: 132644 - protein, 244 aa, Triticum aestivum
  unsure (1)..(244): unsure at all Xaa locations
  Clone ID: PAT_TA_27062.pep
GTREFIADMQQMLKSVVQHFGYRHEVRVEAEILHNLFFNIMKIAFPDSDFQEVKDSLSFSNPGGGASSAAVPSAKHLASGLKRRSATTEAEQHGPGSGKHSHHASAGEAPSRAKPERDSKAFRTXAAGTRAXDSPGLPLHPGDLFIAKKKRQDRARSSIGSPSSSGPRGPLSPTNTGRLGPAPSPRGARTPFQRDSHPSQQSMPGWGAHSDRGGSSPPGIGDIHWAKPAKRQRTDTGKRRPSHL

SEQ ID NO: 132645 - protein, 122 aa, Triticum aestivum
  Clone ID: PAT_TA_27063.pep
DDLPFVYQGTRGPLLKPTLGLAGGRQEAPRQGDEEGKRQQHHLHRRTFPGPAAPGGHQRIPNHCHAGQLNISSSKHRRLHRAMCCASSVSDDVALCIRAYLLHSSLPMSVYVLSCHFKFQFL

SEQ ID NO: 132646 - protein, 332 aa, Triticum aestivum
  Clone ID: PAT_TA_27064.pep
RPTRPGSTQEPHKAGEHKLDDKSAQTDGLISDIRNLVVGLSSRRGQRAKNKVLQEDILQEIERLAAEAYSIFRSPTIDAIEDPVYIDDPESVKPACSGTGSGFEIVCQGFNWESHKSGKWYVELGTKAKELSSLGFTIVWSPPPTDSVSPEGYMPRDLYNLNSRYGTMAELKQLVDIFHENGVKVLGDAVLNHRCAQFQNQNGIWNIFGGRMNWDDRAVVADDPHFQGRGNKSSGDNFHAAPNIDHSQDFVRTDIKEWLRWMRKEVGYDGWRLDFARGFWGGYVKDYMEATEPYFAVGEYWDSLSYTYGEMDYNQDAHRQRIVDWINATNGT

SEQ ID NO: 132647 - protein, 171 aa, Triticum aestivum
  Clone ID: PAT_TA_27065.pep
MEAYMLFPRSNGKSCEEEQEEDIGCPSESEVSAAGSMLSSDEELDDDATSSSSSSGSTDNFQMSSLMAQLPLKRGLSKFFDGKSQSFASLAAVGGLEDLAKPPGKRIKTSRSCEVGLQDAHRRRFARHNAAAFKKVSKGRLSALGRAPALRPLTASAARPKGLPVRAPLFV

SEQ ID NO: 132648 - protein, 106 aa, Triticum aestivum
  unsure (1)..(106): unsure at all Xaa locations
  Clone ID: PAT_TA_27066.pep
RSHVVYTDMFAIKYGFVANHTKYGIEXPLMVCCGNGGPPYNFMPGKFGCGDLCGPEEKVLSWDGVHFTDFGSGLAAKHAMSGEYSKPRVKLASLLNGGSKKPSSVS

SEQ ID NO: 132649 - protein, 79 aa, Triticum aestivum
  Clone ID: PAT_TA_27067.pep
IKVHGVFCKTTSTLLTETLARGPTRRCHAMWAVHMPDTDGGTVFARSNKLRHQFNVFYKFRHQSNRTKQVKTPVVYLTL

SEQ ID NO: 132650 - protein, 228 aa, Triticum aestivum
  Clone ID: PAT_TA_27068.pep
MAALPTAAAAGRVAASAFTFPAKPSLSSFSAASLPRAAAAAAAYSAIALAPAGSLQRRRRPTAAGAAPGSEQRETILLPGCDYNHWLIVMEFPKDPAPTREQMIDTYLNTLATVLGSMEEAKKNMYAFSTTTYTGFQCTVDEETSEKFKGLPGVLWVLPDSYIDVKNKDYGGDKYINGEIIPCTYPTYQPKERRTSKYESRRYERRRDGPPASRKPKQQATQPESASS

SEQ ID NO: 132651 - protein, 96 aa, Triticum aestivum
  Clone ID: PAT_TA_27069.pep
RRPAAAVASKNVHRLLLACLLIASKVLDDFHHDNAFFARVGGVSNAEMNKLELELLGVLDFEVMLSRRLYDLYRAHLQQAGSGALKGRRRRGGPRR

SEQ ID NO: 132652 - protein, 57 aa, Triticum aestivum
  Clone ID: PAT_TA_27070.pep
SFGAGGKTCILTRVYPRKAVGDNAHLFVFNNGESDIKLTNLRAWEMKTPTMNKRLGQ

SEQ ID NO: 132653 - protein, 585 aa, Triticum aestivum
  unsure (1)..(585): unsure at all Xaa locations
  Clone ID: PAT_TA_27071.pep
MASAAAPLIVSLLCCTALAVHAAHVVYPELQSLEATEVDKELRTGYHFQPPKHWINDPNGPMYYKGLYHLFYQYNPKGAVWGNIIWAHSVSTDLIDWVALEPGIYPSKPFDINGCWSGSATILPNGVPVIMYTGIDPKETPGAERRVPGQPLRXPFLRKWVKPDYNPIINPDHGINASAFRDPTTAWYGPDGHWRLVVGSKENMRGIAVLYRSRDFRRWIKAHHSLHAGLTGMWECPDFYPVAVAGGRRHHRSGVDTRELHDSTVAAEVKYVLKVSLDVTRYEYYTIGWYDHAKDRYTPDLDFPDNDYGLRYDYGDFYASKSFYDPVKKRRVLWGWANESDTVPDDRNKGWAGIQAIPRKIFLSRSGRQLIQWPVEEIKSLRAKHVNVSNKAVKGGEYFKIDGFKSVQSDVEAAFVIKNLEKAEKFNASWRTDAQGLCKKLNSHVKGGVGPFGLWLLASDDLKERTAVFFRVFKNNDTSYVVLMCNDPTRSSYESLIYRPTFAGFVNVDITKTKKIALRTLIDHSVVESFGAGGKTCILTRVYPRKAVGDNAHLFVFNNGESDIKLTNLRAWEMKTPTMNKRLGQ

SEQ ID NO: 132654 - protein, 165 aa, Triticum aestivum
  unsure (1)..(165): unsure at all Xaa locations
  Clone ID: PAT_TA_27072.pep
CAIRDKKSPTXAEGQARKSRCKICAGMRNLQETVNLPGSSRKTGGLMDLAEMINSKTVDPRRXEDQTGKGKGAEKGTPKGLVKVKEKAKATPKGGVPGDYLATRKKYCCRTNRKEVRVSDMSACLLLNLDRVPGSVQFCFTSIVIAGEITMILPDICNRLCCDEK

SEQ ID NO: 132655 - protein, 48 aa, Triticum aestivum
  Clone ID: PAT_TA_27073.pep
IDQKLHLTTSPHVQQAQNKIHMSIPNGRRKTPNRQMIDAIYKRCNESP

SEQ ID NO: 132656 - protein, 172 aa, Triticum aestivum
  unsure (1)..(172): unsure at all Xaa locations
  Clone ID: PAT_TA_27074.pep
VLQHGIEANPDKIKAIEQIEAPKRIKDVRRLTGCVAAMSRFISKSAERALPFFKILKXGSPMECTPDAEAALQDQKRYLSSTPILVAPTPQEPLLLYLAATNQVVSDALVAQREIDEEAVATAGPADGKSETPPAGPGAGKARLPAEFDAIRTEPAQSNGVVQKKKTSSRSR

SEQ ID NO: 132657 - protein, 172 aa, Triticum aestivum
  Clone ID: PAT_TA_27075.pep
MASKAHLSFLLLALLAASLAGPSAGIFHIVGAGKGWRIAPNQTYYADWARTRDIHVGDKLMFLYRSGVYDIVQVPTKELFDACSMDNVTMRYQLGPTIIKLDTPGPRYYFCGVGEHCEGGQKVAVNVSGDPAAPATATATAAATAAEAPAAAALPPAAPIELGEAALASSMA

SEQ ID NO: 132658 - protein, 161 aa, Triticum aestivum
  unsure (1)..(161): unsure at all Xaa locations
  Clone ID: PAT_TA_27076.pep
LASHSQAITIPPLRFPAAATATRQRQPPAPAVDPKFEWADKAGTYVLRLTLDXFKKGDFRVQVDGAGRLTVRGARPGASPGSLHKVFQLPATASLDDIAGRFEAGVLTLTVPKRAASAPPAPPPAGVVGEPAAAEEPGAVPAPPAQVDGAKSMPAKPTPPT

SEQ ID NO: 132659 - protein, 108 aa, Triticum aestivum
  unsure (1)..(108): unsure at all Xaa locations
  Clone ID: PAT_TA_27077.pep
GSLRFPYGMXMQGYXYILTHPGTXAVFYDHIFSHLQQDIAKLMSIRCRLKIQCRSKIKILKAEQNLYAAEINENLLMKIGAGHFEPTGPINWIVAAEGHDYKIWEAAS

SEQ ID NO: 132660 - protein, 198 aa, Triticum aestivum
  Clone ID: PAT_TA_27078.pep
SSDGQYLATGGEDGVVRVWRVVEGERPDELDFAEDDPSCVFFTVNENSELAPVNSSEGTKSKQDKSSKGQADPACVVIPHRTFALSQVPVHEFYGHDDAILDLSWSKNGDLISASMDKTARLWRVGCNSCLKVFYHNNYVTCVQFHPTSDNYFISGCIDGLVRIWDVRKCLVVDWANSKEIITAVCYRPDGKGVVVGT

SEQ ID NO: 132661 - protein, 326 aa, Triticum aestivum
  unsure (1)..(326): unsure at all Xaa locations
  Clone ID: PAT_TA_27079.pep
RPAKRDEPSGKCLSPAGEYNLRLGIIKELHPDLVATHASSPQVFEGHPFIVEAGVSIGGKDVKQGLNIFRFANRIPLLFEQGADVITRTALKRINWSIYKINQQQDKIGVFVSIVSTKIPFKGTGKEYIGDDITEIADAVKSALKQCCVQLKSKIVKKLQAREQQDRKRHLNKYIPDVARTIMETLGELADESPPKRRGEDKEGDSGRTSRRAAAEAATVXRGRRTQHVEQVDCEMAREYAMQRGVSEEPREAIYLNSLEGSYKFVDFQSPAFVFRFIPVRGCNRRAPFRSPVWSTIMCCPWNAAVHNCVYILSNCYWYDLLLGCS

SEQ ID NO: 132662 - protein, 88 aa, Triticum aestivum
  Clone ID: PAT_TA_27080.pep
ESCFTVATYRPWYSQPIHPIPDKTLWNEGQPTEDRLEVIINPPKSLRPPGRPRKTRVRAEDLGRVKRVVHCSRCNQTGHFRTTCAAPI

SEQ ID NO: 132663 - protein, 247 aa, Triticum aestivum
  unsure (1)..(247): unsure at all Xaa locations
  Clone ID: PAT_TA_27081.pep
SKNNNGCWLKKFENAELTRGRGGGAGVPFGHGIKKWNPXKMAPYISAKRKGTHIINLARTARFLSEACDLVFDAASQGKSFLIVGTKKRATDLVASAAIRARCHYVNKKWFSGMLTNWSITKTRLSPARACRAEEKMGKFHHLPKRDVAIVKXRKLSIFFFYLGGIKYMTRLPDIVIVLDQQKEYIALRECAILGIPTISLVDTNCDPDLANISIPANDDTMTSIRLILNKLVFSICEGRSLYIRNR

SEQ ID NO: 132664 - protein, 178 aa, Triticum aestivum
  Clone ID: PAT_TA_27082.pep
TFRLCTTENSINQAWILCSIGTTSNEGRRNEPLTFYALDLSCSSPRCVSSGGCFSLHSRQHTFKLKMAILRNLLLIVIAGGAAAALPPGGRVGVRLHLPVALARHHARIAFLLRVLPPLLEIGVGVHHRLILHGAAIVEGLPPLVELVRGGGGGGVGHADGAMPAGVISELQRKRKAA

SEQ ID NO: 132665 - protein, 174 aa, Triticum aestivum
  unsure (1)..(174): unsure at all Xaa locations
  Clone ID: PAT_TA_27083.pep
LKQAWATLFEXIHDRGKWLSTNQVPTSEDYLRNGVITSGAPLLFMHLLFMLGHDLTEDNNDHILRVISCPAKIMRLWDDMGSAKDELQEGLDGSYKDLYQRENPHADAEKHMLDMIAGEWEDLNRECFSQTKSTLPPSFIGASLNFARMVSIMYGYDDEQKLPALEDYTRMLLF

SEQ ID NO: 132666 - protein, 174 aa, Triticum aestivum
  Clone ID: PAT_TA_27084.pep
ALPKQGGSMCVSNTAMQIEEWFSQNCGLLVLTADPPSHLLERWELKEMTGHGITTRNKLVKVIDFSLKMSFQTLKFIAVFVQLLLNMSLLPLVQQRQDVPALIANQVASVNTLHLHQVPLTIASGVCLLEFKKRYFPLTMDLNRPSHSKYTSDQWFPIVVTRPASTPATRCARV

SEQ ID NO: 132667 - protein, 80 aa, Triticum aestivum
  Clone ID: PAT_TA_27085.pep
FHFIIFGGSFTLSEIMAFFCLSHIHVNTSLVCTCLWKQFNLILHWPAIITSAWICMVIFLSTFFCVWVYLYTKYIQIEVE

SEQ ID NO: 132668 - protein, 95 aa, Triticum aestivum
  Clone ID: PAT_TA_27086.pep
SSTNNFVCTYMRTHPFYIHMIQEHLLLAFCFIAPYKMYASDVYCFFLCLNILQKHVLNKSWLASLQLPNVCGRIFHLPTCCCVESNEKARVDAAA

SEQ ID NO: 132669 - protein, 55 aa, Triticum aestivum
  Clone ID: PAT_TA_27087.pep
TIEPVTKQNRMAFDSYTWYILPARTSEEKLSVVKIQKYWCASCLTLSNSSRAYEM

SEQ ID NO: 132670 - protein, 105 aa, Triticum aestivum
  Clone ID: PAT_TA_27088.pep
MASRLWRWYADRQFHKWEKTVLWDMVEPYRPPRSFAPLVGTYVAAFYTAIVGAAVTEQLYKEKYWEDHPGEAVPIMPPMFYWGPWRVVNGEVPRFIQTPEEAKPA

SEQ ID NO: 132671 - protein, 371 aa, Triticum aestivum
  Clone ID: PAT_TA_27089.pep
PGQICSVPFLVCRFSSCASRDSHVTLSRELPCAAGLAASVILSTVRAFGAPPAFRALKGIVLLQALVWGYLVRKQTAETLQCMHELVRAEARVRARQAGVALENQVARKKVPGQDDCENHVREIEEGWCGGIGSVAEMQAKVLKRQEAAAKRERAMAYALTHQRQAGLRQQKPTNLQGSELDDDHWGSNWVERWVAARPWENRLLDNNAKESMPVCDDNQDEEIKSQVTPKGKAPTSSTPPNGLSKKKGASHRKSYSDINFTSFGRSSSVLPSTSLGTSKQKPKLEDEAFEEVSSQPTDVASLAVPNQKERRGQLNTSAKKRLSLPNNVGGGAAKGTTNRNPMNRSSSAKSDPKPQANAPNQARKQVELQA

SEQ ID NO: 132672 - protein, 239 aa, Triticum aestivum
  Clone ID: PAT_TA_27090.pep
AGKGERARGLDHRRWLLASPVIRRTRQRRNLQIRVTMSISGTIGVISGINECVNLFQWARSSISSLRSRWSGKQEQNLQDEVLHLQSGLQCLSDTLPAMYNIIDRAEWSSHKHCVAELLPKFSDAVYDAGGRGGEFRWYEQKVTVEGIANQSPFIDFFNCVIQGSFNKVKDIQKRLENLSNLLEKMGLGEATPRFDKSVRPETSSFPIETTIFGRDQELSQVIKLLVGTDNDSTTKTHS

SEQ ID NO: 132673 - protein, 148 aa, Triticum aestivum
  Clone ID: PAT_TA_27091.pep
VGLQLAVAVIVALALTNSYSSATTQLKGTGDFVLEPYKTEVTSESTPFAISLARHLHSIGAKMYGAFWCTHCNDQKQLFGREAMEILDYVECFPNGAGKGKKMANECVATGLEGFPTWVINGKLLSGDQELSVLAKESGFVSESPEQS

SEQ ID NO: 132674 - protein, 84 aa, Triticum aestivum
  Clone ID: PAT_TA_27092.pep
VGTEENVVCVSRLVLVVFLGGFTANTTLAHYCRDNGLLLHIHRAMHAVIDRQKNHGMHFRVLAKALRMSGGDHIHSGTCPGGRS

SEQ ID NO: 132675 - protein, 106 aa, Triticum aestivum
  Clone ID: PAT_TA_27093.pep
FFFFFKIKKHLDLASHTTMLYKSSTEGHTALQQVATFKTETRERVTPTVDAANNIQQIYHFPCRITADPTGITTHTDNIDNIRGPVPVHSPGKRELFHTHKNFKPK

SEQ ID NO: 132676 - protein, 213 aa, Triticum aestivum
  Clone ID: PAT_TA_27094.pep
MGEAAGDRVLSRLHSVRERIGDSLSAHPNELVAVFTRLVNLGNGMLQSHQIIAEYNTAIPEAEREKLKDGAFEDVLRAAQEAIVISPWVALAIRPRPGVWEYVRVNVSELAVEELSVPEYLQFKEQLVEGSNKDFVLELDFEPFNASFPRPSLSKSIGNGVQFLNRHLSSKLFHDKESMYPLLNFLRAHNYKGMTMMLNDRIRSLSALQGSSE

SEQ ID NO: 132677 - protein, 246 aa, Triticum aestivum
  unsure (1)..(246): unsure at all Xaa locations
  Clone ID: PAT_TA_27095.pep
DTPYSEFHHRFQELGLEKGWGDCAQRASETIHLLLDLLEAPDPSSLEKXLGTIPMVVNDXILSPHXYFAQANVLGYPDTGGQIVYILDQVRAMENEMLLRIKQQGLDITPKILIVTRLLPDAHGTTCGQRLXERVLAPEHTHILAXPFKTEKWICSQMDLRVLKAWPYLESXTLDDVAHXIARNLQPTPCLALENYTESNHKTXLLAPKFGXPHWTTSLWPLEKTKYPHSXLYWKEFGEPYHFSAP

SEQ ID NO: 132678 - protein, 50 aa, Triticum aestivum
  Clone ID: PAT_TA_27096.pep
MPFTPGPYSGKSTLALVARVSAVGVGVVYGSIKLGILKMTKPKEEAAAHH

SEQ ID NO: 132679 - protein, 76 aa, Triticum aestivum
  Clone ID: PAT_TA_27097.pep
WTKISQGGLQRIEEKYTWKLYSERLMTLTGVYGFWKYVSNLERRETRRYLEMLYALKYRTMASTVPLAVEGDSASK

SEQ ID NO: 132680 - protein, 161 aa, Triticum aestivum
  unsure (1)..(161): unsure at all Xaa locations
  Clone ID: PAT_TA_27098.pep
MGETAGERALSRIHSVRERIGDSLSAHTNELVAVFSRLVNQGKGMLQPHQITAEYNAAIPEAEREKLKDTAFEDLLRGAQEAIVIPPWVALAIRPRPGVWEYVRVNVSELGVEELSVAEYLQFKEQLPNXNIDNNFVLELDFEPFKRXFPRPSLVKSICQR

SEQ ID NO: 132681 - protein, 217 aa, Triticum aestivum
  unsure (1)..(217): unsure at all Xaa locations
  Clone ID: PAT_TA_27099.pep
MGEAAGDRVLSRLHSVRERIGDSLSAHPNELVAVFTRLVNLGNGMLQSHQIIAEYNTAIPEAEREKLKDGAFEDVLRAAQEAIVISPWVALAIRPRPGVWEYVRVNVSELAVEELSVPEYLQFKEQLVEGSHKDFVLELDFEPFNASFPRPSLSQVHRPPACSFLTRHPDXRKLFHDKESMYPLLNFFRAHNYRGLTMKLNDRIRSPSAXRGALRKA

SEQ ID NO: 132682 - protein, 88 aa, Triticum aestivum
  Clone ID: PAT_TA_27100.pep
RPGRLLARFVVEKILVLQDVGKLIEEGGEEPGHLVQEGIAADVLGAVLEWIKTEKGDSFLKEAKTSSNLKLEDFRPQHLKRSKSMPSC

SEQ ID NO: 132683 - protein, 85 aa, Triticum aestivum
  Clone ID: PAT_TA_27101.pep
DPSVSSLSPRGSSSSAPRNRERAAAAPAKPSPSSPIPPSPPPPPPQPCRSPRDPTPARAPSPSWPGSPPSASASSTAPSSSASSR

SEQ ID NO: 132684 - protein, 439 aa, Triticum aestivum
  unsure (1)..(439): unsure at all Xaa locations
  Clone ID: PAT_TA_27102.pep
MGETAGERALSRIHSVRERIGDSLSAHTNELVAVFSRLVNQGKGMLQPHQITAEYNAAIPEAEREKLKDTAFEDLLRGAQEAIVIPPWVALAIRPRPGVWEYVRVNVSELGVEELSIAEYLQFKEQLANGSIDNNFVLELDFEPFNASFPRPSLSKSIGNGVQFLNRHLSSKLFHDKESMYPLLNFLRAHNYKGMTMMLNDRIRSLSKLQGALRKAETHLSGLPADTPYSEFHHRFQELGLEKGWGDCAQRASETIHLLLDLLEAPDPSSLEKFLGTIPMVFNVVILSPHGYFAQGQCLXGYPDTGGQIVYILXDQVRAMENEMLLRIKQQGLDITPKILIVTRLLPDAHGTTCGQRLEKVLGTEHTYILRVPXFKTEDGIVRKWISRXEVWLYLEXAYTDDVAHQDRRKAVRPPLDLIIWKLTAMATLKSMFVWRTNC

SEQ ID NO: 132685 - protein, 338 aa, Triticum aestivum
  unsure (1)..(338): unsure at all Xaa locations
  Clone ID: PAT_TA_27103.pep
YFAQANVLGYPDTGGQVVYILDQVRAMENEMLLRIKQQGLDITPKILIVTXRLLPDAHGTTCGQRLEKVLGTEHTHILRVPFKTEDGIVRKWISRFEVWPYLEAYTDDVAHEIAGELQATPDLIIGNYSDGNLVACLLAHKLGVTHCTIAHALEKTKYPNSDLYWKKFEDHYHFSCQFTADLIAMNHADFIITSTFQEIAGNKDTVGQYESHMAFTMPGLYRVVHGIDVFDPKFNIVSPGADMSIYFPYTEQQKRLTSLHTEIEELLFSDIENAEHKFVLKDKRKPIIFSMAKVDRVKNMTGLVEMYGRESRLQELVNLMVVWGXDHGRVPRAKGEPA

SEQ ID NO: 132686 - protein, 314 aa, Triticum aestivum
  Clone ID: PAT_TA_27104.pep
ASCRIRHEAGADMSIYFPYSESQRRLTSLHPEIEELLYSNVDNNEHKYVLKDRNKPIIFSMARLDRVKNLTGLVELYGKNPRLQELVNLVVVCGDHGNPSKDKEEQAEFKKMFDLIEQYNLNGHVRWISAQMNRVRNAELYRYICDTKGAFVQPAFYEAFGLTVIEAMTCGLPTFATAYGGPAEIIVNGVSGYHIDPYQGDKASALLVEFFEKCQVDPSHWTKISQGGLQRIEEKYTWKLYSERLMTLTGVYGFWKYVSNLERRETRRYLEMLYALKYRTMASTVPLAVEGDSREQVIWPPPDQKKSGLDSCKD

SEQ ID NO: 132687 - protein, 422 aa, Triticum aestivum
  unsure (1)..(422): unsure at all Xaa locations
  Clone ID: PAT_TA_27105.pep
LSGLPADTPYSEFHHRFQELGLEKGWGDCAQRASETIHLLLDLLEAPDPSSLEKFLGTIPMVFNVVILSPHGYFAQANVLGYPDTGGQIVYILDQVRAMENEMLLRIKQQGLDITPKILIVTRLLPDAHGTTCGQRLEKVLGTEHTHILRVPFKTEDGIVRKWISRFEVWPYLEAYTDDVAHEIAGELQATPDLIIGNYSDGNLVACLLAHKLGVTHCTIAHALEKTKYPNSDLYWKKFEDHYHFSCQFTADLIAMNHADFIITSTFQEIAGNKDTVGQYESHMAFTMPGLYRVVHGIDVFDPKFNIVSPGADMSIYFPYTEQQKRLTSLHTEIEELLFSDVENAEHKFVLKDKKKPIIFSMARLDRVKNMTGLVEMYGRNPRLQEAVNXMVVCGDHWKVSKDKEEQAXFKKKFELIEQYNP

SEQ ID NO: 132688 - protein, 339 aa, Triticum aestivum
  unsure (1)..(339): unsure at all Xaa locations
  Clone ID: PAT_TA_27106.pep
MGETAGERALSRIHSVRERIGDSLSVHTNELVAVFSRLVNQGKGMLQPHQITAEYNAAIPEAEREKLKDTAFEDLLRGAQEAIVIPPWVALAIRPRPGVWEYVRVNVSELGVEELSVAEYLQFKEQLANGSIDNNFVXLELDFEPFNASFPRPSLSKSIGNGVQFLNRHLSSKLFHDKESMYPLLNFLRAHNYKGMTMMLNDRIRSLSKLPGALRKAETHLSGLPADTPYSEFHHRFQELGLEKGLGDCAQRASETIHLLLDLLEAPDPSSLXEKFLGTIXPMVFNGCILSPHGYFAQANVFGYPDTCGQNVYILXQIRAMENEMLVKNKXQGLDFTPK

SEQ ID NO: 132689 - protein, 713 aa, Triticum aestivum
  Clone ID: PAT_TA_27107.pep
MDDDKWLKSGVPYSPNRDAHMDLTNGPATNYRGGPGGTHGVLRNPRAALLVGPQSNAPQVPRSGSDADRWQQKGLIPSPVTPMQVMHKAEKKYVVGKVSDEEQAKQRQLKAILNKLTPQNFDKLFEQVKEVNIDNVSTLTGVISQIFDKALMEPTFCEMYANFCSHLAGALPDFSEDNEKITFKRLLLNKCQEEFERGEREEAEADKTEEEGEIKQTKEEREEKRVKARRRMLGNIRLIGELYKKRMLTERIMHECIKKLGGNYQNPDEENIEALCKLMSTIGEMIDHPKAKEHMDAYFDRMRNLSTSQLISSRVRFLLRDSIDLRKNKWQQRRKVDGPKKIDEVHRDAAQERHAQSQSSRSRGPVVSSLPRRGAPSMDYGSRGSAAPLVSPGPQQRGRGFGNQDIRYEQERHQFDRTVPLPQRSVKDEAITLGPQGGLARGMSLRGQPPVSNSELPSVVDQRRILSGPNGYNSVPSTTREDTSSRIPDRFSGRIAPAAQSASSSHRPASQEGRSGNKSYSEEELREKSIATIREYYSAKDEKEVALCIEELNAPSFYPSLVSLWVNDSFERKDMERELLAKLFVGLYNGGYNLLSKPQLIVGLSSVLASLEDALSDSPRAAEYLGRLLARFVVEKILVLQDVGKLIEEGGEEPGHLVQEGIAADVLGAVLEWIKTEKGDSFLKEAKTSSNLKLEDFRPQHLKRSKLDAFMLT

SEQ ID NO: 132690 - protein, 472 aa, Triticum aestivum
  unsure (1)..(472): unsure at all Xaa locations
  Clone ID: PAT_TA_27108.pep
MGETAGERALSRIHSVRERIGDSLSAHTNEXLVAVFSRLVNQGKGMLQPHQITAEYNAAIPEAEREKLKDTAFEDLLRGAQEAIVIPPWVALAIRPRPGVWEYVRVNVSELGVEELSIAEYLQFKEQLANGSIDNNFVLELDFEPFNASFPRPSLSKSIGNGVQFLNRHLSSKLFHDKESMYPLLNFLRAHNYKGMTMMLNXDRIRSLSTLQGALRKAETHLSGLPADTPYSEFHHRFQELGLEKGWGDCAQRASETIHLLLDLLEAPDPSSLEKFLGTIPMVFNVVILSPHGYFAQANVLGYPDTGGQIVYILDQVRAMENEMLLRIKQQGLDITPKILIVTRLLPDAHGTTCGQRLEKVLGTEHTHILRVPFKTEDGIVRKWISRFEVWPYLEAYTDDVAHEIAGELQATPDLIIGNYSDGNLVACLLAHKLGVTHCTIAHALEKNKYSNSDLYWKKFWDHYHFXSCQFT

SEQ ID NO: 132691 - protein, 816 aa, Triticum aestivum
  unsure (1)..(816): unsure at all Xaa locations
  Clone ID: PAT_TA_27109.pep
MGEAAGDRVLSRLHSVREXRIGDSLSAHPNELVAVFTRLVNLGNGMLQSHQIIAEYNTAIPEAEREKLKDGAFEDVLRAAQEAIVISPWVALAIRPRPGVWEYVRVNVSELAVEELSVPEYLQFKEQLVEGSNKDFVLELDFEPFNASFPRPSLSKSIGNGVQFLNRHLSSKLFHDKESMYPLLNFLRAHNYKGMTMMLNDRIRSLSALQGALRKAEEHLSGLPADTPYSDFHHRFQELGLEKGWGDCAKRAQETLHLLLDLLEAPDPSTLEKFLGTIPMVFNVVILSPHGYFAQANVLGYPDTGGQVVYILDQVRAMENEMLLRIKQQGLDITPRILIVTRLLPDATGTTCGQRLEKVLGTEHTHILRVPFRTESGIVRKWISRFEVWPYLETFTEDVAHEISGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGMYRVVHGIDVFDPKFNIVSPGADMSIYFPYSESQRRLTSLHPEIEELLYSDVDNNEHKYVLKDRNKPIIFSMARLDRVKNLTGLVELYGKNPRLQELVNLVVVCGDHGNPSKDKEEQAEFKKMFDLIEQYNLNGHVRWISAQMNRVRNAELYRYICDTKGAFVQPAFYEAFGLTVIEAMTCGLPTFATAYGGPAEIIVNGVSGYHIDPYQGDKASTLLVEFFEKCQVDPSHWTKISQGGLQRIEEKYTWKLYSERLMTLTGVYGFWKYVSNLERRETRRYLEMLYALKYRTMASTVPLAVEGESASK

SEQ ID NO: 132692 - protein, 136 aa, Triticum aestivum
  Clone ID: PAT_TA_27110.pep
IRHEASSPHEREREKKRSPPPRRRSANQTLVVVPDPAVAAAAAAMPFTPGPYSGKSTLALVSPRNRPLPPIPPLHRGSDLDDRPWGCCFAGGQGLRRRRRPRLRLRQARHPQDDQAQGGSSCCSSLRTSSSSELTP

SEQ ID NO: 132693 - protein, 816 aa, Triticum aestivum
  Clone ID: PAT_TA_27111.pep
MGETAGERALSRIHSVRERIGDSLSAHTNELVAVFSRLVNQGKGMLQPHQITAEYNAAIPEAEREKLKDTAFEDLLRGAQEAIVIPPWVALAIRPRPGVWEYVRVNVSELGVEELNVLNYLQFKEQLANGSIDNNFVLELDFEPFNASFPRPSLSKSIGNGVQFLNRHLSSKLFHDKESMYPLLNFLRAHNYKGMTMMLNDRIRSLGTLQGALRKAETHLSGLPADTPYSEFHHRFQELGLEKGWGDCAQRASETIHLLLDLLEAPDPSSLEKFLGTIPMVFNVVILSPHGYFAQANVLGYPDTGGQVVYILDQVRAMENEMLLRIKQQGLDITPKILIVTRLLPDAHGTTCGQRLEKVLGTEHTHILRVPFKTEDGIVRKWISRFEVWPYLEAYTDDVAHEIAGELQATPDLIIGNYSDGNLVACLLAHKLGVTHCTIAHALEKTKYPNSDLYWKKFEDHYHFSCQFTADLIAMNHADFIITSTFQEIAGNKDTVGQYESHMAFTMPGLYRVVHGIDVFDPKFNIVSPGADMSIYFPYTEQQKRLTSLHTEIEELLFSDVENAEHKFVLKDKKKPIIFSMARLDRVKNMTGLVEMYGRNPRLQELVNLVVVCGDHGKVSKDKEEQAEFKKMFDLIEQYNLIGHIRWISAQMNRVRNGELYRYICDMKGAFVQPAFYEAFGLTVIEAMTCGLPTFATAYGGPAEIIVHGVSGYHIDPYQNDKASALLVDFFGKCQEDPSHWNKISQGGLQRIEEKYTWKLYSERLMTLSGVYRFWKYVSNLDRRETRRYLEMLYALKYRKMAATVPLAVEGETSGK

SEQ ID NO: 132694 - protein, 286 aa, Triticum aestivum
  Clone ID: PAT_TA_27112.pep
ASGVPGAHTPPTHPTSANHPQPNHPRGYGCTPAPETRAPPIHFYPAIIFSMARLDRVKNMTGLVEMYGRNPRLQELVNLVVVCGDHGKVSKDKEEQAEFKKMFDLIEQYNLIGHIRWISAQMNRVRNGELYRYICDMKGAFVQPAFYEAFGLTVIEAMTCGLPTFATAYGGPAEIIVNGVSGYHIDPYQNDKASALLVDFFGKCKEDPSHWNKISQGGLQRIEEKYTWKLYSERLMTLSGVYGFWKYVSNLDRRETRRYLEMLYALKYRKMAETVPLAVEGETSGK

SEQ ID NO: 132695 - protein, 408 aa, Triticum aestivum
  Clone ID: PAT_TA_27113.pep
WIPRAAGIRHEDGNLVACLLAHKLGVTHCTIAHALEKTKYPNSDLYWKKFEDHYHFSCQFTADLIAMNHADFIITSTFQEIAGNKDTVGQYESHMAFTMPGLYRVVHGIDVFDPKFNIVSPGADMSIYFPYTEQQKRLTSLHTEIEELLFSDVENAEHKFVLKDKKKPIIFSMARLDRVKNMTGLVEMYGRNPRLQELVNLVVVCGDHGKVSKDKEEQAEFKKMFDLIEQYNLIGHIRWISAQMNRVRNGELYRYICDMKGAFVQPAFYEAFGLTVIEAMTCGLPTFATAYGGPAEIIVNGVSGYHIDPYQNDKASALLVDFFGKCKEDPSHCNKISQGGLQRIEEKYTWKLYSERLMTLSGVYGFWKYVSNLDRRETRRYLEMLYALKYRKMAETVPLAVEGETSGK

SEQ ID NO: 132696 - protein, 110 aa, Triticum aestivum
  unsure (1)..(110): unsure at all Xaa locations
  Clone ID: PAT_TA_27114.pep
WKAVIDGYSQVGKAFLAGTVLVFGGATAVLLYTANTLQLHSVDVVKAKGKDAVQPHAHVIKVQIPPLRLWAEAAAPSRHCHADGDCGAXEKSVLVRELSRALGSKTRPPN

SEQ ID NO: 132697 - protein, 122 aa, Triticum aestivum
  Clone ID: PAT_TA_27115.pep
VLAEGRSEGGRRQPVRFQIGGWGRGSLVISLIFTWSENLLQRQLFRNGGSMLLMCTLLVFVVTLRYLILVLLLRLVTRNRSCRIKQRLVNGKVMMCVGNDSKIDMITIYTLRSTFGISVEPK

SEQ ID NO: 132698 - protein, 529 aa, Triticum aestivum
  Clone ID: PAT_TA_27116.pep
GTRGRRRGPKEGGGDGRGGGLIFMCNAQTKPECFQNRVFGMPMGKKEMVEKVRPGTKVFLYDFDLRLLYGVYKATSKGGINLIRNAFNGKFPAQVKFTTDKDCLPLPESTFKHAIKENYSASRKFDPEITSTQVRRLMALFKPITVQQSAPRGHLDGRYHHEERRHQHEDRPHPLHVEDRRPQVVVHVPAPEDSYRATHYAPFPTESRPGQFLVNVQDDHRYYQQAPPAPESQHIPLAPEARQVPIATGPHYAPSVPEPRHVPLVYYHHLAPSSDDSYYRSRVDPVHERIAARTPPRDYAAQLGELAARADHMSDLYRTTVHDARLEDPYRPGELAARGARVEELYRPGEIASRGDRVADLYQDLYRSAEAPSRGARMEDLYRPGEVAARDVRMEDPYRQGGIDARGSYGGLYRSDQLNARAVDLPHSYQTSNPAYAEASQRPVPTARANGPGAPVSSLYSFAGAPAYRLIFSAFHMRCLGSVVLPVVSLDVYFLVKNYSLTVRSRDVLFSYLVCLLNCLPDEWHSGSD

SEQ ID NO: 132699 - protein, 186 aa, Triticum aestivum
  Clone ID: PAT_TA_27117.pep
YDFERQFQAAYTTAKFKEFQDQLRGKIYCYPTQLNKEGSIFTFGVREDSKIFCEGEDGKGKEKGVILEFIVLFNQGECDVQCMCRLFEFRGILCSHIISVLALMEITDVPFRYILQRWRKDIKRKPPFIRCSYDDMIDTQVVQRYDNLCKRSPELAENGAEFDALHDLVMDGLNELQSKIDAYCAR

SEQ ID NO: 132700 - protein, 238 aa, Triticum aestivum
  unsure (1)..(238): unsure at all Xaa locations
  Clone ID: PAT_TA_27118.pep
RSLLPPPLALLSSPSSPLAAPLLDRSSPPATNMSTAYSYSPSPPPRGYRGRAXAPSPRDRYDGRGRDLPTSLLVRNLRRDCRPXDLRRPFAQFXGRLKDVYIPRDYYTQEPRGFGFVQYFDPNDAADAKYYMDGQVILGREVAVVFAQENRKKPAEMRTRESSRGRSYDRRHSPSPRGRPSYRGRSYSRSPSPRPARRRFRDESPSRSRSPSGSRSASPLDGKYGRSSRRERSISVSG

SEQ ID NO: 132701 - protein, 181 aa, Triticum aestivum
  Clone ID: PAT_TA_27119.pep
DTMRVCPRAPVGSSFVNDDSTGISQQGWRTTHNHTIKLPVSLLCKTTSTSGMESGSSGPSNGGDETAAEDSNNSLGAAAAARSASLRNRTIRISKGKRKHATSSYHPGESSSSVNELGSSCLAPSDTTAGRNRTTRRHNISVIDIDDIPSADAGASLSGRSNRTSIDPNVSAQLEADELLA

SEQ ID NO: 132702 - protein, 127 aa, Triticum aestivum
  Clone ID: PAT_TA_27120.pep
PIVTREAFDSMLSARNVSGCEGGAFYTYDAFLAAANASVFPGFGTTGDDKTRRRELAAFFGQTSFVTTGYCYVKAVNRASAPYYGRGPIQLTTEDNYRLARRALGLDLLRNPDLVSTDPVVAFRRPS

SEQ ID NO: 132703 - protein, 201 aa, Triticum aestivum
  Clone ID: PAT_TA_27121.pep
AALTAGAEEQEDEAEDAEQDRGDGAAAGGGGGADRRHAGADPDGGHLEGEAQGVAGEGVQQGVGVLRHQVLLHHPELLEQNATLAFAAAMWRWMTPIKKKQPSAHEAFTGVWKPTKNDTLSKRLPGFGATMNLLYGESICGRGFIDEMNVIISHYQYYLDLMGFGRERSGLNLDCAEQAPFNPAPKKDDEQQPTGGQKPSG

SEQ ID NO: 132704 - protein, 131 aa, Triticum aestivum
  unsure (1)..(131): unsure at all Xaa locations
  Clone ID: PAT_TA_27122.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAGYLKGGAXKGGYXAPSKDAL

SEQ ID NO: 132705 - protein, 190 aa, Triticum aestivum
  unsure (1)..(190): unsure at all Xaa locations
  Clone ID: PAT_TA_27123.pep
MGKIKIGINGFGRIGRLVARVALQSDDVELVAVNDPFITTEYMTYMFKYDTVHGHWKHSDIKLKDDKTLLFGEKPXTVFGVRNPEEIPWGEAGADYVVESTGVFTDKDKAAAHLKGGAKKVVISAPSKDAPMFVVGVNEDKYTSXVYIVSKASWTTNCLGPLARXINDHFRINEGLVTTGIAITGPQKTG

SEQ ID NO: 132706 - protein, 232 aa, Triticum aestivum
  unsure (1)..(232): unsure at all Xaa locations
  Clone ID: PAT_TA_27124.pep
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAYIKGGAKKVIISAPSKDAPMFVCGVNEKEYKSDIGIVSNARWTTNCLAPXAKVSMTRFAIVEGLMTTIHAMTCTQKNVGGSFHKDRRGERLATLKYIPGNTGAPKGCLQGGSQSFNGKLH

SEQ ID NO: 132707 - protein, 241 aa, Triticum aestivum
  unsure (1)..(241): unsure at all Xaa locations
  Clone ID: PAT_TA_27125.pep
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTTNCLCSLAKXINDRFGIVEGLKTTVHAMTGTQQXLVKVPSHQDWESGRAAHFNIXIPGTIGAAKGWLAGCFPXLNGKLTGMALPGS

SEQ ID NO: 132708 - protein, 125 aa, Triticum aestivum
  unsure (1)..(125): unsure at all Xaa locations
  Clone ID: PAT_TA_27126.pep
MFVVGVNEDKYTSDVNIVSNASCTTNCLAPLAKIINDNFGIIEGLMTTVHAITATQKTVDGPSSKDWRGGRAASFNIIPSSTGCCQXALGKVLPEAEWASLTGMSFRVLTVRSTTDTSLVPNSAR

SEQ ID NO: 132709 - protein, 146 aa, Triticum aestivum
  unsure (1)..(146): unsure at all Xaa locations
  Clone ID: PAT_TA_27127.pep
MAPIKIGINGFGRIGRLVARVALQSPDVELVAVNDPFITTDYMTYIFKXYDTVQWTSGKHHEIXVXKDSKDLLFGQEGVAVFGLQEPEEDSMGLLLGADTLXSTGXLTDKDKXSQIKGGAKKXHXAPNKDLQVCSMRINLHSQPSQ

SEQ ID NO: 132710 - protein, 156 aa, Triticum aestivum
  Clone ID: PAT_TA_27128.pep
NAGTVTAGNASSISDGAAALVLVSGQKAQELGLEVLARIKGFADAAQAPELFTTTPALAIPKALSNAGLESSSVDFYEINEAFAAVALANQKILGIPSEKINVHGGAVSLGHPLGCSGARILVTLIGVLREKGGKIGVAGVCNGGGGASALVLELA

SEQ ID NO: 132711 - protein, 193 aa, Triticum aestivum
  unsure (1)..(193): unsure at all Xaa locations
  Clone ID: PAT_TA_27129.pep
PTCSSTTPFTATVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLXIRHMAKTQVECSAFLWWRLKRCPALVYAKE

SEQ ID NO: 132712 - protein, 257 aa, Triticum aestivum
  unsure (1)..(257): unsure at all Xaa locations
  Clone ID: PAT_TA_27130.pep
MAPIKIGINGFGRIGRLVARVALQSPDVELVAVNDPFITTDYMTYMFKYDTVHGQWKHHEVKVKDSKTLLFGEKEVAVFGCRNPXEIPWAAAGAEYVVESTGVFTDKDKAAAHIKGGAKKVIISAPSKDAPMFVCGVNEKEYKSDIDIVSNASCTTNCLAPLAKVXNDRFGIVEGLMTHVHAMTATXKTVDGPFHQXWKGGRAASFXIIPRSTGPAKAVAKGLPKANGKVNGXAFRSPRWRFSVVNRTGKLAKPETY

SEQ ID NO: 132713 - protein, 384 aa, Triticum aestivum
  unsure (1)..(384): unsure at all Xaa locations
  Clone ID: PAT_TA_27131.pep
MGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKAAAHLKGGAKKVVISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVXWYDNEWGYSNRVVDLIRHMGQRPSKSALLSLVGAWSRGVPAFVYAKDIFGPDDAWVQVKLGHDYFFSRHN

SEQ ID NO: 132714 - protein, 146 aa, Triticum aestivum
  Clone ID: PAT_TA_27132.pep
SSISDGAAALVLVSGQKAQELGLEVLARIKGFADAAQAPELFTTTPALAIPKALSNAGLESSSVDFYEINEAFAAVALANQKILGIPSEKINVHGGAVSLGHPLGCSGARILVTLIGVLREKGGKIGVAGVCNGGGGASALVLELA

SEQ ID NO: 132715 - protein, 219 aa, Triticum aestivum
  Clone ID: PAT_TA_27133.pep
FGRGLLLPSSSTRAPRWGLGFAPALHRRDDHGRAGPHRLGCYAARLQVPLLLGAPPRRLHGSRSCLGCCGCAKPAPITAVDEPSKGLRIQGRSIRKTNLSEGFWSTSAHGIGNSALQSQRSMSSICTAPQSSDQHGAGSSSNPNEFVNQGLVQWNQTRQQWVGNKKRKSRLEKTQEPKISWNTTYESLLGSNKLFYQPIPLAEMVDLLVDVWEQEGLYG

SEQ ID NO: 132716 - protein, 184 aa, Triticum aestivum
  unsure (1)..(184): unsure at all Xaa locations
  Clone ID: PAT_TA_27134.pep
DNHEMSPDQGYCDDSYTQWPCVKGAEYYGRGAIPVYWNFNYGXXGDGLKVDLLHHPELLEQNATLAFAAAMWRWXMTPIKKKQPSAHEAFTGVWXKPTKNDTLSKRLPGFGATMNLLYGESICGRGFIDEMNVIISHYQYYLDLMGFGRERSGLNLDCAEQAPFNPAPKKDDEQQPTGGQKPSG

SEQ ID NO: 132717 - protein, 149 aa, Triticum aestivum
  unsure (1)..(149): unsure at all Xaa locations
  Clone ID: PAT_TA_27135.pep
MKRKTRNKIVVTVLLLGAAAVLIGGTLALILTAGTWKVKLKESQEKVCNKGWECSGTKYCCNQTITDFFKVYQFENLFAKRNFPVAKAVGFWDYQAFITAASLFENQGFCTTGGIDMQMMELCAFLGHVGAKTSCGYGVATGGPXAWGL

SEQ ID NO: 132718 - protein, 224 aa, Triticum aestivum
  unsure (1)..(224): unsure at all Xaa locations
  Clone ID: PAT_TA_27136.pep
MGKIKIGINGFGRIGRLVARVALQSDDVELVAVNDPFITTEYMTYMFKYDTVHGHWXKHSDIKLKDDKTLLFGEKPVTVFGVRNPEEIPWGEAGAXDYVVESTGVFTDKDKAAAHLKGGAKKVGISAPSKDAXPMFVVGVNEXDKDTSDVNIVLNASCTTNCLAPLAXKIINDNFGIIEGLMTTGHALTAPQKTGGXVPSTQDWRGGQGPQALTLFPSNHLVAV

SEQ ID NO: 132719 - protein, 178 aa, Triticum aestivum
  unsure (1)..(178): unsure at all Xaa locations
  Clone ID: PAT_TA_27137.pep
MGSQNIGPRDVCIVGVARTPMGGFLGXLSSLPATKLGSVAIEAALKXGANVDPSLVQEVFFGNVLSANLGQAPARQAALGAGIPNTVVCTTVNKVCASGMKATMFAAQSIQLGSNDIVVAGGMESMSNAPKYIAEARKGSRFGHDSLVDGMLKDGLWDVYGDCAMGVCAELCADNHAL

SEQ ID NO: 132720 - protein, 174 aa, Triticum aestivum
  unsure (1)..(174): unsure at all Xaa locations
  Clone ID: PAT_TA_27138.pep
MLLGCGSLSSWVRRLVACVGNCFGCAKSTPITAVDEPSKGLRIQGRSIKHRSLSEDFWSTSPREMENSALQSQRSMSSISTAAQSSEQHGAXSSSNPNEFVNQGLLLWNQTRQQWVGNRRFNSQRQKTREPKIGWNATYESLLGSTKTFAQPIPXLGEMVDFLVDXWEQEGLYD

SEQ ID NO: 132721 - protein, 134 aa, Triticum aestivum
  unsure (1)..(134): unsure at all Xaa locations
  Clone ID: PAT_TA_27139.pep
SFNIIPSSTGAAKAVGKVLPELNGKLTGMSFRVPTVDVSVVDLTVRTEKAASYDDIKKAIKAASEGKLKGIMGYVEEDLXVSTDFVGDSRSSIFDAKAGIALNDHFVKLVSWYDNEWGYSNRVVDLIRHMAKTQ

SEQ ID NO: 132722 - protein, 120 aa, Triticum aestivum
  unsure (1)..(120): unsure at all Xaa locations
  Clone ID: PAT_TA_27140.pep
EGGCYVVFTDKDKAAADMXGGANKVIISAPSKDAPMFVCGVNEKEYKSDIDIVSNASCTTNYLAPLXINDRFGIVEGLMTTVHAMTATQKTVECPSSKDWIGGRAASFNIIPSSTWCHKE

SEQ ID NO: 132723 - protein, 154 aa, Triticum aestivum
  Clone ID: PAT_TA_27141.pep
AAASTLGWWSGISGSLSDPYGLIIRISAEHGRYVAKSYDIRQLASDGHGYPIFEIYFAEANGGYNLQAVHLKPDVSDSDQLRNMLSGKLKGIMGYVEEDLVSTDFVGDSRSSIFDAKAGIALNDHFVKLVSWYDNEWGYSNRVVDLIRHMAKTQ

SEQ ID NO: 132724 - protein, 264 aa, Triticum aestivum
  unsure (1)..(264): unsure at all Xaa locations
  Clone ID: PAT_TA_27142.pep
RHEAAAHLKGGAKKVVISAPSKDAPMFVVGVNEDKYTSDVNIVSNASCTTNCLAPLAKVCFVSSRRLTLTTFGIVDQFVIMFIIIHQIINDNFGIIEGLMTTVHAITATQKTVDGPSSKDWRGGRAASFNIIPSSTGAAKAVGKVLPELNGKLTGMSFRVPTVDVSVVDLTVRTEKAASYDDIXKKAIKAASEGKLXKGIMGYVEEDLVSTDFVXGDSKSEASLMPRAGIALNDHFVKLVSWYDNEWGYSNRVVDLIRHMAKTQ

SEQ ID NO: 132725 - protein, 176 aa, Triticum aestivum
  unsure (1)..(176): unsure at all Xaa locations
  Clone ID: PAT_TA_27143.pep
MLLGCGSLSSWVRRLVACVGAEXCFGCAKSTPITAVDEPSKGLRIQGRSIKHRSLSEDFWSTSPREMENSALQSQRSMSSIRHSQHXSSEQHGAGSSSNPNEFVNQGLLLWNQTRQQWVGNRRLNSQRQKTREPKIGWNATYESLLGSTKTFAQPIPLXEMVXFLVDGWEQEGLYD

SEQ ID NO: 132726 - protein, 564 aa, Triticum aestivum
  Clone ID: PAT_TA_27144.pep
GKWSWERWKQHFALIQESERLVDELQLQLRTAVCREDYRSAHKLKLAIAATSRNDTVGRAISELHRAIEEDRYVDAAYIRDHAGAGLLGWWSGISGSLSDPYGLIIRISAEHGRYVAKSYDIRQLASDGHGYPIFEIYFAEANGGYNLQAVHLKPDVSDSDQLQNMLSGKLDVNNINISSSSLGAKHEEHDEGISMDDQNSDDSDVAAGPAGLKNLSNDSTPIPRIKILKVAPMENINQDYIIKIFDQISEEDDDNDEAEIENESSQDIGDEDKNEEAGTISAEENNDESGEESDIEALLSIGIEVDNDKDFASQSSPKTFERMPAKLDKRDRFSFTFYTEQSSKKPAAEKAQQIPRKRVGFRTTEQDGDLKFDRLKLSGGNRKLPVLQLGIKQLNNKVQPKLYGVTHFSRIQMPISSDPLSGLYETASGFDSEVLSLQRKFGQWQEEDSSEEHLDLKFYEYVEAAKLTGDNLVPAGQVVFRAKVGKHYQLPHKGVIPRELGVVARYKGQRRIADAGFKNPRWVDGELLILDGKFIRDGPVIAFFYWTSNLHLFEFFRRLSLPD

SEQ ID NO: 132727 - protein, 195 aa, Triticum aestivum
  Clone ID: PAT_TA_27145.pep
VPIEVPVGRGKPAVLVDKDESLDKFDAAKLKKLRPAFKDNAGTVTAGNASSISDGAAALVLVSGKKAQELGLHVLARIKGFADAAQAPELFTTTPALAIPKALTNAGLESSRVDFYEINEAFSAVALANQKLLGIPSEKINVHGGAVSLGHPLGCSGARILVTLLGVLREKSGKIGVAGVCNGGGGASALVMELA

SEQ ID NO: 132728 - protein, 203 aa, Triticum aestivum
  Clone ID: PAT_TA_27146.pep
KNRLWKTCVYAITFGMLVALLLGLNMSWSAITAALALIVLDFKDARPCLEKVSYPLLLFFCGMFIPVDGFNQTGIPSTFWEFMEPYARIDTPAGVVILALVILLLSNVASNVPTVLLMGNEVATAAAAISPAAETRSWLLLAWVSTVAGNLSLLGSAANLIVCEQARRAPRNAYELTFWNHLIFGVPSTLIVTAVGIPLIGKM

SEQ ID NO: 132729 - protein, 332 aa, Triticum aestivum
  Clone ID: PAT_TA_27147.pep
MKRKTRNKIVVTVLLLGAAAVLIGGTLALILTAGTWKVKLKESQEKVCNKGWECSGTKYCCNQTITDFFKVYQFENLFAKRNFPVAKAVGFWDYQAFITAASLFENQGFCTTGGIDMQMMELCAFLGHVGAKTSCGYGVATGGPTAWGLCYNHEMSPDQGYCDDSYTQWPCVKGAEYYGRGAIPVYWNFNYGAAGDGLKVDLLHHPELLEQNATLAFAAAMWRWMTPIKKKQPSAHEAFTGVWKPSKNDTLSKRLPGFGATMNLLYGESICGRGFIDEMNVIISHYQYYLDLMGFGRERSGLNLDCAEQAPFNPAPKKDDEQQPTGGQKPSG

SEQ ID NO: 132730 - protein, 143 aa, Triticum aestivum
  Clone ID: PAT_TA_27148.pep
CVRVGTVSGFNKTGLPGAIWNFMAPYSKVDSAGGISVLCVIILLLSNLASNVPTVLLMGNEVATAAALISPAAVTRSWLLLAWVSTVAGNLSLLGSAANLIVCEQARRAPRNAYELTFWNHLIFGVPSTLIVTAVGIPLIGKM

SEQ ID NO: 132731 - protein, 272 aa, Triticum aestivum
  unsure (1)..(272): unsure at all Xaa locations
  Clone ID: PAT_TA_27149.pep
MGKIKIGINGFGRIGRLVARVALQSDDVELVAVNDPFITTEYMTYMFKYDTVHGHWKHSDIKLKDDKTLLFGXEKPVTVFGRQEPLREIPWGXEGWVPDYVVESTGXVFTGQGQGPPAHFEGWCQRKVVISAPKQKNAPMFVVGVNEDKYTSDVNIVSNASCTTNCLAPLAKIINDNLGIIEGLMTTVHAITATQKXTVDGSSSKDWRGGXRAASFNNIXPANTGACPSLLARVFLELDWQPFPVWLFRVPTWGRCQLLNLTVETRKGAFSH

SEQ ID NO: 132732 - protein, 164 aa, Triticum aestivum
  Clone ID: PAT_TA_27150.pep
MARIAPLVLAALLSVLVAPSSACPSCPTPTTPPPPPPPKVKPPPPPSSVPCPPPPYSPAPTPPTPATPTPPAPSSPTGKCPVDVLKLVACVDALNGLVHAVVGAKASETCCPLLSGVADLDAALCLCTTIKAKVLNVKLVLPVAISVLVNQCGKHVPSSFQCPS

SEQ ID NO: 132733 - protein, 164 aa, Triticum aestivum
  Clone ID: PAT_TA_27151.pep
MARIAPLVLVALLSVLVAPSSACPSCPTPTTPPPPPPPKVKPPPPPSSVPCPPPPYSPAPTPPTPVTPAPPTPSSPTGKCPVDVLKLVACVDALNGLVHAVVGANASETCCPLLSGVADLDAALCLCTTIKAKALNVKLVLPVAISVLVNQCGKHVPSSFQCPS

SEQ ID NO: 132734 - protein, 333 aa, Triticum aestivum
  unsure (1)..(333): unsure at all Xaa locations
  Clone ID: PAT_TA_27152.pep
MKRKTRNKIVVTVLLLGAAAVLIGGTLALILTAGTWKVKLKESQEKVCNKGWECSGTKYCCNQTITDFFKVYQFENLFAKRNFPVAKAVGFWDYQAFITAASLFENQGFCTTGGIDMQMMELCAFLGHVGAKTSCGYGVATGGPTAWGLCYNHEMSPDQGYCDDSYTQWPCVKGAEYYGXRGAIPVYWNFNYGAAGDGLKVDLLHHPELLEQNATLAFAAAMWRWMTPIKKKQPSAHEAFTGVWKPTKNDTLSKRLPGFGATMNLLYGESICGRGFIDEMNVIISHYQYYLDLMGFGRERSGLNLDCAEQAPFNPAPKKDDEQQPTGGQKPSG

SEQ ID NO: 132735 - protein, 342 aa, Triticum aestivum
  unsure (1)..(342): unsure at all Xaa locations
  Clone ID: PAT_TA_27153.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGAXDYVVESTGVFTDKDKAAAHLKGGXAKKVVISAPXSKDAPMFVGGXMRTKYTSDVNIXVQNANCTTNCXLAPLAKIINDNFGIIEGLMTTVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 132736 - protein, 337 aa, Triticum aestivum
  Clone ID: PAT_TA_27154.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLASLAKIINDNFGIIEGLMTTVHAITGPQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 132737 - protein, 398 aa, Triticum aestivum
  unsure (1)..(398): unsure at all Xaa locations
  Clone ID: PAT_TA_27155.pep
MGSDLRDVCVVGVARTPMGSFLGGLSSLPATKLGSIAIEAALKRANVDPSLVQEVFFGNVLSANLGQAPARQAALGAGIPNTVVCTTVNKVCASGMKATMFAAQSIQLGINDIVVAGGMESMSNAPKYIAEARKGSRFGHDSLVDGMLKDGLWDVYGDCAMGVCAELCADNHALTREDQDAYAIQSNERGIAARDSGAFAWEIVPIEVPVGRGKPXVLVDKDESLDKFDAAKLKKLRPAFKENAGTVTAGNASSISDGAAALVLVSGKKAQELGLQVLARIKGFADAAQAPELFTTTPALAIPKALTNAGLESSRIDFYEINEAFSAVALANQKLLGIPSEKINVHGGAVSLGHPLGCSGARILVTLLGVLREKSGKIGVAGVCNGGGGASALVMELA

SEQ ID NO: 132738 - protein, 341 aa, Triticum aestivum
  unsure (1)..(341): unsure at all Xaa locations
  Clone ID: PAT_TA_27156.pep
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTXGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQXGDNSSSIFDAKXAGIALNDNFXVKLVSWYDNEWGYSTRVVDLIRHMHSTK

SEQ ID NO: 132739 - protein, 243 aa, Triticum aestivum
  Clone ID: PAT_TA_27157.pep
MAAAAAPARSTKEVLPPALGAVSEPPPLFDGTTRLYICYICPFAQRAWVTRNCKGLQEEIKLVAINLEDKPAWYKEKVYPQGTVPSLEHDGKVTGESLDLIKYIDSNFHGPALLPQDPAKRQFADELIAYADAFTKALYSPLISQVAMSDEAVAALDKIEAALSKFSDGPFFLGQFSLVDIAYVTILERVQIYYSHLRNYEIAKGRPNLERYTEEMNMIEAYKQTKNVPLALLDAAKRHLKIA

SEQ ID NO: 132740 - protein, 258 aa, Triticum aestivum
  Clone ID: PAT_TA_27158.pep
AWADAWADAWAVFLPFLILQVGKDAALRARLRDEVRAALERHAGEVGFASVRGMPLVRSTVYEVLRMNPPVPLQFGRARRDFVLRSHGGEGFSVAAGEMLCGYQPLAMRDPAVFDRPDEFVADRFVGAEGEALLRYVYWSNGPETGEPAAGNKQCAAKEVVVATACMLVAELFRRYDDFECDGTAFTRLHKRPPPPSPASLGRCPPLGPRVRSGVPLGFSSLALPLSSPAPLPLLIGLMCRFSWLIQVLWLWFKFCKN

SEQ ID NO: 132741 - protein, 133 aa, Triticum aestivum
  Clone ID: PAT_TA_27159.pep
MPPPPPPPVHLRLRVSITPPHPLPLPYSRRFSSATSGLATARHLSLRRGSRRRAPVCAARSEAAGAEGFDEELGRLLELLPGELRQRVEDHPELPALVEVVMDLGRPPLARFPSGDFLLSHRPISFDDLRQAT

SEQ ID NO: 132742 - protein, 131 aa, Triticum aestivum
  Clone ID: PAT_TA_27160.pep
GTRGVWKKVEFARPGACAQVGAKQSLPANPWIQHFRSRDCSSSSSSARGDGAQTLVGDHESGIRTTPGGTPLSHGRELGACKGENLLDQNSEVSDQNFADDDEAEVGAESSRTCKKRRLSSSSTYCAQTIQ

SEQ ID NO: 132743 - protein, 100 aa, Triticum aestivum
  unsure (1)..(100): unsure at all Xaa locations
  Clone ID: PAT_TA_27161.pep
SIVFEGRARXEFLSILTGWGKHSKIAGASTLRHVIEALLNSIGAPFQVERFNIGRFVSPSVVVAAWLRESGTINTILVSDERAQRASPSNLVPRLEALQL

SEQ ID NO: 132744 - protein, 117 aa, Triticum aestivum
  Clone ID: PAT_TA_27162.pep
MEEVGMEFLLDAVDSDPKTQMLGLHAVSGSGKRDLRKHETESAGVGNHHRLGRRSPHTESTPRPQDGRKGWTEPADGWETELSSLLGCAGAHGAGRLAAEHGLSAECSSSSDMSDES

SEQ ID NO: 132745 - protein, 111 aa, Triticum aestivum
  Clone ID: PAT_TA_27163.pep
NWSGRICLTSRTHWMVVAMAQRMRWTGKSVVLEEDQSEDVSCSPEIQSKVPVPPPPHGVKKGDHKGPVIPPEKLKQLAGLRSELLKEEKTLLADFRRRKERALEEHERDRR

SEQ ID NO: 132746 - protein, 101 aa, Triticum aestivum
  Clone ID: PAT_TA_27164.pep
SILPRHSFEIPMAPSSSPSSSMAAIPHLLYIVSAPALRQLKTSYSGLNSELQLISNCSVRIYDPASPLLLVLPAPRERPFSPGCERKLLLTIADIIASVNC

SEQ ID NO: 132747 - protein, 126 aa, Triticum aestivum
  Clone ID: PAT_TA_27165.pep
SDGNLVATLLAHKLGVTQCTIAHALEKTKYPNSDIYLDKFDSQYHFSCQFTADLIAMNHTDFIITSTFQEIAGSKDSVGQYESHIAFTLPDLYRVVHGIDVFDPKFNIVSPGADMTVYFPYTETDK

SEQ ID NO: 132748 - protein, 475 aa, Triticum aestivum
  Clone ID: PAT_TA_27166.pep
MAAKLTRLHSLRERLGATFSSHPNELIALFSRYVHQGKGMLQRHQLLAEFDELFESDKEKYAPFEDILRAAQEAIVLPPWVALAIRPRPGVWDYIRVNVSELAVEELTVSEYLAFKEQLVDEHASSKFVLELDFEPFNASFPRPSMSKSIGNGVQFLNRHLSSKLFQDKESLYPLLNFLKAHNYKGTTMMLNDRIQSLRGLQSALRKAEEYLVSIPEDTPSSEFNHRFQELGLEKGWGDTAKRVHDTIHLLLDLLEAPDPASLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDILRVPFRTENGILRKWISRFDVWPYLETYTEDVSSELMREMQAKPDLIIGNYSDGNLVATLLAHKLGVTQCTIAHALEKTKYPNSDIYLDKFDSQYHFSCQFTADLIAMNHTDFIIT

SEQ ID NO: 132749 - protein, 254 aa, Triticum aestivum
  unsure (1)..(254): unsure at all Xaa locations
  Clone ID: PAT_TA_27167.pep
PLYSDVENDEHKFVLKDRNKPIIFSMARLDRVKNMTGLVEMYGKNAHLKDLANLVIVAGDHGKESKDREEQAEFKRMYSLIEEYKLKGHIRWISAQMNRVRNGELYRYICDTKGAFVQPAFYEAFGLTVIEAMTCGLPTIATCHGGPAEIIVNGVSGLHIDPYHSDKAADILVNFFEKXADPSYWDKISQGGLQRIYEKYTWKLYSERLMTLTGVYGFWKYVSNLERRETRRYIEMFYALKYRSLASQVPLSFD

SEQ ID NO: 132750 - protein, 105 aa, Triticum aestivum
  Clone ID: PAT_TA_27168.pep
MAAASPEFFKPPAAFSPRLHLLAADGADDDYHRCCRTPTGAGVGCLGQAATCPPAPRKPRPRPDAACRKRLFDVQVISLRFDDLDAIFRPSPPPPCHDHNNNNIH

SEQ ID NO: 132751 - protein, 477 aa, Triticum aestivum
  unsure (1)..(477): unsure at all Xaa locations
  Clone ID: PAT_TA_27169.pep
MTVYFPYTETDKRLTAFHSEIEELLYSDVENDEHKFVLKDRNKPIIFSMARLDRVKNMTGLVEMYGKNAHLKDLANLVIVAGDHGKESKDREEQAEFKRMYSLIEEYKLKGHIRWISALMNRVRNGELHPYIRDTHTSICATSTFQDIAGSMDSVGQYESHIAFTLPDLYRVVHGIDVFDPKFNIVSPGADMTVYFPYTETDKRLTAFHSEIEELLYSDVENDEHKFVLKDRNKPIIFSMARLDRVKNMTGLVEMYGKNAHLKDLANLVIVAGDHGKESKDREEQAEFKRMYSLIEEYKLKGHIRWISAQMNRVRNGELYRYICDTXGAFVRHSFHEAFGLTVFXAMTCGLPTIXATCHGGXPAEIIVNGVSGLHIDPYHSDKAADILVNFFEKCSEDPSYWDKMSEGGLKRIYEKYTWKLYSERLMTLTGVYGFWKYVSNLERRETRRYLEMFYALKYRSLAAAVPLAVDGESSDN

SEQ ID NO: 132752 - protein, 154 aa, Triticum aestivum
  unsure (1)..(154): unsure at all Xaa locations
  Clone ID: PAT_TA_27170.pep
MGSTVTSDEEACMYALQLATSSILPMTLKNAIELGMLETLVSAGGKALSPSEVAAQLPCKANPDAPAMVDRMLRLLATHKVVSCEMEKGEDGLLVRRYSPAPVCKWLTANEDGVSMAPMLLMVXDKVLMDCWYHLKDVMVDGGLPFNKAHGTSL

SEQ ID NO: 132753 - protein, 44 aa, Triticum aestivum
  Clone ID: PAT_TA_27171.pep
KCHDIAATYFAAIFASSLSNSTTSIYILNHGDPDRDGPNPAHAS

SEQ ID NO: 132754 - protein, 128 aa, Triticum aestivum
  Clone ID: PAT_TA_27172.pep
CVRVHDQVLGDISMQPLCSPRLHLCVSSGEEMLGKKQHGGEDDSRVAAGTALWWPVVEMAFTYRYLAISRCSPCVAHGCTFVSLVARRCWGRSSTVARMTAGLPQAQLCGGRWWRWPSHTSAQFRIGS

SEQ ID NO: 132755 - protein, 77 aa, Triticum aestivum
  Clone ID: PAT_TA_27173.pep
GSHTNYWRDHDTALFIIKHLYRDIPEEPPTDGTGSAPIRLFYVRDPIAEDTPLTFSDHSSVKEFSRKVKTYSRKGGG

SEQ ID NO: 132756 - protein, 61 aa, Triticum aestivum
  Clone ID: PAT_TA_27174.pep
LYIYTPSTPHRPILLSGSITFSRMPGIQKKVLVERFVQQMVVISYRSSVSATAIQPSICTT

SEQ ID NO: 132757 - protein, 208 aa, Triticum aestivum
  unsure (1)..(208): unsure at all Xaa locations
  Clone ID: PAT_TA_27175.pep
MLEWLGRPXQGVPQQPTPPLRVSISKKLRAVVEDKYNRAGVEKGKYVVIHGIESDAVANFQTXDCLLPLELWAEIAKEISSGGNGLRPLFVMPHEKHREEIEEIVGEETAYLFITTPGQXLTCLINDSAGVVATNTAAVQLANARDKPCVALFSSKAKARLFLPYAEERKSCTVVASATGKLAGIDIEAVKKAVKDLEPAPSFALAQT

SEQ ID NO: 132758 - protein, 496 aa, Triticum aestivum
  unsure (1)..(496): unsure at all Xaa locations
  Clone ID: PAT_TA_27176.pep
HEGRFSVDEGGGGGEDGEKRGEEEAAAPVEAKVGAAEERSRSGSFSSSSSPSSATPGVSSEPPLLSFSVDNIDTVKLLELLGPEKVDQADVKAIKEKFFGYTTFWLTREEPFGDLGEGVLFVGNLRGDREEIFGKLQRQLRELTGDKYNLFMVEEPNSEEDDPRGGPRVSFGLLRREVSEPGPTTLWQYVISLLLFLLTVFSCIELGIASKISSLPPDIVSYFTDPNATGPPPDMQLLLPFVESALPVAYGVLAIQLFXEVGHFLAAYPKNXKLGIPFFIPNFTLGTFGSITQFKSILPDRKTMFDVSMAGPLAGAALSFSMFSVGLWLSSNPAGATDLVQVPSNLFQGSLLLGLISRAILGYSALHAATVSIHPLVIAGWCGLTTTAFNMLPVGCLDGGRGLQGAFGKDALFGFGLTTYSLLGLGVLGGPLSLPWGLYVLLCQRTPEKPCLDDVSDVGTWRRGALIASVFLVVLILIPLWDELAEDLGVGLVSSF

SEQ ID NO: 132759 - protein, 199 aa, Triticum aestivum
  unsure (1)..(199): unsure at all Xaa locations
  Clone ID: PAT_TA_27177.pep
MEPHSTTPPPPGRVLGAPVGPARRAVHPARPAXRYPHAPALYAPQPPPAAVAAASQQTAPQQPQHLQVFXAEQYRDMEATNDHEVHALPRAIFKKVMKADDYVRMIATEAPVVFARACEMFILELTHRGWAHAEENKRRTLQKSDIAAAIARTEVFDFLVDIVPRDEAKDAEAAVAAGMPHPAAGMPAADMGYYYVPQQ

SEQ ID NO: 132760 - protein, 142 aa, Triticum aestivum
  Clone ID: PAT_TA_27178.pep
MSNPLDTDAGSELFSSYEAEYKLIQADLNQKLDQIPELAGEPRKAAISQAERALEELDEQLSAMRLEKQNIPTSSRTKVNQRFRNYESDTDAARRKLTTLSFDRSALFGSRYTDDPAGSSDVNMEQRLQLLSGSDRLDRSTQ

SEQ ID NO: 132761 - protein, 120 aa, Triticum aestivum
  Clone ID: PAT_TA_27179.pep
GRPRCPPPRPTEAEFLGSITPKTETFGLMALTMNPPVKPGEPLMGERPDTEQWTSEQRAAKALLEFNSKLDAIAEAVKKRNADGALRNRNGPVEVPYTLLAPRADPTVPHVGGIPNSIAV

SEQ ID NO: 132762 - protein, 220 aa, Triticum aestivum
  unsure (1)..(220): unsure at all Xaa locations
  Clone ID: PAT_TA_27180.pep
ADPSTNTSGDAPADGTAADAEGDGAVAGDTELQTWCSVVRTVDPGELRDAPRWPAMHSAGDLVETCATIIWLGSVYPSAVAFGQCAYNGFVPNRPSVTYGEMPAGAGAAVTEAEFLGHITPKNEAFGLMAVTMSPPVKPGEPLMGERPDKARXTSEQRAAKALLEFNAKLDAVAEAVKKRNADGALRNRNGPVEVPYTLLAPRADPAVPHVGGIPNSIAV

SEQ ID NO: 132763 - protein, 379 aa, Triticum aestivum
  unsure (1)..(379): unsure at all Xaa locations
  Clone ID: PAT_TA_27181.pep
DAITTPVVNTSAYWFSSSQELIDFKEGRHASFEYGRYGNPTTEALEKKMSALEKAESTVFVAASPPLGPIAGMYASVAMLSTLVPAGGHIVTTTDLYRKTRIYMETELPKRGITMTVIRPADMDALQDALDNNNVSLFFTETPTNPFLRCIDIELVSNMCHNKGALLCIDSTFASPACQLALTLGADIVVHSATKYIAGHNDVIGASVCGAAGLYASVAMLSTLVPAGGHIVTTSDILRSMKTLLLRVQCQNSTALRMARFLEEHPKIARVYYPGLPSHPEHHIAKSQMTGFGXGVVSFEVDGDFDPTRKLIAPVKIPYHAPSFGGCESIIDQPAIMSYWDSKEQRDIYGIKDNLIRFSIGVEDFEDLKNDIVQALNKI

SEQ ID NO: 132764 - protein, 149 aa, Triticum aestivum
  Clone ID: PAT_TA_27182.pep
PMFEWEQHCVGHLHYLWAQPGYKALDIHQCLPEFPIMTVDDPDVLCCLLREEDYGKGWMIMVDNHAHLRSCTPESESLGVEAHDNRFPDIPLLPTVFCKYLESPTGVAWIEHKKRKRKLKSAKVKAWNLVTGVEHFGDAQIKDAMKMVY

SEQ ID NO: 132765 - protein, 219 aa, Triticum aestivum
  Clone ID: PAT_TA_27183.pep
MAPPARPSNATLLARLGEGTARFELLEDPAPAPAPPVWPRLHCFARIGSSLRGGWSAALNKVEHYGVQRVTGDGRCMFRALAKGMAKTRGIPLTPREEVQDADDLRLAVKEVICDNQTERQKYEEAIIAITVDESLKRYCQRIRRPDFWGGESELLVLSRLCRQPIIIYIPEREYRGRGNGFIPIAEYGLEFTKDSKEGKKRVPVRLLYSGKNHYDLLI

SEQ ID NO: 132766 - protein, 301 aa, Triticum aestivum
  unsure (1)..(301): unsure at all Xaa locations
  Clone ID: PAT_TA_27184.pep
MDSLSLYEISCFAAGFAGNLFAFALFLSPVPTFKRILKAKSTEQFDGLPYLLSLLNCFICLWXYGLPWVSDGRLLVATVNGTGAAFQLAYISLFFIYADSRKTRLRMVGLLVLLVCAFALVAHASIAFFDQPTRQQFVGAVSMASLISMFASPLAVMGVVIRTECVEFMPFYLSLSTLLMSASFAVYGLLLRDLFIYLPXGLELSWEQRSWHSTLTTAGNGDARIHLRRCLPDQTSSDQFSVLAWLERAGVGFCRRELYAPALFSPVDAESVCTDLLAYASVYMLLKYHSFPEECRGGYFV

SEQ ID NO: 132767 - protein, 125 aa, Triticum aestivum
  Clone ID: PAT_TA_27185.pep
APTEGVVKYVAGDIFHVVPPAQAVLLKSVLHLWSDEDCIKILAQCKKAIPPRGAGGKVIVIDIVLSSASGLMLETHHLVDMLKLVMTRGRQRDEKDWSDIFMKAGFSEYKISKKVGARAVIEVYP

SEQ ID NO: 132768 - protein, 152 aa, Triticum aestivum
  Clone ID: PAT_TA_27186.pep
VAIGCRVDERTCLSTIRAISDFEVQSGQSKAECNWTLGLVWEVRGDDIVSKTTYLVSFDDDDAKYLPLPTKLVLQKKKAKEGRSGDEIEHFPVPSRITVSRTSHGDEMEHGESSSMHGNLKRRRSSVDDDLEEHRRHSRVEDTEQYSEDDYE

SEQ ID NO: 132769 - protein, 267 aa, Triticum aestivum
  Clone ID: PAT_TA_27187.pep
HYLKSCLLYLAAFPEDFNISVRDLISLWIAEGFIPHTPKHTLEETAGNYATELAQRSLVQVVQTSSIHGWIEKIKIHDILRDWCIEEAAQDGFLDVIDETTAGQVGASSSHSLISYRCSFQDSNEQILQASPNLRAFFGFGLSSSVTFPELRFLRVLHVENSRIENFSKVIGGCIHLRHLRLRRCADMEVPSSIRKLIYLQTIDLSYTDVSTSSLWDIPTLRYVHLHRISLPRTVQIPQTLRELRMRANYFEKEKDRCRSWRCFLVL

SEQ ID NO: 132770 - protein, 65 aa, Triticum aestivum
  unsure (1)..(65): unsure at all Xaa locations
  Clone ID: PAT_TA_27188.pep
RARARAAELQRRLXEENYGKRRRLKRVVAATRSRIHDTRALLQDHQDPHPPPQQQQLPAESDPTS

SEQ ID NO: 132771 - protein, 111 aa, Triticum aestivum
  Clone ID: PAT_TA_27189.pep
MCEGRRPGHASRPPWALAAELRRREAAADARLAAARARLAEALAELERARARAAELQRRLEENYGKRRRLKRVVAATRSRIHDTRALLQDHQDPHPPPQQQQLPAESDPTS

SEQ ID NO: 132772 - protein, 117 aa, Triticum aestivum
  unsure (1)..(117): unsure at all Xaa locations
  Clone ID: PAT_TA_27190.pep
XSCXLLQAQXVVCHXXYNVTSMSXVXRYARICSGILVXCHGMXGLGAVAAEQRTLQTRQRKFHLITAVNEATGLTFLSSYLQLKDWCSSHCKFEQFSSTSVLTPVLCWITSYESVDA

SEQ ID NO: 132773 - protein, 238 aa, Triticum aestivum
  unsure (1)..(238): unsure at all Xaa locations
  Clone ID: PAT_TA_27191.pep
MCGGAILAELIPSAPPRERHGGPPLAQRGPRVDDFEAAFKRFGRXSAEEEVLQRAGFEFGAHGQPAARRGGSSPAQYRGVRRRPWGKWAAEIRDPVKGVRVWLGTFPSAEAAAHAYDDAARDFRGASARLNFPSSSTSAPKCRVAEKPTPFVVIDLDDDEEGDAGAADAGGISSESSGALPDFSWQGMSASDEVTAQSVHAEVESGQSVVDLGSAKKRPGSKPPRFGRQRPTTPPTNC

SEQ ID NO: 132774 - protein, 149 aa, Triticum aestivum
  Clone ID: PAT_TA_27192.pep
PSDLAPFLHPPLIHHAEKKEKRKSPAHPASLTQPAMAAPAADFEATPARRPRSTRPRRIQRASSLQPAAIMQKEGCLIAHRMPLPLQQLIASFIACLSQHQPAPPTAARWHHALARVGLKLFSMPVQAFPHPLWLKLFFSRLKLSPCRL

SEQ ID NO: 132775 - protein, 132 aa, Triticum aestivum
  Clone ID: PAT_TA_27193.pep
AECALEATPSGLAFCDRVVGTGAEAVKGQLIKAHYRGMLEDGTVFDSSYGRGRPLTIMVGVGEVIKGWDLCIAGGEGIPPMRVGGKRSLRLPPELAYGEKGAGCRGWEPTSCVIPPNSTLLFDVEYVGRASS

SEQ ID NO: 132776 - protein, 369 aa, Triticum aestivum
  Clone ID: PAT_TA_27194.pep
MDGAPVAEFRPTMTHGGRFLLYNIFGNQFEITAKYQPPIMPIGRGAYGIVCSVMNFETREMVAIKKIANAFDNNMDAKRTLREIKLLRHLDHENIVGLRDVIPPAIPQSFNDVYIATELMDTDLHHIIRSNQELSEEHCQYFLYQLLRGLKYIHSANVIHRDLKPSNLLLNANCDLKICDFGLARPSSESDMMTEYVVTRWYRAPELLLNSTDYSAAIDVWSVGCIFMELINRAPLFPGRDHMHQMRLITEVIGTPTDDDLGFIRNEDARRYMRHLPQFPRRSFPGQFPKVQPAALDLIERMLTFNPLQRITVEEALEHPYLERLHDVADEPICTDPFSFDFEQHPLTEDQMKQLIFNEALELNPNFRY

SEQ ID NO: 132777 - protein, 322 aa, Triticum aestivum
  unsure (1)..(322): unsure at all Xaa locations
  Clone ID: PAT_TA_27195.pep
MATAHLSPALAVSSSRHLTSKHGQPPIFAQPGGTAVLRSCSLPLSSRLAASGRGGWRLAAAVEPRTAQQEKADASSRLVLVVGGTGGVGQLLVASLLSRKIKTRLLLRNPEKAAFLFGKQDESVLQVCEADTRNVDSLNPEMFEGVTHVVCTTGTTAFPSKRWDGEESPERGAWGGDRKXVGAEPRPVHRLNWHIASLDNTFKHYLGKSSSAQQDLDGKAFLPQHNITPGXYSASQGPTRVVLSKGEALTVVPMPGKRNGTHEGQNAVKVTSIRLVVAEACIEALDTETTQGKRDVASTVKGEGEGSYQEKWKQLFAAAESN

SEQ ID NO: 132778 - protein, 225 aa, Triticum aestivum
  Clone ID: PAT_TA_27196.pep
MALRTLAAKKTLGLALGGARGVATFTLPDLPYDYGALEPAVSGEIMRLHHQKHHATYVAHYNKALEQLDAAVSKGDASAVVHLQSAIKFNGGGHVNHSIFWKNLKPISEGGGEAPHGKLGWAIDEDFGSIEKLIKKMNAEGAALQGSGWVWLALDKEAKRLSVETTPNQDPLVTKGSNLHPLLGIDVWEHAYYLQYKNVRPDYLTNIWKVVNWKYAGEEYEKVLA

SEQ ID NO: 132779 - protein, 100 aa, Triticum aestivum
  Clone ID: PAT_TA_27197.pep
KHQLQHPSLSTPGLHPCDARVIQLHFGGTAQMYVWNRHICRVRGVPSKNYRYQPCCMHALASTTTSGMCGALCGRIFLGSKSSNQILVAYIGSFLGSTLF

SEQ ID NO: 132780 - protein, 139 aa, Triticum aestivum
  unsure (1)..(139): unsure at all Xaa locations
  Clone ID: PAT_TA_27198.pep
RRWAFVYPVRDFSVKSERPVPRRGDGGRPGARSGRPWQFAGGGGMASRCLSRRRSRAGTXGNVMGRTGLFXEVMPGVHYCTRESVXCALELVKRGVXRDCVRAGSWRVFSGSPGEHGLTGIGGGLWEEVQQLVGKRRVW

SEQ ID NO: 132781 - protein, 43 aa, Triticum aestivum
  Clone ID: PAT_TA_27199.pep
SARGDSGSLIPGHGGILDRVDSYVFTGALCYSFVRVALPLYGV

SEQ ID NO: 132782 - protein, 166 aa, Triticum aestivum
  Clone ID: PAT_TA_27200.pep
LAGSPLPPVCHLCLHLRPWGSGPARCYRQIKNKPYPKSRYCRGVPDPKIRIFDVGQKKRGVDEFPLCVHLVSWEKENVTSEALEAARIACNKYMAKHAGKDAFHLHVRAHPYHVLRINKMLSCAGADRLQTGMRGAFGKPTGMCARVHIGQVLLSVRCRDAHAAHA

SEQ ID NO: 132783 - protein, 229 aa, Triticum aestivum
  Clone ID: PAT_TA_27201.pep
TCPGRHQHKVPPATTWCMTMPTQQNAVQNMGWGAGNTNWGSALQSNANMAWGVMGQANMNMPWAAPAQGAASYNMGMTMPTQQNAVQNMGWVTPNPGNTNMNMVWATNQGQGTPNAAAMMGAQMQGGNSGPNPVNGTGQGNNNVNWNSPSGNPTWNNQRDFNGGGSRGRSWRPQSGGRGSRPPCHVFQRSGRCNKEHCSYSHTPGDEGYSQRNDRHFDRRPSSNEETSA

SEQ ID NO: 132784 - protein, 176 aa, Triticum aestivum
  unsure (1)..(176): unsure at all Xaa locations
  Clone ID: PAT_TA_27202.pep
TTRSRPPTASRRLPSVAGFREPSTPGRSSGLFAASRANPTTAELPLPAXPGGAPATTHGGAPPPVVLPARAPAPSPAGKAPAPTATPAIVPAAPQKPAAAKGGGKPGQVLGSTPTVAATRSKVAEKAAGGIPVPVPPPAVMAGRPAADAKAGDKAQQTKGKIRVSSRVRKALASSK

SEQ ID NO: 132785 - protein, 136 aa, Triticum aestivum
  unsure (1)..(136): unsure at all Xaa locations
  Clone ID: PAT_TA_27203.pep
SXXPQXIGRCESXAVAXPQAFHRGALTXDGXRPAHXPXLPRPAHPRRDXRRALGHRRRRARRLRLRLLLPGRLGRPGHPDAACGRTSCCSPASAATSEPPIRSRQLAAAVQNAQFYRTELVSASGRRRAAWPRPCT

SEQ ID NO: 132786 - protein, 301 aa, Triticum aestivum
  unsure (1)..(301): unsure at all Xaa locations
  Clone ID: PAT_TA_27204.pep
MSSSSSSGGTGASVPCHSPRKGGKKVLSXVQSEGQGATVRRSIGGHEVRNLXDPFLLLDEFSVSKPAGFPDHPHRGFETVTYMLDGVFTHQDFSGHTGTIRTGDVQWMTAGRGIVHSEMPAADGVQKGLQLWINLASKDKMIEPRYQELESKDISQAEKDGVAVRIIAGEAFGVRSPVYTRTPTMYMDFTMQPGSQLHQPIPEGWNAFVYIIEGEGVFGKEGAAPASAHHCLVLGAGDGLSVWNRSGAPLRFALAAGQPLNEPVVQQGPFVMNSRAQIQQAMEDYYYGRNGFEKASQWSSA

SEQ ID NO: 132787 - protein, 233 aa, Triticum aestivum
  Clone ID: PAT_TA_27205.pep
KQYYIDIVEAKPASAVSIIETDCEVDFAPPLENPEPDSAWGPRVPGKSAKPAAQGAPGANEARVQGAFRLEQRGKSADRITSRPGATQAAEAAQSGAWDTSKRAERRRGTAGGGSRARGPEAGRAEVGRGARSEQDAEAQAAAGKGSERPQPGEPEVAAVTGESPPRKRQQQQANRVSDNFGNQTRYLAWKLSGYRSELCISTSHSSESAHQPRVIGKRSDKRFSSREIRVSK

SEQ ID NO: 132788 - protein, 234 aa, Triticum aestivum
  unsure (1)..(234): unsure at all Xaa locations
  Clone ID: PAT_TA_27206.pep
MASSTSTLEIEARDVVKIMLQFCKENSLHQTFQTLQNECQVSLNTVDSMDTFIADINAGRWDAVLPQVAQLKLPRKKLEDLYEQIVLEMAELRELDTARAILRQTQVMGVMKQEEPERYLRLEHLLVRTYFDPNEAYQESTKEKRRAQIAQAIASEVSVVPPARLMALITQALKWQQHQGLLPPGTQFDLFRGTXAMKQDEEEGYLLLCPSIRLSCGLYQRAYMVFMFPPDLGT

SEQ ID NO: 132789 - protein, 168 aa, Triticum aestivum
  Clone ID: PAT_TA_27207.pep
MAAGTAAAEIAALPEPRGPLRRLCGDLSRRVRLLPPLLDDPSASASPPLADALRAARDLLHSVHHGSKIYQAMRGRDSLLREFAAVNEQIQAALDQLPYHDFDMPEEVQEQVALVHSQFKRAATRAEPADAQLARDLAWALSDDKPTVPALLMRVSEKLQPETMADGT

SEQ ID NO: 132790 - protein, 166 aa, Triticum aestivum
  Clone ID: PAT_TA_27208.pep
MGNCCVARPSFKRRGGGSPRQRGGRLGGANLRCLSTVSSVTDTPRATAQPPVTVLGKGLAAADNTEELLRRYQLGEELGRGEFGVTRRCMDAATGEKLACKSISKRKLRSSVDIEDVRREVAIMRSLPSHVNVVRLREAFEDGDSVHLVMEVCEGGELFDRIVVRG

SEQ ID NO: 132791 - protein, 124 aa, Triticum aestivum
  unsure (1)..(124): unsure at all Xaa locations
  Clone ID: PAT_TA_27209.pep
SXRISGATPDPELLKIDNSAIAEMVFFPVINEACRVLGEGIAFKASDLDIASIFGMGFPPYRGGIMHWADSIGARRICTMLSEWEMEYGQFFKPCSHLLERAAEGLPLSASATKTMNNQAKGKL

SEQ ID NO: 132792 - protein, 41 aa, Triticum aestivum
  Clone ID: PAT_TA_27210.pep
QWLVCSCTIAICQEYLSMCVTRHLRIMGASDLLYELVYVYC

SEQ ID NO: 132793 - protein, 269 aa, Triticum aestivum
  unsure (1)..(269): unsure at all Xaa locations
  Clone ID: PAT_TA_27211.pep
VHVLQSGGDASXENSFGAIVTTPDNSSASFGDDDNNGVSSPRAGNDNDDDEPDSKRRKDGGDGEGINMAGNRTVREPRVVVQTMSDIDILDDGYRWRKYGQKVVKGNPNPRSYYKCTTVGCPVRKHVERASHDLRAVITTYEGKHNHDVPAARGSAALYRPAPRAADSTASTGHYLNPQPSAMAYQASAAPNVAGTQQYAPRPDGFGGQNPGSFGFNGNFGFSGAGFDNPTASYMSQHQEQQRQNDAMHASSAKEEPREEDMFFQNSQY

SEQ ID NO: 132794 - protein, 540 aa, Triticum aestivum
  Clone ID: PAT_TA_27212.pep
MEIEREAPGGERGRSWRANAEQDVQDGKKFEDGDETLVKEPAWKRFLSHVGPGFMVSLAYLDPGNLETDLQAGANHRYELLWVILIGLIFALIIQSLAANLGVVTGKHLAEICKSEYPKPVMICLWLLAEVAVIAADIPEVIGTAFAFYLLFRIPVWIGVLITGSGRRHLGGRQRYGVRKLEFLISMLVFVMAACFFGELSIVKPPAKEVLKGLFIPKLKGNGATGDAIALLGALVMPHNLFLHSALVLSRKTPSSVRGIKDACRFFLYESGFALFVALLINIAVISVSGTVCFGENLSAEDIDKCSDLSLDNSSFLLKNVLGRSSSIVYGVALLASGQSSTITGTYAGQYIMQGFLDIKMKTWLRNLMTRCIAIAPSLVVSIIGGSNGAGRLIIIASMILSFELPFALIPLLKFSSSSSKMGPHKNSIYVIVFSWTLGLMLIGINVYFLSTSFMGWLINSSLPTYAKVLVGIVVCPLMLVYLVAVVYLTFRKDTVVTFVADSCKADAEKAAGGSGEDDDEPVPYREDLADIPLPAHSRG

SEQ ID NO: 132795 - protein, 247 aa, Triticum aestivum
  Clone ID: PAT_TA_27213.pep
MASARRRTTMATNKLIMFVLLLVVLERVRSDNSPCDFPAIFNFGDSYSDTGAFPALFPAVQPPYGRTFFGMPAGRQSDGRLTIDFMAQSLGLRYLNAYLDSLGSNFTQGANFASAAGTIRRVNGSLWTSGYSPISLDVQIWQFQQFINRSHFVYTNLGGIYREILPKPEHLVSKSLYTFDIGANDLAMGYLDNMTTEQVEAYVPDLMERLASAIQTVYNLGGRYFWVHNTGTLGCLPYALAYRPELA

SEQ ID NO: 132796 - protein, 392 aa, Triticum aestivum
  Clone ID: PAT_TA_27214.pep
MASARRCTTMATKLMPAVLLVMLELSAGAGARSDDSPCAFPAIFNLGDSNSDTGAFPALFPAVQPPYGRTFFGMPAGRQSDGRLTIDFMAESLGLRYLSAYLDSLGSNFTQGANFASAAGTIRRVNGSLWTSGYSPISLDVQIWQLQQFINRSQFIYNNIGGIYREILPNPEHLVSKALYTFDIGQNDLTVGYFDNMTTEQVAAYVPDLMERISSAIQTVYDLGGRYFWVHNTGTLGCLPYALAYRPDLAAEKDGAGCSIALNAGPRFFNARLKETVARLRVALPEAAFTYVDVYTAMYRLMSDGFADHLHVCCGYGGGQYNFDKDIRCGVKVEVNGTVLEGKSCGDPSKSVSWDGVHLTEAAYKFIFDQIVDGALSDPPVPLRRACQAKGQ

SEQ ID NO: 132797 - protein, 128 aa, Triticum aestivum
  Clone ID: PAT_TA_27215.pep
PLRTPRQADKHVVVRSSQPPQPPPHPPPQPPPPPHPELSAEPTMTPVARPAPAPRASPAPAPMRPPCFLPAPPRPPPPPSRRPRRPRAPRGSPAPGRGRTLPSAARREAPASPLLFRLEEEEGEGGAG

SEQ ID NO: 132798 - protein, 66 aa, Triticum aestivum
  Clone ID: PAT_TA_27216.pep
SHSGEKKACQTTGQHKHQQYHQISRSVASPVTTPKTAQKNYPKQERIRDQQKPHSTNQPSKRLSTF

SEQ ID NO: 132799 - protein, 285 aa, Triticum aestivum
  Clone ID: PAT_TA_27217.pep
LALPNGAGKTSFISMMIGLIPPTSGTAYVHGMDIRTDMNEIYTNMGVCPQHDLLWETLTGREHLLFYGRLKNLKGAELLKATDDSLKSVNLFRGGVGDKQVGKYSGGMKRRLSVAISLIGDPKVVFMDEPSTGLDPASRNNLWSVVKEAKKNRAIILTTHSMEEAEVLCDRLGIFVDGGFQCIGNPKELKARYGGTYVFTMTTSSEHEQEVEQLVRRLSPNANRIYHISGTQKFELPKQEVKIADVFNEVESAKGRFSIHAWGLADTTLEDVFIKVAKGAQAFNV

SEQ ID NO: 132800 - protein, 343 aa, Triticum aestivum
  Clone ID: PAT_TA_27218.pep
MASRQSLLPSFLYAASSGAAMPDGRGAPVVARAPSEPPFGKIDMFSPAYYAACGFGGAAACGLTHAAVTPLDVIKCNIQIDPAKYKSISSSFSIVLKEQGVRGFFRGWAPTFLGYSAQGAFKYGLYEVFKKEYTDMAGPEYAAKYKTLIYLAGSATAEVVADVALCPMEAVKVRVQTQPGYARGLRDGFPKIVRAEGYAGLFRGMVPLWGRQIPYTMMKFATYENIVEMAYKHLIPTPKDQCSKPLQLGVSFGSGYIAGVFCAAISHPADNLVSFLNNAKGATVGDAVKNLGLWGLFTRGLPLRIIMIGTLTGTQWVIYDSFKVMAGLPTTGGAPAAAPREEA

SEQ ID NO: 132801 - protein, 107 aa, Triticum aestivum
  unsure (1)..(107): unsure at all Xaa locations
  Clone ID: PAT_TA_27219.pep
QLTRDPQYWDNPEDFNPERFVKKNIDYNGTYFEFTPFGGGRRKCPGVGFASSILEXANFLYHFNWTLPGGASSVSLDMSEKFGVTVRKRSDLWLKAIPHVCSKATHI

SEQ ID NO: 132802 - protein, 389 aa, Triticum aestivum
  Clone ID: PAT_TA_27220.pep
MEWWLTLCLIALSTLLALWFSGCRSKSMKHLPPPGPWTLPVIGSLHHILSAFPHRALTDLGRRHGPVMLLKLGEVPLVVISSAEAVAQVFKANDVALSNHSSSRLQDIVGFGGKGILFAPYGEHWRQMRKVCITELLSTKQVKRMEGIRAEEVGNLIRSINTATAAGATVNVSEMVSVLSNDIVTRAVFGGKFARQEECPHEIGKLMDLIGGLCLVDLFPSSWLVQWFSTAERRTKRSCDLIQSIIADIFEKRKAARASRHGAYSDDEEMLNVLLRLLEEDSLAFPLTTEIIVTVMFDMFGGATETTATTLVWAMSELIRHPNIMAKAHLEVREVLGEGRAIIGNSDLAELHYLRMVIKEVLRLHAPWSLLMPPAGTKRRNLQLLWGFM

SEQ ID NO: 132803 - protein, 211 aa, Triticum aestivum
  unsure (1)..(211): unsure at all Xaa locations
  Clone ID: PAT_TA_27221.pep
HASAHASGSDTTGTALEWAMSELRSHPEVMAKAQLEVREVLGQGRAIIGHSHLAELHYMQMIIKEVLRLHPPAALLPRKTREDCKIMGXDILKDTNIFINVFAISRDPRYWSNPEEFNPERFENNNVDYNGTSFEFTPFGGGRRQCPGIAFASSVLEITLVNFLYHFDWMLPDDANSVSLDLSEKFGFTVRRRTDLLLKAIPHVCSRATHI

SEQ ID NO: 132804 - protein, 246 aa, Triticum aestivum
  unsure (1)..(246): unsure at all Xaa locations
  Clone ID: PAT_TA_27222.pep
VEHLSMYLDVADSANLPYGWSRSAQFSLSVVNQIDQKYTTRKDTQHQFSARESDWGFTSFMPLSELYDPSRGYLVNDTIVVEAEVAVRKMVDYWTYDSKKETGYVGLKNQGATCYMNSLLQTLYHIPYFRKAVYHMXPTTENDMPSGSIPLALQSLFYKLQYSDNSVATKELTKSFGWDTYDSFMQHDVQELNRVLCEKLEDKMKGTVVEGTIEQLFEGHHINYIECINVDYKSNRKESFYDLQLD

SEQ ID NO: 132805 - protein, 248 aa, Triticum aestivum
  unsure (1)..(248): unsure at all Xaa locations
  Clone ID: PAT_TA_27223.pep
SAPRDKAETIVPFCEFVDEIQFQFSDTTSFADRKTLDDIIANKTACEGVHDEADGDADEEGGDDTDLKNASKKHSDLSRPEIILIPIPGSELHLCDSNLEAKSAPNLCPHINDLERSDGFQVSRSLYNGENSGVDQVESKNPGFSEQELEGTSESKENSGLCELINSPVPDNKHSDDLKDNSFNPVVELSLCRHLLSEGMGADAARKTFDAEKIXLXKFRAWEQSLIRNDKLVAXFLAVTFPWDVAAP

SEQ ID NO: 132806 - protein, 81 aa, Triticum aestivum
  unsure (1)..(81): unsure at all Xaa locations
  Clone ID: PAT_TA_27224.pep
WCRKXIYLSLAGKLAAEYYPRIRFYCVDVNAVPQKLVNRAGVTKMPSIQMWSDSRKQAEVIGGHESWMVIEDVRRMVEQEE

SEQ ID NO: 132807 - protein, 83 aa, Triticum aestivum
  Clone ID: PAT_TA_27225.pep
MSAYDEVEIEDMEWSEELGAYTYPCPCGDLFQITLADLRLGEEIARCPSCSLFLTVVYNEEDFADAKEPPQKPPAAPQPVAVA

SEQ ID NO: 132808 - protein, 138 aa, Triticum aestivum
  Clone ID: PAT_TA_27226.pep
EKNIAPAVITGAGHTSAIDWWALGILLYEMLYGRTPFRGKNRKKTFYNILHKDLTFPSSIPVSLEAKQLIHGLLQRDPSSRIGSNTGANDIKEHPFFEDIYWPLIRCMSPPELDVPLKLIGKESQPKVKPEEGVIDTF

SEQ ID NO: 132809 - protein, 159 aa, Triticum aestivum
  unsure (1)..(159): unsure at all Xaa locations
  Clone ID: PAT_TA_27227.pep
TPPKFAXEIFLXSXSARXXGXXFPVPECQWVMHAGRNXNLXKSLVPPFXLTGCEPKSLAPVXGXQNRDPRTVLVPISXAXNDHXVLAPRSRPPDLDAAAGIFVPITLASNGPLRTLLGSFLPRSRARTGTAPCPSPSPTLQCSRRRCCRISLSFEYVWI

SEQ ID NO: 132810 - protein, 131 aa, Triticum aestivum
  Clone ID: PAT_TA_27228.pep
HEVQQQQLETRTREICVIRGSKPSGVYIMIFYRPKYVSCKETESGGHTRCSRGRGARLSGVERALHPCGGLVSFPDCYLFFYFSKYSKTEKYCLKNCFGVGLLTVPHTYSFSESETFWKVSLMYSSGLRFQ

SEQ ID NO: 132811 - protein, 174 aa, Triticum aestivum
  unsure (1)..(174): unsure at all Xaa locations
  Clone ID: PAT_TA_27229.pep
KSPLSSSPLLSILPSLPASLLGAPPASCSLRSPRARARPMASGDSKPRSEEEWRAVLSPEQFRILRLKGTELPGTGEYNKFYGDGAYNCVGCGTPLYKSTTKFDSGLCGWPAFFEGLPGAIXRTPDPDGRRVEITCAACGGHLGHVFKGEGFKTPTDERHCVNSVSIKFTPASS

SEQ ID NO: 132812 - protein, 187 aa, Triticum aestivum
  unsure (1)..(187): unsure at all Xaa locations
  Clone ID: PAT_TA_27230.pep
PVAPEQKDSAILFPSSGSVSILPSLSPSSALRRLLAPPRSPRARARPMASGDSKPRSEEEWRAVLNPEQFRILRLKGTELPGTGEYNXFYGDGAYKRAGCRNAPXYKSTTKFDSWPVGLGRPSLRRDFLGAIHXTPDPDGRRXVEITCASCGGTFGTMSSTGEGFKTPTDERHCVNSVSIKFTPASS

SEQ ID NO: 132813 - protein, 431 aa, Triticum aestivum
  unsure (1)..(431): unsure at all Xaa locations
  Clone ID: PAT_TA_27231.pep
MMGARANASANAADCGEYAELDPTGRYGRYNDVLGKGASKTVYRAFDEYQGMEVAWNQVKLYDFLQCPDDLERLYCEIHLLKTLKHKNIMKFYTSWVDVSARHINFITEMFTSGTLRQYRQKHRKGNXWAVKDGCRQILSGLLYLHSHNPPIIHRDLKCDNIFVNGNQGEVKIGVLGLAAILRKSHAVLCVGTPEFMAPEVYAEEYNELVDIYSFGMCVLEMVTFEYPYSECSYPVQIYKRVISGTKPEALYKVKDPMVRQFVEKCLTTASERLTARELLNDPFLRIDGMALCSGDGDYTLLNNYLRQPYLRHAYSNGSVMSNGFSESIDEGAPTEFEDDDTKADGIDLFNGHEDEPLGTVDIAIKGRKSEDGGIFLRLRITDDDGRVRNIYFPFDVEADTALSVATEMIGELDITDHEVTRIAEMIDGEP

SEQ ID NO: 132814 - protein, 253 aa, Triticum aestivum
  Clone ID: PAT_TA_27232.pep
MAPAPAPAPASSGRIRPWLVVGDLVLAVLWVCAGALVKLAVYNVLGLGGRPEGEAAKVSLSVVYMFLFAWLESATGGASYNPLTAISGALASRGGIALYLFTVFVRVPAQVIGAVIGVMLMRFAFPKVGKGAALSVGVHHGALTEGLATLMVVMVSLTLKKKEQGFFVKTWIASIWKMTIHILSSDMTGGIMNPASAFAWAYARGDHTSFDHLLVYWLAPLQATLVGVWVVTFLTKPKKTKEQEADKNKNKKE

SEQ ID NO: 132815 - protein, 116 aa, Triticum aestivum
  Clone ID: PAT_TA_27233.pep
DSVEDTVRRVERTVQLGDLTEKAKGKWPTAQGNLEQKLKGSRSRGRDAQMQHHQKFHKVWGQLMKTGYQNSRFAHQVERFACLYCSQVTDFGLYSPNKYYRPSEDYMPHEFDVLGL

SEQ ID NO: 132816 - protein, 259 aa, Triticum aestivum
  Clone ID: PAT_TA_27234.pep
MGRGRVELKRIENKINRQVTFSKRRNGLLKKAYELSVLCDAEVALIIFSSRGKLYEFGSAGTTKTLERYQHCCYNAQDSNGALSETQSWYQEMSKLKAKFEALQRTQRHLLGEDLGPLSVKELQQLEKQLECSLSLARQRKTQLMMEQVEELRRKERQLGDINRQLKHKLDAEGSNSNNYRAMQQITWAAGTVVDEGAAAYHMQQQQQQHPNHSAAMDCEPTLQIGYPHQFAAPDQAANNIPRSSGPGGENNFMLGWVL

SEQ ID NO: 132817 - protein, 187 aa, Triticum aestivum
  Clone ID: PAT_TA_27235.pep
SSSPTTSVISPSSSSPLYGSTQETNHHLHLRISRCTTTGRSSPSEVPGVLMASYRCRTSLRWSSPAEPHAAADSVHVITALKLILAADESSPASYAGPSPAPRCPPKLPMSHMRHHRRPPPTSPAPKEAFFRRTSLLRLQAPSLWPQVPQVSLTYDSSLTEARSAIMCQHPMDHDDLSDPVGFDRKR

SEQ ID NO: 132818 - protein, 263 aa, Triticum aestivum
  unsure (1)..(263): unsure at all Xaa locations
  Clone ID: PAT_TA_27236.pep
RKSTGNLTSLLRWPTXAPSGMEMPVVEVRSHGLWLLAKNVNQYIHRILVEADSSAESGDDLWSAVREDLWSAVGEAGPNIYRRGDFKESQMADLDVYLLKKVGLFPDILERKASRHLEKGDNVSALITSEFYTRDQFPGFGRPFVFNSEVQKRIGRTSEAKESARVALKSPWWTLGCRYEEAAELAGWEDEQIEFIREKVSEEGKQDDLKKGKAPEQVVLDEAAFLMDLATVDGNWDEVVDRIADCYREAGIHDIAKFIAYRE

SEQ ID NO: 132819 - protein, 69 aa, Triticum aestivum
  Clone ID: PAT_TA_27237.pep
KKKRKGGEYLLCYLESRLCHVQTKLFTLSLPYLFHDVDKLVINEHFHSAIVLYSSSCCFHHDTRSGSIG

SEQ ID NO: 132820 - protein, 110 aa, Triticum aestivum
  Clone ID: PAT_TA_27238.pep
YGFRNRFRALYSTTLPLSLPAWLNLINGTHQEGGDTRDDVPRHNLDWGCLSDVLFSFHVSPTHVDLIALHLYPITRDTASTFWQCTNIVSRCRQIQQASPSPSCPRLQRP

SEQ ID NO: 132821 - protein, 266 aa, Triticum aestivum
  unsure (1)..(266): unsure at all Xaa locations
  Clone ID: PAT_TA_27239.pep
MARHKYVKVAYHGFREMSKEEKVAAYGSTLIRDSFDEPDYALIDTLFSLGEAYLFXAQLVDFISVVAAEVPSGTDYAHMYRDVRSAVDLCHRDGTLKRMVAKEPSRYINEDLAIVPMLQMLRKSGRSTFLVTNSLWDYTDVVMNYLCGPYMSDVSSSHNHKWLEYFDVVITGSSKPSFFHDDNRTGLFEVEPDSGKLLNADLQIGSPRSSQHQPKPIHKVYLPGRPRHLHRLLSVASSSQILYVGDHIYGDILRSKKVLDKNTHGN

SEQ ID NO: 132822 - protein, 147 aa, Triticum aestivum
  Clone ID: PAT_TA_27240.pep
YQGLGCHLNSTHDLFHFEFWISEECQAVNVSLKADAWKMELVGKGVDPRHQTFSYCSRLKMRRRRSVATAENISPVHPHIMHSGSPEDAQAGSKDEFVQREDDNNSVALDSAAEHEHSLNGSNLTPPTVLEFGKTRKLSAERSDPRK

SEQ ID NO: 132823 - protein, 634 aa, Triticum aestivum
  unsure (1)..(634): unsure at all Xaa locations
  Clone ID: PAT_TA_27241.pep
MPGLPLPAPGTQRTLGCEFKLPSSLQDQDAXSKQLEAGLIQCGPLAAEDSFALYCKPVELYNIIQRRAIRNPAFLQRCLHXRIHASRKRRLQVTGSLSELTNSELPEQNIDPRRVPGGTRTSEXLMPGKWSLWARELIXTPTAFLELGAKGGSTAAVSHSWASRPCPSTRAGNRNTSRSPGIGGVXDEFVQREDDNNSVAPDSAEHDHSLNGSNLGKMTVLELGSSLENCVTLNLGHTVXELASAVSMSPSFLEPKFMEQDSCLTFCSHKVDASGVYIMRVRISAPETCSSSIPKSHNMCEWEIDVPPSSLPHIIRLRAGNVLFNFKYYNNTMQKTEVTEDFACPFCLVKCGSYKGLGCHLNSSHDLFHFEFWISEECQAVNVSLKTDAWKTELVGKGVDPRHQTFSYCSRFKKRRRLGNGWXATAENISPVHPHIMDSGSPEDAQAGSGSKDEFVQREDDNNSVAPDSAEHDHSLNGSNLTPPTVLEFGKTRKLSAERSDPRNRQLLQKRQFFHSHRAQPMAVEQVLSDHDSEDEVDDDIADLEDRRMLADFLDVTKDEKLIMHMWNSFIRKQRVLADGHIPWACEGFSRLHGPQLVQNPPLLWCWRLVMIKLWNHSLLDARAMNTCNTILEG

SEQ ID NO: 132824 - protein, 141 aa, Triticum aestivum
  Clone ID: PAT_TA_27242.pep
GAPPPSALFCSAAESPPARGQKFLVPCPFARGCHSLRCTKRGVIGRSIDIGRFSGYGELNQALAHMFGIEGQLEERQTKGWTCLYQDDEGDFLLLGDGPWEEFVISIKSIRIMSPQEVDQKCLQKLGGGLASRQVTSKSRQ

SEQ ID NO: 132825 - protein, 159 aa, Triticum aestivum
  Clone ID: PAT_TA_27243.pep
MLSPLVKSMCARTSYPYECEASIARLPETAAVPGRQKNLLGVLTLAIDAVRAKIVEAKNAATDVSKDPHVDKLSKGAIKDCISNYDDMNYEFDSALTALKRGDKGTAGSALDAARTAVDTCDEGFLDRPQLKPVLGGYEKVLAELSSNVLAINANAKKY

SEQ ID NO: 132826 - protein, 213 aa, Triticum aestivum
  Clone ID: PAT_TA_27244.pep
RTRGVFGNTRRLQHHKPVTKAQAAAALTSGRMEEVVRDELNRLEAENQSRLSAMGEMMEELINRGDIKQYWEVKIKKEQDRGFEVEKHLQDVLHELANERTDQEKEIADLLKEKSALERQNQELVCLRSEVDGMYDRLATESLEVMADEENLEKLSSDMSSKHQAVTEAKSYLEAEKEALTMLRSWVEQEAARVHERAEVLERAVRRWRVPAD

SEQ ID NO: 132827 - protein, 217 aa, Triticum aestivum
  Clone ID: PAT_TA_27245.pep
RATNTIRQDSRTYQFQGHSPAVSQRGYSHAPDCYGMSFAPQPSSYQNNYSHGWPENQNMSYRSNNPEISSFASSYPMQGFRYNEESHNYAPQQFYSPPTHMPQHQEMLPMELNGPPFGQPTIPAPIVQSHVQVPTQDEFDDIDKLTLLCVEFTWASRVLHTIGPQRYLTGILTTIHGRCTATVVGTVNYDRNSMCPTNKCSTSWAGSPISCASAHTS

SEQ ID NO: 132828 - protein, 547 aa, Triticum aestivum
  unsure (1)..(547): unsure at all Xaa locations
  Clone ID: PAT_TA_27246.pep
TMGTACKEGTHVGIIPRAMAALFDKIEKLKNQVDFQLRVSFIEILKEEVRDLLDPATVAAGKVENGNGHAGKLSVPGKPPVQIREGSNGVIXLSGSTEVHVTTQKEMTTCLEQGSLSRATGSTNMNNQSSRSHAIFTITLEQMRKADPIMASDGMPIEEMNDDYLCAKLHLVDLAGSERAKRTGSDGLRFKEGVHINRGLLALGNVISALGDEKKRKEGAHVPYRDSKLTRLLQDSLGGNSKTVMIACISPADINAEETLNTLKYANRARNIQNKPIVNRNPIADEMKRMRQQLEYLQAELVLARGGGVGSDDVQGLRERISWLEHTNEDLCRELYGLRNHVHSDPCEPGLHKTVSGYTKXEGLKRSLQSTEPFDVLMTDSVREGNPKDIDDEVAKEWEHTMLQDSLGKELNELNKQLEKKESEMKGYGHDTVALKQHFGKKLMELEEEKRAVQKERDRLLAEVESLNADGQTHKVRDAQLQKLKTFEAQILELKKKQESQVQLLKEKQKSDEAAKKLQEEIHFIKSQXKVQLQHKIKQEAXTVPGN

SEQ ID NO: 132829 - protein, 145 aa, Triticum aestivum
  Clone ID: PAT_TA_27247.pep
LYLIKGQKVDVGKGMIMDPSQRTFHNQPIPAGYFRVSLSSVKSGHEDLPPPVQHVGEDDETPPRIGSCKGWVLLWMKNLIRLEPAESTPITTTHQQACAETTTPPTQLPAPVVPGESGGRHDEGGAIVLADVISPVEQRMDVETE

SEQ ID NO: 132830 - protein, 259 aa, Triticum aestivum
  Clone ID: PAT_TA_27248.pep
KQDGDDDDNDDEKKEKKLKNKDDDDDDEKKEKKLKNKDDDDNEKKKEKKSKEKSDSSEEDDAEKKSKSKSESYEDDDDNKNSKSKSKASDEDFDAVPMEAKADESMPGVDTPDEYQASTTKAKPRLPAADTPGGYTARTAAQPKMSAADTPDGYATLTTQMSATNTPDGYVTPSKAQPATDSPNGNRPCDRLTDGNVPATDSPDGNVPTTDSPDGNVPAMDSPDGNVQVTDSPDGNVPATDSPDGYAAPTKPDVDVQSY

SEQ ID NO: 132831 - protein, 259 aa, Triticum aestivum
  Clone ID: PAT_TA_27249.pep
PRVREHHADPNKVSWDFGTPLTTALYATPDRMNESTCLECVKLLVKAGADVNCTIPETPLAIATNNGLTTCFKYLLEVGANINVPANQVKKSDSDSKAPLKSSGAKAVRGKNYVAASKLCSEGKSSDKDRKARLKSQGAKAVEGKDYATASKFYTEAIKLDPADAVLYSNRSLCHLKCGEAHDALMDANACISLDPKWHKGYYRKGAALMSLLEYKEASDAFSAGMKLAPNSKEMQEAHREAVEAMRKEQSEPSLYALD

SEQ ID NO: 132832 - protein, 230 aa, Triticum aestivum
  unsure (1)..(230): unsure at all Xaa locations
  Clone ID: PAT_TA_27250.pep
MGRGKIEIKRIENATNRQVTYSKRRSGIMKKARELTVLCDAQVXAIIMFSSTGKYHEFCSTGTDIKGIFDRYQQAIGTSLWIEQYENMQRTLSHLKDINRNLRTEIRQRMGEDLDALEFEELRDLEQNVDAALKEVRQRKYHVITTQTETYKKKVKHSQEAYKNLQQELGMREDPAYGFVDNPVAGGWDGVAAVAMGGGSAADMYAFRVVPSQPNLHGMAYGGSHDLRLG

SEQ ID NO: 132833 - protein, 167 aa, Triticum aestivum
  Clone ID: PAT_TA_27251.pep
PRVRPRVRSARRPRRQRSLAETSIGRLRPPPSTTAPLHRGGGPLRRLLPSARPASRAVSAKIRASAINDLQRSRSSLEALFCYDKAVPEENIGKPAGLDLEKKEVGKNPPCVRCETKGAVLCATCAGSGLYVDSIMESQGIIVKVRCLGCGGTGSIMCSTCGGRGHT

SEQ ID NO: 132834 - protein, 147 aa, Triticum aestivum
  Clone ID: PAT_TA_27252.pep
MEVSARLRPPPSSTAPPRRGGGPLRRLLPSSRPASRAVSAKIRASAINDLQRSKSSLEALFCYDKAVPEENIGKPAGLDLEKKEVGKNPPCVRCETKGAVLCATCAGSGLYVDSIMESQGIIVKVRCLGCGGTGSIMCSTCGGRGHT

SEQ ID NO: 132835 - protein, 159 aa, Triticum aestivum
  Clone ID: PAT_TA_27253.pep
TDQEIHMYRSKKISKNLKLQIFSWRHTKLLSSSSSAGGARHISTFVNPRAFMATDPAVPAEVIRGRHHFRYHLASNHAAERHSVSTDENTIEPVVPVGTCSSQPAEDPAGPMRRNSIRWRLKRDLEHARSHRVRPIQLLHAHEGPGRSLQQDGNQRRMH

SEQ ID NO: 132836 - protein, 242 aa, Triticum aestivum
  unsure (1)..(242): unsure at all Xaa locations
  Clone ID: PAT_TA_27254.pep
MSSPACRPGLPAPRRQAPLLPRPAATPSVSKMAVHRTRPAHSAFEFSSSPGRRRRARVISSCHGGMVERRRLLLIPAISLTIGSLQYSLEKGAAKAEFTDMPALRGKDYGKTKMSYPDYTETESGLQYKDLRVGEGPSPKKGETVVIDWDGYTIGYYGRIFEARNKTKGGSFEGGDKEFFKFKVGSGQVIPAFEEAMTGMRPGGVRRIIVPPDIGYPDNDXNEGRPRKKQQFSGERAPRFGS

SEQ ID NO: 132837 - protein, 143 aa, Triticum aestivum
  Clone ID: PAT_TA_27255.pep
GSTGGQDSPYLGYNSLKDFFPTMEMRPYPQCSNPACLERQKEYMQSKPARDAAAKAKMEAEASAAIEYPVHMDNEWNISVLDDSDTATSSVQRAATDILPEGLVRELPDEDTYVEPPAAPASCGAIDDDLEELQRQLDALNSS

SEQ ID NO: 132838 - protein, 181 aa, Triticum aestivum
  Clone ID: PAT_TA_27256.pep
VASGVDERTLKRDGVCAASLPTTMGVVAGLLVQNSLKYLLKFGQVSPYLGYNSLKDFFPTMEMRPNPQCSNPACLERQKEYMQSKPARDAAAKAKMEAEASAAIEYPVHVDNEWNISVLDDSDTATSSVQRAAADILPEGLVRELPDEDSYVEPPAAPASSGAIDDDLEELQRQLDALNSS

SEQ ID NO: 132839 - protein, 179 aa, Triticum aestivum
  unsure (1)..(179): unsure at all Xaa locations
  Clone ID: PAT_TA_27257.pep
MEEELHALLRDLDALKQLPDPASIDRMRDRVVKMMGPSGAAATATRSKIKDMSAEVVDSNPYSRLMALQRMGIVDNYERIRDYSVAIVGVGGVGSVAAEMLTRCGIGRLLLYDYDTVELANMNRXYLRPDQVGMNKTDAAVQTLSEINPDVVLESYSLNITTVKGFETFLGSLKARISK

SEQ ID NO: 132840 - protein, 150 aa, Triticum aestivum
  Clone ID: PAT_TA_27258.pep
IGVLEALLWRTNSTFAISEHGARTNIYDEGKAIVQKHKATPEEVEVQLTQYRQDGMPDEKRLHGLKALAEASIIVRELTPLTNHFMCAWFNEVVRFTSRDQLSFPYVLWRLNMPGINMFPVCTRRDLVNSLGHTRKVKPLTQTNTDSSTA

SEQ ID NO: 132841 - protein, 264 aa, Triticum aestivum
  unsure (1)..(264): unsure at all Xaa locations
  Clone ID: PAT_TA_27259.pep
RTRGAASCYPGLVEFQGVFYTPDSGEIYFALEYMDGGSLADIIRVKKFITEPVLSHMLQKVLLALRYLHEVRRLVHRDIKPANLLLNLKGDTKITDFGVSSGLHDSVTMCATFLGSVTYMSPERIRNENYSYAADIWSLGLTALECATGRYPYDVNGGEADLMLQILEDPSPTPPQHMHSEEFCSFIDACLQKDADARPTCDELXSHSFIKKYEGPGVDLAEYNRSVHDPAERLSQIAHMLAVHYYLIFDGGDDQWHHMKSFYG

SEQ ID NO: 132842 - protein, 77 aa, Triticum aestivum
  Clone ID: PAT_TA_27260.pep
AIFTSLQPQFPHHYLISVPVGVPVDMTIKTYVNINQRNHFLTKGKEAQSDHHHLGLWGTNLTLLSFIDMFESTTNLK

SEQ ID NO: 132843 - protein, 290 aa, Triticum aestivum
  Clone ID: PAT_TA_27261.pep
EGLQLAVDVLGSKRRQRSSGMQQRLWEGGVPVEGRRSWVPGMAGMRSARGSRLALRSRLKLRRVAYNTGGRSLTDICEKYKVCKSCGVSVFEGFGDLSLKDDADIDHPSLAVEGDDCSPNTDTLAQDTGTLVNSAGRFSLLQKCSRLFKFSPRTKAEQSSEQEAEINIPFGARLEEASPSEGDYEPTPVYQAANNSFDAEGLPSASGARAVGVPVWRALAVDLPSVSPLGVADNCIAVHVSEPFAGAHDMAADTTIASVPQNGKDSTAAPGVSSSLLGQRPSSHRNRKRK

SEQ ID NO: 132844 - protein, 78 aa, Triticum aestivum
  Clone ID: PAT_TA_27262.pep
RSSPGMCFRRNLCAPASAPSNRPGYHDIAVTCWQHCPCCFLPSRWRQFSFGSISLLPKTITLLPSHLRHGPCNTFCCN

SEQ ID NO: 132845 - protein, 384 aa, Triticum aestivum
  unsure (1)..(384): unsure at all Xaa locations
  Clone ID: PAT_TA_27263.pep
SSARGELEVRSWCASETASRGDGGGGKAEGGGALLAKTRHPPPHVLRPHPRRHPPRPGALLGAKVEPSFAERSLIYHRDYLTTATIVTSSAVNITEHAVLTADGQSLAYDYLVVATGHVFASAGSRTERLAEFQRDNEKIKSSESVLIIGGGPTGVELAAEIAVDYPEKKVTLVHRGSRLLDFIDQKASKKCLDWLTSKKVDVLILQSVDLKSLSDTXKFYKTSAGETITAEYHFVCMPLCLYWSWLHDTILXDLWTPKSXVMVEKNLRVKGYNNIFAIGDITDIPEIKQGLKSNKETHALLVAKNLKLLIKGAPPSKLXTYSTGFPLAIVSLGRNGRAXARLPYLTLTGCIPGMLKSKDLFXVGKTRKQAKPINLSRSPDKNK

SEQ ID NO: 132846 - protein, 42 aa, Triticum aestivum
  Clone ID: PAT_TA_27264.pep
PTRPPTRPPTRPEIDPSFGVEATELYPDVHYITVDEYLNRFL

SEQ ID NO: 132847 - protein, 344 aa, Triticum aestivum
  unsure (1)..(344): unsure at all Xaa locations
  Clone ID: PAT_TA_27265.pep
GRPGRYLLVTFSGLSYFSALLYILPLCCAGRGAQGRGRGRVLVIGGTGYIGRFXVAASAREGHPTAVLVRDAAPADPAKAAVLQGFRDAGVTIVKGDMYDHESLVTAIKSADVVISAVGYQQLPDQTLIISAIKEVGHVKRFFPSXEYGNDVDXVTMRVEPAKTVFGXKAHIRRAIEAEGIPYTYVSSNFFAGRFLRSLAQIGVTEPPTEKVLIMGDGNVKGIFAAEEDVGTYTIKAVDDPRTLNKILYLRPPSNTLSHNELVSLWEKKLGKTLERVYLPEDELLKKIRESSAPLNVALAISHSVWLKGDHTNFEIDPSFGVEATQLYPDVPYITVDEYLNRFL

SEQ ID NO: 132848 - protein, 87 aa, Triticum aestivum
  Clone ID: PAT_TA_27266.pep
TCPLLIHVISINMYMLFSPHSTLFEWLLQDWHKTTVPIASLAQSNNLNPFWRSMCRKQGEDFIWKNRNDVYFTRWTFTNNISKETPS

SEQ ID NO: 132849 - protein, 133 aa, Triticum aestivum
  Clone ID: PAT_TA_27267.pep
KGGISRITTVVPGTDESIEKLVQQLYKLIDVHKVDDLTDLPFAERELMVIKVSGNTAARREILDIGNIFRAECVDLSDHTVTLQLTGDLDKMVALQRLLEPYGICEVARTGRAALIRESRVDSKYLRGYSLPL

SEQ ID NO: 132850 - protein, 230 aa, Triticum aestivum
  Clone ID: PAT_TA_27268.pep
HGVRPRVRNDLFSELGEMLEVDRQTNGKACILTDTTRILRDLLSQLESLRKENSTLQNESHYVTMERNELQDENSVLRNEILELQKELTMPHAVSHSANTVFPSQQPMQPATIASAVFPLQQPLLQTTILEHPYAPPPPPRELKLFPDAASDVEGLEPSEDPEATNHITRPLARYPTESASWPVTVSLGLPRMEDEQCSSGTTGSSNEGSSSASSKRLSSKVQPVKEVSL

SEQ ID NO: 132851 - protein, 66 aa, Triticum aestivum
  unsure (1)..(66): unsure at all Xaa locations
  Clone ID: PAT_TA_27269.pep
MVFTLKEMEEATGIFSDKNLIGKGGFGRVYRGXLKDGQIVAIKKMDLPTAKQADGEREFRVGDRHP

SEQ ID NO: 132852 - protein, 257 aa, Triticum aestivum
  Clone ID: PAT_TA_27270.pep
MGSITDMAVIKMLLLPALFALLLRAASAAQWTPAHATFYGGGDASGTMGGACGYGNLYGAGYGTQTTALSTALFNNGASCGACFTIACDTRKSRMCKPGTSITVTATNFCPPNYALAGDNGGWCNPPRQHFDMAQPAWETIAVYKAGIVPVNYRRVRCQRSGGIRFTINGHSYFELVLVTNVGGSGGVAQMWIKGSRTNWMEMSRNWGANWQSNANLDGQSLSFRVKSDDGRVVTANDVAPPGWWFGGTYTSGAQLY

SEQ ID NO: 132853 - protein, 89 aa, Triticum aestivum
  Clone ID: PAT_TA_27271.pep
STKEPKPWALTWVRCIDLNAEKRPRMDQVVRMLDSSETIPQEERRPRQNRISENTETVPLRGKNSIEKSDAPEHEERPPRPKSRPFSSK

SEQ ID NO: 132854 - protein, 189 aa, Triticum aestivum
  unsure (1)..(189): unsure at all Xaa locations
  Clone ID: PAT_TA_27272.pep
QFDQFVLLHVISTSTLPREQITPATVAEKSKLEGKKGEGKRMPRGLLSFLRLLHGVGRRRQSRRRHGLGGLRRHDCNARDLRRFGGRQNSFRRRGPHLGHGARGSGARDGAGPSGASPEPAMPAMVPLPAWILVGPAAPNLYADEVMEPVDEAMDVDTVGVELELAALPPLRPCPVHGWGPCVTPPSFX

SEQ ID NO: 132855 - protein, 278 aa, Triticum aestivum
  Clone ID: PAT_TA_27273.pep
ESFAPPGELSMVNCRFYKVELKWLPRLTRTTFTCWMAFEELPLSFGHVPLLEFLNLTNIGLSRNKMVMLSTLLCETHIQELQLGFKCEKIWVQPECLSERLASAFHRLRIVSLVSIPEGSDLTWTIFILEAAPSLEELYMSVIDHPCEMIMDKKRRTELLLCEKKGVEWESPRSNFKHRRLAKLIIFCFVNCMVSYVRRVMKAAVNLKDVYLYDRLACSKCEHMAIFKPGRLPRAKKKLNAMKKLLTQGIESAPRIHLLTDCEMEADHAARVKDCLCS

SEQ ID NO: 132856 - protein, 209 aa, Triticum aestivum
  Clone ID: PAT_TA_27274.pep
MAAPAMFPKATRKASVGGRAWRLLRLAVLWARKGSAAQSLRLLKTLRHSRVAGLGLGHGGRRNDRLHYGEREFSIDETPAFRFRTPSARVLRFIPCIAPSVPDTPGVYGDDRYFFRDDRKRDASCAGDFYDDQPSECGLESLDDGADEQLLERAMMEASVGSAGAAEAGEDAGVDVKADEFIAKFYAQMKLQRQISWLQYNEMMERSVC

SEQ ID NO: 132857 - protein, 86 aa, Triticum aestivum
  Clone ID: PAT_TA_27275.pep
MNAEPLSIHSFTHRVITKHHNTSSPMMELAAKKKKKKKKKKKKKKKKKKKKKKKKKKKKKKKKKKKKKNKKKKKKKKKKKRGRLKG

SEQ ID NO: 132858 - protein, 315 aa, Triticum aestivum
  Clone ID: PAT_TA_27276.pep
WTLGHAYRVLFDVDGNPRLSCFGLMKNSRDGKSYSTNLAFTPPEYLKTGRVIPESVVYSFGTILLDLLSGKHIPPSHALDLIRGRNITVLMDSCLDGHVSSSDGTEMVRLASRCLQYEARDRPNLKAVVSALASLQKDASAPSHTLLGISQDAVKENAEQVSFSATEKAYATADLEQVHELLENEGYDEDETASFNVSLSSWPGQPSESIQVKKNGDDAFQSKDFTTVLECYSRFIDTGAMESPTMLVRRGFANVVLGRMEDALEDARRAEGISPEWPTAHYLQGMALIGLGMELDGHEKLRIAASLEAQRTGRN

SEQ ID NO: 132859 - protein, 176 aa, Triticum aestivum
  Clone ID: PAT_TA_27277.pep
MGAGEGEAAGSKEKSSGVARTSLDGLRDKNVMQLKKLNMALFPVRYNDKYYQDAIASKDFSKLAYYSDICVGAIACRLEKKEGGVVRVYIMTLGVLAPYRGLGLGTKLLNHVFDLCAKQNISEIYLHVQTNNDDAIAFYKKFGFEITETIHNYYTNITPPDCYVLTKFIGQAATKK

SEQ ID NO: 132860 - protein, 103 aa, Triticum aestivum; identical to SEQ ID NO: 107316
  Clone ID: PAT_TA_27278.pep

SEQ ID NO: 132861 - protein, 222 aa, Triticum aestivum
  Clone ID: PAT_TA_27279.pep
MASRLITRSTAAVLLSHLRSRTPNPTHHLLTHGAAMSSLLGPTHGLPATARSRPLLEPTRWFSSPAPVVEAPRTVDGLTVDSIADKGWTILAEAESDWRSHAAAVAQSIRLIKKRLKWKWLLERSKQLAVVLEKPDLWEDPVFAGNVSREQGELMGKIKSVNQFEQQLMEHIDMLRLAREEGDNELETESMRALADMRRDAKEKELNALLSGDNDVYPCFIE

SEQ ID NO: 132862 - protein, 66 aa, Triticum aestivum
  Clone ID: PAT_TA_27280.pep
IKERLVIFQREVLGRSYNSKAIMSCYLMMIPMELSFGKNSMHLECFSYPITVISICVPCTISYTIR

SEQ ID NO: 132863 - protein, 322 aa, Triticum aestivum
  unsure (1)..(322): unsure at all Xaa locations
  Clone ID: PAT_TA_27281.pep
GIPTAIHRLGGTASLPDLMAALSLPPPKEPFLSRVLRLLAKSDALACTEAGIYSLTPLSYILVDGVLIDGEARQTAFPLAVTSRYHMESGLVRADVRKNDRALPVPSPFEHVHAAAPFDESMTLLDHETDKLFYEALAAHDHMGIGTVVRECRGLFNGLESLTDCCGGDGTTARAIVKAYPHIKCNVLDLPQVIDKVPSDGVVNYVAGDLFHTVPPAQAVMLKLVLHFWSDEDCIKILAQCKKAIPSREMGGKVIIIDIVLGSSLETITETELLMDMLMFICTRGRXQRDEKEWSTIFTKAGFSDYKIVKKLGHRGVIEVYP

SEQ ID NO: 132864 - protein, 60 aa, Triticum aestivum
  Clone ID: PAT_TA_27282.pep
GPDFFRTVSKPKLMDMVMMVCTRGRQRDENDWSAIFMKAGFSDYKIVKKLGARGVIEVYP

SEQ ID NO: 132865 - protein, 361 aa, Triticum aestivum
  unsure (1)..(361): unsure at all Xaa locations
  Clone ID: PAT_TA_27283.pep
MAAHMTVPSDAQLIKAQADLQRHSLTYLTSMALRCAIELGIPTAIHRLGGTASLADLMAALSLPPPKAPFLSRVLRLLAKSDALSCTEDGVYSXTPLSYILVDGVLIDGEARQIAFPLAVTSRDHMESGLGLADWLTXDGPVPSPFEDVHGAAIFEESMTLLDPEMDQLIHDAVAAHDHMGIGPVLRQCRELFEGLESLTDCGGGDGTTARSIVEAYPHIKCTVLDLPKVMDKVLLPAEEGAVKYVSGDLFHVVPPAQAVLLKLVLHFWSDEDCVKILAQCKKAVPPRDAGGKVIVIDIVLGSVSGPMLETQHLMDMVMLVVTRGRQRDEKDWSEIFVKAGFSGYKIVKKLGARAVIEVYP

SEQ ID NO: 132866 - protein, 359 aa, Triticum aestivum
  unsure (1)..(359): unsure at all Xaa locations
  Clone ID: PAT_TA_27284.pep
EVDNPALRERDRRQSVAAQAEKVFVPTDAELLQAQSDLWRHSLCYLTPMXRSCAVDLGVPTAIHRXRGGAASPSGLVAPLSLPPSXLPFLARLLRQLATAGVFNAADAXLTPLPYLLVDGVRIAGEARATQTALVAASRYHADTAMGLVDWAERFGKDFDGSAPAPFDDVHAVDDSVAILGLEDAKLFYDAHAALAHIGLGRVGRVRRGLVDGLEALNCCSGGDGAMGGAAKAIYRAFPYIQCNLMDLLQTVDNERSSSYVVEDEFDTVFLVPFATPTHVLQVLLLELVLHFEDRRKKHQPSSKAGKPCQELGEEVRVIDIAIVPYILCLGWDAENLISLRRRHVEWKTAAGREKEKKR

SEQ ID NO: 132867 - protein, 286 aa, Triticum aestivum
  unsure (1)..(286): unsure at all Xaa locations
  Clone ID: PAT_TA_27285.pep
MSPPVPAMLDDEVDFVEAAKPAITDLVIPVRKLLIVVTITSARPQQAYYLNRLAHVLKGVPPPLLWLVVEWPVTTFETAEILRSSGVXYRHIVCRKNLTSVRKXIAVCQXNNAIYHIKKHHLXSGIVHFADEERSYMGDVFEEMRKIRRVGAWPVANHDASKYRVVVEGPTCKGNRITGWNTIPKKGAPRRFPIGFPGFAFNTTMLWDPQRWNRPARDSVIVHSGGRGGLQESRFVEKLVKNDRQIEGLPDNCNRVMVWNFALEPPQLNYPAGWSLWNHLEVVKDL

SEQ ID NO: 132868 - protein, 96 aa, Triticum aestivum
  Clone ID: PAT_TA_27286.pep
MLQFPALMRQWPSPPLIPASTLLPVPATTQEDELLLAMADSDLEDKLNAIRKTNSNLVIIGKPTNDIKEEYDADVEEDDVDNVDESDGDDFDQETG

SEQ ID NO: 132869 - protein, 91 aa, Triticum aestivum
  Clone ID: PAT_TA_27287.pep
WGSGQSWTAANAVKSWVDEKRNYHLNTNTCDAGKVCGHYTQVVWRKSTRIGCARVVCAGNRGVFIICNYNPPGNFNGDRPFAFLTLDAEAK

SEQ ID NO: 132870 - protein, 85 aa, Triticum aestivum
  Clone ID: PAT_TA_27288.pep
CAPFIFQTNDINLMCVCKFFFFFLYGYFFLFVLLILMLLFFFFFFFSLLQVREISDIFLKAEQNITTSTPLPKQRSLILLRSTGQ

SEQ ID NO: 132871 - protein, 172 aa, Triticum aestivum
  Clone ID: PAT_TA_27289.pep
MASSKSSLAMFALVIVMAVVAGVSAQNTPQDFVNLHNRARAADGVGPVTWDNSVARFAQDYANKRAADCRLQHSGGPFGENIFWGSGQSWTAANAVKSWVDEKRNYHLNSNTCDAGKVCGHYTQVVWRKSTRIGCARVVCAGNRGVFITCNYNPPGNFNGERPFLTLDAEAK

SEQ ID NO: 132872 - protein, 174 aa, Triticum aestivum
  Clone ID: PAT_TA_27290.pep
MASSKSSLAMFALAIVMAVVADVSAQNTPQDFVNLHNRARAVDGVGPVAWDNNVARFAQDWAAQRAGDCRLQHSGGPFGENIFWGSGQSWTAADAVKLWVDEKQNYHLDSNTCDAGKVCGHYTQVVWRKSTRIGCARVVCAGNRGVFITCNYNPPGNFNGERPFAFLTLDAEAK

SEQ ID NO: 132873 - protein, 175 aa, Triticum aestivum
  unsure (1)..(175): unsure at all Xaa locations
  Clone ID: PAT_TA_27291.pep
QSSALARLLAVVAEVSXAQNTPQDFVNLXHNRARAVDGVGPVAWDNEQWPGLRSDWAAQRAGEXGRLQHSGGPFGXTNIFWGSGQSWARATRRGEAVWWHXKQSYHLDSNXTCDAGKVCRVTTRRWLWRKSTRIGLPRRVVLDTGNAGASCITCNYNPPGXNFNGERPXFAFLTL

SEQ ID NO: 132874 - protein, 78 aa, Triticum aestivum
  Clone ID: PAT_TA_27292.pep
MSSTDVPASTDGLAGESWQKSWPEVVGKSIKEAREIILKDKPDADIVVLPAGSPVTRDLRPNRVRIFVDTVADTPFTS

SEQ ID NO: 132875 - protein, 118 aa, Triticum aestivum
  Clone ID: PAT_TA_27293.pep
TKRKVTQIHAMLTLDMPAFIHQILKTYSCACMDGARIHFFAPAKLELASEGCVGDGIDEDAHAVGPSSPRVTGDPAGSTTMSASGLSLSMISPGLLYGLAHHLWPRLLPRVTGEGRRC

SEQ ID NO: 132876 - protein, 186 aa, Triticum aestivum
  Clone ID: PAT_TA_27294.pep
DNYKQVLKDKEDAAVDEDVPLARRRRSSSTTLDRTESHGGREVNGPRTQRASTLHRRHRLRSGPHHLHLPNFQQPEPPPTDSGTGRRRTATPPSYEHQEGGGEVVGFRRTPPPEKITAATNHQPDSAFLSTALPANHPLHPSYVQTGTEVSPPSRRRSGRQRGGNQRAAAGELDRTGKGKKSPLLL

SEQ ID NO: 132877 - protein, 124 aa, Triticum aestivum
  Clone ID: PAT_TA_27295.pep
IDQHKLPSSTEKLMVRTAKEINAGLTNDEWAAAAQPKETPEAARRRLPTTVVQLDQAPSLAQCATTRQSGSSLDVVALALATITAGHSGDCSAQLLPLGGSIYHGTSPRRRGGANFFGDEYLAP

SEQ ID NO: 132878 - protein, 209 aa, Triticum aestivum
  Clone ID: PAT_TA_27296.pep
MAAAAMNTDVEAVDFDSDDDDLMDEEGAIEPSPAPAPRLRSTIAGGGGGDDDAPRKTKGRGFREDPNSSSAHRDSRLAGAGRSGFDALASDGGPGPVRSIEGWIVLVTGVHEEAQEEDLHNIFGDYGQVKNLHLNLDRRTGFVKGYALIEYENFEQAKRAIRESDGTELLSQIISVDWAFSNGPVKQRSTRKRSPRPNRSRSPPRRRYP

SEQ ID NO: 132879 - protein, 127 aa, Triticum aestivum
  Clone ID: PAT_TA_27297.pep
FGRGAIGVHLLSNPDLVAADPVVSFKTALWFWMTPQANKPSSHAVITGRWTPTAADNAAGRVPGYGVITNIINGGLECGRGQDPRVADRIGFYKRYCDVLGVGYGSNLDCNSQRPFTSGASAGLAAQ

SEQ ID NO: 132880 - protein, 163 aa, Triticum aestivum
  unsure (1)..(163): unsure at all Xaa locations
  Clone ID: PAT_TA_27298.pep
GLIEHYACLVAVLGRAGRLVEAYGVVKSMPMEPNVSVLGALLNACHLHGLVKVGEVVGRQLVQLQPSGDGRYIGLSNIYAIARRWQKIXLASMVMEEGEVKRAPGFSGRDVGGRLHRFIAHDKAHSGSAYGYALLNLITVEVKMIADVAIQSNFLHTLFHLGA

SEQ ID NO: 132881 - protein, 98 aa, Triticum aestivum
  Clone ID: PAT_TA_27299.pep
MISRHNSSLVELAPPSKKRKEGRLTNSRDKAPYEGMTKRSRFCSICKTKGHKRTTCPQRGDAPKMPRKEAKCSNCDVIGHRKNTCGRAAGQGADGDVV

SEQ ID NO: 132882 - protein, 303 aa, Triticum aestivum
  unsure (1)..(303): unsure at all Xaa locations
  Clone ID: PAT_TA_27300.pep
PPRSGNQPLVLVSVPPPPDSPGSPSELTNSTPVDSLALTLPSGARRRSRQIQAMDLRAFFGGKKQEPEQNGHANGAAPNGGVKKRTADLAIYEQYEQQARQPEMRAAAIRDGNADVIQKPLLPQFESAEMRNLAETLLRDIIRGSPDVQWESIKGLETAKRLLKEAVVMPIKYPKYFTGLLSPWKGILLFGPPGTGKTMLAKAVATECNTTFFNISASSIVSKWRGDSEKLVKVLFELARHHAPSTIFLDEIDAIISQRGEARSEHEANRRLKTELLIXMDXLTKTNDLVFVLAATNPPWEXX

SEQ ID NO: 132883 - protein, 158 aa, Triticum aestivum
  Clone ID: PAT_TA_27301.pep
APFPLTPCRCDPPPPPPALRPRADPIAPRPQEMSRHHHHDPAPPPCCSCCACACGCSPPAPAPAPCGYYPAPPPQPAPASDQLLHAIAAHLLLSSAPPPPTPPQAQPPPQPHPQHQPHPQPPPNPAAHHANLYASYAYQYQHQQQPGSAPHAAYPQPP

SEQ ID NO: 132884 - protein, 212 aa, Triticum aestivum
  Clone ID: PAT_TA_27302.pep
MASRLLLAVLLASSAWVAASAGAGDEVMVPRPAAALTFGEGYTQLFGDSNLRLHGDGKRVHISLDERTGSGFASQGAYLHGLFSASIKLPSDYAAGVVVAFYMSNGDVYEKTHDELDFEFLGNVKGKEWRVQTNVYGDGSTAVGREERYGLWFDPTQDFHRYSILWTNRTIVFYVDGTPIREVVRSEAMGAQFPSKPMSLYATIWDGSSWAT

SEQ ID NO: 132885 - protein, 479 aa, Triticum aestivum
  unsure (1)..(479): unsure at all Xaa locations
  Clone ID: PAT_TA_27303.pep
GTRYDAISNARHLVYITGWSVFPHITLVRDGNQQETLGELLKRKANEGVHVLLLVWNDVSSIEGLYEAGLLGTRDEVTAKYFRGSRVQCVLCPRNWSVRGYIIDPKRPSTRXVYSHHQKTITVDQELPESSSGSDGRRQIVSFLGGLDMCNGRYDTQSHSLFRTLGTGQAHSNDFSQINFSDEDATLDKGGPRTPWHDIHSKVEGAVAWPRXDVLHNFERRWMKQGGGKEHLVDLVALESKVAPSSWPVTLPGDHEAWSVQLFRSIDSISTVGFPDSMEAAYDAGLVQDKHRVFERSIQDAYIXHAIRAAKSFIYIENQYFAGSSFQWKXPTTGIDPADVGACQQIPRELSLKIVSKIEAGERFAVYVVVPMWSEGTPTGRYRQAMLDNQRRTMALMYDDIAVALQAKKIDADPRDYLTFFCLGNREAKREGEHEPAKRPKDGTDYARAQKARRFMIYVHSKMMIGTAGTPLIVSDVLL

SEQ ID NO: 132886 - protein, 311 aa, Triticum aestivum
  Clone ID: PAT_TA_27304.pep
MAPTVEIRNLTFTYPGIDGKPPPGAPPLIEDVCFSLEAGQRCLLVGSNGAGKTTILKILGGKHMVDPSMVGVLGRSAFHDTALTSSGDLCYLGGEWRRDVAFAGYQVNIQMDISAEKMLFGVTGVDPQRRDELIKILDVDLTWRMHKASDGQRRRVQICMGLLKPFKVLLLDEITVDLDVLARANLLTYLKKECAEQGATIIYATHIFDGLDDWPTHIVYVAHGKLQLALPLEKVKEMSQLSLMRTVERWLRKERDEDRRKRKERKEKGLPAFDKVIEGSRVVNNGWAAGRLTSTIAGEENFSFSSNSVLR

SEQ ID NO: 132887 - protein, 119 aa, Triticum aestivum
  Clone ID: PAT_TA_27305.pep
MHDFCFTIPYGFAVLAGGLLGYLRRGSTASLAGGAGVGGLLLLAGFVSLKAFEKRRNSYLALALETLCALALTFVMGQRYLETSKIMPASVVAGLSVLMSAFYLFKIATGGNHFSPKKE

SEQ ID NO: 132888 - protein, 131 aa, Triticum aestivum
  unsure (1)..(131): unsure at all Xaa locations
  Clone ID: PAT_TA_27306.pep
RPGPPSGGLLPKCLXRQVFQRIDVVSQDFDNIVELELGAPWPLPPVEATATLAHKFEITGIASIKINFDKTTVKTKGNLSQLPLLEVPRLPDSLRPPASNTGSGEFDVTYLDDDTRITRGDRGELRVFVVS

SEQ ID NO: 132889 - protein, 94 aa, Triticum aestivum
  Clone ID: PAT_TA_27307.pep
GAKQTSNLIPLCHNINLSHVRVDLTLNEEDSSVVIEGEATTCGKTGVEMEAMAAVTIAGLTVYDMCKAASKDICITDICLQHKSGGKSGNWSRN

SEQ ID NO: 132890 - protein, 154 aa, Triticum aestivum
  Clone ID: PAT_TA_27308.pep
RHRFLSAAATPPIHPSSILAQAREGGDEEEGARTGLLRRRRPPPQPPAPSAPPATEGDNSTSKNKKGEIGRTIRDRLWSFSFPRSRLSCWTSQSHPIRRSRRGSGTAGDEHGTPVNVPVTAKAIRPPSRKVVAAGTRSLIERNDFYSQECNTHK

SEQ ID NO: 132891 - protein, 136 aa, Triticum aestivum; identical to SEQ ID NO: 112792
  Clone ID: PAT_TA_27309.pep

SEQ ID NO: 132892 - protein, 253 aa, Triticum aestivum
  Clone ID: PAT_TA_27310.pep
FMCSRTTALRVPAAPRLRSFRFSGPFLCSNLFSGVGDSFQDLYLCSGGPVAGLPPTNLPSAVPHLANITTLTICSIALQYVSASLATILKETNLRRLKELQLLMFGMANSNLADIFSFLKTCSCPQLERLFVQLPTNTHDSFTRNYLDVAEEEQPEDGLENLRLAKMTNFKGHHNEMRLLDFLLTKASCLKKLFLVAPKEDHPQGLRKIQSDVLPLFRKAEILERASAGTQIVFSGPDSSHAQPLHSEVFIRF

SEQ ID NO: 132893 - protein, 119 aa, Triticum aestivum
  Clone ID: PAT_TA_27311.pep
ADKEVAGSDSEDGPTTIGEEERGFLRHNKRLMKVLWSDRSVLSWRTSFWIIVTTLHLDRTSFICVLVLYVVKIDGQDLQPLLYVLSSPVLQQRSPQFGVLSKEFVINITILLVSSRDWQ

SEQ ID NO: 132894 - protein, 127 aa, Triticum aestivum
  Clone ID: PAT_TA_27312.pep
AEAPQSPGVEHVAGDMFKNVPSGDAIVLKWILHNWTDEHCTTLLRNCYNALPAHGKVVVVEGILPVEPEATSRGQQASLSDMIMLTHTAGGKERNQREFEQLAKAAGFTGVKTAYIYSNTWVIELTK

SEQ ID NO: 132895 - protein, 369 aa, Triticum aestivum
  unsure (1)..(369): unsure at all Xaa locations
  Clone ID: PAT_TA_27313.pep
TPTSKPREEAEAANGLHGRGNDCRRGGGERPPWPADFPAVEEEACIYAMQLSSTAVLPLTLKNAIELGMLEVVMGAGGKMLSPSEVAPRLPPPAAIPHAPAMLGRMLHLLASYKVDVVLRWEEGTQRPDGHGPTPVCKWFNAXPPGTVISIAPLLLLTNDKVPMESLYHLKDAVLHGGLPFHKAHGMTMYEYTKTDARLNRVFNEAMKGYTTIITXKLVDLYTGFHRIATLVGINFDLAHVIAEAPHSPGVEHVAGDMFKNVPSGDAIVLKWILHNWTDEHCTTLLRNCYDALPAHGWPVVLGATLPVNPDAAPPAQRAALSVVGILPLTPGATARGQRASLALAIAPALTAGGTACIYSNTWVIEFTK

SEQ ID NO: 132896 - protein, 189 aa, Triticum aestivum
  unsure (1)..(189): unsure at all Xaa locations
  Clone ID: PAT_TA_27314.pep
APSTIFLDEIDAIISQRGEARSEHEASRRLKTELLIQMDGLTKTNDLVFVLAATNLPWELDAAMLRRLEKRILVPLPEAEARHAMFKELLPAMTSNRELTYDILVEKTEESAGXDLRLVYKDAAMQPRRRLIAVVAGGEQLLPEEQLPEVGPHKADDVDPAMSNRRPSPHLQAHYYEKINHDYGRLIFS

SEQ ID NO: 132897 - protein, 830 aa, Triticum aestivum
  Clone ID: PAT_TA_27315.pep
MLCLTAPSCSPSLPPRPSRPAADRPGPGISGGGNVRLSAVPAPSSLRWSWPRKAKSKFSVPVSAPRDYTMATAEDGVGDLPIYDLDPKFAGFKEHFSYRMKKYLDQKHSIEKHEGGLEEFSKGYLKFGINTENDATVYREWAPAAMDAQLIGDFNNWNGSGHRMTKDNYGVWSIRISHVNGKPAIPHNSKVKFRFHRGDGLWVDRVPAWIRYATFDASKFGAPYDGVHWDPPSGERYVFKHPRPRKPDAPRIYEAHVGMSGEKPEVSTYREFADNVLPRIKANNYNTVQLMAIMEHSYYASFGYHVTNFFAVSSRSGTPEDLKYLVDKAHSLGLRVLMDVVHSHASSNKTDGLNGYDVGQNTQESYFHTGERGYHKLWDSRLFNYANWEVLRFLLSNLRYWMDEFMFDGFRFDGVTSMLYNHHGINMSFAGSYKEYFGLDTDVDAVVYLMLANHLMHKLLPEATVVAEDVSGMPVLCRSVDEGGVGFDYRLAMAIPDRWIDYLKNKDDLEWSMSGIAHTLTNRRYTEKCIAYAESHDQSIVGDKTMAFLLMDKEMYTGMSDLQPASPTIDRGIALQKMIHFITMALGGDGYLNFMGNEFGHPEWIDFPREGNNWSYDKCRRQWSLADIDHLRYKYMNAFDQAMNALDDKFSFLSSSKQIVSDMNEEKKIIVFERGDLVFVFNFHPSKTYDGYKVGCDLPGKYKVALDSDALMFGGHGRVAHDNDHFTSPEGVPGVPETNFNNRPNSFKILSPSRTCVAYYRVEEKAEKPKDEGAASWGKTALGYIDVEATGVKDAADGEATSGSEKASTGGDSSKKGINFVFLSPDKDNK

SEQ ID NO: 132898 - protein, 330 aa, Triticum aestivum
  Clone ID: PAT_TA_27316.pep
MEEVFPSNSKSKAGQMAGEAIAGAEKKPRPKPEQKVECPRCKSGNTKFCYYNNYSMSQPRYFCKACRRYWTHGGSLRNVPIGGGCRKPKRSGTSDAHKLGVASSPEPTTVVPPSTCTGMNFANVLPTFMSVGFEIPSSLSLTAFGSSSSSNTAAMMSPGGTTSFLDVLRGGAGGLLDGSLSQNNGYYYGGPAIGSGNGMLMTPPAVSFGIPVPMQQHGDLVVGGNGIGAATASIFQGATSEEGDDGMGGVMGLQWQPQVGNGGGGGGVSGGVHHLGTGNNVTMGNSNIHNNNNNDSGGDDNNGGSSRDCYWINNGGSNPWQSLLNSSSLM

SEQ ID NO: 132899 - protein, 168 aa, Triticum aestivum
  unsure (1)..(168): unsure at all Xaa locations
  Clone ID: PAT_TA_27317.pep
GSTGGAPLFIDELIQRAEAQKKRKSIHTGSYTQDEDKFICQAXMEISQDPRTGAQQKGIVFWTRVHRTFHERKMFKPYQITSNRGIGSIQKRWLFIQQECNKYQAAFESVEARPVSGLDVGDTVCSPLPSPFLATAMRLRPCICLHVHLLLIMWCRHFNLWWHSRPGT

SEQ ID NO: 132900 - protein, 169 aa, Triticum aestivum
  Clone ID: PAT_TA_27318.pep
MAAARARWRLLALPLALLLAIGSSRGVDAAPKPPVPKAISDLREAIVKGLGLQSEELKVSGFDVRDALVGHAVAYEFDMEVGRKAVPVRLLEDVNRWDFVDLPIFRSQADADDTALAEIGRGSFDPTLPPFQLAGPMELWIQDGDDVRLALPHDVEAGTLKKVVLADGA

SEQ ID NO: 132901 - protein, 156 aa, Triticum aestivum
  Clone ID: PAT_TA_27319.pep
NYSRAIPAVTDDEDESPSPGLWPFLSLNASDGSLQGLEELLAKVLGKKAGEKGTFKLVNARASAQTYVKMGFTVEKRIADGEVNWSNLPEWRTKPKKLRAHYEVLARVERGQAIPERIAQVQPFQVDEAMSESMLTGNVSRSKMEVVNPPPVYFTL

SEQ ID NO: 132902 - protein, 418 aa, Triticum aestivum
  unsure (1)..(418): unsure at all Xaa locations
  Clone ID: PAT_TA_27320.pep
MAGARARWRFLPLPLPVLLAIGSPRGRDAARKPPVPKAPVPQGHLSPEGRDLXREGVTVRGFDVRDALVGHAVAYEFDMEVGRKAVPVRLLEDVNRWDFVDLPIFRSQADADDTALAEIGRGSFDPTLPPFQLAGPMELWIQDGDDVRLALPHDVEAGTLKKVVLADGAVVTVKGARAVSLRLPLELPLPLNRTTYKGRLSSLLSIARALRGAARSNQKPLMSLRIEGPTSLSSTPSMSPNDKLKLKRLAPGQVELSSRAIPAVTDDEDESPSPGLWPFLSLNASDGSLQGLEELLAKVLGKKAGEKGTFKLVNARASAQTYVKMGFTVEKADXLERKRVNWSNLXEWKTKPKKIXAAHYEVLARCACVGRGGSPXTDRPGCMPLLRAKEAMSESMLTGNVSRSKMEVVNPPPVFFTL

SEQ ID NO: 132903 - protein, 460 aa, Triticum aestivum
  Clone ID: PAT_TA_27321.pep
MIPTTVKAFSGISTPRQRLQLTQMLTVPRLPKPRRNEESYSYNYPESGNTCDPERTTSRRGRFAKRRRHSNDYTTVDYAGDNKETVVASTETNAFTDVGRVNGTSVEKMRSAVSVRRANVLREISQIDTRGLLVEKAKEAVRGKLQELSMAACSRFAEKRKSEGKVYPSDNNIKANGVLSGKLGKGLKLCSSISVDTHIPATAADEKNPEQKRVPVSIDVPDPDFHDFDKDRTERAFYSDQVWATYDSEDGMPRLYAMVQKVLSMRPFRIRMSFLNSKSNIELSPINWVASGFQKTCGDFRVGRYQITETVNIFSHKVSWTKGPRGIIRIIPQKGDTWALYRDWSPDWNELTPDDVIYKYEIVEVIDDFTEEQGLTVIPLLKVAGFKAVFHRHMDPKEVRRIPKGELFRFSHQVPSRLLTGEEGNNAPEGCHELDPAATPVDLLKVITEVNEDVAAQTAE

SEQ ID NO: 132904 - protein, 160 aa, Triticum aestivum
  Clone ID: PAT_TA_27322.pep
MPYDTMQIYNRCCTAEISLGRVAPAIQATIVGVCVTKGEWPFKYGCKVSCFFSPADATEGCEAEVVLLDRRAKRMRAGSDGYLSLSRNVVSVGLQGTLRVVTEAYSESGLNIVRKYHAEFPIQQSQIDSRECSVDGSTLKIVVAWSRLVIDKDDLVLDGY

SEQ ID NO: 132905 - protein, 403 aa, Triticum aestivum
  Clone ID: PAT_TA_27323.pep
MVAVVGELAGTISLPSSSCWRCAARRYRRAAVLGAALSPLCTSALRFVWAPSLGHPSPAWVPLVYPFLLEVMTRPIQPSEHMILVHHQLKLAFMVCLLVPKSICLWMPKLQVSAIMYEISILMWEFSARYVANQAKTSEERGMLETPIRARQIVPRVRGLYGMDIYKNKVLEFLQSERSDESIFGLWGTSGVGKTRLLSLIADSFADSFHHVIFLDGGSSVRVMQNHFAYFLKLDWETISLLEEHYRAKIIMEYLEHVSFLVLLDDVQDEVYPDLTAVGLPMALGHRQKVILTSRSQVACARMGCTISNTLEMKCLGDEDAWSLFEYNAGVKITEADTEIYEYAKKMVSACGGLPRAICAIGIGVAGATCRGKHPDDWWFTYKRFKAKNLPPERMEEIVPVLV

SEQ ID NO: 132906 - protein, 374 aa, Triticum aestivum
  Clone ID: PAT_TA_27324.pep
PTRPLELMRDTLKSPLDEQVKRALRVPLPRTLKRVETLHYISEYMHEERHNPTLLELAKLEFNLLQHVHLKELKYLTKWWRDLYRCVGLNYARDRLVEGYLWCYAIYHEKEFAFSRIFLTKQLMLISLMDDTYDARATIEECRQLNAAIQRWDERATSLLPDYLKRFYTELLRIFKDATSEVTICDTYHVAYARKAFQDLSAYYLQEAEWLHQNHKPSFKDHLSLSAMSIGSPTICVGLMVGMGDPVTREAFEWAAGYPKVAIACGKIARLMDDIAAFKGGKAKGDMASSIECYMVEHSVTSEVAISKILSLLEDEWRTLNQAHFEHHSHLLVVQRIINFANSMLVFYAGKNAYTFSINLKETVESLFVKPIPM

SEQ ID NO: 132907 - protein, 166 aa, Triticum aestivum
  unsure (1)..(166): unsure at all Xaa locations
  Clone ID: PAT_TA_27325.pep
NYQIAPICAQKYVTLVNVRCACNTLKKEWVCQDVLKEYRRSXGRDPKEVAKGQFGVGLIACGGDCVKKVNVPAAELHQRKVQENKNPAAEVANVPKRRKKRDRGAQEPVQVSMWQRIKWYLVVITALAGLVVLGLVIWKGVYQISDWMNEMEEQKARERLLRAGRL

SEQ ID NO: 132908 - protein, 126 aa, Triticum aestivum
  Clone ID: PAT_TA_27326.pep
VSLARDPGRLRRRLVKGIDGSWTSSATGPEGIGAGSWKRSAEGPQLDMHRISGGRISGDQRRISARAAAKGWSGGGEGMKSGGGRMRAQTRSSVSRSRARDLARTCGGLVCDLFSLVNFRRVFLAG

SEQ ID NO: 132909 - protein, 155 aa, Triticum aestivum
  Clone ID: PAT_TA_27327.pep
WGRSRREPAMYARKRCVATAIVLVLWLQATADAARLSPAGLIRLPSNGRGHYTDQVRESKVMDCQDGYVERCIRIGITGIICRCFPKNGVGLTDQAMLATAASPSKIDEERPSPKNSHDQGDSTDQVKESKVTGCLDGCGEMLHHRYNSGTWLLS

SEQ ID NO: 132910 - protein, 82 aa, Triticum aestivum
  Clone ID: PAT_TA_27328.pep
ITCSQPIRLRQDSTSALYKLQIRTGSLPLRGLNKVYINLSAVIIAEQRISQGVATLALYTLQIKMLFLLIYLETTVHICGHS

SEQ ID NO: 132911 - protein, 198 aa, Triticum aestivum
  Clone ID: PAT_TA_27329.pep
IRPRLKMMDGIRTSAFRPPSVRGFVSKTRGVKAYNHYGKDLEMVSAVLCAGLYPNVIQCKRRGKRTAFYTKDVGKVDIHPSSVNAGVQQFPLPYLVYSEKVKTASIYVRDSTNISDYALLLFGGSLSPSNTGEGIEMLAGYLHFSAPKRIIELIQRLRGELDKLLQRKIEEPALDIFSEGKGVVAAAIELLHSQNIYH

SEQ ID NO: 132912 - protein, 161 aa, Triticum aestivum
  unsure (1)..(161): unsure at all Xaa locations
  Clone ID: PAT_TA_27330.pep
MASASASAALEKARQLLEEAAAESLPTEQVDALPSGFYDAFVLCGIRVHAVEPGRLLCHFTVPARLLNSGNFLHGGATASLVDLVGTAVFYTAGAXNQGSPLEMNISYLDAAFSDEEIDIEAKVLRAGKAVGVATVELKKKSGKIIAQARYSKYLGASSKL

SEQ ID NO: 132913 - protein, 217 aa, Triticum aestivum
  unsure (1)..(217): unsure at all Xaa locations
  Clone ID: PAT_TA_27331.pep
RYPPDPKSWRLERQAGKVAVREQGRRDGAERGEEGLKDGELLILLPASISTPPPLHQPLVITHLLEPAPPPTAFGRRLGVVGGVVEGSRMGEWRGGAAPAAVREEEVGAHRGCLRAHAPRIWLLRHRLVLLLTHLPPPSPRSPHSPRPARWRRRGEERSRRPWPPPPHASVSSLSSLSTSRDPPTRTDRERRGPGGGNRDEGRGRRRCCPPVALLXX

SEQ ID NO: 132914 - protein, 114 aa, Triticum aestivum
  Clone ID: PAT_TA_27332.pep
MASGGGYAWALAAGLNAALAAISAKFFAPTLLKYGMVILFNVTMWGCYVNSLKALSSLQATVTNFAANFISSGLAGYFLFQEPLPSKWFAGASLIILGVFILSKSSIEEKVNSD

SEQ ID NO: 132915 - protein, 128 aa, Triticum aestivum
  Clone ID: PAT_TA_27333.pep
FLQQVKPTPYVQSQMWQASGCQLMRHQCCQPLAQISEQSRCQAVCSVAQIIMRQQQGQRFGQPQQQQGQSFRQPQQQVPVEITRMVLQTLPSMCSVNIPQYCTTTPCSTITPAIYSIPMTATCAGGVC

SEQ ID NO: 132916 - protein, 237 aa, Triticum aestivum
  unsure (1)..(237): unsure at all Xaa locations
  Clone ID: PAT_TA_27334.pep
FVSLSFYFCILLLCHGSMAQLFGMSFNPWQSSRQGGFRECTLNRLQASTPLRQVRSQAGLTEYFDEENEQFRCIGVFVIRRVIEPRGYLLXRYHNTHGLVYIIQGSGSAGLSFTGCPETFQKQFQKYGQAQFVQGQSQSQKFKDEXQKVHRFKQGEVIALPXGIVHWFYNDGDAPIXGFLCFHVTNNANQHEPSLREFXWLGTYRVETSFSQKNLKVLHFRPLGEALGSRGKNAHAA

SEQ ID NO: 132917 - protein, 319 aa, Triticum aestivum
  unsure (1)..(319): unsure at all Xaa locations
  Clone ID: PAT_TA_27335.pep
MAATGFASLFFYFCILLLCHSSMAQLFGMSFNPWQSSRQGGFRECTFNRLQASTPLRQVRSQAGLTEYFDEENEQFRCAGVFVIRRVIEPRGYLLPRYHNTHGLVYIIQGSGFAGLSFPGCPRDIPKASFKNMGKAQSRTGSKAKGQKFKDEHQKVHRFRQGDVIALPAGIVHWFYNDGDAPIVAIYVFDVNNYANQLEPRHKEFLFAGNYRSSQLHSSQNIFSGFDVRLLAEALGTSGKIAXRLQSQNDDIIHVNHTLKFLKPVFTQQREPESXHTLNMRNGNLRXNTLRKSNLQWGSLRESTLKRAISGKAHSGEQL

SEQ ID NO: 132918 - protein, 135 aa, Triticum aestivum
  Clone ID: PAT_TA_27336.pep
MWIPRAAGIRHQLTSRREVTNRLLVVVVMAKHFSLLLVLAFVLVVTAEDCTVDLKGLIRECKPYVMFPASPKITPSSACCSVVQKVNAPCMCSKVTKEIEKVVCMDKVVYVADYCKNPLKPGSDCGSYHVPSQGR

SEQ ID NO: 132919 - protein, 567 aa, Triticum aestivum
  unsure (1)..(567): unsure at all Xaa locations
  Clone ID: PAT_TA_27337.pep
MSATSFVSLSFYCCILLLCHGSMAQLFGMSFNPWQSSRQGGFRECTLNRLQASTPLRQVRSQAGLTEYFDEENEQFRCIGVFVIRRVIEPRGYLLXRYHNTHGLVYIIQGSGSAGLSFTGCPETFQKQFQKYGQAQFVQGQSQSQKFKDEHQKVHRFKQGDVIALPAGIVHWFYNDGDAPIVAIYVFDVNNYANQLEPRHKEFLFAGNYRSSQLHSSQNIFSGFDVRLLAEALGTSGKIAQRLQSQNDDIIHVNHTLKFLKPVFTQQREPESXHTLNMRNGNLRQNTLRKSNLKWGSLRESNLKRGSLRESXIQGEQPQMGQSQAKHYQGDQPEEGQEGQSQEEQSQAGPYPGCQPRAGQSHASQSTYGGWNGLEENFCDHKLSVNIDDPSRADIYNPRAGTITRLNTQTFPILNIVQMSATRVHLYQNAIISPLWNINAHSVMYMIQGHIWVQVVNDHGRNVYNGLLSPGQLLIIPQNYVIMKKAQHDGSKYIEFKTNANSMVSHIAGKSSILGALPVDVIANAYGISRTEARSLKFSREEELGVFAPKFSQSIFHSSPTSEEESS

SEQ ID NO: 132920 - protein, 502 aa, Triticum aestivum
  Clone ID: PAT_TA_27338.pep
MAATSFASLSFYFCILLLCHSSMAQLFGMSFNPWQSSHQGGFRECTFNRLQASTPLRQVRSQAGLTEYFDEENEQFRCTGVFAIRRVIEPRGYLLPRYHNTHGLVYIIQGSGFAGLSFPGCPETFQKQFQKYGQSQSVQGQSQSQKFKDEHQKVHRFRQGDVIALPAGIVHWFYNDGDAPIVAIYVFDVNNYANQLEPRHKEFLFAGNYRSSQLHSSQNIFSGFDVRLLAEALGTSGKIAQRLQSQNDDIIHVNHTLKFLKPVFTQQRDAESRTLNMRKGNLRQNTLRKSNLKWGSHRKSNLKWGSHRESSLKWGSLRQSTQGEQPQMGWSQAKHSQGDQPEEGQGGQSQQEQSQAGPYPGCQPHAGRSHASQSTYGGWNGLEENFCDHKLSVNIDDPSRADIYNPRAGTITRLNSQTFPILNIVQMSATRVHLYQNAIISPLWNINAHSVMYMIQGHIWVQVVNDHGRNVFNDLISPGQLLIIPQNYVVLKKAQRDGSKYI

SEQ ID NO: 132921 - protein, 187 aa, Triticum aestivum
  Clone ID: PAT_TA_27339.pep
TVIDLASTSQILAGTTSTGSCHGDAVDGGGDGAARGGGAILWDVHSAHQRKGLKHHPHYLDRNLLLRAARNFAPCCCRMMICATLPDGPGTEPAPEIWASGWQHCCPHQLARRLPATSVSGHVVSGLHCCRKAAHVFICRLWLRLRLRLLLALPVALATGSVQLRNSACRREGEESEEEHGLHGGWL

SEQ ID NO: 132922 - protein, 155 aa, Triticum aestivum
  unsure (1)..(155): unsure at all Xaa locations
  Clone ID: PAT_TA_27340.pep
MPAAAAAGSRNRKPQPQMNTCAAFLQQCXPDSICPVTDVGRASGCQLMRXQCCQPLGPDLGSRLRCQAVCSRXHRSSCGQQQGATFRAQPQQQXGQSFGQPQQQVPVEIMGMVLQTLPSMCSVNIPQYCTTTPCSTIAPAIYSIPMTATCAGGAC

SEQ ID NO: 132923 - protein, 145 aa, Triticum aestivum
  Clone ID: PAT_TA_27341.pep
MGQCQQQPQQQVNTCAALLQQCSPTPYVQSQMWQASGCQLMRQQCCQPLAQISEQARCHAVCGVAQVIMRQQQGQSFGQPQQQQGQSFGQPQQQVPIEIRRMVLQTLPSMCNVNIPQYCTTTPCSTITQTPYNVPMATTCVGGTC

SEQ ID NO: 132924 - protein, 181 aa, Triticum aestivum
  Clone ID: PAT_TA_27342.pep
MKTMFILALLAFTATSAVAQLYTTCSQGYGQCQQQPQPQPQMNTCAAFLQQCIQTPYVQSQMWQASSCQLMRQQCCQPLAQISEQARCQAVCSVSQIIMRQQQGQRFGQPQQQQGQSFGQPQQQVPVEIMRMVLQTLPSMCSVNIPQYCTTTPCSTITPAIYSIPMTATCAGGAWLRSVMC

SEQ ID NO: 132925 - protein, 585 aa, Triticum aestivum
  unsure (1)..(585): unsure at all Xaa locations
  Clone ID: PAT_TA_27343.pep
TSFASLSFYFCILLLCHSSMAQLFGMSFNPWQSSRQGGFRECTFNRLQASTPLRQVRSQASTPLRQVRSQAGLTEYFDEENEQFRCTGVFAIRRVIEPRGYLLPRYHNTHGLVYIIQGSGFAGLSFPGCPETFQKQFQKYGQSQSVQGQSQSQKFKDEHQKVHRFRQGDVIALPAGIVHWFYNDGDAPIVAIYVFDVNNYANQLEPRHKEFLFAGNYRSSQLHSSQNIFSGFDVRLLAEALGTSGKIAQRLQSQNDDIIHVNHTLKFLKPVFTQQREPESXHTLNMRKGNLRQNTLRKSNLKWGSHRKSNLKWGSHRESSLKWGSLRQXHTQGEQPQMGWSQAKHSQGDQPEEGQGGQSQEEQSQAGPYPGCQPHAGQSHASQSTYGGWNGLEENFCDHKLSVNIDDPSRADIYNPRAGTITRLNSQTFPILNIVQMSATRVHLYQNAIISPLWNINAHSVMYMIQGHIWVQVVNDHGRNVFNDLLSPGQLLIIPQNYVVLKKAQRDGSKYIEFKTNANSMVSHIAGKNSILGALPVDVIANAYGISRTEARSLKFSREEELGVFAPKFSQSIFRSFPNGEEVSS

SEQ ID NO: 132926 - protein, 221 aa, Triticum aestivum
  Clone ID: PAT_TA_27344.pep
RNGPVQPLANGVKKEPPVTLVHKNFQGILTNETKCLRCETVTARDETFFDLSVDIEQNSSITSCLKNFSSTETLNAEDKFFCDKCCSLQEAQKRMKIKKAPHILVIHLKRFKYIEQLGRYKKLSYRVVFPMELKISSTSDDVDTEYSLFAVVVHVGSGPNHGHYVSLVKSHNHWLFFDDENVEMVEESTLQTFFGSSHEYSGNTDHGYILFYEGLGAKSLG

SEQ ID NO: 132927 - protein, 65 aa, Triticum aestivum
  Clone ID: PAT_TA_27345.pep
PLLWIIIDVGRRRRRAWGHAAPSAPEHPPALHAAGAQGEEHRSDKHYNQHKYSHRAWDTSSRPGR

SEQ ID NO: 132928 - protein, 155 aa, Triticum aestivum
  Clone ID: PAT_TA_27346.pep
KSVLVGGEAVNVPSDTWGGAKDGSGGTIIDSGTTLSYFPEPAYRAIRQAFIDRMSPSYPLIAGFPVLSPCYNVSGAGKIEVPELSLVFADGAAWEFPAENYFIRLEPEGVMCLAVLGTPRSGMSIIGNYQQQNFHVLYDLERNRLGFAPRRCAEV

SEQ ID NO: 132929 - protein, 262 aa, Triticum aestivum
  Clone ID: PAT_TA_27347.pep
RTQRVCDACYDRLDPLQNLLINSVSNATQTAKHDVMDWTSARGWLNLPIGLTLEHEIYKAAASLRSYSQVSRINPRKSIPRAVLSGASGLAILTVVKAGAFLTYKLGTGLVVARKSDGSWSPPSAIASAGLGWGAQLGGELMDFIIVLHGPEAVKTFSSRMHFSLGAGLSAAAGPVGRVLEADVRAGNKGSGVCYTYSHSKGAFIGVSLEGNIVTTRMDANLRFYGDPYLTTSDILMGNLEQPNAAKFLYQALDDLYSGLDC

SEQ ID NO: 132930 - protein, 95 aa, Triticum aestivum
  Clone ID: PAT_TA_27348.pep
GFQPLATTVKSDLVRQQFFQPEKRRVIANSVPSAPYVTSSPVPVAVPQIKAETRHVAAGNEMKSAMHNGSLRDPVVVMQRLQSAAAKQSLPSTSH

SEQ ID NO: 132931 - protein, 149 aa, Triticum aestivum
  Clone ID: PAT_TA_27349.pep
LRTTKKPRCCLPLLMLASRRSFRSEGKNGRRGSNWAWKSRSSGEGRSLRLMARSAAEEVVQQPRTQGVGGGGDCLVRRWWVRRQGQVQAEQAPPAAARLLPALPPAGSRCRRSPPAAAVCLFLSDEREREGREREISGPPREPVPNSAR

SEQ ID NO: 132932 - protein, 278 aa, Triticum aestivum
  Clone ID: PAT_TA_27350.pep
QQNIMAMYRKVYKGEFRCPRWFSKDLTSLIMRFLDTNPSTRITLPEVMESRWFKKGFRPVKFYIEDDQLYNVIDAENDMLDLGLPDPLPQPLPPPPPSPSPQQVDGDDSGSESDASVVSCPATSSFEERHRLRGPLPRPASLNAFDIISFSRGFNLSGLFEEKGDEVRFISGEPMPDIITKLEEIANVKSFAVRKKDWRVSLEGTREGVKGPLTICAEIFELTPSLVVVEVKKKAGDKEEYDDFCNKELKPGMQHLVHQMVPVPNTPTISELAERPSR

SEQ ID NO: 132933 - protein, 83 aa, Triticum aestivum
  Clone ID: PAT_TA_27351.pep
PRRVHISFAGSLLVSSSKHHLKEAGDSGSDDEPRHAGQDNLELRAIHDSSDCLVADLFSILSNLALNLATSAKSRASRRPTRP

SEQ ID NO: 132934 - protein, 150 aa, Triticum aestivum
  Clone ID: PAT_TA_27352.pep
VPYLTPPTSSPSPRASPPLPNHPPCFPCSDCNPFPPAGRPMLKPPCFGSGPKLPPFVHSPQPSAVPSPPVHKPYLPPAFPPIPGRVDPPHPLPSPNHVPNAVPGPTYQMMPIPSPPVPHFRHPIPPRKKRSGTTTKSPPIAPSPYSLLHS

SEQ ID NO: 132935 - protein, 66 aa, Triticum aestivum
  Clone ID: PAT_TA_27353.pep
RTRGRTRGRTRGLSTYDRHELNYNQIALSRLPISIMGDYTIQTIRNSSESKINKEKSSNSRTITDY

SEQ ID NO: 132936 - protein, 336 aa, Triticum aestivum
  unsure (1)..(336): unsure at all Xaa locations
  Clone ID: PAT_TA_27354.pep
MVSDASKKKAAQKKAAAAAKRGAKVPASSSASSSASANKTGAKAAADALAAVQLSDRTCTAVLTSHPLSRDIHIESLTLTFHGHDLLVDTDLELNYGRRYGLLGLNGCGKSCLLKAIGCRELPIPDHMDIYHLSHEIEASDMSALGAVISCDEERVKLEKEAEVLAAXNLEACVWLEETLKKFDRTLVXDFLNGVCTNIIHMQNRKLKLYTGNFDQYVQTRSELEENQMKQXRWEQDQIASMKEYIARFGHGSAKLARQAQSKEKTLAKMERGGLREKVARDRILTFRFANVGKLPPPALQFVEVTFGYTPDNLIYKKXDFGVDLDSRVALVGPNG

SEQ ID NO: 132937 - protein, 508 aa, Triticum aestivum
  unsure (1)..(508): unsure at all Xaa locations
  Clone ID: PAT_TA_27355.pep
TPSRNTPPRSPTGPRRPPPPPSRHHTTPTPPRRGAARRRAPPSDARTAPAAQTKAAAAAKRAAKVPTSSSPASSSASTNKTTGTGALAAVQLSDRTCTAVLTSHPLSRDIRIESLTLTFHGPDLPVDTELEPSYGRRHGLLGLNGCGKSCLLKAIGCREPPIPDHMDIYHLSHEIEASDVSALGAVISCDEERVKLEKDAEALAARAAAGAPAWGRVAGRLQAFVPSTAVLRAADFFSGFGLYKQMQAKXKTRDFSGGWRMRIALARALFMNPTILLLDEPTNHLAPAAXLRLEETLXKFDRVIHVILQLQDFLDGVCTNIMHMHNRKLKLYTGNLDQCVQTRSELEENQMKHNRLEQDQIASMKENIARFGHLQYMLKEYPGNEEERMRAAIGRFGLSGKVQVMPMRNLSDGQRSRVIFAWLAWREQQMLLLDEPTNHLDIETIDSLAEALNEWDGGLVLVSHDFRLINQVAQEIWVCEKQAVTRWEGDIMEFKEHLPKSKCGMSDD

SEQ ID NO: 132938 - protein, 79 aa, Triticum aestivum
  Clone ID: PAT_TA_27356.pep
WGGVFAVLIGRLRPRGIHVLRRRLSWRFATAVVNQHKRWHTSGVGAEGLARSRWIVGAAISLATLQGLLRLMASLYRVM

SEQ ID NO: 132939 - protein, 77 aa, Triticum aestivum
  unsure (1)..(77): unsure at all Xaa locations
  Clone ID: PAT_TA_27357.pep
LSQSKAKTKTPVYYEVNSSLLCMCCLTMVRLSMRDMLLXKKKKKKKKKKKKKKKKKKKXXXXXXXXXXXXXXXXXXX

SEQ ID NO: 132940 - protein, 191 aa, Triticum aestivum
  unsure (1)..(191): unsure at all Xaa locations
  Clone ID: PAT_TA_27358.pep
PRASRHRKAHADVFTRNDISNLVDTAYAGAAALRTAREAAVDSLFAVQAELRGQGEAVNDGVRRITGAKERLQRRLQDVVMATDXLEAWVAENRKGAADDATEAEGAIQPADVLSRQMLECTATDLALEDTIYALDKAVQEGSVPFDGYLRSVRALAREQFFQRVLCTKVNNAQQQAQVARMAARAPQYAS

SEQ ID NO: 132941 - protein, 206 aa, Triticum aestivum
  unsure (1)..(206): unsure at all Xaa locations
  Clone ID: PAT_TA_27359.pep
PGRPRVRDLSGSPVALASXVTPFVASPGTDRVSRSNPGAWLILRPAGDGAWEPWGRLECWRERGGAGSSDSLGYRFDLLVPGVDHAVPIADSTIAASKGGKFALDLTAAQPLSRGSTPGCSPRGSGDFSQWPLGNYRGFVMSASVEGEGRCSKPTVEVGVAHVGCAEDAAAFVALAAAVDLSMDACRLFSHKLRKELSHLRSDVLR

SEQ ID NO: 132942 - protein, 222 aa, Triticum aestivum
  unsure (1)..(222): unsure at all Xaa locations
  Clone ID: PAT_TA_27360.pep
MSEVFEGYAGQYCEISAALSRKCAAASALDGEKKQQKLSEIQGXVQESESLIRRMDLEARSMQPSVKAGLLAKLREYKSDLNXNVKGEIKRLSAPNAQQATREELLESGMSDTLSASSDQRGRLMMTSERLNQSSDRIRESQRTVFETEEIGVSILQDLHNQRQSLLHAHTTLHGVDXTYIGKSKKILASMSKRMDRNKWIVGGIIATLVFAILFILYFKFA

SEQ ID NO: 132943 - protein, 132 aa, Triticum aestivum
  unsure (1)..(132): unsure at all Xaa locations
  Clone ID: PAT_TA_27361.pep
KTNPTFFDEVXKEYSKGDSRYVARDTATVTVEGITAVLKGPASLLAVYAIASRKSYSHILQFAVCLGQLYGCIVYFTTAYLDGFNFWASPFYFWAYFIGANSLWIVIPLLIATRSWKKICAAVHQSEKVKTK

SEQ ID NO: 132944 - protein, 217 aa, Triticum aestivum
  unsure (1)..(217): unsure at all Xaa locations
  Clone ID: PAT_TA_27362.pep
MGAHPYVPAGLDLPGYVPLRLTQLEILGAYLGTSLFVLVAVWLLSGRCRRLSGTDRLLMCWWAFTGLTHILIEGPFVFTPDFFTKTNPNFFDEVWKEYSKGDSRYVARDTATVTVEGITAVLKGPASLLAVYAIASRKSYSHILQFAVCLGQLYGCIVYFTTAYLDGFNFXGASPFYFWAYFIGANSSWIVIPLLIATRSWKKICAAVHQSEKVKTK

SEQ ID NO: 132945 - protein, 80 aa, Triticum aestivum
  unsure (1)..(80): unsure at all Xaa locations
  Clone ID: PAT_TA_27363.pep
SSKLYSLRSKISVAVLNYIIYSWPKLTHRCILVISEASHCQMMKRLPLAETTEMDAAKDXRRVQAKAHLPSCRFGTRFGT

SEQ ID NO: 132946 - protein, 127 aa, Triticum aestivum
  Clone ID: PAT_TA_27364.pep
DPPRPKVDAIKETLENDEQKVGAEIVRKSLSYPLKLIAKNAGVNGSVVTEKVLVNDNFRYGYNAATGKYEDLMAAGIIDPTKVVRCCLEHAASVAKTFITSDAVVVDIKESEQAPAANPMAGSGYGF

SEQ ID NO: 132947 - protein, 400 aa, Triticum aestivum
  unsure (1)..(400): unsure at all Xaa locations
  Clone ID: PAT_TA_27365.pep
VSAGNNYEIGNMIADAMSKIGRQGVVTLEEGKSAENNLYVVEGMQFDRGYISPYFVTDSEKMSVEYENCKLLLVDKKINNARDLITLLEDAIKGGYPILIIAEDIEQEALATLVVNRLRGELKIAAIKAPGFGERKSQYLDDIATLTGGTVIREEIGLSLDKADKEVLGNAAKVVITKDSTTIVGDGTTQEEVTKRVTQIRNQIEASEQEYEKEKLNERIAKLSGGVAVXIQVGAQTETELKEKKLRVEDALNATKAAVEEGIVVGGGCTLLRLASKVDAIKETLENDEQKVGAEIVRKSLSYPLKLIAKNAGVNGSVVPKKVLVNDNFRYGYNAATGNYEDLMAAGIIDPTKVVRCCLEHAGXLLVKTFITSDAVVXVDIKESEKAPAANPMAGSRYGF

SEQ ID NO: 132948 - protein, 350 aa, Triticum aestivum
  Clone ID: PAT_TA_27366.pep
DGPCTEPTCETAVHVHEFNVDVAISEDGHGTMALGSVQASTTELKDLESGRCLEHGTGTSLSACNVHQSPLKELSYGISVIPDPVEHDGTGTPVALQEGTAVAAEPEAIHEPTQNEDVELAAIKPEAVEHAGTEADPSKEASIPPQEETTAVALVTGPEQNEEADAPTQVEPVAIVPDSMEHASTEVDQSIETSVRLPEKTSVIPGTEPEEKKVEASSQEDNVEAVAAEPEPAGSQENAEVSTKPSPMEIESVQETAMLGEAETRQQLPLPSAEGVVAEASEPPEVTAMKEPELLSTEPAPDGENAKLGEAKAEQLLQQPSSCEAMAAVTGELPSAAGAKTDGTSDVVAD

SEQ ID NO: 132949 - protein, 208 aa, Triticum aestivum
  Clone ID: PAT_TA_27367.pep
EKDHSPKTILAGSQSFCEASDKDVAPVKDDHTDPQSEVNVVDMNGTNQDSAETEAMQIDGVSKGSSSDLPAALRSTNSNQPAEQDGLENSPSISACPKENEKLEETSDEIGGGNSNRSRTDGDSHIMNLVGYSEDSDEDDSIQVADVGDVGCKETTHDDISAVARGAEPGDGPCTEPTCETAVHVPEAISEDGHGTTALGSVQVSTTE

SEQ ID NO: 132950 - protein, 177 aa, Triticum aestivum
  Clone ID: PAT_TA_27368.pep
SNGRGSSTQHLLPFLHANYFPSVASASSRLAGSVAATALPSSGKGGDCAVSASLGLGFLPSGAVSVLSTSSPTTAGDSSATTSEVPSVFAPAALGSSPVTAAIASQDEGCCNSCSALASPSLAFSPSGAGGIDASLLGSASVPSCSTASGFMAAGSTSLGSSTSFFASGSAATAVPS

SEQ ID NO: 132951 - protein, 391 aa, Triticum aestivum
  unsure (1)..(391): unsure at all Xaa locations
  Clone ID: PAT_TA_27369.pep
MAAASVSLKSSLFLSSPLSDFGGAAISISAQNRRRSWQPRGARMQVAAAADSKNILIMGGTRFIGLFLSRKLVQEGHQVTLFTRGKAPITQQLPGESDAEYAEFSSKVLHLKGDRKDFDFVKTSLAAKGFNVVYDINGREATEVSPILEALPNLEQFIYCSSAGVYLKSDLLPHFETDAHTKSRNKGKLXETEGLLETSGVNGTSIRPVXRYGPVNYNPVEEWFFHRLKAXGRPGVDHRFNGNRPIPIPNAGNQITQLGHVKDLATAFIKVLGNPKASKQVYNISGSKYVTFDGLARALRQGWEGFPEPEIIXYNPKDFDFGKKKAFPFRDQHFFAVXVEKASKDLGVTPEYDLLDGLTDSYNLDFGRGTFRKEADFTTDDMILGKKLVSV

SEQ ID NO: 132952 - protein, 250 aa, Triticum aestivum
  Clone ID: PAT_TA_27370.pep
MLQTEHMQHRLHLHSLGQDKLQRFQQPQIHMQVHIPVTPPHISKELPKPRHTSRELPKPRHTSKEPPNPRHTSKEPPNPRHTSKEPPNPRHTSKEPPNPQHTSKEPPKPRHTSKEPPKPEHISKEPPKLERISKEPPKLERINKGHTGYPTAYDSATAYQLHANAFASYSGYPVPGYAQPSFPWQRTLHLSSTQFASWRRLLIPQARYGAPGSTGYPAAPVQASSGAYAGQAAPPAPYPATYDPTKAAQR

SEQ ID NO: 132953 - protein, 70 aa, Triticum aestivum
  Clone ID: PAT_TA_27371.pep
ALFPAKVLAKMRTTREGAVSDALEQQLSLGSASNQRAGSTEKRGASNASSGRNIILRPEVLIGQRCTFIQ

SEQ ID NO: 132954 - protein, 418 aa, Triticum aestivum
  Clone ID: PAT_TA_27372.pep
VQGLPVVLSGRDMIGIAFTGSGKTLVFVLPLIMVALQEEMLMPIVPGEGPFGMIICPSRELAKQTYDVIDMFLTPLKQAGFPEIRPLLCIGGIDMRTQLDVVKKGVHIVVATPGRLKDLLAKKKMNLDNCRYLTLDEADRLVDLGFEDDIREVFDHFKAQRQTLLFSATMPKKIQNFAKSALVKPVIVNVGRAGAANLDVIQEVEYVKEDARIIYLLECLQKTPPPVLIFCENKADVDYIHEYLLLKGVEAVAIHGGKDQEERQNAIEFFKNGKKDVLVATDVASKGLDFPDIQHVINYDMPAEIENYVHRIGRTGRCGKTGIATTFINKNQTETTLLDLKHLLKEAKQRIPPVLAELVDPLEDAEAIAKESGVKGCAFCGGLGHRLADCPKLEHQKSVAIAGSRRDYYGGGGYRGEI

SEQ ID NO: 132955 - protein, 123 aa, Triticum aestivum
  Clone ID: PAT_TA_27373.pep
AGRGGGAKESRGAMPGTTRTWLVVATVLVAATVATANVETGELGEYYMKRSQEARFRRGGPLHDIISAAHRYHQNLFSSRYGSGRRYLLEEGEAAAGAEAPADSTGDATPIHNTLRDHEMMGA

SEQ ID NO: 132956 - protein, 83 aa, Triticum aestivum
  unsure (1)..(83): unsure at all Xaa locations
  Clone ID: PAT_TA_27374.pep
ICRNQGDTGEFFTSYDEVHESFDDMGLQENLLRGIYAYGFEKPSAIQQRGIVPFCKGLDVIXQAQSGTGKTATFCSGILXQLD

SEQ ID NO: 132957 - protein, 44 aa, Triticum aestivum
  Clone ID: PAT_TA_27375.pep
MSMWRRKGVAINFVTREDERMLFDIQKFYNVVIEELPANVADLL

SEQ ID NO: 132958 - protein, 110 aa, Triticum aestivum
  Clone ID: PAT_TA_27376.pep
HTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 132959 - protein, 211 aa, Triticum aestivum
  Clone ID: PAT_TA_27377.pep
MAGMAPEGSQFDAKQYDSKMTELLNQGDTGEFFTSYDEVHESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLL

SEQ ID NO: 132960 - protein, 414 aa, Triticum aestivum
  Clone ID: PAT_TA_27378.pep
MAGMAPEGSQFDAKNYDSKMQELLSQGETEEFFTSYDEVHESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPGKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 132961 - protein, 142 aa, Triticum aestivum
  Clone ID: PAT_TA_27379.pep
GYSQGRQHSWVNIWQQRVKSTAGLVPLKPRESISSSFIKDTDLLSCQGPETACRRMSNTRPVEHKKRQAQQRHALHVAHTPGPPRNEHSHPHATSRKQLNSITSSERYARSWYAGAATGVQGHGQPLFNSLVEPLEEEKVEK

SEQ ID NO: 132962 - protein, 133 aa, Triticum aestivum
  unsure (1)..(133): unsure at all Xaa locations
  Clone ID: PAT_TA_27380.pep
SFCCKLRQTLKPDPCALSAGAEEGDYKLGTPEAASMESKLLLPLRPQRSITSDREPPPRQLERMSARFPSGQESMETPDPCSGQSMNNQSMVGRAPSPSCMAKAPAARRXGRRYEQERDRRRSSARTRERGEP

SEQ ID NO: 132963 - protein, 259 aa, Triticum aestivum
  unsure (1)..(259): unsure at all Xaa locations
  Clone ID: PAT_TA_27381.pep
MRWAPGAGRRGRLGFTPWSDEGCLERLXKEYHALCKEPVPQIVARPLPNDILEWHFVLEGSVATPFEGGYYYGKLKFPSDYPFKPPSISMTTPSGRFAPHKRICLSMSDFHPESWNPMWSVASILTGLLSFMMDDALTTGSIRSTDGEKKRLAKASLAYNCESKNCPHFRKLFPEYVEKYNQQQEKEQTGAEPDPQENPAPAPSXWPPSCQAAAMVNNIGRAVAEVRGEKKLKKRVPFWLMVVIVSVFGAVMALPLMQL

SEQ ID NO: 132964 - protein, 406 aa, Triticum aestivum
  Clone ID: PAT_TA_27382.pep
LSRRPFQRPKPHPPPQSPPHQTALANSTGSDSRPPPPPADRLPRRRAPPTPMAAAADSGPELRRSSSIDRIPAEARRILHRLAGELWGADVDPAALVVYQLQGALTNEVFRITWPGGEGDPRKVLVRIYGQGVEVFFDRADEVRTFECMSRHGQGPRLLGRFPQGRVEEFINARTLSAPDLRDPEISGLIARKLREFHELDMPGPKDISLWQRLRRWLEEARSRCSTEEARELRLETLGDEIAELENVLSGVDQRVVFCHNDLQYGNIMIYEETRQVTLIDYEYASFNPVAFDIANHFCEMAADYHSDTPHVMDFTKYPDVDEQRRFLEAYLSSSGENPSDVEVETLLGLIAKYSLTSHLFWGLWGIVSAHVNKNIDFEYKEYARHRLDQYWDTKPRILQACNPTS

SEQ ID NO: 132965 - protein, 121 aa, Triticum aestivum
  Clone ID: PAT_TA_27383.pep
MSLVTAFLAGSAAPAVAPRSARPSAGFFGVGGGCALSVECSSRPQKKGTKHHMKTRPKKTQRWDIKRRPIQYEPLPALPDDWTLVAAGEKEDAAPQDEETTPAAAVEVEVVAAPAAPAAAD

SEQ ID NO: 132966 - protein, 139 aa, Triticum aestivum
  Clone ID: PAT_TA_27384.pep
ARSPRHQSCSAPRAAHRRPITPATTPARPAKTLSATSPPPPRSPRAPPPRSPRAPPPPPPPPWRTTPSPRSWTSTTPPAALPAPASSTTTTRGTSSTPTAWAAAGTRRGAPSPSPASSTPSTAPTSTTPIWPDRGVFRY

SEQ ID NO: 132967 - protein, 100 aa, Triticum aestivum
  Clone ID: PAT_TA_27385.pep
VLADGLKKIKQFTVDLSSVETNMVFFDMADPRISPAKLCQALKQRNVLAMPTSSKSVRFVVHYQISDSDIQYTLKCIEEAVEEILACDAKSERCSTNGTS

SEQ ID NO: 132968 - protein, 127 aa, Triticum aestivum
  unsure (1)..(127): unsure at all Xaa locations
  Clone ID: PAT_TA_27386.pep
AAXYVAVRDTVGKLADDHRKAKVLADGLKKIKQFTVDLTSVETNMVFFDIADPRITPDKLCQVLEQRNVLAMPASSKSVRLVIHYQISDXDVQYTLTCIEKAVEEILSGNAKFERLTNGTTTNSYGH

SEQ ID NO: 132969 - protein, 375 aa, Triticum aestivum
  unsure (1)..(375): unsure at all Xaa locations
  Clone ID: PAT_TA_27387.pep
MVTKVVGRRSDPVTTPTEAMLGAMAAAEVDDDVLGADPTAQRFEAEMARIMGKDTALFVPSGTMGNLVSVLAHSDTRSSEVILGDNSHSHIYENGGIATLGGVHPSTETNNPDXGTMDFDKIVAAIRHRDGAMYYPTTXRLICLENTHXSTGGKCLSVEYTDKVGEVAQSHGLKLHIDGARIFNASVALGVPVHRLVRAADSVSVCLSKGLGAPVGSVIVGSKDFIYKAKILRKTLGGGMRQVGILCAAAHVAVRDTVGKLADDHTKAKVLADGLKKIKQFTVDLSSVEPNMVFFDIADPHITPDKLCQVLEQRNVLAMPASSKSVRLVHPLPKFQTSDVQYTLTGIEKTVEEILSGNAKFERLTNGITTNLYGQ

SEQ ID NO: 132970 - protein, 251 aa, Triticum aestivum
  unsure (1)..(251): unsure at all Xaa locations
  Clone ID: PAT_TA_27388.pep
MARRRHSSSGLLCLVLSLLLPPPAPGCHGSGRCRRGTAELAASPQPPAAPTPRPQPGPQPVPLPIPNPQPDPNPQPLPNPDPKPQPQPDPNPAAXRPLPQPLPQPTAEPKPTATGLYHQQPLPQPPXGPNAQPLPLQPLPLPPPLPLPPPGPNAPPLPLPPPLPLPPPGPNPQPLPRLXPQVQPLPDSNTPGRQNNALQGPLGNGAVGNGAAPALYSCGATYIHIFSIGLFLILFCLDKVTHVTISLDSIK

SEQ ID NO: 132971 - protein, 92 aa, Triticum aestivum
  Clone ID: PAT_TA_27389.pep
KGPPKKKPYFFFFFMEKGKSSSFHSNSKITAWLSIMSMDSGLIFFFFQPEEDSVRRLFITEKWLPVSRILTECIIALPYFVGRYASLLDSSP

SEQ ID NO: 132972 - protein, 198 aa, Triticum aestivum
  unsure (1)..(198): unsure at all Xaa locations
  Clone ID: PAT_TA_27390.pep
PHAHVRCLPRPPLSPRAATAAAATLAAATSSLLRRTPLLRPHGLRVSHDFAPQRFARHIASSTNEEVAAKTAAATADTGGPTIFDKIIAKEIPSSIVYEDEKLVAXRDINPQDPVHVLVIPKLXRDGLTGLDKADPRXAEILGQLLYAXRRVVAEKEGVADGFLVVINNGAEGCQSVYHLHVHVLGGRYMKCPRCYVY

SEQ ID NO: 132973 - protein, 130 aa, Triticum aestivum
  Clone ID: PAT_TA_27391.pep
SLSPGWRTAFPGGCAGELMLVHRALSLDGEYARSYDAYRVDLEAGVLAPAKGFNGRAVFMGMFRSISVPAEAAYPSVAADSIYLGHDCDRQIQGYNIADGSRCSLIEAVYPRSIVDCLRCCIQGVGKQLA

SEQ ID NO: 132974 - protein, 172 aa, Triticum aestivum
  Clone ID: PAT_TA_27392.pep
MLPQRIARASALRSGMAAARRLPTIQRRTFLPDQYTDKKVIDQKYPEAPSMTEAEDPGMNGGYINPPRIKRQFRDPHGNWWDPQERRNFGEPIHEDNDVLGIFSPWEYTWTTAGPGAVMVGTFIAVFMSVTGIVYLNYPDRPAYPRAFEGGLERELGGPGATRARMEGDEDP

SEQ ID NO: 132975 - protein, 88 aa, Triticum aestivum
  Clone ID: PAT_TA_27393.pep
MARAGQGGGMGSAVNVGIAVQADWENREFISNISLNVRRLFDFLLRFEATTKSKLASLNEKLDSLERKLEVLEVQVSSATTNPSVFNN

SEQ ID NO: 132976 - protein, 217 aa, Triticum aestivum
  unsure (1)..(217): unsure at all Xaa locations
  Clone ID: PAT_TA_27394.pep
DQSEVDVFTIKPFPSRLNAVPPRISNGLIPGXVSSQAYQQDNSGRRMRRGPYSNVNKYLLTGRYRNIMDMNAGFGGFAAAIESPKSWVMNVVPTIAKIATLGAVYERGLIGIYHDWCEAFSTYPRTYDLIHASGLFTLYNNKCSMEDILLEMDRILRPEGAVIMRDDVDVLTKVNKLARGMRWNTKLVDHEDGPLVREKVLYAVKQYWVGGNQTAAS

SEQ ID NO: 132977 - protein, 188 aa, Triticum aestivum
  Clone ID: PAT_TA_27395.pep
MVQLLVTVATAVLLLVAGATAQRQGCENATFPAGRSFERCNTLPVLGASLHWTYHAANGTAELAFRATSGSAGWVAWGINPSGAGMPGSNVFVASQGGRGAVSVLTTILRSTAPALDNTTLQFDVPVPPTAEYAAGAYTIYTTVALPGNSTQQNPRGRAGPLSGGDILPHPTSGPNLQSLMRLDFLSG

SEQ ID NO: 132978 - protein, 273 aa, Triticum aestivum
  unsure (1)..(273): unsure at all Xaa locations
  Clone ID: PAT_TA_27396.pep
MASTMPHRIALLLLLLASTRAATAAGAGACAAEKFPAGKTYAKCEDLPQLGAALHWTYDEAKSSLSLAFVAAPAGANGWVAWALNPTGEGMAGAQALVALKGSGSAAPTVRTYNITGYVPLGKASTPIAFPATDLAADSGSGGKIRLYGKLQLHSGMKAVNHIWQVGTSVTAGAPDKHAFAAGNLASKSKLVLSGKAASAASPSPAPAPMAGGPSGSAGSEAATTAPSAGKSPSGAAAAGVSAPALXVLALMGLLAVMAFPFLAVARMNEYVL

SEQ ID NO: 132979 - protein, 136 aa, Triticum aestivum; identical to SEQ ID NO: 106789
  Clone ID: PAT_TA_27397.pep

SEQ ID NO: 132980 - protein, 148 aa, Triticum aestivum
  Clone ID: PAT_TA_27398.pep
MSAAASTPDAAPSPAAAAPAAVGEEARKEAEDVVVQYVVLRRDLADAWPLGSVVAQGCHAAVAAVWAHRDHPDTAAYCAPGNLDSMHKVTLEVKGETQLKNLAEKLEAAGVRYKLWIEQPENIPTCIATAPCPKSQVASFFRKLKLCK

SEQ ID NO: 132981 - protein, 464 aa, Triticum aestivum
  unsure (1)..(464): unsure at all Xaa locations
  Clone ID: PAT_TA_27399.pep
MMNKKLGDFEFLDDHRSKDTTMSICDRSSEENNHKEVDGALVQETNEMRLEEILKLHGNVEMLMSKEKASVEIRSCNEEITKLVSHMHMAIMNAALFKEKIVELIVTCESYEISAMVQKEVLKEDITRRNSYVDELKDKLNAIEIENRRLKVDLNGDVTMLGSLQSEVSALEKQTVSLANDFLQSNKLKVEENASSPQPLETIVGSSDQNANETVKDMELQKLRGTIKRLQNVVADASVLLEQERLGFNANLQEARKQIEALKLKEILDDDLVEMNYEQMLTHIQLDLIQPSSGRRTEALGQQKKIAAQADHKVHDLAGPSNSHARDDLGPPQSESFDSGSSRQSPAELVVVKELSIVNQELPRXSITTEPHQEWKNKVIQRLSSDGKRLQRARKMSEKIGRLEVEMQKVQQALVKYEEEQTTSKTVVQRSKVQLVDYLYGRRRESRKPRFSPCGCMRAKTIDD

SEQ ID NO: 132982 - protein, 156 aa, Triticum aestivum
  Clone ID: PAT_TA_27400.pep
GETTTRPHIDNTEMRSMVAATHTQTQHTHICAVSDSMKTCVYTVTWLPVEGAAHRRQWSTEGIEGAVRRRGINEVAAVNRHGGGNIFRLSRSTSTEKHSKNKHVHLVFDASRLQMVASQVGPAPNRRWLIRRMTTAGAGRASKALLQGAGQASKMY

SEQ ID NO: 132983 - protein, 164 aa, Triticum aestivum
  Clone ID: PAT_TA_27401.pep
MGIAAIALILATMIASKAAAQNNGCSSVMMTLSPCLDFIGSKALEPGFSCCTTLAGIVQTDPRCLCMVLDGSAASFGIVINHTRALELPSICKVQAPPISQCTAIPVPPATAPEDPPEETSNQVADAPKGSPNSNATSSSRNSKSAANLMVTMLIPTCALIYVF

SEQ ID NO: 132984 - protein, 269 aa, Triticum aestivum
  unsure (1)..(269): unsure at all Xaa locations
  Clone ID: PAT_TA_27402.pep
MLLVSQAANGSLSARRLPSKPLASRRGANPDPLFAGPRVARRRLALSGAADARDAPRRASASPPAHAAAGEGPSGSPAAAEDPVLLGVSDDRVPLEGVIQVERPGQADAQSKLVSYAKIGLLAGGDLLCLLIFSAIGRLSHGLPVLDAETFKTADPFIAGWLLSAYLLGGFGDDAKGSNGVGNAVTVAAKSWAVGIPLGIAIRSVTAGHIPQIPFVLVAMGSTXVLLTAWRALVSXFFPAGQSKKDDVYRKGNPFELXFELLTSLVRRW

SEQ ID NO: 132985 - protein, 160 aa, Triticum aestivum
  Clone ID: PAT_TA_27403.pep
LVLLDSTRGRDTTAFVSPAATAADRIHQPPCVRVHRIQRRRIPAACSFLLLLLSLLISPTAAAKSSGRPITDKEIRENKAACYTDVENGLWGFACRSSTTEKENCVLRCLSPECYNLIYGGDPLEEGELDYVRSHEYKYCMHKVSLGESLDGVKGSFSYS

SEQ ID NO: 132986 - protein, 187 aa, Triticum aestivum
  Clone ID: PAT_TA_27404.pep
SGKNNILVEYPFWKGSERFNEIVDIKHIRPCPPHASVISFCINDDVEGFQDHASGPGKITEIHPKLTYTFKLRTSGKKVQLHQNTLRLRYDWTDNQWKQVAQNLSGTKFTGGDRVEVSSDEEGFHGAWFQGTVIKSVGHKFLVEYDALKDDDETTPLKETIGEEHIRPSPPAIPVTSGFKVLDEIDA

SEQ ID NO: 132987 - protein, 180 aa, Triticum aestivum
  Clone ID: PAT_TA_27405.pep
AAFPLLLASPRLLLHFLQNSLRRRGDWTDDQWTLLAQYRSRANLTGPATGVGCCVLHRFNGAWFQGTVVKSVGHKFLVEYDALKDDDEITPLKETIGEEHIRPSPPAIPVTNGFKVLDEIDAYTNDGWWVGVISEVLDDQKYKVYFKAYKEQNDFELEQLRRHCDWVGGRWMQASPALEM

SEQ ID NO: 132988 - protein, 214 aa, Triticum aestivum
  Clone ID: PAT_TA_27406.pep
MEVKLWNDKRERELLESLADLYAIIKATEKLERAYVRDLVSAADYEADCLKLISQFNSLSSSLAGVVTIPRFVQAYRLDCPAALNRLVQSGVPATIELRAATSSSSAPPATAASASAIAQCVQSFITAMDAVKLNMLANDQVRPLLHDLSTSMGKLGTVLPPDFEGKVKVNEWLAKLHKMGAGDELTDQQARQLNFDLESAYSAFMASLPTAGL

SEQ ID NO: 132989 - protein, 199 aa, Triticum aestivum
  Clone ID: PAT_TA_27407.pep
MSFFKAAAAAGLLIGAANATPHYAAYGNGTEYTTEVLTAITTYCPEPTTLTHGNKTYTVTKPTTLTITDCPCTVTKPQTEHYPQPTPGKPGHPGKPEIPAPHPTAPAPGSLSTPSPVIPRLLTPPAPSPLTLPAALLLRAPTLPSSLLLPAASPLLVSWPSSVFLLSSKLFNRMLVTNIWPQDTIYVDVKKRWDPFFND

SEQ ID NO: 132990 - protein, 103 aa, Triticum aestivum
  unsure (1)..(103): unsure at all Xaa locations
  Clone ID: PAT_TA_27408.pep
MASKTALMAVALLVLVAGDLVHGHTILPPLGRARRSLGWMQGMKGGPPXGMQPSETAASAARRRTISWVQKGEESSRAGGVEERKFIAPVPGFKLPPLPPNAA

SEQ ID NO: 132991 - protein, 99 aa, Triticum aestivum
  unsure (1)..(99): unsure at all Xaa locations
  Clone ID: PAT_TA_27409.pep
MASKTALVAVALPVLVAGDLAHGHAAAPRTRNCPXSLGWMQGMKGGPPSGMQPSETARRRAISWVQKGEESSWADGGEERKFIAPVPGFKLPPLPPNAA

SEQ ID NO: 132992 - protein, 234 aa, Triticum aestivum
  unsure (1)..(234): unsure at all Xaa locations
  Clone ID: PAT_TA_27410.pep
MASRFWGQGDSDSEEEVDEIESEQGSDSEKSEAGDGGRDGSKNRYLNKYTQDSDDSDTESHRVIRSLKDKRNDEMKATADQMRNAMKINDWISLQECFDKLNKQLDKVVRVNESAKIPNGYITTLVLLEDFLAEALANKEAKKKMSSSNAKALNAVKQKLKKNQQQYEDLIQKCRENPESFEDDVADNKDVDDDDDESGDDVVDPDKMASDSEXXXNEDDVSQDXGAWXKKLSX

SEQ ID NO: 132993 - protein, 166 aa, Triticum aestivum
  Clone ID: PAT_TA_27411.pep
EQQSGRLGQSHVQILFELLHGHKRKKIANNKAPHFQIGDFSIIHRTSKANLAVVHGEGEEGRPAGRLDGQPEEQRPLEHDLHLSYHGLDVSPFATRKASAALSVAAFPSLPRPSLLSCHSPVRRRLPAAALSVAAFLPLPRPSPPSRRPLPGCLPAFPLSERKLDD

SEQ ID NO: 132994 - protein, 262 aa, Triticum aestivum
  unsure (1)..(262): unsure at all Xaa locations
  Clone ID: PAT_TA_27412.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKVKEIKNGRLAMFSMFGFFVQAIVTGKGPLENLXDHLXDPVNXNAWSFATNFV

SEQ ID NO: 132995 - protein, 749 aa, Triticum aestivum
  unsure (1)..(749): unsure at all Xaa locations
  Clone ID: PAT_TA_27413.pep
MAGGKRRYKRNPTAGGPRHSAGAGRRRSLPELPSFVSPTSVAAAFGPSSSGGRGRGRGGRRGAAAEPANAVPFSYTAALRPCPASAGGATQALEVAIDTGSCADPAASASMYSYEVVGGIGLGFHGDEEAEGQEEAGEGAPHLGLGFHDRIEEEMDAEVEELEEVSFVTPRQAKSKGRQNGGFISIGGVRIYSEDTSSPESEGMGDSDEESDSDYEVRDRNADVDSDEEDSDDDKGDPESDEDGSGSDSEEGLSIGDSSVDDEIVADYMEGIGGSEELLSSRWLNGMKLVDSDDDEMDTDDDEDGFLKKGKEKLEGYALMRASEQYGMKMPNSAERRKGRSSNGRDCGRGLASIQVMGLEDVMMVKDARMANRSSKGSKASSSSQLSRSWPDAARKSKKYQRXPGEKKKHKKXHIAKKRRQRMLSRGVDLEQINTKLRKMVVNQLDMLCFQPMHSRDCSQVQRLASIYQLKSGCQGSGNKRFVTATLTGQSSMPSADGQVRLDKLLGTEPEDYSVNWNSSKGPARAKGLSAPGKLARHSDSCGKNVPTKKVSFAERPVSFVSSGTMAETVTEAVAVGSTSGDVSCEKVVGSDSKLGTFETHTKGFGSKMMAKMGFIEGTGLGKDGQGILQPVQAIQRPKSLGLGVEFDSELEAAKARSEPPAKARPEPPANARRELSRTRSEPRRNTRPLEMYDCGTFERHTKGFGSKMMVKMGFVPGSGLGKDGQGIVNPLTAVRRPKSRGLGATDKY

SEQ ID NO: 132996 - protein, 102 aa, Triticum aestivum
  Clone ID: PAT_TA_27414.pep
FHRSFVPDPSSFSHRRLSTSVFSSIPTPSFLYLLNEASRVRPLGGVIDSPPRSCAMASAAPQSQRCDGVYFPSECDQALRAPLSERQRRAGTTTSTSLGVDG

SEQ ID NO: 132997 - protein, 169 aa, Triticum aestivum
  Clone ID: PAT_TA_27415.pep
MAEETGATAASGSAAGKMTMVVGVDESEHSYYALQWTLLHFFSPGQQQQYRLVVVTAKPTAASAVGLAGPGAAEVLPFVEADLKRSSLRVIDKAKELCAQVSDAVFEVVEGDARNVLCEAVERHHAEMLVVGNHGYGAIKRAVLGSVSDYCTHHAHCTVMIVKKPKHKH

SEQ ID NO: 132998 - protein, 169 aa, Triticum aestivum
  unsure (1)..(169): unsure at all Xaa locations
  Clone ID: PAT_TA_27416.pep
MAEGTGATAASGSAAGKMTMVVGVDESEHSYYALQWTLLHFFSPGQQQQYRLXVVTAKPTAASAVGLAGPGAADVXPFVEADLKRSSLRVIDKAKELCAQVSDAVFEVVEGDARNVLXEAVERHHAEMLVVGNHGYGAIKRAVLGSVSDYCTHHAHCTVMIVKKPKHKH

SEQ ID NO: 132999 - protein, 142 aa, Triticum aestivum
  Clone ID: PAT_TA_27417.pep
FPRPRDVVGTIDQGQAQARHFWAGNQDVMSSCFLYTQVSRGSLDAMIQLTTQGMLQGLFNASYQHHMLRAEPLRGRVLPGGICEAEVLELPNLLAFVSCSFSNRIATTSFSMAATSRHTYTATGSDATVGEGTNHAHISTAT

SEQ ID NO: 133000 - protein, 75 aa, Triticum aestivum; identical to SEQ ID NO: 106874
  Clone ID: PAT_TA_27418.pep

SEQ ID NO: 133001 - protein, 327 aa, Triticum aestivum
  Clone ID: PAT_TA_27419.pep
MELATRDLAALGAADLVRVSAAIPRAAPRTFALLTACLVFPLSFAVLAHSLFTHPILRRIRTSDYTATSAQWVALFAYQFLYLIFLFTFSLLSTAAAVFTVASLYAAKPASIASSLSALPPILPRLLRTFLWVSLLMLAYHVGFVVTVVLLILLFDPPMTASTPPPLSFLLALLAVAFLFLAIHVYISALWHLASVISVLEPLCGLAAMSKSRQLLQGRTRTAAVLVFSYFAICGLITGMFRSAVVKARGEEGSLDMSLAGRIGVGALLVSVLVCVNLLGLLAQSVFYYACKAYHNQEIDRTALYEHLGGYLGEYVPLKSNIQMENL

SEQ ID NO: 133002 - protein, 200 aa, Triticum aestivum
  Clone ID: PAT_TA_27420.pep
MGNCQAAEAAEVIIQHPGGKVERLYWPTPAAEVMKTNPGHYVALVILRLSPDSSAAAGYSAAAASVVPGAGAAAKITRGRSEARRRVLHGQQVYRLITAQEVTKALRARKNDKMRRCEAIKQQHDQLRRGDGAEQGASPPDANANAKQRGEGGGHRGSRGRRRARSPGSSSSSPRTCSTSARSTAQSRSKRCRRRCGTAS

SEQ ID NO: 133003 - protein, 213 aa, Triticum aestivum
  Clone ID: PAT_TA_27421.pep
MAASSSSPAAAAVGRAVEEVRSALNEHADVVAELFGRVSTELRGGFGPAVDTFVGFFHAVDWKEPWLIGMISFHVILLLVTIISRRNINFQLILSALTFSGVFLAEKLNTFLGQNWKSFSSQNYFDPQGLFISVMWSGPLLLITILILVNTLVTLCMLMVRWKRAELKHRAREARSQAGVMMLPAVLMTALLWSGGRRSCAADVLLNCGSVVR

SEQ ID NO: 133004 - protein, 129 aa, Triticum aestivum
  Clone ID: PAT_TA_27422.pep
MGRRILNDALRTMVNAERRGKATAQLQPISGVMISFLNIMKHRGYIKNFEVFDPHRVGKITVELQGRIKDCKALTYRQDLRATEIEKYRTRMLPTRQWGYVVVTTPNGVLDHEEAIRQNVGGQVLGYFH

SEQ ID NO: 133005 - protein, 275 aa, Triticum aestivum
  unsure (1)..(275): unsure at all Xaa locations
  Clone ID: PAT_TA_27423.pep
MANYGSDSDDDNEPATVAGGAPEPQEASVLLPPPPLDLLQPPNFVDYSTIAQGSRIRSFPHVEXNYALHVYTPVVIPFNARKQLTLVMRRAASLVPDLYAVDADYALSELCKDEQKLEKVLLGREFHVSLGRTVGIQVHQIDSLVAMLRQKFQSQQRYWMEFNKWEHFVNDDSTRSFLSLEVTRTGLPEISKQIHMVDEVYRLHGLPEFYKNPRPHISLAWALGDVSSKLKQATKEIEKFENSIISSKNCNLRCNFSRIVCKVGKKVYDICKIGD

SEQ ID NO: 133006 - protein, 119 aa, Triticum aestivum
  Clone ID: PAT_TA_27424.pep
RPGSADNPNDGDQQSSSRLSRAVAGDLFRCCCCRERCSSSPPQGQRSARPRYHEYPRGERRSLRIQDIRHHAANIPSSLRPTLCFQGRSCERGHQGREALLGGQVLPSNLHLQRIPVKM

SEQ ID NO: 133007 - protein, 133 aa, Triticum aestivum
  Clone ID: PAT_TA_27425.pep
GRSTGRAGSKSILHMRKHTLALFLLLLLLTFASHGAWCAAAARSAMAEDAAHHHLRPHHHGKRLLEIQTPRKVGHATGGSGGGSSGGGRSGGGGTDTRPHNSKNGGAMALPAPATSVLALVFTTTVLLSALSF

SEQ ID NO: 133008 - protein, 207 aa, Triticum aestivum
  Clone ID: PAT_TA_27426.pep
INTIASKQHITPQALCKQFLELQQYTHTSTAPAIEMSSAPSVRFYKTSRQFRQCAKQFNVSCPKCLVEKNGGSASEAVRREKNGSGENQRQEGGRWSWQRRHGTAILAVVWPCVRAAATAPAGAAAASGSTCRVPDLPGSLYLQEPLAMVMRPQMMTSCILSHGASRCCCAPCPMGGKGEEQEEEGESVFPKGAKGVNQEWAGESGD

SEQ ID NO: 133009 - protein, 57 aa, Triticum aestivum
  Clone ID: PAT_TA_27427.pep
RSSAEPLTMTTTTTTTTTVETAAETHVTPYYMCTLFKPSTERSKGASLQRMSCRRPR

SEQ ID NO: 133010 - protein, 105 aa, Triticum aestivum
  Clone ID: PAT_TA_27428.pep
DPCRSLPPTPMKRSPPSGGIPGLLRNKMLGLLRDALRGAPHGHADGGGGRRGAPARLLWPGKRQLPHLRPIWVCVWRHVLPRLRAGRRAGLTSGAPCASSSRFCL

SEQ ID NO: 133011 - protein, 181 aa, Triticum aestivum
  Clone ID: PAT_TA_27429.pep
RCYELVALHRLKGQHVPVEVWSPASHCMWSCPSRRRPGGASVTPSRGRPLDLDELIQVQRRSDLLFDGLHALIDVPMPVLGGWELSYCLNYMQKGSSHCSSIDICSSQISPELPTPYSSTDQTSSNGCRQLSPPHAPPCILCFSNPCLTDQTISYLLATVPSIPRTLHIMYGRRVKQTKIS

SEQ ID NO: 133012 - protein, 151 aa, Triticum aestivum
  unsure (1)..(151): unsure at all Xaa locations
  Clone ID: PAT_TA_27430.pep
IPIFEKGYEKDPAVVAKEAIQXATRNKSDVVLVDTAGRMQDNEPLMRALSKLINLNKPDLVLFVGEALVGNDAVDQLNKFNQKLADLSTVPTARLIDGILLTKFDTIDDKVGAALSMVYISGSPVMFVGCGQSYTDLKKLNVKSIVKTLLK

SEQ ID NO: 133013 - protein, 310 aa, Triticum aestivum
  unsure (1)..(310): unsure at all Xaa locations
  Clone ID: PAT_TA_27431.pep
XKFRQLXPRGRARAEAMKKSRQQPANPSSGAGRASGGPAGKKLGPNARSRGGGGAGKKNSGSGKDDSDGDSGKEQNGGFTANGGSVAKGGHENGSTKDSSRTAARAVVADSDGKENGDPNDGAFDVNTLRKKTGGKKGGGGKKNDVKKAAKAEPKKAVKQMRVWDDKPPKSEKLDFTDPADERGEEVIEKVLTDQGDSMMDKDEDLSSDSEDEEDEGEENAQAGQKKKGWFSSMFKSIAGNNVLEKSDLQPALKALKDRLMTKNVAEEIAEKLCESVAASLEGQKLXSFTRISFLLFRQLLEGGFFFPHF

SEQ ID NO: 133014 - protein, 388 aa, Triticum aestivum
  unsure (1)..(388): unsure at all Xaa locations
  Clone ID: PAT_TA_27432.pep
KAAKSEPKKVVKQMRVWDDKPPKNEKLDFTDPADERGEEVIEKVLTNQGDSMMDKDEDLSSDSEDEEDEEEENAGAGQKKKGWFSSMFKSIAGNNVLEKSDLQPALKALKDRLMTKNVAEEIAEKLCESVAASLEGKKLGSFTRISSTVQTAMEEALLRILTPRRSIDILRDVQAAKERGKPYVVVFVGVNGVGKSTNLAKVAYWLLQHNLSVMMAACDTFRSGAVEQLRTHARRLQIPIFEKGYEKDPAVVAKEAIQEATRNKSDVVLVDTAGRMQDNEPLMRALSKRIRLIKXELFLLVGEAVLWNDAGDQLNSHNQKLPDLSTVPAARLIDGILLTKFDTIDDKVGAALSMVYISGSPVMFVGCGQSYTPPWKKMVVLILKTLLK

SEQ ID NO: 133015 - protein, 126 aa, Triticum aestivum
  Clone ID: PAT_TA_27433.pep
GSCRAAADARARLSFLPPTSDRRRRERNPRTKEYASPSSRRSQPPVWSVSPGRRRLGPEGGTRGADGGGAMEPLEAAIAIVFNALLLVFMVKLFFAMFQMKLVVILFYLVVLLFALAFSGRGPAGF

SEQ ID NO: 133016 - protein, 173 aa, Triticum aestivum
  Clone ID: PAT_TA_27434.pep
TILKAVANPLGASLGPDRAGNKLGLESSELHELGLEDEPPQLLEVAKRGSRKRQRPGLQVAIEVLPGADSGRGPFLLMIAKSNPGRSLHGFVLEKNTDPNSIQDSHLDPNQRSTGTRGWRLMRLWVAPKKIRGRCGGEGGRTADGWRRRPAGGGGRPEKKTEGGGGQRRRREH

SEQ ID NO: 133017 - protein, 415 aa, Triticum aestivum
  unsure (1)..(415): unsure at all Xaa locations
  Clone ID: PAT_TA_27435.pep
MMQSHMPSPARLGVTASSPSLPPNQSPANPTSSPPQANPPSASAAPSAAGIAVPTLTTSPALLPLLPPLPRAQSLLHLISSLASNLFELSPNRAAWISSYRGSLPNFLPSSSASAAPTPLPAPVSTTKEAMSMLTSLQTQLFETVAELQETLDLQDARAKLAREARAKDASLLAFAKKLREAHHVLDRLVDDYADYRRDPKRPRGAAAVDEPEPVSQGDFGASLHSKLKLDDILTYAHRISYTTFAPPEHGAGLPLRGALPSAPQDNELRMSQLYQFADLDVGVPKKPLETKEGVTAEMESMPLFELPEXSLRGPFMLPITVPPGWQKGLPALLPVIPMPPPGWKPGDPIELGGIIPAVKPEEQRPSVPIPVGVQPMVPRAQEPIQVAAVNLDIISSSSDEYSSDVGSSDEDDED

SEQ ID NO: 133018 - protein, 122 aa, Triticum aestivum
  Clone ID: PAT_TA_27436.pep
AYALAHASASSYWGQLAAPPGSEAQSRGHADYLRKIIVQGRSSKSTKVVDIMTEENKLITVKPETRVLKAMQLMTDKRIRHIPEISGTEMMGMVSIGDVVRAVVSEHKEELNRLNAYIQGGY

SEQ ID NO: 133019 - protein, 205 aa, Triticum aestivum
  unsure (1)..(205): unsure at all Xaa locations
  Clone ID: PAT_TA_27437.pep
MQRAIQAXXSHGSVLKSAVLQHISVVKPAMLPAVFPRFMSVSPAQIEESGFESSTVADILKSKGKSADGSWLWCTTDDSVYDAVKSMTQHNVGALVVVKPGEDKSIAGIVTERDYLRKIIVQGRSSKSTKVGDIMTEENKLITVKPETRVLKAMQLMTDKRIRHIPVISGTEMMGMVSIGDVVRAVVSEHKEELNRLNAYIQGGY

SEQ ID NO: 133020 - protein, 394 aa, Triticum aestivum
  Clone ID: PAT_TA_27438.pep
MSSDEEVREEKELDLSSNEVVTKYKTAAEIINKALKLVLSECKPKAKIVDICEKGDNFITEQTGNVYKNVKRKIERGIAFPTCVSVNNTVCHFSPLATDDSVLKENDMVKIDMACHIDGFIAVVAHTHVIKAGPVTGRAANVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKQGDLVAHIKFTVLLMPNGSDKITSHPLQQLEPSKSIEGDAEIKAWLALGTKSKKKGGGKKKKGKKGDAAEVAEPMEVSKDAPSQE

SEQ ID NO: 133021 - protein, 177 aa, Triticum aestivum
  unsure (1)..(177): unsure at all Xaa locations
  Clone ID: PAT_TA_27439.pep
MQRAIQAIGSHGSVLXKSAVLQHISVVKPAMLPAVFPRFMSVSTAQIEESGFESSTVADILKXSKGRVPIGSWLWCTTXDDSVYDAVKSXMHKHNVGSFGGLLKPGEDKSIAGSRQQRGRLSPDITYSAWVDASKYNQKAGDIMTEENXLITVKPETRXVLKAMQLLTEKRIRHNPA

SEQ ID NO: 133022 - protein, 225 aa, Triticum aestivum
  unsure (1)..(225): unsure at all Xaa locations
  Clone ID: PAT_TA_27440.pep
PPRRGRWRLTAPAGRAAAPPPRTPAAPPTPPPATPSARHYAHSALPPTPPPHSSTXPAMARPAHAVVLALPDRRPRAGPPGGLAAAAGGAGTAVSGLPAKSAGHHISCLGGHAAPSARRGRQGFLRRTSKDLLPSSSHVAWFCESSCNARGIPIFLTRARAPRSAFGGTAAALTNCSLKLPVVAHIHALTEAHTPTSWHQPQQPSAQAQRNRQRPGLPSRRQPSS

SEQ ID NO: 133023 - protein, 136 aa, Triticum aestivum; identical to SEQ ID NO: 116005
  Clone ID: PAT_TA_27441.pep

SEQ ID NO: 133024 - protein, 342 aa, Triticum aestivum
  unsure (1)..(342): unsure at all Xaa locations
  Clone ID: PAT_TA_27442.pep
IRTYQRCASAHPRGLCHESKPHVASCGDGEGPRVQLWRRSGRWALGSVPARRTKRGGLMRATSVRRYGRKHNRTKTHLSTPGPSSVDPAMLKARGTTSAYSYGRIRRRVTGGCSLARSTCWVTDRNEFSLSQLXALGGSFGQDLNSIEAGWQVSPRLYGENNTSLFTYWTSDAYQATGCYNLLCSGFIQTNNQIAMGASIFPISNYGGSQYDINILVWKDPPAGAPTASDVTKNAPTMTXVSAYLAGSASWCTVVGQVXVGLHDDRCHVNGSGXLPPPVVGFGLSCLFQCVHLADSSNNLNAPRGIGSFTEQSNCYDVQNGNNGDWGTYFYYGGPGKNPNCP

SEQ ID NO: 133025 - protein, 174 aa, Triticum aestivum
  unsure (1)..(174): unsure at all Xaa locations
  Clone ID: PAT_TA_27443.pep
MRSFPVAGGRNVSLALFSDVSNSRELLDLMQSGKLEPEAAFINASLVPGVFPVLAAAHKALLSKSRESLTTRTLHSELVYNCSGSKHITESLKRCGIADDTQYIXLAARFDASDEEMKALEKLISGTEIDLSELETRADQPKILKQYKITPQELSISTLPEAIXVCRIAARLAL

SEQ ID NO: 133026 - protein, 268 aa, Triticum aestivum
  unsure (1)..(268): unsure at all Xaa locations
  Clone ID: PAT_TA_27444.pep
QVCVASSTMCWGRSLPAHLVVVMGTQYYDGRESAHTDYPITDLLQMMGHASRPLQDNSGKCVILCHAPRKEYYKKFLFEAFPVESHLHHFLHDHMNAEVVVGVVENKQDAVDYLTWTFMYRRLNKNPNYYNLQGVSHRHLSDHLSELIETVLNDLESSKCVAVEEDMYLKPLNLGLIAAYYYISYTTIERFSSMLTQKTKMKGLLEILASASEYAELPSRPGEEEYIERLVRHQRFSIDKPRYXDPHVKANALLQSHFXRHTVVGDLA

SEQ ID NO: 133027 - protein, 433 aa, Triticum aestivum
  unsure (1)..(433): unsure at all Xaa locations
  Clone ID: PAT_TA_27445.pep
FPGYWGGSGLGFLFEALPVERHLHPFLYDHTNAGAVGGVVENQPGAGDCLTWTFMYRRLNKNPNYYNLQGVSHRHLSDHLSELIETVLNDLESSKCVAVEEDMYLKPLNLGLIAXYYYIMLAPLSETVQFRLHNSKTDQRCKGPPCKILPSVTLERDMTNLPNSEVGPVHAPRFPKTKEEGWWLVVGDSSTKQLLAIKRVTLQKRARVKLEFTAATEPGSKDYMIYLMSDSYLGRDHXQMVTQGMWDRDSVLLQLPHFTRDLARRCQENEAKPIESIFDLAEMSIDEMRDLLQLSNSELQDVVVFFKRFPNVDMTYEVREGDDIRAGDNVTLQVTLERDMTNLPNSEVGPVHAPRFPKTKEEGWWLVVGDSSTKQLLAIKRVTLQKRARVKLEFTAAAEPGTKDYMIYLMSDSYLGCDQEYEFTIDIKEAGGD

SEQ ID NO: 133028 - protein, 270 aa, Triticum aestivum
  Clone ID: PAT_TA_27446.pep
MAAAAAAGQQQRVVVMRHGDRLDHAEPMWPANKPRPWDPPLTDAGVLRAWTVGKRIRAQAAADGYALPRVLVSPFRRCLQTAAQAVAALCAVPDDAALAAVLDPSANVPLDASRVKVSVEYGLSEMMNVEAMGAIVSQVTPSVEKWFPDLAELEAILPPGTIDHSTKPLFLEVPKWGESVRGARIRYASVIKALADKYPDENLLLVTHGEGVGSSVACFGATGMEVYEVEYCAYTVLEKQPGGEGGGDESVLKVVADRSGPTTGIHYLVT

SEQ ID NO: 133029 - protein, 114 aa, Triticum aestivum
  Clone ID: PAT_TA_27447.pep
MATLFCAAAATSCRLTFPLAAPAPAPGLGRGRSRRGMVAVRAEADTAAAGSGINPAIRKEEAKVVDTVLAGELSKPLTPYCRCWRSGTFPLCDGSHVKHNKATGDNVGPLLVKK

SEQ ID NO: 133030 - protein, 140 aa, Triticum aestivum
  Clone ID: PAT_TA_27448.pep
PAGSRYCTPESERHASPHSKQRSAGRAHRRRDQTRGDMATATVRLSAGRLLALAVVLCALTAGESAKARYISFDALRAGQPLVHGVGVPAPAPAPAPVSAGGVKAPAAVSSMAPTSTAAAAAARPMEGGAVVVLRHLLHA

SEQ ID NO: 133031 - protein, 174 aa, Triticum aestivum
  Clone ID: PAT_TA_27449.pep
HATTRVDFYLLIGVRTYSEVVVAASRTSEEQGMQLSVELVTEDDGATFHQPGRCRGSSLTHGGNLEGGRGLVPSGAYRGRRRGTATMYEGMAGPQSVERDVPRLGGLARHDRAQHHGQRQQPAGGEANGGRRHVTLSLISPPVSTSDRAGIVCAVQSRRGACVRFRSRPPPERP

SEQ ID NO: 133032 - protein, 104 aa, Triticum aestivum
  Clone ID: PAT_TA_27450.pep
SGELDQKRRSEKKAECQRAAESPMAGGGVSGGAAALEVARPLEVPRRKGYPGLLWKSSKITTTRRKNGKRRLKPVRKTAADAKASSQAKTSSTSSTPEESHSQQ

SEQ ID NO: 133033 - protein, 451 aa, Triticum aestivum
  unsure (1)..(451): unsure at all Xaa locations
  Clone ID: PAT_TA_27451.pep
MASPKRLPYSSAGAGGGARRGSGALPPVVVLVFLFVLAPSIFFVVRSGGHVHVASDPRGADGNQETDWQEQLATNNLKSVLSKEVIDAIAASQQETGTLNLDFFRDHPSPSWKTDDLVDHKMNTNLVVDDKAKAQNSSAEHVPLIYKAPKDGSVMXHQVDTAAKIARRKLREIRREKRAMDLVWKDDEALVKLENAAIERSKVVDSAVLGKYSIWRKENENENSDSTVRLMRDQIIMARVYSVLAKSKNKHGLYQELQSRIKESHRAVGEATADADLHRSAPDRMRAMGQVLTKAREELYDCKVISQRLRAMLQSADEQVRSLKKQSTFLSQLAAKTIPNSIHCLSMRLTIDYYLLPVEKRKFPRSENLENPELYHYALFSDNVLAASVVVNSTIMNAKEPEKHVFHLVTDKLNFGAMNMWFLLNPPGKATIHVENVDEFKWLNSSYCPVL

SEQ ID NO: 133034 - protein, 180 aa, Triticum aestivum
  Clone ID: PAT_TA_27452.pep
VARARLGGGLLPAGAPRLLGGVGPVRAFPPAVVGIPLLYNLDMVNVAADRGTKEHSSGCVNGKANGNRCMLVRSSHHRPERAQRRPLRLPGTRERLHASLIDSKQVEFSSARGRRRRFDQSDLLLLLHDDYYYLNLSACVCNMHHELVVQCSAAQHISEPGKVLLAFFSLRQVGRGFLVS

SEQ ID NO: 133035 - protein, 163 aa, Triticum aestivum
  Clone ID: PAT_TA_27453.pep
MEGKSGLRAVILLLGAVLVIGSLVPLAQADPTAAATGAADAKFCCKDKIGSHCYAACITQYGPIPFCAEMCCCVQLTSGRCPRQCPTPADPRLFLANSSTSDLLTSNAVEVESCTLRCSSIVCDSMRNVIDGGSEGTKAVVERCGDACGRFCAGAGGAASLDA

SEQ ID NO: 133036 - protein, 166 aa, Triticum aestivum
  unsure (1)..(166): unsure at all Xaa locations
  Clone ID: PAT_TA_27454.pep
MEAGKGSLRAVILLLGAVLVVGSLVPLAEADPTAAATGAADAKFCCKDKIGSHCYAACTTQYGPTPFCAEMCCCVQLTSGRCPRQCPTPADPRLFLANSSTFDLLTTNAVEVESCTLRCSSIVCDSMRNAPLSMSAAWXTKAVVERCGDACGRFCAGAGGVASLDA

SEQ ID NO: 133037 - protein, 252 aa, Triticum aestivum
  unsure (1)..(252): unsure at all Xaa locations
  Clone ID: PAT_TA_27455.pep
AGKYXXKKKKKKKKKKKKKKKKKKKKKKKKIPRHTHARTHASRARKFSSPENLDVRTYGGGYPQHGRRRAPDAVAVAAALPPPPRRRRVVRGGGRGGRRQADHPDPGGQDPRGVLRGRQAGGRPHGRQGRRARRFPPRHHHDRAQTGAVHARRRRGRRASAQGRLLPRGPPRGGRRRGRSGRRRPRLLIKLRPGRSTTYSGAASSMHAGSPAMADPGLHPRSSLFHSSSLFLSLSLRIYVSNHVRTLACTTL

SEQ ID NO: 133038 - protein, 174 aa, Triticum aestivum
  Clone ID: PAT_TA_27456.pep
LSDYNSQKESTLHLVLRLRGGMQIFVKTLTGKTITLEVESSDSIENVKQKIQDKEGIPPDQQRLIFAGKQLEDGRTLSDYNIQKESTLHLVLRLRGGMQIFVKTLTGKTITLEVESSDSIENVKQKIQDKEGIPPDQQRLIFAGKQLEDGRTLSDYNIQKESTLHLVLRLRGGF

SEQ ID NO: 133039 - protein, 226 aa, Triticum aestivum
  Clone ID: PAT_TA_27457.pep
FVKTLTGKTITLEVESSDSIENVKQKIQDKEGIPPDQQRLIFAGKQLEDGRTLSDYNIQKESTLHLVLRLRGGMQIFVKTLTGKTITLEVESSDSIENVKQKIQDKEGIPPDQQRLIFAGKQLEDGRTLSDYNIQKESTLHLVLRLRGGMQIFVKTFTGKTITLEVESSDSIENVKQKIQDKEGIPPDQQRLIFAGKQLEDGRTLSDYNIQKESTLHLVLRLRGGF

SEQ ID NO: 133040 - protein, 61 aa, Triticum aestivum
  Clone ID: PAT_TA_27458.pep
RCIMKGLVHDDSSVTRLSIADKLEDIIDLIHGLTLSQWIKSMMSSIGKVLTHVRTLRSGQK

SEQ ID NO: 133041 - protein, 158 aa, Triticum aestivum
  Clone ID: PAT_TA_27459.pep
GHFGVQWAKAMGAEVIAFDVIPDKVEDARKLGCDGYVLMQKEEEIEPHYNSFTHILATKIVNKCWPTYLNMLKKNGIFILCDIPEVPLSGLSAFTMAGKQLTIASSFIGSPSDIQECLDFASEHNVRTWVNTFPMEKINEAIQFVREAKPRYRAVVMN

SEQ ID NO: 133042 - protein, 164 aa, Triticum aestivum
  Clone ID: PAT_TA_27460.pep
IIGQPLQKSEVEFCNWDENMVQMDIICCGVCGTDLHTVDEGWGPTEFPCVVGHEIIGKVTKVGNNVKKIKVGDRCGVGCQSASCHQCDYCKKGMENLCAVHAVWSFNDRYENPTKDKTYGGFAEKWRGPQDFVVKIPDNFSSEVAASFLCGGVTTFTPLKRYNV

SEQ ID NO: 133043 - protein, 348 aa, Triticum aestivum
  Clone ID: PAT_TA_27461.pep
MSEETFSAYVCHAKSQPLEKSEVNFCTWDENMVQMDIICCGVCGTDLHTIDEGWGPTEFPCVVGHEIIGKVTKVGSNVKKIKVGDRCGVGCQSASCHECDYCKKGMENLCSVHAVWSFNDRYENATKDKTYGGFAEKWRGPQDFVVKIPDNFSSEVAASFLCGGVTTFTPLKRYNVSKGDKVAVLGLGGLGHFGVQWAKAMGAEVIAFDVIPDKVEDAKKLGCDGYVLMQKEEQIEPHYNTFTHILATKIVNKCWPTYFNMLKKNGIFILCDIPEVPLEGLNAFTMAGKQLTIASSFIGSPSDIQECLDFASEHNVRTWVNTFPMDQINDVFQFVRDAKPRYRAVVMN

SEQ ID NO: 133044 - protein, 132 aa, Triticum aestivum
  Clone ID: PAT_TA_27462.pep
LYPETVKSTLNTTHSEYGGHDTFRYGTRSIKNEVLPKHPLESRLNQWEETQWELKLNLARQAYGMHAPVKLMMERSIVEKRQRTPIMPTSNLHLDILMGRDETIDYEDFLNDPSLSTDSMDLHTSMEHKLKL

SEQ ID NO: 133045 - protein, 75 aa, Triticum aestivum
  Clone ID: PAT_TA_27463.pep
LELIHLMRNMVGIENIIIEDALKIFIISNIQNFRDIMMINNLIMLHRNPQQDYRGFMESPTCSLTHDDSSYSKIL

SEQ ID NO: 133046 - protein, 135 aa, Triticum aestivum
  Clone ID: PAT_TA_27464.pep
MAMRGNNVKTLALMLVVVGLVALQQTQQVQASHCCCHLDSVPTYFKCREKSDSTVSECCGSSDGYISDAAGFECKPGFIDIETALQAVNYCKLGCKASLCNKVTPSGKDAMERCTSGCHDLCTKNNAEIAQVVTA

SEQ ID NO: 133047 - protein, 201 aa, Triticum aestivum
  Clone ID: PAT_TA_27465.pep
VRSPFEVIILGDSGVGKTSLMNQYVNKKFSNQYKATIGADFLTKEVMVGDRLVTMQIWDTAGQERFQSLGVAFYRGADCCVLAYDVNNSKSFEALDQWRDEFLVQASPRDPERFPFVLLGNKIDVEEGKRMVSQKRAMAWCQSKGNVPYFETSAKEAINVEQAFQTIAKNALSQETDVDIDFPDTIQIPNGRQEYDQGCAC

SEQ ID NO: 133048 - protein, 182 aa, Triticum aestivum
  Clone ID: PAT_TA_27466.pep
MIQYKIVLKFISAVRNNSKNTGIIFISESSCAAVGYKIVGMWTPFCIITNKSSSSLAERVILLYALFLQGRVSMPAGAMCMCAVMVELELPRPPPTLWGMAGGGRGETMAIYLRSIGSCIHRERGGLVLAAAREDHAQIGSPDASRVSVGEQAALSSLPTAASRAGRRGACRRMLTQSAVEA

SEQ ID NO: 133049 - protein, 357 aa, Triticum aestivum
  Clone ID: PAT_TA_27467.pep
MSSLHRCLPWLILLLVLRDGGGGTAVAAAGKVPAIIVFGDSSVDTGNNNFIPTIARSNFWPYGLDFADGHPTGRFSNGRLATDFISEAFGLPASIPAYLDTTLTIDDLAAGVSFASASTGLDNATAGILSVITMAEQLDYFKEYKLRLKLAKGDARGEEIIREALYIWSIGTNDFIENYYNLPERRMQYTAAEYEAYLLGLAESSIRAVHALGGRKMDFTGLTPMGCLPAERMGNRGDPGQCNEEYNAVARSFNAKLQQAVVPKLNKELPGLHLVYADTYDVLDAVVRKPSDYGFEHAERGCCGTGMFEAGYFCSLSTSLLCTNPDKYVFFDAIHPTERMYNMLADKVMNTTLHVFL

SEQ ID NO: 133050 - protein, 43 aa, Triticum aestivum
  Clone ID: PAT_TA_27468.pep
YKLVGEIFIIIMVSLQPIMGTTRKSLRPCLRTRLLLLQRTQAP

SEQ ID NO: 133051 - protein, 137 aa, Triticum aestivum
  unsure (1)..(137): unsure at all Xaa locations
  Clone ID: PAT_TA_27469.pep
GSSGRPGRYSHSPPLLQVNRSSSNSQRTSKTDDGVVGKSSHGEDELQVPKGPIHSPVELKHVHAAVVKVPEVNSYALPPKVRIQATAMQMKVQAFDNEVQAAQTLSSPIEMRXKAHFQLEKHSAPSIVPPSAPRLTQ

SEQ ID NO: 133052 - protein, 79 aa, Triticum aestivum
  Clone ID: PAT_TA_27470.pep
FGRVGGNAVTARDDYFRMVYDAIYASAKRGGPCAGGLFWQVLAPGMESWTDRYAVVLERSSTTAAIVSQEYARIGRITP

SEQ ID NO: 133053 - protein, 110 aa, Triticum aestivum
  Clone ID: PAT_TA_27471.pep
EQQVEFMKKWMASHTEDAAAALRKPLLVAEFGWKSSGNAVAARDDYFRMVYDAIYASVKGGGPCAGGLFWQVMAPGMESWTDGYEVVLERSPSTTAVVSQECARIGGITP

SEQ ID NO: 133054 - protein, 166 aa, Triticum aestivum
  Clone ID: PAT_TA_27472.pep
IGLEGFYGDSAPQRKRFNPGGNYSAGTDFIGNNRISTVDFATIHCYPDQWVPGSTSEQQVEFMKKWMASHTEDAAAALRKPLLVAEFGWKSSGNAVAARDDYFRMVYDAIYASVKGGGPCAGGLFWQVMAPGMESWTDGYEVVLERSPSTTAVVSQECARIGGITP

SEQ ID NO: 133055 - protein, 129 aa, Triticum aestivum
  Clone ID: PAT_TA_27473.pep
MQATMGNSKAAVCVLALVLCGLLATDTAAAARCDASALRPCLGAIMLGGAVTPGCCARLRAQRACLCQYARDPSYRGYVNSPRAQSVVAACGLPKAQVLIARPARYTYRLRPVWPASCTMPGTGGRRST

SEQ ID NO: 133056 - protein, 223 aa, Triticum aestivum
  unsure (1)..(223): unsure at all Xaa locations
  Clone ID: PAT_TA_27474.pep
DDEYDYLFKLVLIGDSGVGKSNLLSRFTTNEFNLESKSTIGVEFATKNLEIDNHTVKAQIWDTXXDXERYRAITGAYYRGAVGALLVYDITRQSSFQNVQHWLKELRDHADPNIVIMLVGNKVDLSESSRQVTTEDGGSLAEQEGFLFVETSALDATNVDKAFATVFDTIYSNLPKKTNQSADAATNQPTAGERIQLRPPSVRGLSSREEKGQQKKENGGGCC

SEQ ID NO: 133057 - protein, 162 aa, Triticum aestivum
  Clone ID: PAT_TA_27475.pep
MSEYCPVYAPFFGTMGCAAAIVFSCLGAAYGTAKSGVGLSAMGVLRPDLVLKCIVPVVMAGILGIYGVVVSVLLSGGLAMKQTLFSGFVQMAAGLSVGLSCLAAGIAIGITGDAGVRATAQQPRMFVGMILILIFAEVLGLYGLIVALILNTKASGTESVCQ

SEQ ID NO: 133058 - protein, 349 aa, Triticum aestivum
  unsure (1)..(349): unsure at all Xaa locations
  Clone ID: PAT_TA_27476.pep
MSEASVVNQAEVEDAAAAALPGLDLPPGFRFHPTDEEIISHYLTPKALDHRFCSGVIGEVDLNKCXPWHLPGKAKMGXKEWYFFCHNDRKYPTGASTXNRATENGYXRPLARTTDILRRDGASFISMKKDXLVFYLMTLAPRGEXKTGCVIHEYRLEGKLAHPVPRSAMDEXAVYKVFYIELTTTNGAMAAAEAGIERVSSLGFITDFLDSGELPPLMDPPLGGDVDEVIDFKSTSAYATGAHSGLQVKMEQHMPLHVPHMMYSSPYFSLPAANSGDMSPAIRRYCKAEQVSGQTSALSPSRETGLSTDPNAAGCAEISSAATPSSQNQEFLDQFDEYPALNLADIWKY

SEQ ID NO: 133059 - protein, 278 aa, Triticum aestivum
  Clone ID: PAT_TA_27477.pep
RLLVYVYPKRRRSADAVAKLNAKFDRVISKKREELQNGIFSNKPDNEKDLVTLMLEAGMQEDISITNEELRHNMAVLFVAGYDSTSNSLSFCLYHLAKNKRAQQKLREEIINILGDDDMDIVPSLEELKQMKYMNMVIKENLRLNMPVDLIFPRKTVEDTFVAGTFIPKGTNIAVDIGALHRDPRSWKDPDEFVPERFEDDGEQKEHEGLAWVPFSNGTRQCIGMNFSLMKQRLVLTMLLRKYEVDLPKDSIHYDHIIYERPIYICPDSLELIFTKRY

SEQ ID NO: 133060 - protein, 172 aa, Triticum aestivum
  Clone ID: PAT_TA_27478.pep
NLPKVFFDIAVNGQTSGRMTFKLFSDTVPKTAENFRALCTGEKGKGISGKPLHYKNSSFHRIIPGFMAQGGDFTTGDGRGGESIYGRTFEDENFTLKHKGKGLLSMANAGPNTNGSQFFITFVDTPWLDGNHTVFGQLVDGSKVLSLLEQHGSQSGMPNAKIEIVDCGELKD

SEQ ID NO: 133061 - protein, 320 aa, Triticum aestivum
  Clone ID: PAT_TA_27479.pep
MDRYQRVEKPRPEAAAISENEIRITTQGLIRNPRARATSLLQEKRVKEIVLKAMGQAISKTVAITEIIKKRIPGLHQDTTISSVSITDVWEPIEEGLVPLEMTRHVSMISISLSPKELDTNSPGYQAPLHAEPLKPRYQQVQRYQQQHQPRQNQVQTDSYVRGRGRGRGRGLGGWAGYGGGYGGYDNNQGGYGGYSNQGGYGHNQGGYGNHGGYGHNQGGYGNQGGYGNQGGYGQNQGGYGGGYGYDQGGYGGYDNGGWNYNQNRGRGGGGRGRGNWGYSGPGYERGGRGAGGPGGPGGRGYVRGRGRMGPGRGRGNQNY

SEQ ID NO: 133062 - protein, 255 aa, Triticum aestivum
  Clone ID: PAT_TA_27480.pep
RLVPEEAIPEVSTYLCESFGNKARIDYGTGHEANFMAWLLCLEKLNVLEQKDDTVVVLRIFVKYIRVMRHLQFEYWLEPAGSHGVWGLDDYHFLPFLFGSSQLLDHKYIKPKSIHDKDVVDQFHQSYMYLACIHFINSVKTTASLRWHSPMLDDISACKTWAKVNQGMIKMYKAEVLAKLPIMQHFMFGSLISFDGGQVMSAELDSHCGHVHNTDNQETENEQEYPECCGIPVPSAIAAAAVSKNTSIFRPLPFD

SEQ ID NO: 133063 - protein, 334 aa, Triticum aestivum
  unsure (1)..(334): unsure at all Xaa locations
  Clone ID: PAT_TA_27481.pep
MLLVLAFSRIFSTMCLPFLAGSEAGHRRQGGHGGGASLPGLPPPSLLLLCGPPQEQGRGWCAAGCAPPSRRRAVSCSCAPDSWSRGLERRQLVLSGLVSSFAIVLPITVVESCAAATEVDDDGVKMAMLVDETNAYSFLYPVQLPGKKTSFRWVESRKSERYSSAAPLSPDARQRIVSERLDMINNAVISVSIRATKLTLSTFRQTRKVKAAKDVADRAMSDRSSLKGTTNERMGESSVLXDAHTEDVXGDSXWDYEDIARKSPTKSAPAPNLVRYNVRVTAEAEDIVQSVNAYRLRKQRDFKGPLLQKAVASFHPLPPTEECVPPYRDPWRFW

SEQ ID NO: 133064 - protein, 231 aa, Triticum aestivum
  Clone ID: PAT_TA_27482.pep
MRDDQGSKKPRVNPEEPSAVRATTSNEIGTVAATVEVRKSSGPDRGESNRKLRSGTRDDQGSKKPRVNPEEPSAVCATTSNEIGAVAATVEVRKSSGPDRDGSKRKHRSGTHDDQGSKKPRKNGKLAKSEISCLAMLELKLLKIDKTYGSDRFKEVARAATHTVLASYGLEHTPSVALALPKPVCKHSCRTGSSKPSAIANTCKECLRGFVKQAISSVLASKQMDQTAASC

SEQ ID NO: 133065 - protein, 103 aa, Triticum aestivum
  Clone ID: PAT_TA_27483.pep
MASRNAAPVFLLALLLSWVAMSSAARKLQEQETAPPTEEEPSAPHLTVPGLPDYELPPMPKFELPPFPEMHLPPFPGTPWKPATRTPTLTGFFFPQPEPEANP

SEQ ID NO: 133066 - protein, 148 aa, Triticum aestivum
  Clone ID: PAT_TA_27484.pep
STPRTEWSYQLVGTSYTTDVVLSILADQGVRQLYPKGPDIDFKKELRTLNRELQLHILELADILVERPSQYARRVEDISLIFKNLHHLLNSLRPHQARATLIHLLESQIQRRKQAIEDIKQRREEAQRLLGESLVIIEGSQQQVMTPM

SEQ ID NO: 133067 - protein, 149 aa, Triticum aestivum
  Clone ID: PAT_TA_27485.pep
MSSNSSNTDLINQLLSLPVDFTMDPLVIPTITNVVRPKKSRVTLEDKDQKTKERILRNRAAAQESRDKKRRYVSDLESSNKRLEEENGQMKKKMKHLEEENMSLACQLESISKQFAALQAQIKFNTNSTFLFNDFCGSARIVKKEIICV

SEQ ID NO: 133068 - protein, 293 aa, Triticum aestivum
  Clone ID: PAT_TA_27486.pep
MDQYEKVEKIGEGTYGVVYKAKDRYTNETIALKKIRLEQEDEGVPSTAIREISLLKEMQHRNIVRLQDVVHNEKCIYLVFEYLDLDLKKHMDSSADFKNHHIVKSFLYQILHGIAYCHSHRVLHRDLKPQNLLIDRRTNSLKLADFGLARAFGIPVRTFTHEVVTLWYRAPEILLGARQYSTPVDVWSVGCIFAEMVNQKPLFPGDSEIDELFKIFRIMGTPNEETWPGVSSLPDYKSAFPKWPSVDLATVVPTLEPLGLDLLSKMLCLDPTRRINARTALEHEYFKDLDVSS

SEQ ID NO: 133069 - protein, 294 aa, Triticum aestivum
  Clone ID: PAT_TA_27487.pep
MEQYEKVEKIGEGTYGVVYKARDRTTNETIALKKIRLEQEDEGVPSTAIREISLLKEMQHGNIVKLHDVVHSEKRIWLVFEYLDLDLKKFMDSCPEFAKSPALIKSYLYQILRGVAYCHSHRVLHRDLKPQNLLIDRRTNALKLADFGLARAFGIPVRTFTHEVVTLWYRAPEILLGARQYSTPVDVWSVGCIFAEMVNQKPLFPGDSEIDELFKIFRVLGTPNEQTWPGVSSLPDYKSAFPRWQAEDLATVVPNLEPVGLDLLSKMLRFEPNKRITARQALEHEYFKDMEMVQ

SEQ ID NO: 133070 - protein, 67 aa, Triticum aestivum
  Clone ID: PAT_TA_27488.pep
RALCKIDPHWSIQKTAAILKQKKLHAATCSESQVKKGPSMHPLPLYFGNFIEAWHFTLAKTELLYVA

SEQ ID NO: 133071 - protein, 315 aa, Triticum aestivum
  unsure (1)..(315): unsure at all Xaa locations
  Clone ID: PAT_TA_27489.pep
MEPMSVDSSGCGGLDAQIEQLLQCRPLAEQEVKALCEKAKEILMEESNVQPVKSPVTICGDIHGQFHDLVELFRIGGKCPDTNYLFMGDYVDRGYYSVETVSLLHCAXKVRHPHRITILRGNHEXRQITQVXYGFYDECLRKYGNANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNAHTFIQFEPAPRRGEPDVTRRTPDYFL

SEQ ID NO: 133072 - protein, 182 aa, Triticum aestivum
  Clone ID: PAT_TA_27490.pep
FFFFFFEDNISIYLILSRDKWISVDNILAQKFDCDKKITFPYIYFCLMDRSVDILLPHHSTDTHNTSRHTGLTIQCWLQHHALAGLLTVAAAAGAGGVARSQPAYQPAPDYWDSHLALQAGGVVHTVGQNFPFGQGTHPQRAMHVASPSSVGCPDMAGASAVAQRAARSMTAANLRAGEAMR

SEQ ID NO: 133073 - protein, 205 aa, Triticum aestivum
  Clone ID: PAT_TA_27491.pep
CENQTYDCYANLALLKLYQFNPHLARDETITNILVKALTVFPSPDFSLGLSLLPPHVLAPLSSSLHNPAAGDAPLSEAVQKLNELRNLLEGADYSTFWSTLDSDDLYADLIADVSGFEELMRVRIAATVSQAVREVDRSILESWLNLSGSEFDNFVGSVCGWNIDGAKIKVPINKDNEAKGTVVRENVKFDQFARVIKRAYEQPA

SEQ ID NO: 133074 - protein, 200 aa, Triticum aestivum
  Clone ID: PAT_TA_27492.pep
NFRKVVVIDGKGHLLGRLASIISKQALNGQKVVVVRCEELNVSGEFFRNKLKYHAYLNKRCLVNPTRGPFHFRAPSRILYKAIRGMIPHKTARGAAALDRIKLFEGVPAPYDRVKRMVVPDALRVLRLKPGRKYTTIGRISHEVGWKYQDIVAKLEEKRKAKSAAYYQRKVALAAIQKKAVEAKAESVKEINSSIAALGY

SEQ ID NO: 133075 - protein, 123 aa, Triticum aestivum
  Clone ID: PAT_TA_27493.pep
PRVRKGVGRRFANIACKKADIDLTKRAGELSSEELERIVTILQNPAQYKIPNWFLNRQKDIVDGKSSQVISNVLDTKYREDLERLKKIRAHRGLRHYWGVRVRGQHTKTTGRRGRTVGVSKKK

SEQ ID NO: 133076 - protein, 148 aa, Triticum aestivum
  Clone ID: PAT_TA_27494.pep
RENTFQHILRLLNTNVDGRVKIQIALTSVKGVGRRFANIACKKADIDLTKRAGELSSEELERIVTILQNPAQYKIPNWFLNRQKDIVDGKSSQVISNVLDTKYREDLERLKKIRAHRGLRHYWGVRVRGQHTKTTGRRGRTVGVSKKK

SEQ ID NO: 133077 - protein, 71 aa, Triticum aestivum
  Clone ID: PAT_TA_27495.pep
MGGGMEVNKNRWIEEWNAGRENLELNFRFTRRSLAVIGLFGLAVPILVYKGIVREFHMQDEDAGRPYRKFL

SEQ ID NO: 133078 - protein, 177 aa, Triticum aestivum
  Clone ID: PAT_TA_27496.pep
AWSRPTSASPSAHSQSGDEAGGGESGRGDEEDRWRHGREASNSWERGVERRPGGPRAELQLRPPQRWPSPASSPPPSPPSPTRASSVNSICINKGHAGAYLQVPDEASPAGRVGDFPSWQQAPPVEGEGLPNGFWHAFPVHSKRGFFDPVWFARYCLKDSIRSILFSQVVKSELNKM

SEQ ID NO: 133079 - protein, 304 aa, Triticum aestivum
  unsure (1)..(304): unsure at all Xaa locations
  Clone ID: PAT_TA_27497.pep
MQMTHKVETRSKEEILLEPYNYLISHPGKDIRSKLIAAFDYWLNVPKDALKIITKTIEMLHTASLMIDDVQDDSDLRRGVPVAHHIYGVPQTINTANYVYFLALQDILKLNIPEMVAAYTEELIHLHQGQGIELYWRDSLTCPSEEEYIDMVNNKTSGLLRLAVRLMQAATNSKIDYIPLVNIIGIHFQVRDDYMNLQSNTYTQNKGFCEDLTEGKFSFPIIHAIRAEPKNRQLLNIISQKPTSVXVKQYALEIIKRAGSFEYVQEFLRQKEQEALNEIERLGGNPMLEKVIRALSLTNQTTTH

SEQ ID NO: 133080 - protein, 139 aa, Triticum aestivum
  unsure (1)..(139): unsure at all Xaa locations
  Clone ID: PAT_TA_27498.pep
SLXDSQFPVEEDLNNTVDSYSVTINGFIFCTRHGLEVCSKCPTDNRSANNMMVEDMLHDKLSEEEYTTKWKGDEREPFSVAHKWTRVAKGKPGCMAHKTVACDECFNWGEQLYRGIHGGRKPRVSRLQRKSRDHTDKLS

SEQ ID NO: 133081 - protein, 339 aa, Triticum aestivum
  Clone ID: PAT_TA_27499.pep
PDLVQFVSGFADVGEEIVKCGVKHVTFIGSPGVGKLVQKNAADHLVPCVLELGGKDCAILLKDTDLVQAIPVLMRGVFQNCGQNCIGIERIIVAEEIYDKVVDEMDSRISKLRQGSVLVDGEGVDCGAMTMGNQFEKLEGLVQEAVSRGARLLRGGKRYHHPSHKHGQYFEPTLLVDVTPDMAIANNEAFAPIMVIMKHQGPDDAVRIANECPYGLGSSVFSADKSLAESICLRLKVGMANVNDFAVNYLCQSLPFGGVGISGYGRFAGQEGLRGLCVPKAITIDRIPGVKTPIPPILDYPITSAANGWTFVESLVNLVYHPEIPAKIKAMIGLAKAHL

SEQ ID NO: 133082 - protein, 180 aa, Triticum aestivum
  Clone ID: PAT_TA_27500.pep
NLSAEEQKVTKNPMRNLRIEKLVLNISVGESGDRLTRAAKVLEQLTGQTPVYSKARYTVRSFSIRRNEKIAVHVTVRGPKAEEILERGLKVKEYELKARNFSETGNFGFGIDEHIDLGIKYDPSIGIYGMDYYVVMGRPGYRVSRRKHCKSTVGVTHRIKKEESIEWFKNRFDGVVSNKN

SEQ ID NO: 133083 - protein, 106 aa, Triticum aestivum
  Clone ID: PAT_TA_27501.pep
MSAELAVVYAALILEDDNIEITADKLQTLVAAAGIEVEPIWFSLYAKALEGQDLKALLLNVGAPGAGAAAPAGAAGAAAASDAPAEEAKEEEKEESDDDMGFGLFD

SEQ ID NO: 133084 - protein, 141 aa, Triticum aestivum
  Clone ID: PAT_TA_27502.pep
LRGTDGKAPGMIGWWPAKAVTFVDNHDTGSTQHMWPFPSDRVMQGYAYILTHPGTPCIFYDHFFDWGLKEEIDRLVSIRTRQGIHSESKLQIIEADADLYLAEIDSKVIVKLGPRYDVGHLIPGGFKVVAHGKDYAVWEKI

SEQ ID NO: 133085 - protein, 308 aa, Triticum aestivum
  Clone ID: PAT_TA_27503.pep
PRVRRLRGRPGHRPPQPARPEGARGVAQLAQDRRRLRRLALRLRQGLLRGRRQDLHRPLRGQKELVEWLNWLRTDVGFDGWRFDFAKGYSADVAKIYIDRSEASFAVAEIWTSLAYGGDGKPNLNQDPHRQELVNWVNKVGGSGPGTTFDFTTKGILNVAVEGELWRLRGTDGKAPGMIGWWPAKPVTFVDNHDTGSTQHMWPFPSDRVMQGYAYILTHPGTPCIFYDHFFDWGLKEEIDRLVSIRTRHGIHSESKLQIIEADADLYLAEIDGKVIVKLGPRYDVGHLIPGGFKVGAHGNDYAVWEKI

SEQ ID NO: 133086 - protein, 205 aa, Triticum aestivum
  Clone ID: PAT_TA_27504.pep
MANKHLSLSLFLVLLGLSANLASGQVLFQGFNWESWKHNGGWYNFLMGKVDDIAAAGVTHVWLPPASQSVAEQGYMPGRLYDLDASKYGNKAQLKSLIGALHGKGVKAIADIVINHRTAEHKDGRGIYCIFEGGTPDARLDWGPHMICRDDRPYADGTGNPDTGADFGAAPDIDHLNPRVQKELVEWLNWLTEERTDGRSIYCIF

SEQ ID NO: 133087 - protein, 438 aa, Triticum aestivum
  unsure (1)..(438): unsure at all Xaa locations
  Clone ID: PAT_TA_27505.pep
PPQRTQHELKNKARKHSPPSLLLVLLGLSASFPSRQGQFQGLTWESXKHKGGWFKVQLGEVHGGGARRGRPRAPPPAAXSHAAQWYRPGRLSDLGTATDGNKDHLQSPIGAPQGKGVKAIADIVISTSTADRNDGRGSNSISEGRHPXARPARAPPVISSGPRAYADGTGNPDSGPDIGAARAAAPPTPHLKPGVMERLSWSPTDLTFDGWSFGFAKGYSVDVAKIYIDRSDARFAVADIWTSLAYGGDGKPNLNQDPHRQELVNWVNKVGGSGPGTTFDFTTKGILNVAVEGELWRLRGTDGKAPGMIGWWPAKAVTFVDNHDTGSTQHMWPFPSDRVMQGYAYILTHPGTPCIFYDHFFDWGLKEEIDRLVSIRTRQGIHSESKLQIIEADADLYLAEIDGKVIVKLGPRYDVGHLIPGGFKVAAHGKDYAVWEKI

SEQ ID NO: 133088 - protein, 234 aa, Triticum aestivum
  Clone ID: PAT_TA_27506.pep
RPAGEHPRPGTRVLCTAASSSAPREGKEVLVQHLLVGEKDARLLVDLEKSIASGADLSDLAVEHSLCPSKENGGMLGWVRRGQMVPEFEEAAFSAPLNKVVRCKTKFGWHLVQVLSERDQCLLQDIQPEELHEKMQDPSFIEEAQLIDVREPDEVERASLPGFKVLPLRQFGTWGPVMTDEFNPQKDTYVLCHHGMRSMQVAKWLQSQGFQKIYNVAGGIHAYSVKADSSIPTY

SEQ ID NO: 133089 - protein, 127 aa, Triticum aestivum
  Clone ID: PAT_TA_27507.pep
MPRKERIFTEKELLKYDGTDPSLPIYLAIDGEVFDVTKGRGWYGKGGSYHHFSGKDAARAYVTGCFQDHLTHDLRGLNENELKGVAHWKKFYENHHTYHKIGRVIHDPIPQDAPLPKPCKSAMKQKP

SEQ ID NO: 133090 - protein, 77 aa, Triticum aestivum
  unsure (1)..(77): unsure at all Xaa locations
  Clone ID: PAT_TA_27508.pep
FXFFFFFFKSTQQVATRVFLLLQKPQRPANTPGHSFRGRIGRRRPCSTDNRRGTAATAPGRPNGRCACSAAGSAHAS

SEQ ID NO: 133091 - protein, 266 aa, Triticum aestivum
  Clone ID: PAT_TA_27509.pep
LPPTAAPRCFDPPPPPPPLPPPAPPPARRASSAARRPRHPVRPPPHRPPNQRGRRPPAEQRAPTRNMTDPTRHSATPSNDRLPDAVQQAKERLHQRLRSVDLFSGRRQTSPAVGTPAPRPAPPSVSGLCASAPAPPAHPTMRFSSRPSRSASRRWQRPAVSGRSPAVVAPLALGPASVTAPWTLQGTIRDAVDAESSVDCSICLEGCHGASDGLIQLRCKHIFHLARPARSPPSRAASPGGAAGVGRAFRRLCKKEHWSCYVVCVM

SEQ ID NO: 133092 - protein, 170 aa, Triticum aestivum
  Clone ID: PAT_TA_27510.pep
MEPGLARRLWHVVLAVCHMLRRGLCRKRLMMDLHLLLGRGKLAGRALRGLLAQPATAHGHGHRISSSSTSAMASFYGHHARAVEFSCTTTPSYPQYYGLFPFKSRGGRSGGGRSTARDDYRGLDAAAVARAFEMMSADVESGRATPAVAGMATATPSPMVAWILSRSPPG

SEQ ID NO: 133093 - protein, 196 aa, Triticum aestivum
  unsure (1)..(196): unsure at all Xaa locations
  Clone ID: PAT_TA_27511.pep
MGRVIRAQRXGAGSIFKSHTVGRKGAAKLRVFDFAERHGYVRGIVKEIVHDPGRGAPLAKVVFRDPYKYKLRTETFIATEGMYTGQFIYAGKKASLNIGNVMPLASMPEGTVICNVEEKVGDRGAIARTSGNYATIIGHGDDGKTRIRLPSGSKKVIPSTSRAVVGIVAGGGRIDKPLXKAGRAFHKYRVKRNSCA

SEQ ID NO: 133094 - protein, 85 aa, Triticum aestivum
  Clone ID: PAT_TA_27512.pep
GRAQGQYIVASSKGGFELMVTMNVVLTSGTYAGSSVTVMGRDDTGVAVRELAVVGGTGQFRMAKGYVLWKTVRPDLLELDIYVNP

SEQ ID NO: 133095 - protein, 165 aa, Triticum aestivum
  Clone ID: PAT_TA_27513.pep
MACFKLNPTSFALAAAVAVILAVAAPRPAAGASAHLHVYMHDVMGDSAMMVVRGPRGNFGNTVVMDDVLTEGTSASSAAVGRAQGQYIVASSKGGFELMVTMNVVLTSGTYAGSSVTVMGRDDTGVAVRELAVVGGTGQFRMAKGYVLWKTVRPDLLELDIYVNP

SEQ ID NO: 133096 - protein, 367 aa, Triticum aestivum
  unsure (1)..(367): unsure at all Xaa locations
  Clone ID: PAT_TA_27514.pep
RHEALERSLHRGNPIRVVRTVKDLTCSTGKIYIYDGLYQIREAWVEKGKSGFNMFKHKLLREPGQPDGIAVWKKTEKWRENPSSRDRVILHDISYGVESKPICLVNEVDDEKGPSHFTYTTKLNYMNSPSSMRKMQGCKCTSVCLPGDNNCSCTHRNAGDLPYSASGILVSRMPMLYECNDSCTCLHNCRNRVVQKGIQIHFEVFKTGDRGWGLRSWDPIRAGTFICEYAGVIVDKNALDAEDDYIFETPPSEQNLRWNYAPELLGEPSLSDLNESSKQLPIIISAKHTGNIARFMNHSCSPNVFWQPVLYDHGDEGYPHIAFFAIKHIPPMTELTYDYGQXSQGNSGCRRTKSCLCWSRKCRGSFG

SEQ ID NO: 133097 - protein, 94 aa, Triticum aestivum
  Clone ID: PAT_TA_27515.pep
RRRRGSHRSSCGSGGNSDPRITAFRCRFLPEGAALKFTVRRMRLRLFVVVVLGVVLLRSAPLFLALGVCGDGVRLYRVMWIFALYIKRGENLFW

SEQ ID NO: 133098 - protein, 387 aa, Triticum aestivum
  unsure (1)..(387): unsure at all Xaa locations
  Clone ID: PAT_TA_27516.pep
KXDMLGTYLQRSAVLLCCTGIPLAAIYAFSEPLLVLLGXSPEIAHAASIFVYGLIPQIFAYAINFPIQKFMQAQSIVLPSAYISTGTLVLHLLLSWVVVYKAGLGLLGASLVLSLSWWVIVAAQFAYIAVSPACRETWTGFTWQAFSGLPAFLKLSAASAVMLCLETWYFQILVLIAGLLPDPEIALDSLSVCMTISGWVFMISVGFNAAASVRVSNELGAGNPKSAFFSVWVVTSLCAAISVVFAIVMLCLRNHISYLFTESEIVSDAVADLCPLLAITLILNGIQPVLSGVAVGCGWQQFVAYVNIGCYYIVGVPLGIVLGFVFNLGVKGIWSGMIGGTTMQTAILLWVTIRTDWSKEVEEAHKRLNKWDDTKKQPLLTAATDNS

SEQ ID NO: 133099 - protein, 317 aa, Triticum aestivum
  unsure (1)..(317): unsure at all Xaa locations
  Clone ID: PAT_TA_27517.pep
SRNPFAVSSWFGPICWLALDSLGPLPAATCLPHGSLAVGCVTFWVVAFPISSAHHNTSIKMLKEVVFPRFGVPRXLMTDGGSHFIRGAFRKMLAKYDVNHRIASPYHPXQSSGQVELSNRELKLILQKTVNRSRKNWSKKLDDALWAYRTAYKNPMGMSPYKMVYGKACHLPLDLEHNAXCAIKDLPCDFKLARERRLFDISSLDEWRTQAYENAQLFKEKVKRWHDKRIQKREFNVGDYVLLYNSRLRFFAGKLLSKWEGPFVIEEVYRSGAIKINNFEGTNPKVVNGQGIHLLSSPYPITSDAPVPEDKELKFNK

SEQ ID NO: 133100 - protein, 161 aa, Triticum aestivum
  Clone ID: PAT_TA_27518.pep
MACASPLIALLVVLGCAAAASAATFTVGDGQGWTTGANYATWASGKTFAVGDKLVFNYASQAHTVTEVTKSEYDACSSNTNGDNSGATTMTLKAGANYYICTIGTHCAAGMKLAVTAGDSSPGTPAAGTPPTTPSGSGGYRMEVGPILAATAGVLLKLAVF

SEQ ID NO: 133101 - protein, 162 aa, Triticum aestivum
  Clone ID: PAT_TA_27519.pep
VQEKAESGMVALRYAARTLGRFTLRRPQGFGISSTAAEDQQRFLPRLINTNGLTAEQQKDVASRLVQIDGKKEELYNMISGLERSYNVSGKIVRQNGRLARHLSVLVKPKPNDPYWRLHSRSQRIMDCIHFMGGCCLGPVIVSGFAWWMTEAHAEEKDDSLG

SEQ ID NO: 133102 - protein, 196 aa, Triticum aestivum
  Clone ID: PAT_TA_27520.pep
NVYDPKRIFGVTTLDIVRASTFVSELIGGEPNSLRVPVIGGHSGVTILPLLSQVPGIEKLNQEQIEKVTHRIQFGGDEVVKAKDGAGSATLSMAYAGARFATNIIEAAFAGKKGIVECTYVQLDADKSGAQSVKDLVGSELEYFSVPVELGPSGVEKILPIGNVNEYEKKLLIDASPELKTNIDKGCTFVTEGSKL

SEQ ID NO: 133103 - protein, 127 aa, Triticum aestivum
  Clone ID: PAT_TA_27521.pep
LPAPATLEQGSGSGRRRPLGVLFLCIKSTGCDVSRWKLGPSVCSVGLQYKEQKEADMVLRGSLCPNLNDDCVMCNNLSRVKLIWCGLSCVELVILYSYDTNKHWVVCLVLQPKRIFRSYQYMVLLFY

SEQ ID NO: 133104 - protein, 112 aa, Triticum aestivum
  Clone ID: PAT_TA_27522.pep
GLQARYRGRWILVRPVPGAFIINFGHQMEIVTNGVLASVEHRALTNSAVARMSVATLIMPKMDCLIGPAPEMVSEENPAKFREFVFREFMAAYDTAAASREDVLEYFRIEDH

SEQ ID NO: 133105 - protein, 356 aa, Triticum aestivum
  Clone ID: PAT_TA_27523.pep
MELLSNRPLHASVPDKYVFPPEKRAALLHDAPSSDVALPVVDLQRAYLSDAGRRRLVAEEIIKAGKEFGFFQVVNHGVAEDAVRAFRKASAEFFAMPAEEKLPYCSDDQSKPFRVASSTSYDRNQTRYWRDYLKLRCHPVSDELVGHWPAKPESFRSSLAEFSAQVHELAQTLLLLIAEGLGLDGGFFAGDLSGGDTQMNVNYYPPCPDPSVTLGLLPHCDRHLLTVLSQGDVAGLQARYRGRWLLVRPVPGAFIINFGHQMEIVTNGVLASVEHRALTNSAVARMSVATLIMPKMDCLIGPAPEMVSEENPAKFREFVFREFMAAYDTAAANREDVLEYFRIHNTRSMLMNYIYA

SEQ ID NO: 133106 - protein, 85 aa, Triticum aestivum
  Clone ID: PAT_TA_27524.pep
MASTSRRMVASVLLVLLLLVATEMGTMRVAEARHGHRHCESQSHRYRGACWRDDNCEHVCNTEGFPWGKCKFHDFERKCFCKKPC

SEQ ID NO: 133107 - protein, 102 aa, Triticum aestivum
  Clone ID: PAT_TA_27525.pep
VQRRPGPGFPLSPPGGSGRASWLVDADGTVNEAGQMFLNLQNEWKTDARGNVDGDGNFKFRGFYERYVVEVTCTATGKQMLKTFTVEKGDNDTPLLVDLADA

SEQ ID NO: 133108 - protein, 201 aa, Triticum aestivum
  Clone ID: PAT_TA_27526.pep
MSPLRALLVLAAVLAACLGPAAADQPGSVEGYTIAGRIKIDAARGFGLPAKTSNTKVILNGGQKVTFARPDGYFAFHNVPAGTHLIEVSSLGYFFSPVRVDISARNPGHIQAALTENRRVLNELVLEPLKEEQYYEPREPFNILSLLKSPMGMMVGFMVLMVVVMPKMMENIDPEEIKQAQEQMRNSPVPSFSGLLARANS

SEQ ID NO: 133109 - protein, 148 aa, Triticum aestivum
  unsure (1)..(148): unsure at all Xaa locations
  Clone ID: PAT_TA_27527.pep
GXLQLGSCKIIPXDLHFVLRMRHMFEYLSLESHSNKARRMENPHGAKFKRSFTLPARMSSSNSPSPSVSASTGPAPRRPQRRARAAPAQPAGSAFSDLLRTLASSLGRATHACMRRSIILTTTNVRALRFLVPTFCFVPTNQAMFKLF

SEQ ID NO: 133110 - protein, 328 aa, Triticum aestivum
  Clone ID: PAT_TA_27528.pep
MHLICISLLSITAFVSADVSTRASSLNLTQTWSATMPSAPITSDAVSYITSNWFASNFYAPEDISFTNDPIDTNSTNTVLKVNYPAGSYAPVGTKNGNGGVKGGAEFYSLPNGQTEYNTALLKYDVAFDSNFDWVKGGKLPGIFGGDISQGCSGGEKATGENCFSVRMMWREGGAGEAYAYIPTSDSLCNSKQVICNSDYGTSFSRGVIRFSTMKWSQIEIYVKLNSGSNSNGILEVWQDGSLMINQQNIQFRSNQNLGVSSMMFSTFFGGGSSSYATPVNTSTYFRNFQFSTGNTPDPVGNTAAASLQISSSSYYFLFLVVIYQFFT

SEQ ID NO: 133111 - protein, 116 aa, Triticum aestivum
  Clone ID: PAT_TA_27529.pep
GGGNNKGVNDQPVKVVDIVDPFRFQEHPVFSKNQFIFHMKRYIKTLFAKFKGDALNVFKKNVEFPPKYFFSKLKALQFFVGKSMHNNGGVVFPYSKEGAVDPTFLYFAHGLKKVKC

SEQ ID NO: 133112 - protein, 249 aa, Triticum aestivum
  Clone ID: PAT_TA_27530.pep
MAMVTTGLVAVASLLLLLAGGASAATLALYNKCGETVWPGIQPGAGKEILARGGLQLLPNRATSIRLPAGWSGRVWGRQGCRFDAAGRGKCATGDCGGALYCNGAGGEPPATLAEITLGASAAALDFYDVSLVDGYNVAIDMRPYHGSGANCLPAGCVSDLNSVCPAGLAVRGGNRVVGCRSACAAFGSAEYCCTGQFGGPQQCKPTTYSRLFKRACPKAYSYAYDDKTSILTCAAGTSYVVTFCPHRR

SEQ ID NO: 133113 - protein, 323 aa, Triticum aestivum
  unsure (1)..(323): unsure at all Xaa locations
  Clone ID: PAT_TA_27531.pep
MEEEKARGLSSAASSLIPPTSPEIDLEAGAGDQLQCRICLETDGRDFIAPCKCKGTSKYVHRDCLDHWRAVKEGFAFSHCTTCKAPYYLRVHVHTDRKWRTLKFRFFVTRDILFIFALVQFVISALAYLVHFIDGYQQYWLRTAWGFDNEVTFYYICGALLFFALLGLSGCFITCYXRRVRSDLAAQRRRELRLCCCQPGMGADCHLXGTLCMWTDCTTCFEVCATTAGECGGCLGGGXAGLPLLLIMGVIVLGLFTVVGIFYSVLVATMVGQRIWQRHYHILAKRMLTKEYVVEDVDGERADWSPPPLPAEHVQQLKSLGLL

SEQ ID NO: 133114 - protein, 59 aa, Triticum aestivum
  Clone ID: PAT_TA_27532.pep
FFFFFFFFFFLEHAYNTHDLPKIKILHERSVSWIGRGNVEFDCRNGRLHHCYSCQWGSA

SEQ ID NO: 133115 - protein, 139 aa, Triticum aestivum
  Clone ID: PAT_TA_27533.pep
VMQSLKKSIEVFKALFSNTLILLLVAFMLAAGVLADPACDKNAILKIIPQRKLGRNVSGKFEIVAGKQANLISERALKSAFELCFFDRGSCNVHKSSMTFECYTNTEWRSVSWIGRGNVEFDCRNGRLHHCYSCQWGSA

SEQ ID NO: 133116 - protein, 197 aa, Triticum aestivum
  Clone ID: PAT_TA_27534.pep
RSVVYVSLGSLAVITHEQFTEFLSGLAATGYAFLWVLRPGMVQMTSSALLGATVEAVGGGRGRVVEWAPQRDVLRHRAVGCFLTHAGWNSTLECAVEGVPMVCWPFFADQQTNSRFVDAVWRTGLDMKDVCDRGVVERTVREVMISDEIKEAAQAMAQQLRLDVAEVGSSSFEFERLVRFIRELNISSSISDEAQKE

SEQ ID NO: 133117 - protein, 112 aa, Triticum aestivum
  Clone ID: PAT_TA_27535.pep
MASNNTTDAASGDGNAITTLITLPAKANGAGVEAEDITVITLAGEGEEGAEEEEVHVAAYTNSNYQAVNNSVLLAGSCAVRDPGVHVVIVEHVDDIRDCDGDEIFEDGEVAK

SEQ ID NO: 133118 - protein, 209 aa, Triticum aestivum
  Clone ID: PAT_TA_27536.pep
GGDGRHGSSRQNGAFPRRRRPQELRNVPAVGVTGLSTAGCNQRATRVARATPNRIVASSEVEQTYIMIKPDGVQRGLVGEIISRFEKKGFLLKGLKFFQCPKDLAQEHYKDLKERPFFPNLIDYITSGPVVCMAWEGDGVVASARKLIGATNPLQAEPGTIRGDLAVQTGRNVVHGSDSPDNGKREIGLWFKEGELAQWESVQTPWLIE

SEQ ID NO: 133119 - protein, 78 aa, Triticum aestivum
  Clone ID: PAT_TA_27537.pep
KPLRSLITSSTQNSTEISVRSVSILSKSLTLSTCCKAIHILFLHCRYCNITFTWLIPPIKIDSFIKTCKTMHQKQNLS

SEQ ID NO: 133120 - protein, 168 aa, Triticum aestivum
  Clone ID: PAT_TA_27538.pep
RVIHASEKKAYTAVLDQSSMPNFNSSWVNYKGAWLTTICVIVVLKALFTLIPFITPEASWTLTNLAFNCGHYIMFHWVQGIPFENNQGAYDGLTLWEQIDGGVQFTATRKFLTAVPIVLFLLSTHYTHYDVFLFGINFTALLVVLVAKLPMMHRVRVFGINKLDYDMD

SEQ ID NO: 133121 - protein, 161 aa, Triticum aestivum
  Clone ID: PAT_TA_27539.pep
PPSPPPRRRSRPARPLPDRTPPNPRIPDQISPRPEPIPIEFEPRSAGPGQALRRNRPNSGDPEAHGGRPRGSELGLPPAPAAAAAPPPAKGPASPPPPPPRSSLPPLRTTSYPPAPTTPPAAPHKQEAADSPRPPSADSFLKVPHTLVDIPLWDLLSSARF

SEQ ID NO: 133122 - protein, 187 aa, Triticum aestivum
  unsure (1)..(187): unsure at all Xaa locations
  Clone ID: PAT_TA_27540.pep
MATDAILETIKPRRSPWLEDLPVTNGGAAKGGKVDLSGMRRRVSSSLSLSLQPLSSSSSAAFRRARSMPSIKALAAAGAVRQWWEWGLGWWPLARHAPARPLRARAHGMSALAGALRGLRCRGTRPRVSFAPRAGVRRXXGRDGRPLXXVAAXXFXXDSVSYAQNFXTATSTPASCCAGARMAANRA

SEQ ID NO: 133123 - protein, 213 aa, Triticum aestivum
  Clone ID: PAT_TA_27541.pep
QRPVIVNIRATGICGSDVHYWTHGRIGHFVCEKPMVLGHESSGVVVSVADDVTSLKVGDRVALEPGVPCRVCEMCKLGMYNLCPDMAFAATPPYDGTLCNYYKHAADFCYKLPDHISLEEGALIEPLSVGIHASRRGGVKLSDRVFVFGAGPVGLLTAAAAKAAGASHVTIADRDPARLAFAKEYCADETIHLTGARRLDQDSNDFAKEEAEK

SEQ ID NO: 133124 - protein, 218 aa, Triticum aestivum
  Clone ID: PAT_TA_27542.pep
CQTRRVEPFSAPKSKVSHFLPTSKRIVQFSNKGAEPKPSDRVVYVDGTFDLFHIGHIEFLKRAKEQGDFLVVGVHDDQTVNAIKGINYPLMNLHERALSVLACRYVDEVIIGAPYSVTEDILNKEYNVSVVIHGTTSSELDIDGADPYELPKSRGIYREISSPNSTLTTQGIIDRIIENRFMFEERQKRKNAKAILEAQKEEEEKKQQNIKKQSLITA

SEQ ID NO: 133125 - protein, 68 aa, Triticum aestivum
  unsure (1)..(68): unsure at all Xaa locations
  Clone ID: PAT_TA_27543.pep
XPPXSMIGSTQIVYXTLFMXVSVFSDXQDNPSRGFPVVAYFTSILLSFHLGKVFPRMVFLADGSGAQY

SEQ ID NO: 133126 - protein, 207 aa, Triticum aestivum
  Clone ID: PAT_TA_27544.pep
MPSPQRRAGSGDKVAMSGAGISPAGSSALLFCSLEKVCQLANYLKSVGVGKGDAVIIYLPMLLELPIAMLACARIGAVHSVVFAGFSADSLAQRIVDCKPKLVLTCNAVKRGPKPILLKDIVDASLVESEKNGFSVGICLTYENQSVMKRQDTKWQTGRDVWWQDVVTNFPTKCDVEWVDAEDPLFLLYTSGSTGKPKGVMHTSGGY

SEQ ID NO: 133127 - protein, 59 aa, Triticum aestivum
  Clone ID: PAT_TA_27545.pep
LYSAKQHVRYVRTIINHSPSSHRARNHLQLPGRFSLKVSGISKGRDTRRPTTSYQVGVK

SEQ ID NO: 133128 - protein, 65 aa, Triticum aestivum
  Clone ID: PAT_TA_27546.pep
LYSAKQHVRYVRTIINRSPLSDRASNHLQLPCHFTLKGSGIRKGRGTKRPTTSYQVGVNLKKSML

SEQ ID NO: 133129 - protein, 363 aa, Triticum aestivum
  Clone ID: PAT_TA_27547.pep
PTQKTETVDRSLKSFQHVVNGPTDTISQVGKDTSTENQKEAIFETVSSGPGSALLVKLPPDSEITAATGSTLACSTKILSKLSLDTTTVKAVGRKLVGDAMFYQKYYTKNVAGDILLAPQRLGEISIIQLKSSAKYMLRRDAFLAKTEKVTLDLGVHHQQTGVVNKLVHTVSGPGTLAISHYGGIYRISLAAGEEYQANPRNLIMWDKSTNPTQPKINHRLVPSPRSQLRRYEVIRNIADSPSLQPKLQYANYIIHSIRNFILGTPDFVKLKGPGDFYLASRVEPRFEKSRLMNALAAVNDSTSQLFEQSNLFSSSDEQAGLFQSESIKRKQHPGYAQKSHDGIPSFYAEVGPKGTVSFTAYN

SEQ ID NO: 133130 - protein, 373 aa, Triticum aestivum
  Clone ID: PAT_TA_27548.pep
MALTGDYKLISTDDMLQGHAELCIHAYGFVKSMALKCAIELGIPGAIHGHGGGATLGELATIIALPPSRLPRLRRLMRVLTVSGVFSVQNQQPDDPAGCAAVVYGLTAASRLLVGDGESIVGAAPPRSLMVDPNLTAPFSGMSAWFMDDEQPRSFFEMHHGEDMWEMAARDAALSRTIGDGMTDDSRFVVEVLLREGRARDVFSGVRSMVDVGGGTGTIAKAIAAAFPHVECSVLDLPHVVAEAPAGGEVRFIEGDMFEHIPPADAVLLKSVMHDWRDDECVKILRRCKEAIPSREAGGKVIIINMVVGSEKSKGNSTKKGGGTSIVRSSSSWFLREVNEKSMSGRRSFLEAGFSGYSIIPMLGIRSIIEVYP

SEQ ID NO: 133131 - protein, 64 aa, Triticum aestivum
  unsure (1)..(64): unsure at all Xaa locations
  Clone ID: PAT_TA_27549.pep
MKLYKRIFXYFLRLRPRKTRIFRYLRFHILVTRCSIGIRRNRNSFALHIKLDFEGPFFFQNPLF

SEQ ID NO: 133132 - protein, 161 aa, Triticum aestivum
  unsure (1)..(161): unsure at all Xaa locations
  Clone ID: PAT_TA_27550.pep
FPXPXPRSGXVFYQARPRGAPPPRPRRPPARGRRGAGLQVRLRQLRSELRQRRRRRQMLAAAPAHAWIRTPTFVPKVKVDMARSMATNYIFLDAAINRIVCKILAAYSTACVCVCVLSERSQMIQQRVMRTVQGPDVYFFRSSFLCFSESFLGYIRPYNVM

SEQ ID NO: 133133 - protein, 166 aa, Triticum aestivum
  Clone ID: PAT_TA_27551.pep
KTELLQHDDMPKLKYLKMVVKETLRLHPPATLLVPRETTGRIQVAGYDIPAKTKIIVNAWAIGRDPGAWNDDPEEFRPERFQDKDVDFNGAHFELLPFGSGRRICPGLAMGVANVEFILANMLYCFNWELPDGVSCEDVNMEEAGALTFRKKTPLMLVPTRYSMCP

SEQ ID NO: 133134 - protein, 165 aa, Triticum aestivum
  Clone ID: PAT_TA_27552.pep
SRVRPTPFGSKAPTQEQLDEWKEAFSLYDKKGNSTVSSANLGDLLRGLGQNPTEAEVRELIKETAKSKNIPESQEFDIDFGTFLSILTRPDGFKPAGSSQEFIQGFQVFDKEGDGYISAGELRYVLTNLGEKLTNEELDELLKEVEIGKDGRINYIDFVTVVLSN

SEQ ID NO: 133135 - protein, 100 aa, Triticum aestivum
  Clone ID: PAT_TA_27553.pep
PVSADLGTHSSLNGNLGALAPVTAIIDGTGSIGAAVGPLLTGYISAKSWSGVFPMLMASALVPGLLLSRLVVAEIPPKMAASQRPVYSAGDLPVSSLEVP

SEQ ID NO: 133136 - protein, 152 aa, Triticum aestivum
  Clone ID: PAT_TA_27554.pep
RQKYGEIMSSNKKVLHLLHGLKAFPDANVSTNDIILQDQTPYVLKLHNRSPEDRACFEITGQAPSSSGSDSAGFPTWLKVSPAAGIICPGQTVEVTLQHGDLRGTSWNNLSGANQEKAAQLSVKITGACSTVAKCYGVRVQCQKGTFPFKRF

SEQ ID NO: 133137 - protein, 211 aa, Triticum aestivum
  Clone ID: PAT_TA_27555.pep
KEFINKYDNFLFDCDGVLWEGNNMFEGVAESMKLLREKGKHVCFVTNNSTKSRASYLKKFEGLGIKAELGEVFSSAFATATYLKNVLKFPTDKKVYIIGMQGIKEELALEGIKSCGAEEDSGLFDNDLIPDDPEVGAVIVGLDTQVNYRKYAKGFAYLTRNPGCYFLLTNEDSTFPQHGSFYPGAGAIAAPLITALNRRPDAVLGKPALIC

SEQ ID NO: 133138 - protein, 338 aa, Triticum aestivum
  unsure (1)..(338): unsure at all Xaa locations
  Clone ID: PAT_TA_27556.pep
MPQLSSRRQGLAPPLAAKERKQDGPQWTVLRSSGTLRGEGSGSLAPGWSGRGEKGSNQDCSLARQGFGCQDDTIFCAIFAGQSERGHYVSTGGRHXGGRTLPGRWQEDVPLAALVDGEKKLGDCQFDLWRQSYLAAAAAVDEELRRSRRLDAVNSGSTALSIVKKGDTMVIANVGDSRAVLGTTSDDGSIAAVQLTVDFKPNLPQEKARIVQCKGRVHCHEDEPGVHRVWLPDREAPGLAMSRAFGDYCVKDYGVISAPEVTQRRITARDQFVILATDGVWDVVSNDEAVQIVADTPEREKAAKRLVQCAVRAWRRKRRGYAVDDCSAICLFLHPPPS

SEQ ID NO: 133139 - protein, 133 aa, Triticum aestivum
  unsure (1)..(133): unsure at all Xaa locations
  Clone ID: PAT_TA_27557.pep
FQTDMIALSCCHTXGAVDCSFFQSRIGTDPTMDSGFAAQRRGTCTSSQSSAFLDPTPLGFDNSYYKNLQGGRGLLGSDQVLYTDPRSRGTVNYYASNQGTFFYDFTVAMTKLGRVGVKTAADGEIRRDCRYTN

SEQ ID NO: 133140 - protein, 141 aa, Triticum aestivum
  Clone ID: PAT_TA_27558.pep
RVRAVQTFGRKKTATAVAHCKRGRGLIRINGSPLELLEPEILKFKVYEVILLLGEERFANVDIRIRTHGGGHVSQVYAIRQALAKAIVAFYQKYVDEAAKKEIKEILVQYDRTLLVADPRRCEPKKFAGPGARARYQKSYR

SEQ ID NO: 133141 - protein, 257 aa, Triticum aestivum
  Clone ID: PAT_TA_27559.pep
LLKRHLKPHQQVALTLYPITVLVAFLYSTLGNPPNTYYAHKHNVLNLYFVKIGWVWVTLVYFSYLYFVRSRYLQDTQRFIKGSLRYLLVTLYWYIMTQWLLGPSMIDRIYVLTGGQCRSLTEQADGSDKLTSVVSQQVCRHLGGHWAGGHDVSGHCVLLIHASLFLWEELCWMFYSFDSLSLLKKQDKTQYRSVMAVLTIAVIWWFRLFQPGIYFHGHYELLFGPFFGTLGWVILYVGVFPRIPEIGNPFPSLVNHL

SEQ ID NO: 133142 - protein, 180 aa, Triticum aestivum
  Clone ID: PAT_TA_27560.pep
MKALAGDGNASAPLLQATKISIPASSTGGAAEAALLGKGRYKVWALAAIALLALWSMSAASVSLRWSAGDLAAAVSGDLDAPLRDDLDSLEMEEREKLVGRMWDMYTRTSDEVRLPRFWQEAFEAAYEELAGDDMQVRDTAISEIARMSAHRLELEQPMNANQEEGKVSIMNNDHGRVKQ

SEQ ID NO: 133143 - protein, 171 aa, Triticum aestivum
  Clone ID: PAT_TA_27561.pep
VCLVEGGSSLAARQRGVVVVPEWRWRGCCAGVRGSVEVLVGVGRPRGSGGVADSGESLAGASWPSAAALVGVAFFLGGAIVVICASSSLGSRSLGESQDPCWIKRRRRLERRFPSWGRRFGDLGPFCASCRLDVHGIAVSRCPTGGEVCLALRRVWQRRWWRAKPSRGLSF

SEQ ID NO: 133144 - protein, 194 aa, Triticum aestivum
  Clone ID: PAT_TA_27562.pep
RSRPPTRPDTVKIVPNDFKKDNLNAVTDVLNEKYANKVVQEVGHCICVHDILNVTEGFILYLDGCSYVRVTFRLVVFRPFVGEILVGKIKSSSPAGVVVTLGFFDDILIPGGALQPGSKFDPAEQVWVWNYEGEKMFMDIEEPIRVRVLREQYTDTTPTNHPQKGRNNDAADDLAANSTKIPPYSITCTIQEDG

SEQ ID NO: 133145 - protein, 241 aa, Triticum aestivum
  Clone ID: PAT_TA_27563.pep
EVWKYLLGVQQADRSKELSLSKARREEYEQMDKEDVEIAKRIRGEVLRYQRRVSEVLQEKEYVNSFVNIILAYLNSNRDVEYNPSFVSLVAPFIYVMDTECDAYFCFERIMQALEEYNSSFSLKEQVAYFMTLFRCSLPELCNYFEDEEVEIHDWSTSWLQNLLSKEMRFENLVRLWDCYFAMSDPLSFHPFVCLSILLSVKEAVEDLEQSEIRTMLHRLPLLNMEMIIADAYKMERQTNG

SEQ ID NO: 133146 - protein, 305 aa, Triticum aestivum
  Clone ID: PAT_TA_27564.pep
PASAKYITIYDKNHSKKFASRNGPEEIKFTKDEIDQYCYLNVYEQINGTNKIKLKLDNGNYVYTHSNQYIHSGGNASVFELIKLENEGENIYAIKSSNGNFVAVYDKNGMHNLKADRNSIDRYCKFKIEEPIIKKEIINIKYDISKAVIKQTSPEIAARQNVENNSYDSNTISRIGYAYKKSETGTWNNTAGVELTVGMSFEAGVPFIASANFEVQISTSYSHEWGGSKTIEKEINGQLEVSIPPRKKGTVSIIVSKASMDVPFTYTTKTRYLNGEIVEKNNINGIYRNLESYLIQGDTSELIPI

SEQ ID NO: 133147 - protein, 223 aa, Triticum aestivum
  Clone ID: PAT_TA_27565.pep
VLEPHATPLSLRFSSPPRSPAHGRRRRSSFSYSLPCHQVTGPSTSPSFSSLSSGRRRRLDLDRVQVSETGGWVNPGADPVARPHVAADPASSWRRQRVLVVLCERERSEREPWEETEQRGGRDAAGRRLLRPLLLAVGRRAEPARPSSGRCRGACEERSRSPVVLSSSRRVQPATQPLSFAPCRAGEARAPPHWRDGRGHVTNLKANRTATPLATYFACLAKA

SEQ ID NO: 133148 - protein, 345 aa, Triticum aestivum
  Clone ID: PAT_TA_27566.pep
QKKKQKTFLSVFPTLRDEVLAELKKYNMPEDAYEWTKRNLEYNVPGGKLNRGISVVDTVRILKGDSVTEDDIFKATVLGWLIEFLQAFFLVSDDIMDASITRRGQPCWYKSSGVGMVAINDAFILESCIYIFLKKYFKGTDYYVELIELFHEVTFQTELGQLCDLITAPEDHVDLSKFSVKKHQFIVIYKTAYYSFYLPVALAMHMVGVKNEEAFKSAHDILIPLGEYFQVQDDYLDCYGAPEVIGKIGTDIMDNKCSWLINQALDKANPEQRKVLDENYGKKDAEAEAKIKQLYIELDIEGVYKAYEEKSYNELSALIEKLDESVGVKKQVFVEFMDKIYKRTK

SEQ ID NO: 133149 - protein, 103 aa, Triticum aestivum
  Clone ID: PAT_TA_27567.pep
RKGTGAPVYLAAVLEYLAAELLELAGNAAKDNKKSRIIPRHLLLAVRNDEELGKLLAGVTIAHGGVIPKINPVLLPKKTAEKEGKEPKSPKKAAKSPKKATKA

SEQ ID NO: 133150 - protein, 165 aa, Triticum aestivum
  unsure (1)..(165): unsure at all Xaa locations
  Clone ID: PAT_TA_27568.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGXEDAANNFARGHTPLGKXEMVDLXLTRIRKLFKQPALGLQGFPCISTACWKVETGLLVLWVRFFPGTGFS

SEQ ID NO: 133151 - protein, 110 aa, Triticum aestivum
  Clone ID: PAT_TA_27569.pep
ITIPGALVSGNWNEYNLNPLTRIHWRASLELAGNAAKDNKKSRIIPRHLLLAVRNDEELGKLLAGVTIAHGGVIPKINPVLLPKRTAEKEGKEPKSPKKATKSPKKATKA

SEQ ID NO: 133152 - protein, 136 aa, Triticum aestivum; identical to SEQ ID NO: 106789
  Clone ID: PAT_TA_27570.pep

SEQ ID NO: 133153 - protein, 86 aa, Triticum aestivum
  Clone ID: PAT_TA_27571.pep
SSGRPGRYYKGLGTSTAEEGRDYFEHIALHKKDFVWADDKEDGEAIELAFSKKKISERKDWLTNYQPGTCLDQREKRIKYLGRDHA

SEQ ID NO: 133154 - protein, 125 aa, Triticum aestivum
  Clone ID: PAT_TA_27572.pep
SAPPSSTTSRRISDSMARTKQTARKSTGGKAPRKQLATKAARKYQKSTELLIRKLPFQRLVREIAQDFKTDLRFQSSAVSALQEAAESYLVGLFEDTNLCAIHAKRVTIMPKDIQLARRIRGERA

SEQ ID NO: 133155 - protein, 134 aa, Triticum aestivum
  Clone ID: PAT_TA_27573.pep
HASGSRHLSSPPKSIRSHPPARGSKKEAASTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 133156 - protein, 215 aa, Triticum aestivum
  unsure (1)..(215): unsure at all Xaa locations
  Clone ID: PAT_TA_27574.pep
MFADTQLSQSRIKDALMRKRITGGVLDSNSLRTLKDRRDLFYPFSLILHNSKPVGHQDLVGLVISILLLADFSLVLLTFLQLYSYSMVDVLLVLFILPLGILSPFPAGINALFSHGPRRSAGLARVYALWNITSLVNVVVAFICGFVHYKSSTKTHPSLQPWNLGTDESGWWLFPTGLMVFEXCFKARLVDWHVANLRIQDRAVYSNDPNIFWQS

SEQ ID NO: 133157 - protein, 202 aa, Triticum aestivum
  Clone ID: PAT_TA_27575.pep
HASASDATSGGPSGSAQVIDGKKDKIVLLKGRARVDSNISDSSTPQQSLPPPRNTPPSTSRQDQRNEASVRIIKTILSNKEGRHAIASSQHEQEGHIISAEKDKRPPRAPNSRSTVKDQTVENAEKNHYDDKHLHGSGPIGEKIERHARNRDRPDRGVWAPRRYDKSASGGSTQASSSEFPLMQSHSMDNFSQQVDGHGERK

SEQ ID NO: 133158 - protein, 115 aa, Triticum aestivum
  unsure (1)..(115): unsure at all Xaa locations
  Clone ID: PAT_TA_27576.pep
MARTKQTARKSTGGKAPRKQLXPGTVALREIRKYQKSTELLIRKLPFQRLVREIAQDFKTDLRFQSSAVSALQEAAESYLVGLFEDTNLCAIHAKRVTIMPKDIQLARRIRGERA

SEQ ID NO: 133159 - protein, 154 aa, Triticum aestivum
  unsure (1)..(154): unsure at all Xaa locations
  Clone ID: PAT_TA_27577.pep
ATYCTSAEVANSHNPHHRSPQPHPKQQPWPPRQTRSRRPRYPFSLILHNSKPVGHXXLVGLVISILLLADFSLVLLTFLQLYSYSMADVLLVLFVLPLAILSPFPAGINALFSHGPRRSAGLARVYALWNITSLVNVVVALICGFVLPRAWHSA

SEQ ID NO: 133160 - protein, 235 aa, Triticum aestivum
  unsure (1)..(235): unsure at all Xaa locations
  Clone ID: PAT_TA_27578.pep
MEGSTGNSPAPPPAFRNRYWILRHGRSVPNERGLIVSSLENGTKPEFGLAPQGVEQARSAGESLRKELEEMGVPVDSVKICYSPFSRTTETARVVAGVLGVPFEGPSCKATVELRERYFGPSYELLSHEKYAEVWAIDEADPFLAPEGGESVADVASRLAGVLSSADVEFHGSAVLIVSHGDPLQIFQAVLSGAKENPSFLDDASGLRKESLVISSVLSQHRKFALNXAELRRVV

SEQ ID NO: 133161 - protein, 109 aa, Triticum aestivum
  Clone ID: PAT_TA_27579.pep
PQDYLLISLVLLEQHDLIRYKGFVMPGSSFLLLPCNGGGGCVVWHRLQKQPWATEEGMLSVFLKAVLFVPSPNYGCLASLACCSYHYGSPTSLACCEFGMFMMGAGASL

SEQ ID NO: 133162 - protein, 156 aa, Triticum aestivum
  Clone ID: PAT_TA_27580.pep
MEVSGAAAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTSEKEGKEPKSPKKATKSPKKATKA

SEQ ID NO: 133163 - protein, 59 aa, Triticum aestivum
  Clone ID: PAT_TA_27581.pep
SSNYPVVVLKHLTAHHTTISCQGPELIIRSLKLDWVICAPAAFLGCGSRFSGSLSGIEP

SEQ ID NO: 133164 - protein, 140 aa, Triticum aestivum
  unsure (1)..(140): unsure at all Xaa locations
  Clone ID: PAT_TA_27582.pep
GIRHEGKPAAEKPKATTIRKRAPAQSKGMKQKVMEEILKPTDDSNLSAPSPEKKVRRIRSSPFNKKSGSLLQRAAGASTGAEDAEAPPSGMXSAEPVAPRRTVRERKVAIVYADSGSDDVEESEDEDASEPSESDYSDED

SEQ ID NO: 133165 - protein, 126 aa, Triticum aestivum
  Clone ID: PAT_TA_27583.pep
VPLQIHPIQSARSQLQGRRKPSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 133166 - protein, 68 aa, Triticum aestivum
  Clone ID: PAT_TA_27584.pep
EESGGQGGAVGLGALVPSTSGGSSDKSSVVQSFSPSTPPATSSSYRAGNKRRKGIPHRSPFGSLIVEY

SEQ ID NO: 133167 - protein, 149 aa, Triticum aestivum
  Clone ID: PAT_TA_27585.pep
MAAVLTRPTPGTVQCFGRKKTAVAVAYTKPGRGLIKVNGAPIELIRPEMLRLKAFEPIMLAGRSRFKDIDMRIRVRGGGKTSQIYAIRQAVAKALVAYYQKYVDEAAKKEVKDIFARYDRTLLVADPRRCEPKKFGGRGARARFQKSYR

SEQ ID NO: 133168 - protein, 205 aa, Triticum aestivum
  unsure (1)..(205): unsure at all Xaa locations
  Clone ID: PAT_TA_27586.pep
MKGSTGKSPAAAPPAFRNRYWILRHGRSVPNERGLIVSSLENGTKPEFGLAPQGVEQARSAGESLRKELEEMGVPVDSVKIRYSPFSRTTETARVVAGVLGVPFEGPSCKVTVELRERYFGPSYELLSHEKYAEVWAIDEADPFLAPEGGESVADVASRLAGVLSSAEVEFHGSAVLXVSHGDXMQIFQAVLNGAKENHLSDEEL

SEQ ID NO: 133169 - protein, 142 aa, Triticum aestivum
  Clone ID: PAT_TA_27587.pep
MEVEKKTKGRKPAAEKPKTTIRKRAPAQTKGMRQKVMEEIFKPTDDSTLSAPSPEKKVRRIRDSPFNKKSGSVLHRMASSSTGTEDAEAPPSGSSAEPVVPRRTTRERKAAVVYVASESEDDESEDEDVSEPSDDDDFSEDD

SEQ ID NO: 133170 - protein, 280 aa, Triticum aestivum
  Clone ID: PAT_TA_27588.pep
LEACEAGSVFEGLLPNDIGVYATTASNAEESSWGTYCPGEYPSPPSEYDTCLGDLYSISWMEDSDVHNLRTESLKQQYDLVKKRTAAQDSYSYGSHVMQYGSLDLNDQHLFLYIGSNPANDNTTFVEDNSLPSFSRAVNQRDADLVYFWHKYQKLAESSPEKNDARKQLLEMMGHRSHIDNSVELIGNLLFGFADGPMVLNTIRPAGEPLADDWSCLKSTVRAFESQCGSLAQYGMKHMRSFANICNAGILPEAMVKVAAQACTSIPTNPWSATHRGFSA

SEQ ID NO: 133171 - protein, 327 aa, Triticum aestivum
  Clone ID: PAT_TA_27589.pep
FPSSDSVLTSLMSQAVQPWIWHRLVAGLNAQLRLVRRGNLKATFLPVLNWLETHADPALGVNGVRVDLAWFQATALGYCQLGLVVYTVEGEPVTAELDGSPRIKIEQHSPVQDMLADAQLSRSRIKDALMRKRITGGILDSTTLRTLKDRRDFLYPFSLILHNSKPVGHQDLVGLVISILLLADFSLVLLTFLQLYSYSMADVLLVLFVLPLAILSPFPAGINALFSHGPRRSAGLARVYALWNITSLVNVVVALICGFVHYKSSTKRHPSTQPWNLGTDESGWWLFPTGLMLLKCIQARLVDWHVGNLEIQDQAVYSKDPNIFWQS

SEQ ID NO: 133172 - protein, 157 aa, Triticum aestivum
  unsure (1)..(157): unsure at all Xaa locations
  Clone ID: PAT_TA_27590.pep
MEASGAAAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAXGVTIAHGGVIPKINPVLLPKRTAEKEGKEPKSPKKATKSPKKTTKA

SEQ ID NO: 133173 - protein, 193 aa, Triticum aestivum
  unsure (1)..(193): unsure at all Xaa locations
  Clone ID: PAT_TA_27591.pep
RPAPITWFPVMQYGSLDLXAEHLFSYIGSNPANENTTFVEDNALPSFSRAVNQRDADLVYFWQKYRKLAESSPEKNDARKQLLEMMGHRSHIDNSIELIGNLLFGSAGGPMVLKAVRPAGEPLVDDWSCLKSTVRTFESQCGSLAQYGMKHMRPFANICNAGIVPEATAKVAAQACTSIPTNPWSATHKGFSA

SEQ ID NO: 133174 - protein, 148 aa, Triticum aestivum
  Clone ID: PAT_TA_27592.pep
ATYCTSAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKSPKKATKSPKKATKA

SEQ ID NO: 133175 - protein, 149 aa, Triticum aestivum; identical to SEQ ID NO: 133167
  Clone ID: PAT_TA_27593.pep

SEQ ID NO: 133176 - protein, 69 aa, Triticum aestivum
  Clone ID: PAT_TA_27594.pep
MADWAPVVVGVVLFILLSPGLLLEMPGSHRHVDFGGLHTNGKAIFVHTILFFAAFTVLTLALHIHIYAG

SEQ ID NO: 133177 - protein, 89 aa, Triticum aestivum
  Clone ID: PAT_TA_27595.pep
MEVEIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 133178 - protein, 214 aa, Triticum aestivum
  Clone ID: PAT_TA_27596.pep
RHEGDAHNLNAESLKQQYERVRDRTSANGTYSLGSHVMQYGDLGLNDQSLFLFIGTNPANDNASFLQGSSSTSRQLPGGRVNQRDADLVHFWHKYRRSAEGSAEKGEARRRLVETMARRSRVDSSVELIGGLLFGSEEGAKVLGAVRPAGQPVVDDWDCLKSVVWTFQQRCGPLTQYGMKHMRSLANLCNAGVREEAMDKAASQACAANPSSLF

SEQ ID NO: 133179 - protein, 136 aa, Triticum aestivum; identical to SEQ ID NO: 106789
  Clone ID: PAT_TA_27597.pep

SEQ ID NO: 133180 - protein, 69 aa, Triticum aestivum
  Clone ID: PAT_TA_27598.pep
MADWAPVVVGVVLFVLLSPGLLFEMPGSHRHVDFGGLHTNGKAIFVHTLLFFAAFTILTLALHIHIYAG

SEQ ID NO: 133181 - protein, 136 aa, Triticum aestivum; identical to SEQ ID NO: 106789
  Clone ID: PAT_TA_27599.pep

SEQ ID NO: 133182 - protein, 138 aa, Triticum aestivum
  unsure (1)..(138): unsure at all Xaa locations
  Clone ID: PAT_TA_27600.pep
MARTKQTARKSTGGKAPRKQLATKAARKSAPATGGVKKPHRFRPGTVALREIRKYQKSTELLIRKLPFQRLVREIAQDFKTDLRFQSSAVSGXLRRPAEAYLVGLFEDTNLCAIHAXKRVTIMPKDIQLARRIRGERA

SEQ ID NO: 133183 - protein, 411 aa, Triticum aestivum
  Clone ID: PAT_TA_27601.pep
RTRGRTRGLDLFQELQKKNYTPFPKKKPTSGPVAVGSTEADEDNDESPAEAAASDYEYLLAMSIGTLTMEKVKELIAQQNKVEADLEILRNTEPKTLWLRDLDALEKELDVLDAKLEAEQNDRSRKRAKNSEKARDPKPATKKQPKKATAKSQKAGSDDDVDYKGDILKPAAQKKKPPPKKASAPVKDEVKDEEDEVAELKDRLAAYNIHSDNSPEPSAMETEEHQEGKKGRNGPSKRGAAKKAMSSLAEISDEDIAEPHHESEDGGSSMEVEKKTKGRKPAAEKPKTTIRKRAPTQSKGMRQKVMEEIFKPTDDSTLSAPSPEKKVRRIRDSPFNKKSGSVLHRMASSSTGTEDAEAPPSGSSAETVVPRRTTRERKAAVVYVASESEDDESEDEDVSEPSDDDDFSEDD

SEQ ID NO: 133184 - protein, 180 aa, Triticum aestivum
  Clone ID: PAT_TA_27602.pep
MMAKCDPRHGKYMACCLMYYKGLGTSTAQEGRDYFEDITHHKKDFVWADDKEDGEAIELAFSKKKIAERKDWLTNYQPGACLDQREKRIKYKGFVMPGSSFLLLPCNGGGGCVVWHRLQKQPWATEEGMLSVFLKAVLFVPSPNYGCLASLACCSYHYGSPTSLACCEFGMFMMGASASL

SEQ ID NO: 133185 - protein, 136 aa, Triticum aestivum; identical to SEQ ID NO: 106789
  Clone ID: PAT_TA_27603.pep

SEQ ID NO: 133186 - protein, 249 aa, Triticum aestivum
  Clone ID: PAT_TA_27604.pep
MAIDHASPLALKSGGAATGGAGRDEEAGSQRWPPWLKPLLATSFFVQCRAHADAHKSECNMYCLDCINGALCSLCLAHHRDHHAIQIRRSSYHDVIRVSEIQRVLDITGVQTYIINSARVVFLNERPQPRPGKGVTNTCEVCERSLLDSFRFCSLGCKIVGTSGGHRPRKKHGGVGGGGKKKRAAVKDARSDSEHSCTSTSGGSSDRSSVVQSFSPSTPPATSSSYRAGNKRRKGIPHRSPFGSLIVEY

SEQ ID NO: 133187 - protein, 200 aa, Triticum aestivum
  Clone ID: PAT_TA_27605.pep
LESKGETNFQVCTLGKDVVITKKMVSIGMEKKLEHQRVFTPSVVEPSFGLGRIIYCLFEHSFYTRPSKSEEEQLNVFRFPPIVAPIKCTVFPLVKNQEFDDAAKVLAKELTAAGISHIIDTTGISIGRRYARTDEIGVPFAVTVDSATEVTIRERDSKQQVRVGIDEVASVVKELTEGQSTWTDISFKYPSHIGPQGDQE

SEQ ID NO: 133188 - protein, 476 aa, Triticum aestivum
  unsure (1)..(476): unsure at all Xaa locations
  Clone ID: PAT_TA_27606.pep
MARLSCSPLLLLLLVLSSQLALLVAGEFLRLPSEKDVVGTRWAVLIAGSNGYYNYRHQADVCHAYQIMKKGGLKDENIIVFMYDDIAGSRDNPRPGVIINHPKGGDVYAGVPKDYTGADVNANNFLAALLGDKSKLTGSGSGKVVSSGPDDHIFVYYADHGGPGILGMPGDEEYLYANELWCXTLEKKHAGGAGYKSLVFYLEACESGSIFEGLLPGNIGVYATTAANAEESSWGTYCPGDDEGAPPPEYDTCLGDLYSVAWMEDSEXHNLNAESLKQQYERVRDRTSAAGTYSLGSHVMQYGDLDLNDQSLFLYIGTNPANDNASFVQGSSSTSRQLPGGRVNQRDADLVHFWHKYRRSAEGSAKKGEARRRLVETMARRSRVDSSVELIGGLLFGSEQGAKVLGAVRPAGQPVVDDWDCLKSVVRRFQERCGPLTQYGMKHMRSLANLCNAGVREEAMDKAAAQACAANPSSLF

SEQ ID NO: 133189 - protein, 247 aa, Triticum aestivum
  unsure (1)..(247): unsure at all Xaa locations
  Clone ID: PAT_TA_27607.pep
MAFHDEAPLLLRINTARGGHMGGGECDEAENQRWPPWLKPLLATSFFGQCKMHADAHKCECNMYCLDCVNGALCSQCLAYHHGHHAIQIRRSSXYHDVIRVSEIQKVLDITGVQTYIINSARVVFLNERPQPRPGKGVTNTCDVCERSLLDTFRFCSLGCKIVGTSGEFRGRKRHAGGKKMKLKLKKAAASDSDDSSTITSGGSDKSSVVQSFSPSTPPATANSYRSAKRRKGIPHRSPFGSLIVEF

SEQ ID NO: 133190 - protein, 155 aa, Triticum aestivum
  Clone ID: PAT_TA_27608.pep
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKKTTKSPKKATKA

SEQ ID NO: 133191 - protein, 238 aa, Triticum aestivum
  unsure (1)..(238): unsure at all Xaa locations
  Clone ID: PAT_TA_27609.pep
MRECISIHIGQAGIQVENACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHXSFLSTLEVSILLDNEAIYDFCRRSLDMXRPTYTTLKGLVLKAFHA

SEQ ID NO: 133192 - protein, 104 aa, Triticum aestivum
  unsure (1)..(104): unsure at all Xaa locations
  Clone ID: PAT_TA_27610.pep
DKKXXEDAIDAAIQWLDTNQLAEADEFEDKMKELEALCNPIIAKMWLIKVNGAPIELIRPEMLRLKAFEPIMLAGRGTESSFRPWTRSSRPASWGWTRQWRGGM

SEQ ID NO: 133193 - protein, 136 aa, Triticum aestivum; identical to SEQ ID NO: 106789
  Clone ID: PAT_TA_27611.pep

SEQ ID NO: 133194 - protein, 246 aa, Triticum aestivum
  Clone ID: PAT_TA_27612.pep
MAFHDEAPLLLRINTARGGHMGGGECDEAENQRWPPWLKPLLATSFFGQCKMHADAHKCECNMYCLDCVNGALCSQCLAYHHGHHAIQIRRSSYHDVIRVSEIQKVLDITGVQTYIINSARVVFLNERPQPRPGKGVTNTCDVCERSLLDTFRFCSLGCKIVGTSGEFRGRKRHAGGKKMKLKLKKAAASYSDDSSTITSGGSDKSSVVQSFSPSTPPATANSYRSAKRRKGIPHRSPFGSLIVEF

SEQ ID NO: 133195 - protein, 69 aa, Triticum aestivum; identical to SEQ ID NO: 133180
  Clone ID: PAT_TA_27613.pep

SEQ ID NO: 133196 - protein, 393 aa, Triticum aestivum
  unsure (1)..(393): unsure at all Xaa locations
  Clone ID: PAT_TA_27614.pep
RLKSALIWVVASAVVCGLVLGILYALIGKVDFTVRHLSSSVQAFPNPNQFGAFTSGQPCIAPLTRQCSANTAPPNSQTTWTMRATFPEYVVALATIDGSVLFTIFGGVGIACLPLSLIFSFVRRPKAVITRSQYIKEATELGKKAKEXLKKAAEALHQEERSGNKGRKWRKNVKAVEKELLLLENDMNALEEMYPQGEKAEATWAFTVLAYIGKLIFGIVGLIVSIAWVAHIIIYLLVDPPLSSFLNEIFIKLDSVWGLLGTAAFAFFCFYLLIAVIAGEMMLXGLKLVFITIHPMKWGGTLMNSFLFNVGLILLCSISVIQFCATAFAYYAQATAAQEIFGHTLQSLRGIKYLYKYNVFQYGFVALAILTLFYYALFGWRKRKPTGRFQLSS

SEQ ID NO: 133197 - protein, 389 aa, Triticum aestivum
  Clone ID: PAT_TA_27615.pep
HASEEKPTSGPVAVGSTEADEDNDESPAEAAASDYEYLLAMSIGTLTMEKVKELIAQQDKVKADLEILRNTEPNTLWLRDLDALEKELDVLDAKLEAEQNDRSRKRAKNSEKAKDSRPAPKKQPKKATAKSQKAGSDDDVDYKGDIPKPAAQKKKPPPKKASAPVKDEVKDEEDEVAELKDRLAAYNIDSDNSPEPSAMETEEQQKGKKGRNGPSKRGAAKKAMSSLAEISDEDIAEPDRESDDGGSSMEVEKKTKGRKPAAEKPKTTIRKRAPAQTKGMRQKVMEEIFKPTDDSTLSAPSPEKKVRRIRDSPFNKKSGSVLHRMASASTGTEDGEAPPSGSSAEPVAPRRTTRERKAAVVYVASESEDDETEDEDVSEPSDDDFSEDD

SEQ ID NO: 133198 - protein, 149 aa, Triticum aestivum; identical to SEQ ID NO: 133167
  Clone ID: PAT_TA_27616.pep

SEQ ID NO: 133199 - protein, 156 aa, Triticum aestivum
  Clone ID: PAT_TA_27617.pep
MDVSGAAAKGKKGAAGRKAGGPRKKSVTRSVKAGLQFPVGRIGRYLKKGRYAPRVGTGAPVYLAAVLEYLAAELLELAGNAAKDNKKSRIIPRHLLLAVRNDEELGKLLAGVTIAHGGVIPKINPVLLPKKTAEKEGKEPKSPKKAAKSPKKATKA

SEQ ID NO: 133200 - protein, 309 aa, Triticum aestivum
  Clone ID: PAT_TA_27618.pep
TNPYVYGDDLVDVLKKKHAAGSYKSLVFYLEACEAGSVFEGLLPNDIGVYATTASNAEESSWGTYCPGEYPSPPPEYDTCLGDLYSISWMEDSDVHNLRTESLKQQYDLVKKRTAAQDSYSYGSHVMQYGSLDLNDQHLFLYIGSNPANDNTTFVEDNSLPSFSRAVNQRDADLVYFWRKYQKLAESSPEKNDARKQLLEMMGHRSHIDNSVELIGDLLFGFADGPMVLKTVRPAGEPLADDWSCLKSTVRAFESQCGSLAQYGMKHMRSFANICNAGILPEAMVKMAAQACTSIPTNPWSATHNGFSA

SEQ ID NO: 133201 - protein, 471 aa, Triticum aestivum
  Clone ID: PAT_TA_27619.pep
TRPVVVLGITVAVLSILMLPADVANRQACRRAVYSGACALTLPMKTLWLVVYIADAVLVFLVIPFAMFYYEGDQDKSVGKRLKSALIWVVASAVVCGLVLGILYALIGKVDFTVRHLSSSVQAFPNPNQFSAFTSGQPCIAPLTRQCSANTAPPNSQTTWTMRATFPEYVVALATIVGSVLFTIFGGVGIACLPLSLIFSFVRRPKAVITRSQYIKEATELGKKAKELKKAAEALHQEERSGNKGRKWRKNVKAVEKELLLLENDMNALEEMYPQGEKAEATWAFTVLAYIGKLIFGIVGLIVSIACVAHIIIYLLVDPPLSSFLNEIFIKLDSVWGLLGTAAFAFFCFYLLIAVIAGEMMLGLKLVFITIHPMKWGGTLMNSFLFNVGLILLCSISVIQFCATAFAYYAQATAAQEIFGHTLQSLRGIKYLYKYNVFQYGFVALAILTLFYYALFGWRKRKPTGRFQLSS

SEQ ID NO: 133202 - protein, 247 aa, Triticum aestivum
  unsure (1)..(247): unsure at all Xaa locations
  Clone ID: PAT_TA_27620.pep
MAFHDEAPLLLRINTARGGHMGGGECDEAENQRWPPWLKPLLATSFFGQCKMHADAHKCECNMYCLDCINGXLCSQCLAYHHGPXHAIQIRRSSYHDVIRVSEIQKVLDITGVQTYIINSARVVFLNERPQPRPGKGVTNTCDVCERSLLDTFRFCSLGCKIVGTSGEFRGRKRHAGGKKMKLKLKKAAASDSDDSSTITSGGSDKSSVVQSFSPSTPPATANSYRSSKRRKGIPHRSPFGNLIVEF

SEQ ID NO: 133203 - protein, 355 aa, Triticum aestivum
  Clone ID: PAT_TA_27621.pep
RRVASEQHGRIKELTDELSRKDQEIEGLMQALDEEEKELEVLENKSNDLEQMLQEKEFSLKSLEDSRTKALTKLATTVEKFDELHSLSESLLAEVESLQSQLQERDSEISFLRQEVTRSTNELLTTEDSNKQYSSQINDFVKWLETALMQFGVHCESADDHDYTQVPVYMDMLDKKIVSLISESDELRVAVQSKDSSLQVERTKMEELLRKSEALEASLSQKDSQIGMLRRDRTMGQPRSINLPGTSEIEQMNDKVSPAAAVTQIRGARKVNNDQVAIDVEMHKDKPLDDEDDDKAHGFKSLTMSRVVPKFTRPISDRIDGMWASGDRLLMRQPTLRLGVLIYWIALHALLVSFI

SEQ ID NO: 133204 - protein, 158 aa, Triticum aestivum
  Clone ID: PAT_TA_27622.pep
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKSPKKTTKSPKKTTKA

SEQ ID NO: 133205 - protein, 944 aa, Triticum aestivum
  unsure (1)..(944): unsure at all Xaa locations
  Clone ID: PAT_TA_27623.pep
DGSHIKGLLINFIHKEWPSLLKVPSFLVEFITPIIKATKGKAVKSFYSMPDYEAWKESLAGNASSWTIKYYKGLGTSTAQEGRDYFEDITHHKKDFVWADDKEDGEAIELAFSKKKIAERKDWLTNYQPGTCLDQREKRIKYSDFINKELILFSMADLERSIPSMVDGFKPGQRKILFCSFKKNLVKESKVAQFIGYVSEHSAYHHGEQSLASTIIGMAQDFVGSNNINLLEPRGQFGTRNAGGKDAASARYIFTRLQPITRLIFPKDDDVLLNYLNEDGQSIEPSWYMPIIPMVLVNGSEGIGTGWSTYVPNYNPRDIIANLKRLLNGETIVPMVPWYRGFKGSLKETSSKATGVTYTITGVIEEVADTKLKITELPVRRWTTDYKEFLESMCPIPIKEKEKSKDKNKEKKKDKDKEKEKEKSKEPPLLEEIRSQCDHADVDFELILTEQNMNIAKQEGLEKKFKLTTTIGTTNMHLFDSNGKIRKYDTPEDVLKEFFDLRLDFYVRRKKVMLENMGIELLKYKNKVRFILAVISGDIIVNNRKRAELFQELKQKKYDPFPKKKPTAEPVAVGSTEVDEENDDGPAEAAASDYEYLLAMSIGTLTMEKVKELIAQQDKVEEDLNILSNTEPNTLWLRDLDALEKELDVLDAKLEAEQNDRSRKRAKNAKESNAAPKRQPKKAAAKSQKANLAGSDDEDFEPPKPKPAAQKKKPPPKKASAPVKDEEDDEVAHLKDRLAAYNLDDSSPEPSAMETEEQQKAKKGRNGPSKRGAAKKAMSSLAEPSDEDMAEPRHESEGGGSSMEVEKKTKGRKPAAEKPKATTIRKRAPAQSKVMKQKVMEEIFKPTDDSNLSAPSPEKKVRRIRSSPFNKKSGSLLQRAASAXQGQEDAEAPPSGSSAEPVAPRRTVRERKVTVVYADSGSEDDESEDEDASEPSESDYSGED

SEQ ID NO: 133206 - protein, 208 aa, Triticum aestivum
  Clone ID: PAT_TA_27624.pep
FGDYYSVLLLEDKILCCLDLFDITTVRATRGVYSEFLICELRFRGGFSALLPLDLAPDLTVDGIPPLQLRRRRHGFCFCSGGFVLGGGLHPPHDHRREHPVGHEVEEQHDGTDRDERGDVARYRRASRAPSLGERISLSSGGSARSRRARRGSFAPGRCGVAAAAPRRVPFQAGAAAEARRREPIVRVAASMETARCDIFELERFKLR

SEQ ID NO: 133207 - protein, 98 aa, Triticum aestivum
  Clone ID: PAT_TA_27625.pep
MASRLLAAASSSSSSSSSSPLARLISSRRMAGAADHHGSTKVNMWQEPLNPGNWKEEHFVLTSLAMWGAIIYGGLKAFGGKKEVKTEAGSAPAAAPAH

SEQ ID NO: 133208 - protein, 449 aa, Triticum aestivum
  unsure (1)..(449): unsure at all Xaa locations
  Clone ID: PAT_TA_27626.pep
HEAVVYSAGNDGPRPQTVEDTSPWVLTVAASKIDRSFPTVITLGNKQQMVGQSLYYQVKNINSSSHTARNFTKLICAQSCVPRHEVLHHIDVKGAILVCLNDNDAINPSDDFHHAAKYVVEGGGSGLXFAQYTTDTLSSTVAYCPGIACVIVDIYISRRICQYAFDSSSPTAKIEPTRTVMSKDVLASKVASFSSRGPSADYPAFIKPDVAAPGANILAAVGDSYVTKSGTSMAAPHAAGVAALLKALHPDWSPAAIKSAIVTTAHVTDGHGMPILAEGLPRKVADPFDYGGGNINPCGAAHPGLIYDIDPHDYNKFFQCANVKEGISAIASCNTTSMPEYNLNLPSISVPDFRSAITVSRTVTNVGELHSVYHVVVQSPTGVNMEVFPDVLVFDAANKVRKFEVKLSPIWNFQGGYTFGSITWQNDRQVVRIPVATRITIQDFYADVA

SEQ ID NO: 133209 - protein, 449 aa, Triticum aestivum
  unsure (1)..(449): unsure at all Xaa locations
  Clone ID: PAT_TA_27627.pep
MLNEDELRDAVLLVFANKQDLPNAMNAAEITDKLPFAAAQIGQAFRNEISPRQGLLRVREFTLAEIEHFVDPEDKSHPKFVDVADLEFLMFPRELQLSGESAKLTKLAEAVSKGTVNNEXTLGYFIGRVYLFLTRLGIDKSRLRFRQHLPNEMAHYAADCWDAEIECSYGWIECVGIADRSAYDLKAHSEKSGVPLVAHEKFSKPREVEKLFIVPSKKDLGLAFKGNQKMVVEALEAMSEKEAMDMKTALESKGETNFQVCTLGKDVVITKKMVSISMEKKLEHQRVFTPSVVEPSFGIGRIIYCLFEHSFYTRPSKSEEEQLNVFRFPPIVAPIKCTVFPLVKNQEFDGAAKVLAKELTAAGISHIIDTTGISIGRRYARTDEIGVPFAVTVDSATEVTIRERDSKQQVRVGIDEVASVVKELTEGQSTWTDISFKYPSHIGPQGDQE

SEQ ID NO: 133210 - protein, 158 aa, Triticum aestivum
  Clone ID: PAT_TA_27628.pep
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKSPKKATKSPKKTTKA

SEQ ID NO: 133211 - protein, 136 aa, Triticum aestivum; identical to SEQ ID NO: 112792
  Clone ID: PAT_TA_27629.pep

SEQ ID NO: 133212 - protein, 431 aa, Triticum aestivum
  unsure (1)..(431): unsure at all Xaa locations
  Clone ID: PAT_TA_27630.pep
MRECISIHIGQAGIQVGNACWELYCLEHGIQPDGQMPGDKTVGGGDDAFNTFFSVTGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMXVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 133213 - protein, 131 aa, Triticum aestivum
  Clone ID: PAT_TA_27631.pep
AGSGPYPPPPAFRLQTEDLRYHHQLSRHIAQLGRIEAMASRLLAAASSSSASSSPLARLISSRRMAGAADHHGSTKVNMWQEPLNPGNWKEEHFVLASLAMWGAIIYGGLKAFGGKKEVKTEAGPAAAPAH

SEQ ID NO: 133214 - protein, 89 aa, Triticum aestivum
  Clone ID: PAT_TA_27632.pep
LCQDDIHEARHLQLSCRQHAGRRGRSRLHSCHQQQRRQDRHHRHLSGRHCLSSLPVPVPVVCSERERERERERERERERERERERERER

SEQ ID NO: 133215 - protein, 113 aa, Triticum aestivum
  Clone ID: PAT_TA_27633.pep
RICALQTHRPKVGRIEAMASRLLAAASSSSSSSSPLARLISSRRMAGAADHHGSTKVNMWQEPLNPGNWKEEHFVLTSLAMWGAIIYGGLKVFGGKKEVKTEAGSAPAAAPAH

SEQ ID NO: 133216 - protein, 452 aa, Triticum aestivum
  unsure (1)..(452): unsure at all Xaa locations
  Clone ID: PAT_TA_27634.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAXKRAFVHWYVGEGMEEGEFSEAREDLAALEKDYEEVGAEFDEGEDGDEGDEY

SEQ ID NO: 133217 - protein, 297 aa, Triticum aestivum
  Clone ID: PAT_TA_27635.pep
ERLSVDYGKKSKLGFTVYPSPQVSTSVVEPYNSVLSTHSLLEHTDVSILLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 133218 - protein, 451 aa, Triticum aestivum
  Clone ID: PAT_TA_27636.pep
MRECISIHIGQAGIQVGNACWELYCLEHGIQPDGQMPGDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 133219 - protein, 387 aa, Triticum aestivum
  unsure (1)..(387): unsure at all Xaa locations
  Clone ID: PAT_TA_27637.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPTYTNLNRLVSQVISSLTAXSLRFDGALNVDVNEFQTNLVPYPRIHFMLSSYAPVISAEKAYHEQLSVAEITNSAFEPSSMMAKCDPRHGKYMACCLMYRGDVXVPKDVNAAVAPSKTKRTIICLTGCPTGSKCGYKLTXPPSVXPSGDLSKAQRLFSYPLPQCPG

SEQ ID NO: 133220 - protein, 451 aa, Triticum aestivum; identical to SEQ ID NO: 133218
  Clone ID: PAT_TA_27638.pep

SEQ ID NO: 133221 - protein, 496 aa, Triticum aestivum
  unsure (1)..(496): unsure at all Xaa locations
  Clone ID: PAT_TA_27639.pep
MAMASFRPLPLALLLAACLSALVLAVAHARTLRLEPTIRLPSQRAAGQEDDDSVGTRWAVLIAGSNGYYNYRHQADICHAYQIMKKGGLKDENIIIFMYDDIAHNPENPRPGVIINHPQGGDVYAGVPKDYTGKEVNVKNFFAVLLGNRTAVSGGSGKVVDSGPNDHIFVFYSDHGGPGVLGMPTYPYLYGDDLVDVLKKKHAAGTYKSLVFYLEACESGSIFEGLLPNDIGVYATTASNAEESSWGTYCPGEYPSPPSEYDTCLGDLYSISWXMEDSDVHNLRTESLKQASITWVKKRTAAQDSYSYGSHVMQYGSLDLNAEXICSPYNGSNPANENTTFVEDNALPSFSRAVNQRDADLVYFWQKYRKLAESSPEKKDARKQLLEMMGHRSHIDNSVELIGNLLFGSVGGPMVLKAVRPAGEPLVDDWSCLKSTVRTFESQCGSLAQYGMKHMRSFANICNVGIVPEAMAKVAAQACTSIPTNPWSATHKGFSA

SEQ ID NO: 133222 - protein, 170 aa, Triticum aestivum
  Clone ID: PAT_TA_27640.pep
MVKYSTDPANPTKSAKAMGRDLRVHFKNTRETAFALRKMSLNKAKRYLEDVLAHKQAIPFRRYCRGVGRTAQVKNRQPNGQGRWPAKSAKFVLDLLKNAESNAEVKGLDVDALYISHIQVNQAQKQRRRTYRAHGRINPYMSNPCHIELILSEKEEPVKKEAESQIARKA

SEQ ID NO: 133223 - protein, 170 aa, Triticum aestivum; identical to SEQ ID NO: 133222
  Clone ID: PAT_TA_27641.pep

SEQ ID NO: 133224 - protein, 170 aa, Triticum aestivum
  Clone ID: PAT_TA_27642.pep
MVKYSTDPANPTKSAKAMGRDLRVHFKNTRETALALRKMSLNKAKRYLEDVLAHKQAIPFRRYCRGVGRTAQVKNRQPNGQGRWPAKSAKFVLDLLKNAESNAEVKGLDVDALYISHIQVNQAQKQRRRTYRAHGRINPYMSNPCHIELILSEKEEPVKKEAESQIARKA

SEQ ID NO: 133225 - protein, 132 aa, Triticum aestivum
  Clone ID: PAT_TA_27643.pep
WQLWSRLRPRRPACWRQESCRCLASWMSSWQSQSWLASQQAVFACFVLWIAAVTAVVYILPGFATARGVRNELHVCVHFITSLSRICVTINRVLRSIPSLLLMINKLCSSIESVSLLACTVRYVLCMSSRVV

SEQ ID NO: 133226 - protein, 114 aa, Triticum aestivum
  unsure (1)..(114): unsure at all Xaa locations
  Clone ID: PAT_TA_27644.pep
PRQXXLRVREFTXAEIEHFVDXEDKSHPKFVDVADLEFLMFPRELQLSGESAKLTKLAIHVENQVGQYILKRIAPALILHLDKEICDLLETSQGRRESGQPTTAVGRVALMLEE

SEQ ID NO: 133227 - protein, 452 aa, Triticum aestivum
  unsure (1)..(452): unsure at all Xaa locations
  Clone ID: PAT_TA_27645.pep
MRECISIHIGQAGIQVGNACWELYCLEHGIQPDGQMPGDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPXRHGKYMACCLMYRGDVVPKDVNAAVATIKTKRTIQFVDWCPTGFKCGINYQPPSVVPGGDLAKVXRAVCMISNSTSVVEVFSRIDHKFDLMYAKRAFVHWYVGEGMEEGEFSEAREDLAALEKDYEEVGAEFDEGEDGDEGDEY

SEQ ID NO: 133228 - protein, 432 aa, Triticum aestivum
  Clone ID: PAT_TA_27646.pep
YADSYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALENDYEEVGAEFDEGEDGDEGDEY

SEQ ID NO: 133229 - protein, 451 aa, Triticum aestivum
  Clone ID: PAT_TA_27647.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPGVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 133230 - protein, 56 aa, Triticum aestivum
  Clone ID: PAT_TA_27648.pep
PVKLVRGDGVRVSPVLNVTSIGTSVVNMLSHLLCDCGEKAGKQQSRGFGVRCWVTR

SEQ ID NO: 133231 - protein, 144 aa, Triticum aestivum
  unsure (1)..(144): unsure at all Xaa locations
  Clone ID: PAT_TA_27649.pep
NGHWKQNCXKYLADKKDGKVNKSIYDIHVIDVXLLVFIENPQVFDTGSVAKSSNSKRELQNKQRLVEGEMMMCVGSNSKVYKITXRTLPLPSGLVLNLXNKCYSVFALXHNMIGSFLLQYGYSFKSRNNCYSVYMNKPLIRLII

SEQ ID NO: 133232 - protein, 82 aa, Triticum aestivum
  Clone ID: PAT_TA_27650.pep
HASVSSSFSESDVRRCVHVGLLCVQGNPADRPVMSSVVMMLGGETVSLSAPSKPAFYARNAGADHPVISSTVSVQDGPGVSI

SEQ ID NO: 133233 - protein, 273 aa, Triticum aestivum
  Clone ID: PAT_TA_27651.pep
KADESPLPSATIPSSDNVLNTPRPSDNTTTAPATKPTQTNVYTSSNVDFDSDPSAYVKTKVQSLIYWEYPKKSAIFLAGSLGVLALTQYYSVLQILAGLFSLATGINWVYVNLHKQSQRVISNKQPQEIVNPHNHRLQAKTTYIPRERVLRVAHFTMDVAEVVTQHVTKLVLIEDSMRSFTAFVASFFVWILAKHVSTKNLLSTFILLAFSLPRLYLQHKEVVDAHVAKHSHTARLLAEQYGNLANQKLREVVGQVKSRIRPEKVSVETKKTE

SEQ ID NO: 133234 - protein, 87 aa, Triticum aestivum
  Clone ID: PAT_TA_27652.pep
DGDVDQVDIMQSRPDAAAGEGGMAPTGEWVPMTESWGSIWRMDTRRPMQGPFSLRITNESGKTLVADQVIPADWEPNEIYSSIIQFD

SEQ ID NO: 133235 - protein, 225 aa, Triticum aestivum
  Clone ID: PAT_TA_27653.pep
MKSIVAAIAALAITMVSAQSTNIVTPHAPTLNQVLTAGETTTITWTPIAGFDTISTIDLLQGASSALTPVTGGHVASNVASSLGSYSWTVPSTLPAGSDYALSFGSSPNVSYTPYFTIQAASGTSGSSSSAVSSSAAPSSSAAASSSAASSPAASSSVAASSSAASTPASSSSAAAVSSHASKPASSSPAAASSSAASVSTSAGNKNVAAVGIMAAAGAVVAALI

SEQ ID NO: 133236 - protein, 483 aa, Triticum aestivum
  unsure (1)..(483): unsure at all Xaa locations
  Clone ID: PAT_TA_27654.pep
MNNIFVFVIILLLPLFTLGCLRRRTNQSPLLPPGPPALPIIGHLYLFRGPLHPXAAEECLGVHDIVFANRPQLPTGKILSYDWSTMGTASYGDYWRHIRRIGVTELLSVHRVQQYADVHTRMARSMARRLYRSAAGGRARVELKSRLFEMLMNVMTSMICARTYYGTYRWRGDIXEVTDEVQWFRTMVEETMTLIGASTVWDYIPTLVRWLDIGGFGRRLWRLRESRTKFVQGLIEDERKKMEDGTTTGRTMIAALLSLQHKDPEDCPDQLIRALCIVSISLXNLRNIXTVEWAMSLMLNNPKVMVKVRDEIDSYIGKPIRLIEASDLPKVAXYFRCITXETLRLHPPTPLLVPQEPPIDCTVSGFYIPKGTMLLVNTSAIHRDPKIWDKPTNFIPERFEGEKCEGNMAMPFGMGRRRCPAENLGMQMVGLALGTMIQCFEWERVGEELVDMTDGFGLTAPRAVPLEAFYKPRQSMVTLLSEI

SEQ ID NO: 133237 - protein, 72 aa, Triticum aestivum
  Clone ID: PAT_TA_27655.pep
TGPEFPGRPRVRVQLIEQFEPGVYVTLIQLRDGTKVPTRPFVSKRRFAEQQAEEWWRENQERVFRKYNHAPT

SEQ ID NO: 133238 - protein, 192 aa, Triticum aestivum
  Clone ID: PAT_TA_27656.pep
MQVKFIGLGFVIALVASVAANTSGSRAARAISKDSFSTTRRDVALSSKRFATAVRRRNNKHEVRSAEPDEEEPDEEEPKEDEPNEDEPNEEEPDEEEPKEEEPNEEEPDEEEPEEENPEGTENGEKKQKRGALKRREHGDSDKGEDDEPVKEEPNEEEPNEEEPNEEDPNEEEPNEEDPNKEEEEEEEEEEE

SEQ ID NO: 133239 - protein, 94 aa, Triticum aestivum
  Clone ID: PAT_TA_27657.pep
GEERVARARPAAVDGQHAHAAVVGAPERRARAGQAAGPSGAEQELALQQGEDLVAELVDVHGNRRRHGFHLSCEARYLHVLPGTSYRALCLYRS

SEQ ID NO: 133240 - protein, 107 aa, Triticum aestivum
  Clone ID: PAT_TA_27658.pep
PTRPPTRPMQHKQTKKIRLLMRRDKTLKVCANHYVESYMTLQPNVGSDRSWVWKVTADVSDGTPEAQTLAIRFANSDNANQFKEKFEEAKKNNEELKKDEDKEEKKD

SEQ ID NO: 133241 - protein, 235 aa, Triticum aestivum
  Clone ID: PAT_TA_27659.pep
MEFIHKGGVWWFLLLAMVLLAPATVGAEQEDGATTITTLHVEEEVGSRADDHGNDDCDIKCAYYQDLARRQFCVDQCHSQQHHHPSREDCELKCQHWQDPTRKELCVQQCMSFGLNLHVGGSSSVHERPHALEEEVGSRADDHGNDDCDDKCAYYQDLARRQFCVDQCHSQQHHHPSREDCELKCQHWQDPTRKELCVQQCMSFGLNLHVSGSSSVDEHLRGWEAVAGAIIEEVV

SEQ ID NO: 133242 - protein, 140 aa, Triticum aestivum
  Clone ID: PAT_TA_27660.pep
LEGGVWGFLLLAGVWRAPPTVGAEQEDGATTITTLHVEEEVASRPVEEGVDSRAIDRAYDHYHARRQFCVDQCHSQQHHHPSREDCELKCQHWQDPTRKELCVQQCMSFGLNLHVSGSSSVDEHLRGWEAVAGAIIEEVV

SEQ ID NO: 133243 - protein, 97 aa, Triticum aestivum
  Clone ID: PAT_TA_27661.pep
VSARAAKFCEHKGRQSVPGWCLKRSISGYWGRQKEWTGEFRDHTTFPIQRRRWSALRYTSTGHVSRVLHCLWLGYGSPTWLNLISPFMSSICVVNQW

SEQ ID NO: 133244 - protein, 130 aa, Triticum aestivum
  Clone ID: PAT_TA_27662.pep
RPVRVSIIVELRHERWRGVCFPVSCGIGGKVVMAMRGGHCHKEFHVRVFDKVRHRRQHGGESPASCVIGGEHGGESPASCGTGGKHAAASVPRRCARGEGAGGVALIEANDDDGSRRDKMAFAAVCVLHR

SEQ ID NO: 133245 - protein, 177 aa, Triticum aestivum
  Clone ID: PAT_TA_27663.pep
MMKYVMRKCYSITYVDNGVSYAPYWEQYSPWGRNWLHFRNHEKLWERQKAVRIDFYDNSRQGQIVQSSQDIFMMQMDVRGQYHNELGYVCMYEQQYYDYWNKKSGIHMGNSNQRDPLMVVKDNIGNGYSYGLVTKPNTYYIARDTDDNKSVLTTHVRRWFRFNEIDSRNCEREIIRQ

SEQ ID NO: 133246 - protein, 131 aa, Triticum aestivum
  Clone ID: PAT_TA_27664.pep
KKAAQKSAKVDAAGQSRRVIPEFTASGIDDALDLLSLNDSSVKAKDIEKHPERRFKAAYAAFEERELPNFKRDNPGLRLSQLKELMYKAFQKSPENPFNQDNIVKYNASQDEAKSAKSERNKAIEDRLRTN

SEQ ID NO: 133247 - protein, 165 aa, Triticum aestivum
  Clone ID: PAT_TA_27665.pep
QRPPEAKTRLLVERHDWKTLLENDQLRGEVSSEGGTFKGWSEGAITFSPTYKYHRNSDAYYGCAQLGRKGDKLKRRAPAWCDRVLWRGVGLRQTRYDRCESRLSDHRPVRAAFSVEVDAPWNLNSLRSFFLSERFDDRAKSPADGLFLLREDDHTTTSARYAEDV

SEQ ID NO: 133248 - protein, 83 aa, Triticum aestivum
  Clone ID: PAT_TA_27666.pep
RAEPALQDFCVFQPGLSFDNQQVVYLLTSGEFRGDKTWVLALDLKNKTLVDVAEFDNETPLFSPVVYCHGSLSLFKPTSQGGA

SEQ ID NO: 133249 - protein, 471 aa, Triticum aestivum
  unsure (1)..(471): unsure at all Xaa locations
  Clone ID: PAT_TA_27667.pep
GSGWIQPIVSRDRLSRIEAELSLLKERQKGLTEQWEREKSVMTKIQSIKEEIDRLNVEIQQAEREYDLNRAAELKYGSLNALQRDLQKTEDELNEYQSSGKSMLREEVTQDDIAEIVSRWTGIPVSKLKQSDREKLLYLXKDELHKRVVXGQDPAVKAVAEAIQRSRAGLSDPNRPIASFMFMGPTGVXGKTELAKALASFMFNTEDAVVRIDMSEYMEKHSVSRLIGAPPGYVGYEEGGQLTEAVRRRPYSVVLFEEIEKAHSDVFNVFLQILDDGRVTDSQGRKVSFTNSIIIMTSNVGSQYILNMDEEGGATDSAYESMKKRVMDAARSVFRPEFMNRVDEYIVFKPLERKQINSIVKLQLARVQKRIADRKIKLDVSPAAIEFLGSLGYDPNYGARPVKRVLQQYVENELAKGILRGEFKDEDSISVDTQVTVPSNGKLPQQKLVFRKTNEESKPAAAQDEKFLPTV

SEQ ID NO: 133250 - protein, 142 aa, Triticum aestivum
  Clone ID: PAT_TA_27668.pep
PVVVLASAAPAAETSVVFSSEAATSSVTTADSLLAVAGTSGTDSSGSSALSRGVISSTAPVTASVEELSSSLLSTSVAETVGGSTAPVTASVEALSSSLLSTSVAETVAGSTVPPVTASVEELSSLLSISVGGSTSLSSTVL

SEQ ID NO: 133251 - protein, 74 aa, Triticum aestivum
  Clone ID: PAT_TA_27669.pep
FAAIQMHPKGLIVCDEDATLELHVKTVKYFKSIEHVHQSLIGPENLSLQGGVKQLKQFNYSARSSTPLNGPYDE

SEQ ID NO: 133252 - protein, 101 aa, Triticum aestivum
  Clone ID: PAT_TA_27670.pep
MASTKALFVLAVLLASAVLLAAAASEQTHDKEGKVDTNGAGVQDGWGGGGRGGGYPGRGGGGYGPCGRWGCCRRGYHGDCIRCCRAANDVPEAMDRTEVHN

SEQ ID NO: 133253 - protein, 293 aa, Triticum aestivum
  Clone ID: PAT_TA_27671.pep
PTRPVVDEWIKTEDGNDIFTKTWKAISTPIATLVLIHGFGEHVARYDRMCSYFASQGIECYAYDQRGWGETGKKSGQFGNNQGYDTALEDVNNAVIKMKRENIPLFLMGHSMGGGVILNYLSRSDKYKGVKLIDGSIASSPLVTLSMPIPAPKYYGLRMISNLLPNFTIQAGVDPNGISHDPEEVNKFRQDPLVHDYATLNTLKSMIDAGSDILKSRAKLIECPILYSHGDADPINSHTSCVKACELTRSKDKEMKSWAGLYHELHNETLSERQQILNYYLDWIKNRCPAIKQ

SEQ ID NO: 133254 - protein, 171 aa, Triticum aestivum
  unsure (1)..(171): unsure at all Xaa locations
  Clone ID: PAT_TA_27672.pep
MTSYIDFSKPSLWVSAASIVFNPTFWNIAAQQEYHNKVITKLFGGNPRLGCYALAVTIFSLGIFRDYLYNEALAEQPTHPTLLAPAIKYSAIPLFAMGNTLVLTSMWALGVTGTYLGDYFGILMDEPVTTFPFNVSSSPMYHGSAMSFLATAXLVGKPAGIFLTGIVHTAY

SEQ ID NO: 133255 - protein, 108 aa, Triticum aestivum
  Clone ID: PAT_TA_27673.pep
PACRSRLLSSSILLLPQPPPSPLPQFSHHRRRLSSHPCSQGLDVIGSVRGGMDEEARASEAGARKQRVLPEGAPTCQIFQLIGPRQGKNVGFGGGWNPLSPKDGVHDV

SEQ ID NO: 133256 - protein, 156 aa, Triticum aestivum
  Clone ID: PAT_TA_27674.pep
RIRGRVDHFSGPPPYSSPPPHPLPVLCFSKTASWCSAAAASELMVREPTSSMEAVARGSSSSSMEGGHLIGKVLELQIGVAVAITMQMQVVPKDLAKPKVQRWGCNLKKKETQIQVEKDAPPRDGNLETRRSVRLVKKKTKEQGRQQPIPCCLESA

SEQ ID NO: 133257 - protein, 182 aa, Triticum aestivum
  unsure (1)..(182): unsure at all Xaa locations
  Clone ID: PAT_TA_27675.pep
MAAAFSSTVGAPASTPTNFLGKKLKKQVTSAVNYHGKSSKANRFTSHGKRKTSDEKRNTDKWKGLRYDISDDQQDITXRXKGSVDSLXFQAPNXRTDQRAXLNSYDYSTKDPRIHXYNTWEXLXAXPSMDNLLSSXQKXMTCPNQXHHWVLGRKVKESSMQLPNGPIYETEMNPKHRTYLVY

SEQ ID NO: 133258 - protein, 121 aa, Triticum aestivum
  Clone ID: PAT_TA_27676.pep
ISFVDSPRLSSAPIDQWIKNILSRWHPKNLSFHRANVVNSAIPIISPPCNASTASDIRVQLLHHSSYGEQHFEVNFPPTSGTSKLSSSRMHKPPPSSNQTTSSQYQLKFNSEFLSYATSSS

SEQ ID NO: 133259 - protein, 106 aa, Triticum aestivum
  Clone ID: PAT_TA_27677.pep
MEAHRLADYVSGLALEKETKANFSRYQVSKNADDYTRSKPCRGAASVAPLLKGKVKEGACVVLLQLATRIAVSLHKNAKKSFSETIKDMYMHYNERSGLLLCGFQT

SEQ ID NO: 133260 - protein, 155 aa, Triticum aestivum
  Clone ID: PAT_TA_27678.pep
LVVQIYESPNCQHLLVSHFRLVFVFLADLVDHPHHPHSPHHHPHSHYQHTHSHPHSHYQPTKQILFPRALGTNCTCIMVAAATPICSSVTFPVKRTPSMLLPLPRATASVELVGSRSISYVAAAAEHHVAVLENRKWMGWRMRRTAGEVSALAGD

SEQ ID NO: 133261 - protein, 75 aa, Triticum aestivum
  unsure (1)..(75): unsure at all Xaa locations
  Clone ID: PAT_TA_27679.pep
MTKGTGSFGKRRNKTHTLCIRPXRKYNWSVKAIRRKTTGTGRMRYMRHVPRRFKSNFREGTEAAPRSKGASSSGN

SEQ ID NO: 133262 - protein, 132 aa, Triticum aestivum
  Clone ID: PAT_TA_27680.pep
MDASATGAGAKAKKGAAGRKAGGPRKKSVTRSVKAGLQFPVLEYLAAELLELAGNAAKDNKKSRIVPRHLLLAVRNDQELGRLLAGVTIAHGGVLPNINPVLLPKRTAEKEPKEGKSPKKTAKSPKKADKKA

SEQ ID NO: 133263 - protein, 90 aa, Triticum aestivum
  unsure (1)..(90): unsure at all Xaa locations
  Clone ID: PAT_TA_27681.pep
LGVPVWLFFPLSTTLPPGYYDGRYWTXLWKLPMFGCTDATQVXLNEVEEVKKEYPDAYVRVIGFDNLRQVQCVXSFIAFRPPGCEESGKA

SEQ ID NO: 133264 - protein, 193 aa, Triticum aestivum
  Clone ID: PAT_TA_27682.pep
VPPPVCGAAAAHKPHLLALLHISGQSPHFSGPPPHLLASTPSTSCPRLWQWSSAVAALLQDCSVVLGGCGNGADGARADQFNGGGSTGQRQQHGGRPLDWKEKVFVDSESEDNDGVSEDGEDAPSMHDQQEAQMQVEKETQIQVEKDAPPTDGNLETRRSVRLVKKKTKGVNSLYPLLRNLLANIFFLVFYDS

SEQ ID NO: 133265 - protein, 146 aa, Triticum aestivum
  unsure (1)..(146): unsure at all Xaa locations
  Clone ID: PAT_TA_27683.pep
MAEQTEKSFLKQPKVFLSTKKADKAKRPGKAGNRFWKSVGLGFKTXPFTGTVAIRGRIIAGTCHSAKMNRTIIVRRNYLHFVKKYQRYEKRHSNIPAHISPCFRVKEGDHVIIGQCRPLSKTVRFNVLKVVPAGTTGGGKKAFIAA

SEQ ID NO: 133266 - protein, 162 aa, Triticum aestivum
  unsure (1)..(162): unsure at all Xaa locations
  Clone ID: PAT_TA_27684.pep
MFIPPFQVGPPMACVVLLLMTAMDRTEEKTPGKAGTRFWKXVALGSKTPREAFDGTYIDKKCPFPGTVAIRGRIIAGTCHSAKMNRTIIVRRNYLHFVKKYQRYEKGHSNIPAHISPCFRVKEGDHVIIGQCRPLSKTVRFNVLKVVPAGTTGGGKKAFVAA

SEQ ID NO: 133267 - protein, 162 aa, Triticum aestivum
  Clone ID: PAT_TA_27685.pep
KHLQKTTISLFEASAPSFPTSKSFLISFAHVPFSIAKLLSLSPFQGLWEPLPFASWSPLPLLFAVPLPSQTRGRPPCCCRCPVLLPSWLARAPSASLPQPPSAMPLSWSSEWHELDGVEARRCGGRREASERVGRTPEKLRWRGCFCAQRRRRPQEEREEHF

SEQ ID NO: 133268 - protein, 162 aa, Triticum aestivum
  Clone ID: PAT_TA_27686.pep
VGLATDIAIRVKFPNDREPYSLGRASRVEVLDDEVLAADGVHDDRRPGDAGPGLEPLLRRLQPLLVGHSPWDGATEDLLLRNNVVAGVRDDTGADEAGDDVLASHWSFGSLLPGGGFGGAPRPRCCLFLVGAGAEFLQPGGSTSSRAAATAVELQLLFPLVG

SEQ ID NO: 133269 - protein, 87 aa, Triticum aestivum
  Clone ID: PAT_TA_27687.pep
IRGRIIAGTCHSAKMNRTIIVRRNYLHFVKKYQRYEKRHSNIPAHISPCFSVAIGRLRPLSKTVRFNVLKVVPAGTTGGGKKAFVAA

SEQ ID NO: 133270 - protein, 246 aa, Triticum aestivum
  unsure (1)..(246): unsure at all Xaa locations
  Clone ID: PAT_TA_27688.pep
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELTQQMWDSKNMMCAADPRHGRYLTASAMFRGKMSTKEVDEQMINVQNKNSSYFVEWIPNNVKSSVCDIAPRGLSMASTFIGNSTSIQEMFRRVSEQXTXMXXXKAFLNWYTVNNQMVNATLMNIADAPTNVQLGM

SEQ ID NO: 133271 - protein, 69 aa, Triticum aestivum
  Clone ID: PAT_TA_27689.pep
ILQLAFWTSLFHVNSGTIALTEQPKLLFFFYLSAAFLSLYIMQVPFTLLNRLPDLRFSIWILLTIYSHR

SEQ ID NO: 133272 - protein, 142 aa, Triticum aestivum
  unsure (1)..(142): unsure at all Xaa locations
  Clone ID: PAT_TA_27690.pep
MSVDKPDGGGVSSSPSLCWGGQGADKDKGLQEVKNSYASVDEYLGVFEPLLFEEGKPQILQGRRNEDEGEEEDEISLDXQRGVVRSSAESEGFHKLSMLETDGLRDIVSLPENVLLLLSKEKVSFMLAGSRQHPSQFSGYYI

SEQ ID NO: 133273 - protein, 298 aa, Triticum aestivum
  Clone ID: PAT_TA_27691.pep
TLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSSVCDIPPIGLKMSSTFIGNSTSIQEMFRRVSEQFTAMFRRKAFLHWYTGEGMDEMEFTEAESNMNDLVAEYQQYQDATAEDDEEYEEEEEEEHAD

SEQ ID NO: 133274 - protein, 112 aa, Triticum aestivum
  Clone ID: PAT_TA_27692.pep
MAPLQPKSGLFVGINKGHVVTKRELPPRPSDRKGKGTKRVLFVRNLIREVAGFAPYEKRITELLKVGKDKRALKVAKRKLGTHKRAKKKREEMSSVLRKMRSGGGGATDKKK

SEQ ID NO: 133275 - protein, 87 aa, Triticum aestivum
  Clone ID: PAT_TA_27693.pep
MESIDDYTRSKPCRDAASVAPLLPKGKVKEGACVVLLQLAARIVVSNLHKNAKKSFLKTIKDMYKHYNERSGLLLCGFQTWKCLSES

SEQ ID NO: 133276 - protein, 255 aa, Triticum aestivum
  Clone ID: PAT_TA_27694.pep
MGMAHVLLAAALAMVAAAATGSASPAEGIQPLWEIAMNKATVNLHGSACVRATPALLGDQEEDTVWVTVKYGWENPSADDWIAVFSPADFISGSCPNPSRYPGEPLLCTAPIKYQYANYSANYLYGGKGAIRFQLINQRSDFSFALFTGGLENPALVTVSKQVAFKNPKAPVFPRLAQGKTHDEMAVTWTSGYDIGEAYPFVEWGVVASGGNPTRTPAGTLTFTRGSMCGEPARTVGWRDPGFIHTAFMRGLWPN

SEQ ID NO: 133277 - protein, 84 aa, Triticum aestivum
  Clone ID: PAT_TA_27695.pep
ASSYSDRGLQRVCTKSIVSSSDNACMVDFHRYLKAYKRCWFHCQTIWSSPYSYYLPNIIAFIGSYDTLVEPNIREITNMIVFVL

SEQ ID NO: 133278 - protein, 81 aa, Triticum aestivum
  Clone ID: PAT_TA_27696.pep
AWSRPRYSNSLVRVTCRGIQECREKNKHANSSTQVHLCHKISTNQQRWRQKSSVSHKIGRQSSTNSYPICQSSLPARAAAR

SEQ ID NO: 133279 - protein, 79 aa, Triticum aestivum
  Clone ID: PAT_TA_27697.pep
RLTSGRHPESLFCMLENNNYHVGDFPDIWFYKCVIWTNERKYIPEIITIWATPNGLTVEPTPFIGLQVPVEVYHASIIR

SEQ ID NO: 133280 - protein, 120 aa, Triticum aestivum
  Clone ID: PAT_TA_27698.pep
VSSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTCPGGRS

SEQ ID NO: 133281 - protein, 77 aa, Triticum aestivum
  Clone ID: PAT_TA_27699.pep
MATKYIIGALVGSFGIAYVCDTTVSDKKIFGGTVCKTATDKEWFQATDAKFQAWPRTAGPPVIMNPISRQNFIVKNP

SEQ ID NO: 133282 - protein, 85 aa, Triticum aestivum
  Clone ID: PAT_TA_27700.pep
RTRGRTRGKPAAPKAAAKPAKDAAKPKKKASAKPKKAAAAGTKRKAPEKKKLVAKAKKSPAAKAKAKPKTVRSPAAKKARKVASA

SEQ ID NO: 133283 - protein, 102 aa, Triticum aestivum
  Clone ID: PAT_TA_27701.pep
RDYSVISSSGKGTCEEMIKRAVFARELGVPIVMHDYLTGGFTANTTLAHYCRDNGLLLHIHRAMHAVIDRQKNHGMHFRVLAKALRMSGGDHIHSGTCPGGR

SEQ ID NO: 133284 - protein, 64 aa, Triticum aestivum
  Clone ID: PAT_TA_27702.pep
MLCRRRSRRCVFVSAATMPSHKTFRIKQKLAKKQRQNRPIPYWIRMRTDNTIRYGLVIQDFASG

SEQ ID NO: 133285 - protein, 164 aa, Triticum aestivum
  unsure (1)..(164): unsure at all Xaa locations
  Clone ID: PAT_TA_27703.pep
MLTFSVFPSPKVSDTVVEPYNATLSVHQLVENADECMVLDNEALYDICFRTLKLATPTFGXDLNHLISATMSGVTCCLRFPGQLNSXDLRKLAVNLIPFPRLHFFMVGFAPLTSRGSQQYRALTVPELTQQMWDSKNMMCAADPRHGRYLTASAMFRGKMSTRS

SEQ ID NO: 133286 - protein, 214 aa, Triticum aestivum
  Clone ID: PAT_TA_27704.pep
SDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQKKNSSYFVEWIPNNVMSMSCFAGWGFWGQSLICLVLCYESVYHRNYRLYLGRDHA

SEQ ID NO: 133287 - protein, 116 aa, Triticum aestivum
  Clone ID: PAT_TA_27705.pep
TNFQTNISSLEATKKQPTSLVVVQVHVLNPASTAHNFSTPKSMKSNRRKSWQKHASWLTSPRRTSWHSCAGWTQQSSLRAAEEPHRHLPSPCPWGGGGQHLQRRDKPCSECNHQHS

SEQ ID NO: 133288 - protein, 155 aa, Triticum aestivum
  Clone ID: PAT_TA_27706.pep
MQPKISSALDPNSRDALGLAWSKFFHANDIAGRKADCPYFRAAVKITQQLGPIPIPTAKEIDGPYLEANYDEANSFLQKFKQDWKNFGVTLMCDSWTGPTGMSIINFMVYCNARMFFLNTIDASGQTQNSEMAREQRISRSFWMLGSLELMLQIS

SEQ ID NO: 133289 - protein, 129 aa, Triticum aestivum
  Clone ID: PAT_TA_27707.pep
MAGKYIVAGLVGSCVISYACDYIVSQKKIFGGTIPGTVSDKEWLKATEQRFQAWPRVAGPPVIMNPISRQNFIVKDLNPEGQDLRFAVGWNLYLMAMPVAKSNYIAGCTLAICRPIIKQHYCVGRRGYI

SEQ ID NO: 133290 - protein, 332 aa, Triticum aestivum
  unsure (1)..(332): unsure at all Xaa locations
  Clone ID: PAT_TA_27708.pep
PWTNSLQRIIVFGDMGKAERDGSNEFANYQPGSLNTTDTLVKDLDNYDIVFHIGDMPYANGYLSQWDQFTAQVAPISARKPYMVASGNHERDWPNTGGFFDVKDSGGECGVPAETMYYYPAENRANFWYKVDYGMFRFCVADTGHDWREGTPQHKFIEECLSTVDRKHQPWLIFAAHRVLGYSSNAWYAAEGSFEEPEGRESLQKLWQRYRVDMAFFGHVHNYERTCPLYQSQCVTXERSNYSGTMNGTIFFVAGGGGSHLSGYTSGTPKXSVFRDKEYGFTKLTAFNHSSRLFEYKKSSDGKVYDSFTIHRDYRDVFGCVHDSCFPTTLAT

SEQ ID NO: 133291 - protein, 203 aa, Triticum aestivum
  unsure (1)..(203): unsure at all Xaa locations
  Clone ID: PAT_TA_27709.pep
MGEAVAAAEYALKNEGAVTVPPPGPTRGTGSCSRPLLARLTVRLGHYKAKPVHWLCGNFAPVRYETPPAVGLPVRGHLPECLNGQFVMVGPNPKFVPVAGYXHWFDGDGMIHXVRIKDGRATYVSRYVKTSRLKQEEYFGGAKFMKVSFIKILNLLNNDSIIAQHLIDCLHRQLCSLFLIHACNFFALLINKNLIYISYIRLF

SEQ ID NO: 133292 - protein, 196 aa, Triticum aestivum
  Clone ID: PAT_TA_27710.pep
RVDGVPQWTPVYRVQRDIPMPLVTSGVEKGNLRELALARMEDLGLKCRDVRTREAGIQDIHHKIRPDEVELVRRDYAANDDWETFLSYEDTRQDILIGLLRLRKCGRNVTGSELVGRCSIVRELHVYGTAVPVHGRDAEKLQHQGYGTLLMEEAERIARKEHRSKKLAVISGVGTRHYYRKLGYELEGPYMVKCLA

SEQ ID NO: 133293 - protein, 251 aa, Triticum aestivum
  unsure (1)..(251): unsure at all Xaa locations
  Clone ID: PAT_TA_27711.pep
MREILHIQGGQCGNQIGAKFWEVICDEHGIDGTGRYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRKMLTLSGFRPQGLRNRGGPSNGSLFVHQLVENAXDEWMXLDKEALFDIFFRTLXKLATPFLWGPGTILFFVTMSGVTCLPGGSLGQINF

SEQ ID NO: 133294 - protein, 90 aa, Triticum aestivum
  unsure (1)..(90): unsure at all Xaa locations
  Clone ID: PAT_TA_27712.pep
RNSXEGIESARARARTMAALRLAGIYELKAAKEFPDIDPGHLKAARKFPKLRVKDVDATALNVFKILRQSPVDGHVRMTLKTLAEIQEEE

SEQ ID NO: 133295 - protein, 89 aa, Triticum aestivum
  Clone ID: PAT_TA_27713.pep
ELWTVVIFSISWQSSIFSDQLQLRMDMPCYPPKPAVCCSNRQILPSNCEATFWNYWLAYRYRHTAGMKMEMINSRLVRLSAYCRDEKLK

SEQ ID NO: 133296 - protein, 103 aa, Triticum aestivum
  Clone ID: PAT_TA_27714.pep
LKEGKSTETPLVAASESGTRVFIKRNPKRMDKLDTVFSCPFCNHGSSVECRIDLKNLIGEANCQICQESFSTTANALTEAIDVYSEWIDECERVNTVEDDDGA

SEQ ID NO: 133297 - protein, 116 aa, Triticum aestivum
  Clone ID: PAT_TA_27715.pep
KSEQSVPRPHVAGMQWRWLSEGVAHAILPRRCPQWLTLTQITVSLCPPSPHGRGPASGAERRRPYYANLASKGHPREGCRRCWKYALEAIIKVLLLYFLVHDNCLLFMLKKKKKKK

SEQ ID NO: 133298 - protein, 153 aa, Triticum aestivum
  Clone ID: PAT_TA_27716.pep
LGNSQRTEATKLSVLSLPANASSCLASYACPHLCSSIRVQRAAPARPLRVLPRVAWPLLSRQGGGSFHSRRPLLRALAGGVRKALSQRCKCCPPSLPKGKVKEGACVVLLQLAARIVVSNLHKNAKKSFSEMIKDMYLHYNGRSGLLLCGFQT

SEQ ID NO: 133299 - protein, 69 aa, Triticum aestivum
  Clone ID: PAT_TA_27717.pep
KGVSSVITFDIDVKVPSLKLLLNLRGTWQKLAKKQRQNRPIPYWIRMRTDNTIRYNAKRRHWRRTKLGF

SEQ ID NO: 133300 - protein, 108 aa, Triticum aestivum
  Clone ID: PAT_TA_27718.pep
ILTTSKLITTKLGLGPNAHTPTDDDDDNNNQQQQQQQIIAIYQTMMVVVILPTGWKHHGNYGMLQAGCSLIGWWWYPVIYRVANGVVSLFHRSCRVRVRVTLSPSFVF

SEQ ID NO: 133301 - protein, 145 aa, Triticum aestivum
  Clone ID: PAT_TA_27719.pep
MPKIKTSRVKYPEGWELIEPTLRDLEAKMREAENDTHDGKRKCEALWPIFRISHQKSRYIYDLYYRRKEIKRELYEFCLDQGYADKNLIAKWKKPGYERLCCLRCIQTRDHNFATTCVCRVPKHLREETVIECVHCGCKGCASGD

SEQ ID NO: 133302 - protein, 123 aa, Triticum aestivum
  Clone ID: PAT_TA_27720.pep
SLSFETILMELVELRTPFLAETMFDKLGLPRPVYHVRMLEQGGYRAQIEFHRTKEHYDASARRTKLLSHICVSGEAAMDQAADQAIAYMENNENKVLADYNYYRLQQEKQFLCKTFRPAVREN

SEQ ID NO: 133303 - protein, 118 aa, Triticum aestivum
  unsure (1)..(118): unsure at all Xaa locations
  Clone ID: PAT_TA_27721.pep
MISSWSERMISHTGTETRPRLLREAAVGNFPQWAKAXDGAMPPLLARSARRRRRRRWSPRPRSRPRPRPRRSPRPSAPRPPRRAAKSPPLDLVRWRCVLVVLGVFVFRVCTKRTPRPP

SEQ ID NO: 133304 - protein, 93 aa, Triticum aestivum
  Clone ID: PAT_TA_27722.pep
DFLDIWFYKCVIWTNESKDIPEIITIWATPNGLRVEPTPFIGLQVPVWKSTMQALSDDWHSAFSYISSEDHDQTKKMPKYAVRLPIYKCISVN

SEQ ID NO: 133305 - protein, 108 aa, Triticum aestivum
  Clone ID: PAT_TA_27723.pep
ASSSRGKQPGSPAKASYKLSDAAKKDAPKPKAKPAAPKAAAKPAKDGAKAKKKASAKPKKAAAGTKRKAPEKKTLVAKAKKSPAAKAKAKPKTVRSPAAKKGRKVAAA

SEQ ID NO: 133306 - protein, 170 aa, Triticum aestivum
  Clone ID: PAT_TA_27724.pep
SAHASARFLSLLLCAAPPLRTGHISSPSSTSPAKALTSPALLHISSPPPHPLPVQDCGNGARRLRPFSKTAAWCSAAAATELMEREPTSSTEAVARGSGSSMEGVRLTGKVQMFLMQFQYVYAVLVFSNLSRPSTCMQFQFLSNFRSMLLCFLVIICVCLCCFRFRRGPW

SEQ ID NO: 133307 - protein, 125 aa, Triticum aestivum
  Clone ID: PAT_TA_27725.pep
YSDEWHADLLGCCSEPALCLKTFFFPCGTFSRIASIAKNKPMSSGEACNDIMAYSLILSCCCYTCCVRRKLRQRLNIVGGCCDDFLSHVMCCCCALVQEWREVEIRGAYGGKTKITPPAHQYMEH

SEQ ID NO: 133308 - protein, 118 aa, Triticum aestivum
  Clone ID: PAT_TA_27726.pep
GTRQLRSSAAKGKLVKVKASYKLSDAAKKDAPKPKPKAKPAAPKAAAKPAKDAAKPKKKAPVKPKKAAAAVGTKRKAPEKKTLVAKAKKSPAAKAKAKAKPKTVRSPAAKKGRKVAAA

SEQ ID NO: 133309 - protein, 156 aa, Triticum aestivum
  Clone ID: PAT_TA_27727.pep
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKADKKA

SEQ ID NO: 133310 - protein, 163 aa, Triticum aestivum
  Clone ID: PAT_TA_27728.pep
SARGNDFSTLYAPLIRDGRMEKFYWAPTRDDFFGALRARVYDDEVRKWVTSTGIENIGKKLVNSRDGPVTFEQPKMTVEKLLEYGHMLVQEQDNVKRVQLADTYMSQAALGDANQDAMKTGTFYGGKGAQQGTLPVPAGCTDQTAKNFDPTARSDDGSCLYTF

SEQ ID NO: 133311 - protein, 156 aa, Triticum aestivum
  Clone ID: PAT_TA_27729.pep
MDASATGAGAKAKKGAAGRKAGGPRKKSVARSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKADKKA

SEQ ID NO: 133312 - protein, 42 aa, Triticum aestivum
  Clone ID: PAT_TA_27730.pep
AWSRPRYPDAYVRVIGFDNLRQVQCVSFIAFRPPGCEESGKA

SEQ ID NO: 133313 - protein, 99 aa, Triticum aestivum
  Clone ID: PAT_TA_27731.pep
AEFDAPPSPEHSYNMEFPTDEELTKQDPPALPPQLLMTALGGTDHFDEHALKPKPQHVVLNHLFIEKGWGAQSLLALGLTHRFQSKYVNFVLYKPLVRR

SEQ ID NO: 133314 - protein, 82 aa, Triticum aestivum
  unsure (1)..(82): unsure at all Xaa locations
  Clone ID: PAT_TA_27732.pep
MMYGHMLVQEQDNVKRVQLADTYMSQAALGDANQDAMKTGSFYGGKGAQQGTLPVPAGCTDQTAKNFDPTARSDXGSCLYTF

SEQ ID NO: 133315 - protein, 222 aa, Triticum aestivum
  unsure (1)..(222): unsure at all Xaa locations
  Clone ID: PAT_TA_27733.pep
YYYPAENRANFWYKVDYGMFRFCVVDTGHDWREGTPQHKFIEECLSTVDRKHQPWLIFAAHRVLGYSCNAWYAAEGSFEEPEGRESLQKLWQRYRVDMAFFGHVHNYERTCPLYQSQCVTGERSHYSGTMNGTIFVVAGGGGSHLSSYTTAIPRWSVFRDQDYGFVKLTAFNHSSLLFRXTRRSSDGNVYDXFTVDRDXYRDVLSCVARTACFSHHTRSLTV

SEQ ID NO: 133316 - protein, 431 aa, Triticum aestivum
  unsure (1)..(431): unsure at all Xaa locations
  Clone ID: PAT_TA_27734.pep
VVCDEHGIDTTGRYTGTSDLQLERVNVYYNEASCGRFVPRAVLMDLEPGTMDSVRTXGPYGQFFRPXDNFVFGAIWVLGNNWGERGIILEGADSIDPVLHVVXRKEPENCDCFQRIQIIHPLCGGTGSGMGTLXLISKIREEYPDRMMLTFSVFPSPKVSDTVVEPYNATLSVHQLXSENADECMGSPXRTLYDICFRTLTDHPTLVILNHLISATMNGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADDEGEYEDEEDVQGDEM

SEQ ID NO: 133317 - protein, 147 aa, Triticum aestivum
  unsure (1)..(147): unsure at all Xaa locations
  Clone ID: PAT_TA_27735.pep
MPKIKTSRVKYPEGWELIEPTLRDLEAKMREAENDTHDGKRKCEALWPIFRISHQKSRYIYDLYYRRKEIKKELYEFCLDQGYADKNLIAKWKKPGYERLCCLRCIQTRDHNFATTXCVCRVPKHLREETVIECVHCGCXRGCASGD

SEQ ID NO: 133318 - protein, 77 aa, Triticum aestivum
  Clone ID: PAT_TA_27736.pep
MSGKYIIGSLVGSLGIAYVSDTIVSDKKIFGGTVCKTATDKEWFQATDAKFQAWPRVAGPPVIMNPISRQNFIVKDP

SEQ ID NO: 133319 - protein, 239 aa, Triticum aestivum
  unsure (1)..(239): unsure at all Xaa locations
  Clone ID: PAT_TA_27737.pep
RIAWQYRKYFGDERNSSAEHRDNKQEFSHDFDLRKPLERHLLNAQHIECLSTQDLDTLHDLQDRCSAFLSKHQRKEGGNLSAGRIAIQSLCAPECGYXGKDWDMVLFLRSLKAMVRSSNAVAIITFPHTSPIDSFCKRWQHLADTLLSIKAIPDEDKDLAKLLTGYQDMVGFLHVHKVAQTNSQVPVILEASTFSLKLRKRRSLVLERLNQAPVDGSSGPSSGGSGSCSSSTQGSQLDF

SEQ ID NO: 133320 - protein, 351 aa, Triticum aestivum
  Clone ID: PAT_TA_27738.pep
SGGNHDANASDSQKSWKGIKDNNLYDPWNHAWPYYGGFDCVYCNLKHKGGGATRVAEHLGGIVGNVRSCPNVPRNVRDAMRECRDESRRKKREKQNSRLRIERNIMEGLYQKGGVINILDDEEEEIQMNIREALRDPNVSRRVDRRIGKGSVGDVRVDVGKKSITAYFDKQLCSNKVSMQPKISSALDPNSRDALGLAWSKFFHANDIAGRKADCPYFRAALKITQQLGPTPIPTAKEIDGKYLDANYDEATSFLQKFKQDWKNFGVTLMCDSWTGPTGMCLINFMVYCNTRMFFLNSIDASGQTQNSAGAWSMMLVGGLEHGSWSFFNGTRPPRPCFHGFLLELLFVVML

SEQ ID NO: 133321 - protein, 159 aa, Triticum aestivum
  Clone ID: PAT_TA_27739.pep
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKRTAEKEPKEGKSPKKTAKSPKKADKKA

SEQ ID NO: 133322 - protein, 143 aa, Triticum aestivum
  unsure (1)..(143): unsure at all Xaa locations
  Clone ID: PAT_TA_27740.pep
QAGSSSVAIAKYIEEKHGKALPXANFKKMLSVQLRASASKGKLVKVKASYKLSDAAKKDAPKPKAKPAAPKAAAKPAKDAAKPKKKAAVKPKKAAAAAGTKRKAPEKKTLVAKAKKSPAAKAKAKPKTVRSPAAKKGRKVAAA

SEQ ID NO: 133323 - protein, 60 aa, Triticum aestivum
  Clone ID: PAT_TA_27741.pep
FFFFFFPVANKVSFPSIDGKTIIRGLHIIYMCMCSRCYNSDMHPPRPTLVGAYICSYIHI

SEQ ID NO: 133324 - protein, 106 aa, Triticum aestivum
  Clone ID: PAT_TA_27742.pep
MGKGTGSFGKRRNKTHTLCIRCGRRSFHLQKSTCSSCGYPAARIRKYNWSVKAIRRKTTGTGRMRYMRHVPRRFKSNFREGTEAAPKEECCRCQLSLDVAIKNLIS

SEQ ID NO: 133325 - protein, 175 aa, Triticum aestivum
  unsure (1)..(175): unsure at all Xaa locations
  Clone ID: PAT_TA_27743.pep
MAPTVMASSATSVAPFQGLKSTAGLPISRRSSSAGLSSVSNGGRIRCMQVWPIEGIKKFETLSYLPPLSTEALLKQVDYLIRSKWVPCLEFSKVXFVFREHNSSPGYYDGRYWTMWKLPMFGCPDATQVLNEVEEVKKEYPYAYVRVIGFDNMRQVQWVSFIAFRPPGFEEFGKA

SEQ ID NO: 133326 - protein, 261 aa, Triticum aestivum
  unsure (1)..(261): unsure at all Xaa locations
  Clone ID: PAT_TA_27744.pep
MWSFASNAIAGSIKKKVQPSKGSLSNHDCSDDDGSSCASREEGLECPICCESFNIVENVPYVLWCGHTMCKNCILGLQWAVVXFPTLPIQLPLFVSVSXWCNLISFRLVYKGNLXFPRKNYFXLWDGLKSMNGDRAKFHSSGHEERQSVCPSSGGTSSSQHHRRTPTARAETSSARDRNAAANTSNTASVSLQKLMVCFVQLTAKFPLVIMFLLIVLYAVPASAAVLLLYVLVTFLFALPSFLILYFAYPTLDWLVREIFT

SEQ ID NO: 133327 - protein, 210 aa, Triticum aestivum
  Clone ID: PAT_TA_27745.pep
MRGVDDRVAPDLPAPVLSVVVEASSCAHSSHIWPCGLICGGFGERCAAAGMEDGGAAAFAFGGCFRAAITSGEVVRASVVAREDALTSGWPALDLSAAGAAHPTYFEMIKEAIAALKDRTGSSSVAIAKYIEEKHGKALPANFKKMLSVQLRASAAKGKLVKVKASYKLSDAAKKDAPKPKAAAKPSKDAAKPKKKAAEKPKKARKVAAA

SEQ ID NO: 133328 - protein, 178 aa, Triticum aestivum
  Clone ID: PAT_TA_27746.pep
PELTQQMWDAKNMMCAADPRHGRYLTASAMFRGKMSTKEVDEQMMNVQNKNSSYFVEWIPNNVKSSVCDIPPVGLAMSSTFVGNSTSIQEMFRRVSEQFTAMFRRKAFLHWYTSEGMDEMEFTEAESNMNDLVAEYQQYQDATAEEEYDDEEEPAADKPDPSCIRPFLAYWVCAANRV

SEQ ID NO: 133329 - protein, 295 aa, Triticum aestivum
  Clone ID: PAT_TA_27747.pep
MALGGCGNEADGARANHEGSSTGQRQQHGGRPLVWEDYATSLTDAIAKILDPVSALSAIDEVSKFRECQGRFGTRLAEEAAARMGPTQWWFQFGGDVPALQKCAMRICSQCVSSSGCERNWSAFALVHTKQRNRLLYDKLHKLVSVRYNLKIRAEEDQEKDIDNEVDPSALLMDTTMFDEANPIMEWLNDDEEDPIVDGANEASAVFEKIRRLNSSRKDSYVGTKGNKKKRKRNHDEENEYVETESEDDDEENEYVDNESEDDDGVSEDDEDDQQDQQETQMQVEEETQVQAEKE

SEQ ID NO: 133330 - protein, 445 aa, Triticum aestivum
  Clone ID: PAT_TA_27748.pep
MREILHIQGGQCGNQIGAKFWEVICDEHGIDGTGRYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPSFGELNHLISATMSGVTCCLRFPGQLNSDLRKLAVNLIPFPRLHFFMVGFAPLTSRGSQMYRALTVPELTQQMWDAKNMMCAADPRHGRYLTASACFRGKMSTKEVDEQMLNVQNKNSSYFVEWIPNNVKSSVCDMPPRGLKMAGTFVGNSTSIQEMFRRVSEQFTAMFRRKAFLHWYTGEGMDEMEFTEAESNMNDLVAEYQQYQDATADEEYDEEEEEERDAE

SEQ ID NO: 133331 - protein, 156 aa, Triticum aestivum
  Clone ID: PAT_TA_27749.pep
MDASATGAGAKGKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKADKKA

SEQ ID NO: 133332 - protein, 84 aa, Triticum aestivum
  Clone ID: PAT_TA_27750.pep
FLNASKTNFSLQQNPTAAPPSFAPCTLSGARHPPYIACMASGAYFDLIVVLISLSTPTLLNLKQHLLQKKKNNQQQQLLCGLCL

SEQ ID NO: 133333 - protein, 166 aa, Triticum aestivum
  unsure (1)..(166): unsure at all Xaa locations
  Clone ID: PAT_TA_27751.pep
MAAAFSSTVGAPASTPTNFLGKKLKKQVTSAVNYHGKSSKANRFTVMAXAENIDEKRNTDKWKGLAYDISDDQQXDITKGKGIVDSLFQAPTXGDGNHEGVLNSYEYXQPRXQEFDXTTHGSSTSSCFNGQLVVISPRINDLPTXFXIWYWGGRSRNPQCNCLPNG

SEQ ID NO: 133334 - protein, 86 aa, Triticum aestivum
  Clone ID: PAT_TA_27752.pep
MVNDIWKINISRFGVVSIRRCASNMKVGPSIKGKVKEGACVVLLQLAARIAVSNLHKNAKKSLETIKDMYLYYNERSGLLLCGFQT

SEQ ID NO: 133335 - protein, 68 aa, Triticum aestivum
  Clone ID: PAT_TA_27753.pep
MTTSRRLADRKSAKFQKNVTKRGSVPETTVKKGNDYPVGPIVLGFFIFVVIGSSLFQIIRTATSGGMA

SEQ ID NO: 133336 - protein, 119 aa, Triticum aestivum
  unsure (1)..(119): unsure at all Xaa locations
  Clone ID: PAT_TA_27754.pep
MAGKYIVAGLVGSCVISYACDYIVSQEEDLRWAPSQGLCPDKEWXLKATEQRSKAWXPRVAGPPVIMNPSTAQNFIVKDSTLRSNFKVCGPDLPDGILLLTYVFRCIQYCSIKQHGVGW

SEQ ID NO: 133337 - protein, 111 aa, Triticum aestivum
  Clone ID: PAT_TA_27755.pep
MAPSQPKSGLFVGINKGHVVTKRELPPRPSDRKGKGTKRVHFVRNLIREVAGFAPYEKRITELLKVGKDKRALKVAKRKLGTHKRAKKKREEMSSVLRKMRSAGTGTEKKK

SEQ ID NO: 133338 - protein, 230 aa, Triticum aestivum
  unsure (1)..(230): unsure at all Xaa locations
  Clone ID: PAT_TA_27756.pep
MAAAVVDAAVPVAAKANGAGARCCAAKGPGYATPREAMEKGPREGLLYVTCVYNGTGIDKPDYLATVDVDPNSATYSQVIHRLQATHIGDELHHSGWNACSSCHGDPSTSRRFLILPSLLSGRLYVVDTAKNPRAPALHKVVQAEDIAEKTGXLGFPHTSHFALQTGDIMISCLGDKEGNAAGNGFLLLDSEFNVTGRWEKPGHSPGXGYDSGTXXXSQTMISSSWGXRF

SEQ ID NO: 133339 - protein, 150 aa, Triticum aestivum
  Clone ID: PAT_TA_27757.pep
QESGDGARGGEGEAPWRPRLWRSATRQAWDSRWRAASCWSWSWRAASASRWSWSWRAASASSTRTSPGCRTGRGSSNFLFIRLPFDKMFPDVRTGHTFARYMRALLCPTCTRMPRSPSRRRLRTCTCTTTRDLGSFFVASKFEMFLWELV

SEQ ID NO: 133340 - protein, 77 aa, Triticum aestivum
  Clone ID: PAT_TA_27758.pep
MATKCIIGALVGSLGVAYVCDTIVSDKKIFGGTVCKTATDREWFQATDAKFQAWPRTAGPPVIMNPISRQNFIVKNP

SEQ ID NO: 133341 - protein, 190 aa, Triticum aestivum
  Clone ID: PAT_TA_27759.pep
PRVRPSAIGKLSSLEILDLSSNFSDMKELPFSFGDLLNLREVDLSNNQIHALPDSFGRLDKLEKLNLEQNPLSMPPAEVVKEGVDAVKEYMSKRWLDALLEEEQRSMAAGSSREPAGVDSQSLAGAAVSRGSRTLGGALWAMSVVARPSRRKTRSSTSSSETSVSEAIEYRVCIYQVYGTLDLGITLCSC

SEQ ID NO: 133342 - protein, 159 aa, Triticum aestivum
  Clone ID: PAT_TA_27760.pep
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKRMAEKEPKEGKSPKKTAKSPKKADKKA

SEQ ID NO: 133343 - protein, 112 aa, Triticum aestivum
  Clone ID: PAT_TA_27761.pep
MAPSQPKSGLFVGINKGHVVTKRELPPRPSDRKGKGTKRVLFVRNLIREVAGFAPYEKRITELLKVGKDKRALKVAKRKLGTHKRAKKKREEMSSVLRKMRSGGGGAADKKK

SEQ ID NO: 133344 - protein, 65 aa, Triticum aestivum
  Clone ID: PAT_TA_27762.pep
AQWHGPLGRERPNVGRGGRRAEAPVASLDSDLEAFSHNPAHGSFAPLAFQPSAMTNCVNQRFLSY

SEQ ID NO: 133345 - protein, 375 aa, Triticum aestivum
  unsure (1)..(375): unsure at all Xaa locations
  Clone ID: PAT_TA_27763.pep
RLRHRLGGRLGQAGVENGTSVGGAVQHAVRQLPVPFRGAQIRRRKLQPRPPSAEGPSASXSERAVDRCPLEAAAAAAAAATGSAAASTVSGVRGGDDLDEDDDGYGCEIGTLGNFKKSKGTVNMSATYSTRNNDIESSVVARGDLWRLEASRSGSTSGNDTSPLYLVQLGPLLFVRDSTLLLPVHLSKQHLLWYGYDRKNGVHSLCPAIWSKQRRWLMMSMMCLNPVACSFMDLQFPNGQXTYVAGEGITASGFVPLFGGLLQAHGKFPXGETRMSFSCKNKRGTRFTPMFXWPDKSLSLGSYSKPWAYKRFWVLMVRPSIQVSVCPTFGGSDPGVRAEVIHSLKEELNVMCGLSCSRNPSAFTALSIGRSKWNG

SEQ ID NO: 133346 - protein, 135 aa, Triticum aestivum
  Clone ID: PAT_TA_27764.pep
HEGERERELPHVTDERGQVANLLDVHEYIPDSLDSVAEFDAPPSPEHSYNMEFPTDEELTKQDPPALPPQLLMTALGGTDHSDELAPKAKPQHVVLNHLFIEKGWGAQSLLALGLTHRFQSKYVNFVLYKPLVRR

SEQ ID NO: 133347 - protein, 106 aa, Triticum aestivum; identical to SEQ ID NO: 133259
  Clone ID: PAT_TA_27765.pep

SEQ ID NO: 133348 - protein, 175 aa, Triticum aestivum
  Clone ID: PAT_TA_27766.pep
MAPAVMASSATTVAPFQGLKSTAGLPVSRRSGSASLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 133349 - protein, 191 aa, Triticum aestivum
  Clone ID: PAT_TA_27767.pep
MAGSGGGAYRAEDDYDYLFKAVIIGDSGVGKSNLLSRFTKNEFCLESKSTIGVEFATRSLQVDGKVVKAQIWDTAGQERYRAITSAYYRGAVGALLVYDVTRRATFDNVARWLKELRDHTDASIVVMLVGNKSDLRHLVAVSTEDGQEYAEAESLYFMETSALDATNVDNAFSEVLTQIYRIASRKTVDAG

SEQ ID NO: 133350 - protein, 203 aa, Triticum aestivum
  unsure (1)..(203): unsure at all Xaa locations
  Clone ID: PAT_TA_27768.pep
ERIRIGKELLEAKXMEELNERKRIIELRRLEKEEEKRAREKIRQKLEEDKAERRRKLGLPAEAPAASKPSAPPPVEEKKSAFLPVRPATKAERMRDCLRNIKQQNKEEDAKVKRAFQTLLTYIGNVVKNPDEEKFRKIRLTNATFQERVGSLGGIEFLVLCGFEKPEGEEILFLARDKVDKAVLNVAGAELNSAITNPFFGVL

SEQ ID NO: 133351 - protein, 218 aa, Triticum aestivum
  Clone ID: PAT_TA_27769.pep
MAAREQGGDEYDYLFKVVLIGDSGVGKSNLLSRFTKNTFSLDSKSTIGVEFATRTTQVEGKTIKAQIWDTAGQERYRAITSAYYRGAVGALLVYDVTKAATFDNVKRWLKELRDHADSNIVIMLIGNKTDLRHLRSVATDKAAGFAEWEGLSFIETSALDATNVDKAFQTVLAEIYRVVGKKALSSTDDSGAGAVGEGQSILVSGGEPTSVSSRCCSF

SEQ ID NO: 133352 - protein, 152 aa, Triticum aestivum
  Clone ID: PAT_TA_27770.pep
DNVSDESVVKIVDTFPGQSIDFFGALRARVYDDEVRKWVTSTGIENIGKRLVNSRDGPVTFEQPKMTVEKLLEYGHMFVQEQDNVKRVQLADTYMSQAALGDANQDAMKTGSFYGKGAQQGTLPVPAGCTDQTAKNFDPTARSDDGSCLYTF

SEQ ID NO: 133353 - protein, 174 aa, Triticum aestivum
  Clone ID: PAT_TA_27771.pep
MWSFASNAIAGSIKKKVQPSKGSLSNHDCSDDDGSSCASREEGLECPICCESFNIVENVPYVLWCGHTMCKNCILGLQWAVVKFPTLPIQLPLFVSCPWCNLLSFRLVYKGNLKFPRKNYFLLWMVESMNGDRAKFHSSGHEERQSVCPSSGGTSSSQHHRRTPRMRRRPRRQR

SEQ ID NO: 133354 - protein, 77 aa, Triticum aestivum
  Clone ID: PAT_TA_27772.pep
MSGKYIIGSLVGSLGIAYVCDATVSDKKIFGGTVCKTATDKEWFQATDAKFQAWPRVAGPPVIMNPISRQNFIVKNP

SEQ ID NO: 133355 - protein, 147 aa, Triticum aestivum
  Clone ID: PAT_TA_27773.pep
NFVEYLKRKNFTVCAVYLLDSQFVSDVTKYISGCMASLSAMIQLELPHINILSKMDLVSNKKDVEDYLNPEAQVLLSQLNRQMAPRFHKLNKALAELVDDYNMVNFIPLDLRKESSIQYVLSNIDNCIQYGEDADVKVRDFIPEEDG

SEQ ID NO: 133356 - protein, 173 aa, Triticum aestivum
  Clone ID: PAT_TA_27774.pep
MLYVRNITVLQGYIKYFEMHSNVRPGSDTGSSLICEGWMAATKKIKISSIGSTSGSSNWEEDCTIRCSDDVPLDSPVYAQMLPNPQEGDDAKPSLKKIRVGYPALSLHDGDVVYLMHMPDPRGDKACVIALDMRNKAVKGVANFGGSGRPLGHSYTYFPSGISKHLGIFSSTR

SEQ ID NO: 133357 - protein, 176 aa, Triticum aestivum
  unsure (1)..(176): unsure at all Xaa locations
  Clone ID: PAT_TA_27775.pep
AWSRPRYEXXAFVLPGLXXDERKFLGPIVLGSSVLFYLGILFSYTVLAPAALNFFVNYAEGAVESIWSIDQYLPGRPLDVVAAEVNKCENSDIALVKLIEEREVMKKQLDKYKNQKDKLESLCRSLQAERKQSPSVSIPNDASNQEGVTSQKQSPSVSIPDDASNQEDVTSQQPEV

SEQ ID NO: 133358 - protein, 95 aa, Triticum aestivum
  unsure (1)..(95): unsure at all Xaa locations
  Clone ID: PAT_TA_27776.pep
MGKGTGSFGKRRNKTHTLCIRCGRRSFHLQKSTCSSCGYPAARIRXYNWSVKAIRRKTTGXTGRMRYMRHVPRRFKSNFREGTEAAPKKSAAAAN

SEQ ID NO: 133359 - protein, 134 aa, Triticum aestivum
  Clone ID: PAT_TA_27777.pep
LSPVDFEEFSLPYLKQIVDSVKETHPDLPLILYASGSGGLLERLPLTGVDVVSLDWTVDMAEGRKRLGSNIAVQGNVDPGVLFGSKEFITKRIYDTVQKAGSEGHVLNLGHGIKVGTPEENVAHFFEVAKGIRY

SEQ ID NO: 133360 - protein, 311 aa, Triticum aestivum
  Clone ID: PAT_TA_27778.pep
WRLIFQMLDYNVPGGKLNRGLSVIDSYMLLREGTEVDEEDFYLACVLGWCIEWLQASALVMDDITDNAYTRRDNLCWYKLPTVGLSAINDGVLLKCHVQAIIKRYFKEKFYFMELMELWNEIGLQTAMGQMLDLITTHTGAKDLARYRIQGYRRIVKYKTSYYSFYLPVACALLLNGAKLSDYVELKNVLIEMGVYFQIQDDYLDCFGDPQVIGKVGTDIEDYKCSWLIVQAMELANENEMKILYENYGKSCPECVAAVKNVYKELDLQDIFLEYESRVYKHLVSTIDAEPDRAIREILKIFLKKIYRRKK

SEQ ID NO: 133361 - protein, 161 aa, Triticum aestivum
  Clone ID: PAT_TA_27779.pep
MAEQTEKAFLKQPKVFLCSKKTTKGNNKPGKEGNRFWKSVGLGFKTPKEAIEGTYIDKKCPFTGTVSIRGRIIAGTCHSAKMNRTIIVRRNYLHYVKKYQRYEKRHSNIPAHISPCFRVREGDHVIIGQCRPLSKTVRFNVLKVVPAGSKSGAVKKAFTGA

SEQ ID NO: 133362 - protein, 122 aa, Triticum aestivum
  Clone ID: PAT_TA_27780.pep
SARGFFFSPPARKRKRKRIESARARARTMAALRLAVRRFCDRALGRSAGIYELKAAKEFPDIDPEHLKAARKFPKLRVKDADATALNVFKILRDSPVDGHKNVTLREVRMTLRTLAEIQEEE

SEQ ID NO: 133363 - protein, 93 aa, Triticum aestivum
  Clone ID: PAT_TA_27781.pep
MTKGTGSFGKRRNKTHTLCIRCGRRSFHLQKSTCSSCGYPAARIRKYNWSVKAIRRKTTGTGRMRYMRHLPRRFKSNFREGTEAAPRNRASAN

SEQ ID NO: 133364 - protein, 99 aa, Triticum aestivum
  Clone ID: PAT_TA_27782.pep
SVSPMLAYAEQEDQSRPSRGLWTTSLCHTISTSLALDVLAAIVVSTLFPPLPVRGLPLQDTPNTYPLLHQLVVSPCGRLNCPKVNATQDTRALNQPIIA

SEQ ID NO: 133365 - protein, 228 aa, Triticum aestivum
  Clone ID: PAT_TA_27783.pep
MEGNYCRYLRMLMITLGASLVTALQVLPPSLPKGKVKEGACVVLLQLAARIAVSNLHKNAKKSFSETIKDMYLHYNERSGLLSPLIAEDIYEVIMKNAARLDSEIIYDRDFDYDYFGFKTLERSYLLKLGGVVVERPQHMLMRVSVGIHKDDIDSAIRTYHLMSQRWFTHASPTLFNAGTPRPQLSSCFLICMKDDSIEGIYDTLKECAVISKSAGRIGVSVPTFVLL

SEQ ID NO: 133366 - protein, 392 aa, Triticum aestivum
  Clone ID: PAT_TA_27784.pep
TVAIGDHVLSEGEWLSLNGSTGEVILGKQPLSPPALSGDLGTFMSWVDDVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQTAEKVFANAGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKVGLDYVSCSPFRVPIARLAAAQVLV

SEQ ID NO: 133367 - protein, 79 aa, Triticum aestivum
  Clone ID: PAT_TA_27785.pep
MKVGPSIKGKVKEGACVVLLQLAARIVVSNLDKNAKKSLETIKDMYLHYNERSGLLSPLIAEDIYKVIMKEHKIKKRYP

SEQ ID NO: 133368 - protein, 149 aa, Triticum aestivum
  Clone ID: PAT_TA_27786.pep
AWSRPRYRALTVPELTQQMWDAKNMMCAADPRHGRYLTASAMFRGKMSTKEVDEQMLNVQNKNSSYFVEWIPNNVKSSVCDIPPTGLSMSSTFVGNSTSIQEMFRRVSEQFTAMFRRKAFLHWYSCTAELSSYMFGHNIAFLKSILLSV

SEQ ID NO: 133369 - protein, 164 aa, Triticum aestivum
  unsure (1)..(164): unsure at all Xaa locations
  Clone ID: PAT_TA_27787.pep
MVLKTELCRFSGQKIYPGKGIRFIRADSQVFLFANSXKCKRYFHNRLKPAKLTWTAMYRKQHKKDIHAEAVKKRRXRATKKPYSRSIVGASXWEVIQKKRAEKPEVRDAAREAALREIKERIKKTKDEKKAKKAEVTKSQKSQSKGAVQKGSKGPKLGGGGGKR

SEQ ID NO: 133370 - protein, 224 aa, Triticum aestivum
  unsure (1)..(224): unsure at all Xaa locations
  Clone ID: PAT_TA_27788.pep
MAGGGGRGRGEEEYDYLFKVVLIGDSGVGKSNLLSRFTRNEFCLESKSTIGVEFATRTLHVEGKIIKAQIWDTAGQERYRAITSAYYRGALGAVLVYDVTKPTTFENIARWLKELRDHADANIRIMLVGNKTDLKDLRAVPTDDAGGYAEAEGLSYIETSALEAMNVEXRAFQLILGDIYRTVSKKAVASEEDRAGAAGVKEGKTINVAATADNGGEKKQCCSA

SEQ ID NO: 133371 - protein, 68 aa, Triticum aestivum
  Clone ID: PAT_TA_27789.pep
MTTSRRLADRKSAKFQKNITKRGSVPETTVKKGNDYPVGPIVLGFFIFVVIGSSLFQIIRTATSGGMA

SEQ ID NO: 133372 - protein, 216 aa, Triticum aestivum
  Clone ID: PAT_TA_27790.pep
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVDDAKAFAEREITFFMETSALEAMNVETAFTEVLTQIYRVVSKKALDIGDDPAAPPRGQTINVGGKDDVSAVKKAGCCSS

SEQ ID NO: 133373 - protein, 257 aa, Triticum aestivum
  Clone ID: PAT_TA_27791.pep
FVGGKGETGAAAMANVGDLANIAQLTGLDAVRLIGLIVKAAATARMHKSNCRRFAQHLKLIGGLLEQLRVSELKKYPETREPLEQLEDALRRGYLLVNSCQDRSYLYLLAMGWNIVYRFRTAQTEIDNYLRLVPLITLVDNARVRERIEYIERDQCEYSLDEEDKEVHEALLNPDPSTNPSIVLKKTLSCSYPNLPFNEALRKESEKLQVELQRSQSNMDMAQCEVIHHLLGVTRTVESSIPDESTVPWVSGAHHVL

SEQ ID NO: 133374 - protein, 216 aa, Triticum aestivum
  Clone ID: PAT_TA_27792.pep
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKAFAERESTFFMETSALEAMNVENAFTEVLTQIYRVVSKKALDIGDDPAAPPRGQTINVGGKDDVSAVKKAGCCSS

SEQ ID NO: 133375 - protein, 118 aa, Triticum aestivum
  Clone ID: PAT_TA_27793.pep
MFLQETKTAVNSGRRIATFASARFNEHMVKEGISGFTNVDYKSKGLSNEALSRRCKCCPLLPKGKVKEGACVVLLQLAARIAVSNLHKNAKKSFSEMIKDMYLHYNERSWLLLCGFQT

SEQ ID NO: 133376 - protein, 105 aa, Triticum aestivum
  Clone ID: PAT_TA_27794.pep
RRLKLWAHSEDCCVQPAQECQEFLLGDVSDCCVQPTQECQEFLLGDVSHGACFCHDFLRLDFVDLGVEKFWVVDAGLRICTCTTMRDLGCFFVASKLEMFVLNLV

SEQ ID NO: 133377 - protein, 178 aa, Triticum aestivum
  Clone ID: PAT_TA_27795.pep
AVDALGLLLDKPYRSTGLQIAISWRCVLFHLNLCLFFHLHLRLLLIMHGWSIFPILTHPIIILTLTINKYILFLVKRTPSMLLPLPRATASVELVGSRSISSVAAAAEHHAAVLEKGRSRRAPLPQSSTGSGWGGGEEMWRRAGEVSALAGDVEEGEEMWPVRSGGAAHRRTDRERAI

SEQ ID NO: 133378 - protein, 190 aa, Triticum aestivum
  Clone ID: PAT_TA_27796.pep
FPVPPPVCGAAAAHRPHLLALLHISGQSAHFSGPPPHLLASTPSTSCPRLWQRSSAVAALLQDCSVVLGGCGNGADGARADQFNGGGSTGQRQQHGGRPLDWKEKVFVDSESEDNDGVSEDGEDAPSMHDQQEAQMQVEKETQIQVEKDAPPTDGNLETRRSVRLVKKKTKGVNSLYPLLRNLLKCHMKN

SEQ ID NO: 133379 - protein, 224 aa, Triticum aestivum
  Clone ID: PAT_TA_27797.pep
KDEKTIRWFELPNCFIFHNANAWEEGDEVVLITCRLENPDLDKVNGTQNEKLENFGNELYEMRFNMKTGAASQKQLSVSAVDFPRVNESYTGRKQRYVYCTILDSIAKVTGIIKFDLHAEPESGKKQLEVGGNVMGIYDLGPGRFGSEAVFVPKEPGVSGEEDDGYLIFFVHDENTGKSEVNVIDAKTMSPDPVAVVELPNRVPYGFHAFFVNEEQLVHQQAEV

SEQ ID NO: 133380 - protein, 96 aa, Triticum aestivum
  Clone ID: PAT_TA_27798.pep
MTKGTGSFGKRRNKTHTLCIRCGRRSFHLQKSTCSSCGYPAARIRKYNWSVKAIRRKTTGTGRMRYMRHVPRRFKSNFREGTEAAPRSKGASSSGN

SEQ ID NO: 133381 - protein, 145 aa, Triticum aestivum
  Clone ID: PAT_TA_27799.pep
MPKIKTSRVKYPEGWELIEPTLRDLEAKMREAENDTHDGKRKCEALWPIFRISHQKSRYIYDLYYRRKEIKRELYEFCLDQGYADKNLIAKWKKPGYERLCCLRCIQTRDHNFATTCVCRVPKHLREEMVIECVHCGCKGCASGD

SEQ ID NO: 133382 - protein, 201 aa, Triticum aestivum
  unsure (1)..(201): unsure at all Xaa locations
  Clone ID: PAT_TA_27800.pep
ENPRVPIVVTGNDFXTLYAPLIRDGRMEKFYWAPTRDDRVGVCKGIFQTDNVSDESVVKIVDTFPGQSIDFFGALRARVYDDEVRKWVTSTGIENIGKKLVNSRDGPVTFEQPKMTVEKLLEYGHMLVQEQDNVKRVQLADTYMSQAALGDANQDAMKTGSFYGKGAQQGTLPVPAGCTDQTAKNFDPTARSDDGSCLYTF

SEQ ID NO: 133383 - protein, 225 aa, Triticum aestivum
  unsure (1)..(225): unsure at all Xaa locations
  Clone ID: PAT_TA_27801.pep
VRDRARKKKEEEEKRMEREREKERIRIGKELLEAKKMEELNERKRIIELRRLEKEEEKRAREKIRQKLEEDKAERRRKLGLPAEAPAASKPSAPXPVEEKKSAFLPVRPATKAERMRDCLRNIKQQNKEEDAKVKRAFQTLLTYIGNVVKNPDEEKFRKIRLTNATFQERVGSLGGIEFLELCGFEKPEGEEILFLARDKVDKAVLNVAGAELNSAITNPFFGVL

SEQ ID NO: 133384 - protein, 156 aa, Triticum aestivum
  Clone ID: PAT_TA_27802.pep
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSTKKAAKSPKKADKKA

SEQ ID NO: 133385 - protein, 97 aa, Triticum aestivum
  Clone ID: PAT_TA_27803.pep
YHHHHHCLIDSNNLLLLLLLVVVVVLVGVCVLGPSPSFVVINLEVVKIQHIYVSLLPSRWDLANFFPRLCCIFSSCLLQPLDLPVQQQKVDESNFPV

SEQ ID NO: 133386 - protein, 175 aa, Triticum aestivum
  unsure (1)..(175): unsure at all Xaa locations
  Clone ID: PAT_TA_27804.pep
MDASATGAGAKSKKGAAGRKAGGPRKKSVTRSVKAGLQFPVGRIGRYLKNGRYAKRVGTGAPVYLAAVLEYLAAELLELAGNAAKDKQXSRIVPRHLLLAVRNDQELGRLLAGVTIAHGGVLPNINPVLLPKKTAEKEPKSPKKAAKSPKKGRKEGLDRDAHRSISLSCSVELMV

SEQ ID NO: 133387 - protein, 107 aa, Triticum aestivum
  Clone ID: PAT_TA_27805.pep
MKVFCELHFCPQLCCTTLLSDRSIPFVLYDLCMYVRAEVIHSLKEELNVMCGLSCSRNPSAFTALSIGRSKWNGQVGSSGVVVTLETPLNNIGRPSLSVQLNGGFEI

SEQ ID NO: 133388 - protein, 128 aa, Triticum aestivum
  Clone ID: PAT_TA_27806.pep
ARREKKNSKTTISFGVFLFSLFQIFLFGCHRHTTCCSEDIMLWDFSAEPKLWFYLQLSFHILPRFHKNINMLGCVSLPATSLSPTHPSGQVACYPLIVSIGAVSHILSRRDEIRIKGLPTEFYSSPHQ

SEQ ID NO: 133389 - protein, 328 aa, Triticum aestivum
  Clone ID: PAT_TA_27807.pep
VAVQEEVVAVLKQAQEGKPVESVLLVDRQLRYLPEAFGRILGLRVLDVSHNQLQVIPDAIGGLEHLEELRLASNALVSLPDTVGFLSNLKILNVSTNKLRTLPDSISKCRSLVELDASYNGLTYLPTNIGYELINLRKLWVHMNKLRSLPSSICEMRSLYVLDAHFNELCGLPSAIGKLSSLEILDLSSNFSDMKELPFSFGDLLNLREVDLSNNQIHALPDSFGRLDKLEKLNLEQNPLSMPPAEVVKEGVDAVKEYMSKRWLDALLEEEQRSMAAAAAAESPQASTPKAWLARSVSWVSDVGGSLVGYVSGGQTKSEKDSILDQQF

SEQ ID NO: 133390 - protein, 217 aa, Triticum aestivum
  unsure (1)..(217): unsure at all Xaa locations
  Clone ID: PAT_TA_27808.pep
MAYRAEDDYDYLFKVVLIGDSGVGKSNLLTRFTRNEFSLESKSTIGVEFATRSIHVDDKVVKAQIWDTAGQERYRAITSAYYRGAVGALVVYDVTRHVTFENVERWLRELKDHTDANIVIMLVGNKADLRHLRTVXPEDAKAFAERENTFFMETSAXLEAMNVEDAFTEVLSQIYRVVSKKALDIGDDPAAXPKGKTINVGSKDDVSAVKKSNCCSS

SEQ ID NO: 133391 - protein, 421 aa, Triticum aestivum
  Clone ID: PAT_TA_27809.pep
EIETVDEILKHKTRGLGTKIPELNICPIYANLPTELQAKIFETTPEGSRKVVLATNIAETSLTIDGIKYVIDPGFCKIKSYNPRTGMESLLINPISKASANQRAGRSGRTGPGKCFRLYTSYNYMHDLEDNTVPEIQRTNLANVVLTLKSLGIHDLVNFDFMDPPPSEALLKALEQLFALSALNSRGELTKTGRRMAEFPLDPMLSKMIVASEKYKCSDEVMSIASMLSIGNSIFYRPKDKQVHADNARLNFHTGNVGDHIALLNVYNSWRETDFSTQWCYENYIQVRSMKRARDIRDQLEGLMERVEIEVCSNASDLDAIKKAITSGFFHHSARLQKNGSYRTVKNPQTVFIHPSSGLAQLLPRWVIYHELVLTTKEYMRQVTELKPEWLVEIAPHYYQLKDVDDAGSKKLPKGQGRAAL

SEQ ID NO: 133392 - protein, 278 aa, Triticum aestivum
  unsure (1)..(278): unsure at all Xaa locations
  Clone ID: PAT_TA_27810.pep
MTTGSCGSRPSSPSPTSTARCPVTLVSTPWGCPTRRAPADSSSPGGWPTARSSTANHIXXMGGFYIAPAFMDKLVVHLSKNFMTLPNIKIPLILGIWGGKGQGKSFQCELVFAKMGINPIMMSAGELESGNAGEPAKLIRQRYREAADMIKKGXKMCCLFINDLDRRCGVRMGGNQQXYXTVNNQMVNATLMNIADAPTNVQLPGMYNKVLCLYRQDAPTRLPRTSTQRRGVTTAAAFTPFKHANLISDVLSFVQILWSYIWSVRATARMRMRMVELY

SEQ ID NO: 133393 - protein, 91 aa, Triticum aestivum
  unsure (1)..(91): unsure at all Xaa locations
  Clone ID: PAT_TA_27811.pep
DFQVPANKTVINNPPPPRRSPPHHRPSEMEMKXSPSPPSSRPPRPPPSWPPRLPLPPATPPRWQSPRPPSSPPSSHISSTEAADSRGGVNY

SEQ ID NO: 133394 - protein, 441 aa, Triticum aestivum
  Clone ID: PAT_TA_27812.pep
LHIQGGQCGNQIGAKFWEVICGEHGVDPTGQYTGSAPEQLERMDVYFNEAGGNRYVPRAVLMDLEPGTMDSLRSGPIGAIFRPDNFVYGQSGAGNNWAKGHYTEGAELIDSVLDVVRKEAENSDCLQGFQVCHSLGGGTGSGMDTLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMMNVQNKNSSYFVEWIPNNVKSSVCDIPPVGLAMSSTFVGNSTSIQEMFRRVSEQFTAMFRRKAFLHWYTSEGMDEMEFTEAESNMNDLVAEYQQYQDATAEEDYEEEEEPAADQP

SEQ ID NO: 133395 - protein, 291 aa, Triticum aestivum
  unsure (1)..(291): unsure at all Xaa locations
  Clone ID: PAT_TA_27813.pep
RSQPASLLLLGREGRERETATGREAAEAPRRRPAALARERDGARRRLADRLEGREGREGRGWRRGGRRRGSRVGDEYDYLFKVVLIGDSGVGKSNLLSRFTKNTFSLDSKSTIGVEFATRTLHDAHLLXNXHVEEKIIKAQIWDTAGQERYRAITSAYYRGALGAVLVYDVTKPTTFENISRWLKELRDHADANIRIMLVGNKTDLKDLRXAVPADDAGGYAEAEGLSYIETSALEAMNVEEAFQLILGDIYRAVSKKAVASEEDRAGAAGVKEGKTINVAAAADNGGEKK

SEQ ID NO: 133396 - protein, 148 aa, Triticum aestivum
  Clone ID: PAT_TA_27814.pep
MAATKKIKISSIGSTSGSGNWEEDCTIRCSDDVPLDSPVYAQMLPNPQEGDDAKPSLKKIRVGYPALSLHDGDVVYLMHMPDPRGDKACVIALDMRNKAVKGVANFGGSGRPLGHSYTYFPSGISKHLGIFSSTRQISNAAETSRDGK

SEQ ID NO: 133397 - protein, 94 aa, Triticum aestivum
  Clone ID: PAT_TA_27815.pep
VLPNYTINNNSTKCTIKPKLGLSAKNYGRACYECLRGGLDFTKDDENVNSQPFMRWRDRFVFCAEAIYKSQAETGEIKGHYLNATAGTCPGGRS

SEQ ID NO: 133398 - protein, 215 aa, Triticum aestivum
  Clone ID: PAT_TA_27816.pep
MAHRVDNEYDYLFKIVLIGDSGVGKSNILSRFTRNEFCLESKSTIGVEFATRTLQVEGKTIKAQIWDTAGQERYRAITSAYYRGAVGALLVYDITKKLSFENINRWLSELRNHADSNIVIMMVGNKSDLNHLRSVQEEEGQALAEKEGLSFLETSALEALNVEKAFQTILSDIHQIISKKALAAQEAAGSGPPTQGTTINVADSSGNTKKGCCST

SEQ ID NO: 133399 - protein, 160 aa, Triticum aestivum
  unsure (1)..(160): unsure at all Xaa locations
  Clone ID: PAT_TA_27817.pep
MDASATGAGAKAKKGAAGRKAGGPRKKSVTRSVKAGLQFPVGRIGRYLKNGRYAKRVGTGXAPVYLAAVLEYLAAELLELAGNAAKDNKKSRIVPRHLLLAVRNDQELGRLLAGVTIAHGGVLPNINPVLLPKRTAEKEPKEGKSPKKVAKSPKKADKKA

SEQ ID NO: 133400 - protein, 420 aa, Triticum aestivum
  unsure (1)..(420): unsure at all Xaa locations
  Clone ID: PAT_TA_27818.pep
RHEDLLRLPPEPRSSPSHSAARPTSPNGDRLPAPLAAVHFPPPQDNPRRPRPPAAPLRPLQRRRRGCRGGGCGRDGRRNRCWVSAIKGKKVERPPVWLMRQAGRYMKSYQNLCEKYPLFRERSENVDLVVEISLQPWKVFKPDGVILFSDILTPLPGMNIPFDIVKGKGPVIYDPLRTAAAVNEVREFVPEEWVPYVGQALNLLRGEVKNEAAVLGFVGAPFTLASYCVEGGSSKNFSKIKRMAFAEPAILHNLLQKFTTSMASYIKYQADNGAQAVQXFDSWATELSPVDFEEFSLPYLKQIVDSVKETHPDLPLILYASGSGGLLERLPLTGVDVVSLDWTVDMAEGRKRLGSNIAVQGNVDPGVLFGSKEFITKRIYDTVQKAGSEGHVLNLGHGIKVGTPEENVAHFFEVAKGIRY

SEQ ID NO: 133401 - protein, 124 aa, Triticum aestivum
  Clone ID: PAT_TA_27819.pep
MATKCIIGALVGSLGIAYVCDTIVSDKKIFGGTVCKTATDKEWFQATDAKFQAWPRVAGPPVIMNPISRQNFIVKDPRMGGGASSTSVLLPPCSQSFFSRILEFLIKGTLKSGYTILFYEFQFP

SEQ ID NO: 133402 - protein, 89 aa, Triticum aestivum
  Clone ID: PAT_TA_27820.pep
MGKRKAAAKPPPRKRMDKLDTVFSCPFCNHGSSVECRIDLKNLIGEANCQICQESFSTTANALTEPIDVYSEWIDECERVNTVEDDDGA

SEQ ID NO: 133403 - protein, 120 aa, Triticum aestivum
  Clone ID: PAT_TA_27821.pep
FLPVYVQGLIEQEALEEAKNDLLDYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 133404 - protein, 681 aa, Triticum aestivum
  unsure (1)..(681): unsure at all Xaa locations
  Clone ID: PAT_TA_27822.pep
MAGGGDHPGANKRKREAAGRPNAPSKGXGPGDAAKRKKTYYAPAAKPKPQPVTANEKRVAAKEMSESRKMKRKPNYNLEKELAVLWEKMRCRDVSKENRSKLVTEALRKMDGKYFEIAGSHVTARVLQTCVKWCSQPERDAVFVALQPHLLHLSRKKYAVFLVKKLIKLATKKQLALFISSLHGHVASLLRHTIGAAVVDCTFHQATPPQKRSLLLELYSTELQLFKDLTEQKSCSLLETISKLGLQKSSVLQYMTTVIQPLLEKGIVEYSIVHTVILEYLTIADKTSASDVIRQLIPHLTQGSSVVDGDELSGVAEVPTKSKAKKKRSSEPLLIRIMQTREGLKIGLACLKHGSAKDRKKIIKSLKGQNMKLALGDYGCLFLACLLSIVDDTKLVTKVVIDELTNHLKELIFDKNGRRPLLQLLHPLCSRYLTPTDLNCLKYSVPSLVSKDEASESATKVNLDSKLDDVADKEHGGSEDTLVASDSKKDPFKRRQELLVKSELFEVLIETCIENVGELLRTNFGKDVLYEVAVGGKNNVLEGVTDRIHVLHNAIASDAERPRTEDVEHAFDNYHSSRVIRKMILDCPAFAATLWKKALKGKCKSFADGFSSKVVAAYLESSDSKVKDLAKSEVQPLIDGGILKIPDHKAAEKEVSLLSTGLSPSPATQSRPRRRPCLRVR

SEQ ID NO: 133405 - protein, 159 aa, Triticum aestivum
  Clone ID: PAT_TA_27823.pep
MDASATGAGAKAKKGAAGRKAGGPRKKSVTRSVKAGLQFPVGRIGRYLKKGRYAKRVGTGAPVYLAAVLEYLAAELLELAGNAAKDNKKSRIVPRHLLLAVRNDQELGRLLAGVTIAHGGVLPNINPVLLPKRTAEKEPKEGKSPKKTAKSPKKADKKA

SEQ ID NO: 133406 - protein, 88 aa, Triticum aestivum
  Clone ID: PAT_TA_27824.pep
HEEDFQVPANKTEINNPPPSRRSPPHHHPRSPSPPSSPPPRPPPSWPPRPLLPPATPLKWQSPPPPSSPPLSHISSTEAADSRGGVNY

SEQ ID NO: 133407 - protein, 280 aa, Triticum aestivum
  unsure (1)..(280): unsure at all Xaa locations
  Clone ID: PAT_TA_27825.pep
MGNASARAVENGHAAAPMEQVAVAPVGGSSAEAAAPPDAVMRELPPPVPYVFAPQVPVAPMQIPNEFSPAFNHSWMNGSDESTNNNPPEVEIPTLITWSQGGNEVFVEGSWDNWTSRKVLERSGKDHAVLLVLPSGIYHYRMIVDGVPRYVSELTXVPDERGQVANLLDVHEYIPXSLDSVAXFDAPXSPEHSYNMEFPTDEELTKQDPPALPPQLLMTALGGIDHSDELAPKPKPQHVVLNHLFIEKGWGAQSLLALGLTHRFQSKYVNFVLYKPLVRR

SEQ ID NO: 133408 - protein, 216 aa, Triticum aestivum
  Clone ID: PAT_TA_27826.pep
MAHRVDNEYDYLFKIVLIGDSGVGKSNILSRFTRNEFCLESKSTIGVEFATRTLQIEGKTVKAQIWDTAGQERYRAITSAYYRGAVGALLVFDITKRQTFDNVQRWLRELRDHADANIVVMMVGNKSDLNHLRSVPEEDSQAFSEKEGLSFLETSALEAINVEKAFHTVLSEIHQIVSKKALAAQESAAANGRSMQGTTINVAEPSVNAKGSCCSS

SEQ ID NO: 133409 - protein, 145 aa, Triticum aestivum
  Clone ID: PAT_TA_27827.pep
MPKIKTSRVKYPEGWELIEPTLRDLEAKMREAENDTHDGKRKCEALWPIFRISHQKSRYIYDLYYRRKEIKKELYEFCLDQGYADKNLIAKWKKPGYERLCCLRCIQTRDHNFATTCVCRVPKHLREETVIECVHCGCKGCASGD

SEQ ID NO: 133410 - protein, 157 aa, Triticum aestivum
  Clone ID: PAT_TA_27828.pep
IVQYSQKTTISLFEASAPSFPTSKSFLISFAHVPFLSKVFGNHFHLHPGRRCHSYLQFHYLPKQEDALHAAVAAPCYCLHGWLVHHQLRCRSRRAPCPCLGAANGTNWMGWRRGDVEEGGRLVSALAGRRRSYAGEDVFCAQRRRRPQEEREEKQRS

SEQ ID NO: 133411 - protein, 175 aa, Triticum aestivum
  Clone ID: PAT_TA_27829.pep
MAPAVMASSATTVAPFQGLKSTTGLPISRPSGSAGLSNVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 133412 - protein, 234 aa, Triticum aestivum
  Clone ID: PAT_TA_27830.pep
NLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAETKNDLLIYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 133413 - protein, 168 aa, Triticum aestivum
  Clone ID: PAT_TA_27831.pep
MAPTVASPATGAVPSPIASDLGKAARSVGLGLPALPPLPGLASHGQPRVASFCKRLARNVVSMAAGEPAAPLADNAELTEFFNGLKQEWDRVEDKYAVTTLAVAATLGMWSAGGVVSAIDRLPVVPGLMEVVGIGYSGWFAYKNLLFKPDRKAFFAKVRNIYEDIISG

SEQ ID NO: 133414 - protein, 158 aa, Triticum aestivum
  Clone ID: PAT_TA_27832.pep
MIVFCELHFCPGLCFPTRAYFSFGMICVCTSAATTLRAAARAGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLSKYGRPLLGCTCPGGRS

SEQ ID NO: 133415 - protein, 288 aa, Triticum aestivum
  Clone ID: PAT_TA_27833.pep
DNFDMVFHIGDLPYANGYISQWDQFTAQVAPISARKPYMIASGNHERDWPNTGGFFDVEDSGGECGVLAETMYYYPAENRANFWYKVDYGMFRFCVADSEHDWREGTPQYKFIKECLSTVDRKHQPWLIFAAHRVLGYSSNKWYAEQGSFEEPEGRESLQKLWQRYRVDLAFFGHVHNYERTCPLYQNQCVSNERSRYSGTMNGTIFVVAGGGGSHLNGYTSAIPKWSVFRDRDYGFTKLTAFNHSSLLFEYKRSSDGKVYDNFTIHRDYRDVLGCVHDSCFPTTLAT

SEQ ID NO: 133416 - protein, 410 aa, Triticum aestivum
  Clone ID: PAT_TA_27834.pep
MGALAESIASHVPSGMLSAGLAALAALPNPGELVRKAARLEDELRELLRLNGRGAGAGAEQGGGNRAQQTRERFLRAYERLKDELLKDRAFNFDFTEETRQWVAKMLDYNVPGGKLNRGLSVIDSYMLLREGTEVDEEDFYLACVLGWCIEWLQASALVMDDITDNAYTRRDNLCWYKLPTVGLSAINDGVLLKCHVQAIIKRYFKEKFYFMELMELWNEIGLQTAMGQMLDLITTHTGAKDLARYRIQGYRRIVKYKTSYYSFYLPVACALLLNGAKLSDYVELKNVLIEMGVYFQIQDDYLDCFGDPQVIGKVGTDIEDYKCSWLIVQAMELANENEMKILYENYGKSCPECVAAVKNVYKELDLQDIFLEYESRVYKHLVSTIDAEPDRAIREILKIFLKKIYRRKK

SEQ ID NO: 133417 - protein, 72 aa, Triticum aestivum
  Clone ID: PAT_TA_27835.pep
EEALPTSLAHIFPLCFPCERRRSRDHLAQCRPAVPRRVRFNVLKVVPSRVKEWCGEEGVSPGFISRVLQTSS

SEQ ID NO: 133418 - protein, 250 aa, Triticum aestivum
  Clone ID: PAT_TA_27836.pep
TNPSIVLKKTLSCSYPNLPFNEALRKESEKLQVELQRSQSNMDMAQCEVIHHLLGVTRTVESSIPDESTDAKVTKKTKSKCTKVNEDSAKSYDDDSPKKQKDAYVAPRSSSPVPYNHDLVSSTASYSDEWHADLLGCCSEPALCLKTFFFPCGTFSRIASIAKNKPMSSGEACNDIMAYSLILSCCCYTCCVRRKLRQRLNIAGGCCDDFLSHVMCCCCALVQEWREVEIRGAYGGKTKITPPAHQYMEH

SEQ ID NO: 133419 - protein, 368 aa, Triticum aestivum
  Clone ID: PAT_TA_27837.pep
MALGGCGNEADGARANHGGSSTGQRQQHGGRPLVWEGNGTANRSGSGDQDANGSGSQRPWKGLKDNNLYDPWNHAWPYYGGFDCTYCSLKHKGGGATRVAEHLGGIVGNVRSCPNVPRNVRDAMRECRDESRRKKRDKQNSRLRIERNIMEGLYKKGGVVNVPDDDEEEIQMNIREALRDPNVSRRIERRIGKGGVGDVHVSVGKRSISAYFDRQLSSNKVYMQPKISSALDPNSRDALGLAWSKFFHANDIAGRKADCPYFRAAVKITQQLGPIPIPTAKEIDGPYLEANYDEANSFLQKFKQDWKNFGVTLMCDSWTGPTGMSIINFMVYCNARMFFLNTIDASGQTQNSDFIYREIEGVLCWFKG

SEQ ID NO: 133420 - protein, 264 aa, Triticum aestivum
  unsure (1)..(264): unsure at all Xaa locations
  Clone ID: PAT_TA_27838.pep
MDAGAGAGAGAPYASRTAEEVFRDFRGRRAGMIKALTQEVDKFYQLCDPEKENLCLYGYPNETWEVTLPAEEVPPEIPEPALGINFARDGMNEKDWLALVAVHSDSWLLAVSFYFAARFGFDKEARRRLFNMINNLPTIFEVVTGAAKKQIKEKAPNSTHKSNNKPSMKTYSKPESQSKAPKIAAPPKDEDESGEDYGEXEEEEERDNTLCGTCGTNDGKDEFWICCDNCERWYHGKCVKITPARAEHIKHYKCPDCSNKRARA

SEQ ID NO: 133421 - protein, 428 aa, Triticum aestivum
  Clone ID: PAT_TA_27839.pep
MFLESYHSKEDKFREWMVSKDWKECQWRYEPGYVFAEECLSSNVWWNALEWVLSSLRPLYTAMRYADTQKQCTLSGFKKSMMLAIQRMEAHLGPTSRLYLSFMRKVGKRIDAMEEDTFMVAAAVLDPYTHYKLNLCNHTDYATSLTDAIAKILDPVSALSAIDEVSKFRECQGRFGTRLAEEAAARMGPTQWWFQFGGDVPALQKCAMRICSQCVSSSGCERNWSAFALVHTKQRSRLLYDKLHKLVSVRYNLKIRAEEDQEKERDIDKEIDPSALLMDTTMFDETNPIMEWLNEDVEDLIVDGADAASAVFEQIRRLNSSRKASYVGSKGNNKKRKRNDDDENEFLETESEDDEEENEYVDNDIEDDDGVSEDDEDGEQDQLETQMQLEEETQVQVQKEAPTSTGHLETRSGRLIRKKTKNVNSLYS

SEQ ID NO: 133422 - protein, 216 aa, Triticum aestivum
  unsure (1)..(216): unsure at all Xaa locations
  Clone ID: PAT_TA_27840.pep
MAHRVDNEYDYLFKIVLIGDSXGVGKSNILSRFTRNEFCLESKSTIGVEFATRTLQVEGKTIKAQIWDTAGQERYRAITSAYYRGAVGALLVYDITKKLSFENINRWLSELRNHADSNIVIMMVGNKSDLNHLRSVQEEEGQALAEKEGLSFLETSALEALNVEKAFQTILSDIHQIISKKALAAQEAAGSGPPTQGTTINVADSSGNMKKGCCST

SEQ ID NO: 133423 - protein, 435 aa, Triticum aestivum
  unsure (1)..(435): unsure at all Xaa locations
  Clone ID: PAT_TA_27841.pep
AMTRAVADVSAARSALQELGPRPDHELIDSSRAVVAAAAAGDVAPRITEEDLEACRTVVRLEEAHDTYEALLQEAEERLEKVYRSAMEGRDLEEAEGKDESAAGDEGVAVQEEVVAVLKQAQEGKPVESVLLVDRQLRYLPEAFGRILGLRVLDVSHNQLQVIPDAIGGLEHLEELRLASNALVSLPDTVGFLSNLKILNVSTNKLRTLPDSISKCRSLVELDASYNGLTYLPTNIGYELINLRKLWVHMNKLRSLPSSICEMQSLYLLXDAHFNELCGLPSAIGKLSXLQILNLSSNFSDMKELPFSFGDLLNLREVDLSNNQIHALPDSFGRLDKLEKLNLEQNPLSMPPAEVVKEGVDAVKEYTSKRWLDALLEEEQRSMAAAAAESPQASTPKAWLARSVSWVSDVGGSLVGYVSGGQTKSEKDSILDQQF

SEQ ID NO: 133424 - protein, 192 aa, Triticum aestivum
  Clone ID: PAT_TA_27842.pep
ARDKLPTNVSIGQYIVTMLLQIWLTVAVNDINTLRPYEYYSYTCSCTIIIFNSVDALALIDPFAVYINRFSQRICSGAEAFLADLTVSLTNQILQINPALNAAPMVAEWAGEDGIELVHPLPRWWLSSRLSLPHGSASLLTSKSGDLFARKKGNGYGGAGPLVAGGGGRDSGGGGWIRPRRWRGRGRGKGRD

SEQ ID NO: 133425 - protein, 148 aa, Triticum aestivum
  unsure (1)..(148): unsure at all Xaa locations
  Clone ID: PAT_TA_27843.pep
SWYADQGSFEEPEGRESLQKLWQKYRVDIAYFGHVHNYERTCPLYQSQCVNNEKSHYSGTMNGTIFVVAGGGGSHLSEYTTAIPKWXSIFRDHDYGFTKLTAFNHSSLLFEYMKSSDGKVYDSFTIHRDYRDVLSCVHDSCFPTTLAS

SEQ ID NO: 133426 - protein, 161 aa, Triticum aestivum
  Clone ID: PAT_TA_27844.pep
MAEQTEKAFLKQPKVFLCSKKTTKGNNKPGKEGSRFWKSVGLGFKTPKEAIEGTYIDKKCPFTGTVSVRGRIIAGTCHSAKMNRTIIVRRNYLHYVKKYQRYEKRHSNIPAHISPCFRVREGDHVIIGQCRPLSKTVRFNVLKVVPAGSKSGAVKKAFTGA

SEQ ID NO: 133427 - protein, 159 aa, Triticum aestivum; identical to SEQ ID NO: 133321
  Clone ID: PAT_TA_27845.pep

SEQ ID NO: 133428 - protein, 162 aa, Triticum aestivum
  Clone ID: PAT_TA_27846.pep
KHLQKTTISLFEASAPSFPTSKSFLISFAHVPFLNQKPESYKLLSLSPFQGLWEPLPFASWSPLPLLFAVPLPSQTRGRPPCCCRCPVLLPPWLARAPSASLPQPPSAMPLSWSSEWHELDGVEVRRCGGRREASERVGRTPEKLRWRGCVLCAAAAPPTGG

SEQ ID NO: 133429 - protein, 174 aa, Triticum aestivum
  Clone ID: PAT_TA_27847.pep
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 133430 - protein, 156 aa, Triticum aestivum
  Clone ID: PAT_TA_27848.pep
MDASATGAGAKGKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKTAKSPKKADKKA

SEQ ID NO: 133431 - protein, 111 aa, Triticum aestivum
  Clone ID: PAT_TA_27849.pep
MAPSQPKSGLFVGINKGHVVTKRELPPRPSDRKGKGTKRVLFVRNLIREVAGFAPYEKRITELLKVGKDKRALKVAKRKLGTHKRATKKREEMSSVLRKKNKTSKSQLIKP

SEQ ID NO: 133432 - protein, 111 aa, Triticum aestivum
  Clone ID: PAT_TA_27850.pep
MAPSQPKSGLFVGINKGHVVTKRELPPRPSDRKGKGTKRVHFVRNLIREVAGFAPYEKRITELLKVGKDKRALKVAKRKLGTHKRAKKKREEMSSVLRKMRSAGTGTDKKK

SEQ ID NO: 133433 - protein, 363 aa, Triticum aestivum
  Clone ID: PAT_TA_27851.pep
PLSPPALSADLETFMSWVDEVRQLKVMANAHTPGDALAARKNGAEGIGLCRTEHMFFASDERIKAVRQMIMAPTVELRQKALDRLLPYQRSDFEGIFRAMDGLPVTIRLLDPPLHEFLPEGHVEDIVRELCAETGAAEDDVLARMEKLSEVNPMLGFRGCRLGISYPELTEMQARAIFEAAISMTNQGIQVFPEIMVPLVGTPQELGHQVALIRQIANNVFTNMGKTIDYKVGTMIEIPRAALVADEIAEQAEFFSFGTNDLTQMTFGYSRDDVGKFLPIYLAQGILQHDPFEVLDQRGVGELVKIATERGRKARPNLKVGICGEHGGEPSSVAFFAKAGLDYVSCSPFRVPIARLAAAQVLV

SEQ ID NO: 133434 - protein, 219 aa, Triticum aestivum
  Clone ID: PAT_TA_27852.pep
MPILGIWGGKGQGKSFQCELVFAKMGINPIMMSAGELESGNAGEPAKLIRQRYREAADMIKKGIFQTDNVSDESVVKIVDTFPGQSIDFFGALRARVYDDEVRKWVTSTGIENIGKRLVNSRDGPVTFEQPKMTVEKLLEYGHMLVQEQDNVKRVQLADTYMSQAALGDANQDAMKTGSFYGKGAQQGTLPVPAGCTDQTAKNFDPTARSDDGSCLYTF

SEQ ID NO: 133435 - protein, 89 aa, Triticum aestivum
  Clone ID: PAT_TA_27853.pep
MGKRKSAAKPPPKKRMDKLDTVFSCPFCNHGSSVECRIDMKNLIGEANCRICQESFSTTVNALTEPIDIYSEWIDECERVNTVEDDDGA

SEQ ID NO: 133436 - protein, 127 aa, Triticum aestivum
  unsure (1)..(127): unsure at all Xaa locations
  Clone ID: PAT_TA_27854.pep
LNSQAALVADEIAEQAEFFSFGTNDLTQMTFGYSRDDVGKFXPIYLAQGILHHDPFEVLDQRGVGELVKIATERGRKARPNLKVGICGEHGGEPSSVAFFAKAGLDYVSCSPFRVPIARLAAAQVLV

SEQ ID NO: 133437 - protein, 187 aa, Triticum aestivum
  Clone ID: PAT_TA_27855.pep
RFNRPVHCYNATTDMADGGSKWQQHIEVIEYYSYTCSCTIVIFNSVDALALIDPFAVYINSFSQRICSGAEAFLADLTVSLTNQILQINPAFDAAPMVAEWAGEDGIELVHPLPRGWLSGRLPLPHGSTSLLTSKSQREGGDLVTCLRGRRETATSAQVPDGFRRRRVDPPPGAGGEGEGERGGTRG

SEQ ID NO: 133438 - protein, 296 aa, Triticum aestivum
  Clone ID: PAT_TA_27856.pep
LISKIREEYPDRMMMTFSVFPSPKVSDTVVEPYNATLSVHQLVENADECMVLDNEALYDICFRTLKLTTPTFGDLNHLISATMSGVTCCLRFPGQLNSDLRKLAVNLIPFPRLHFFMVGFAPLTSRGSQMYRALTVPELTQQMWDSKNMMCAADPRHGRYLTASAMFRGKMSTKEVDEQMLNVQNKNSSYFVEWIPNNVKSSVCDIPPTGLKMSSTFVGNSTSIQEMFRRVSEQFTAMFRRKAFLHWYTGEGMDEMEFTEAESNMNDLVAEYQQYQDATVEEEEDYEDEQEDEEAA

SEQ ID NO: 133439 - protein, 190 aa, Triticum aestivum
  Clone ID: PAT_TA_27857.pep
NLTEFASASNPEHNHQPCAPSPCTSQASCMRTNELSGCCSCQKCPSLIHGFCQCNSHSHLILLHQNLPWDSSSSLLLQICTHCSTHGEAEADRWLELLPAMATRRRGLGGPRWPAPLSSPLLPPAPASSSGRLALLPLDCDIGARHPPLPPARGLSPSPRFPGEVHGVADGSGDPSEAGGGGWRERRRVS

SEQ ID NO: 133440 - protein, 209 aa, Triticum aestivum
  Clone ID: PAT_TA_27858.pep
SSFLKPQASRAHRTRSSFPFRYFLRLATMTALAKPSASAPKPKKTSAAGAAHPTYFEMIKEAIAALKDRTGSSSVAIAKFIEEKHGKALPANFKKMLSVQLRSSAAKGKLVKVKASYKLSDAAKKDSPKPKAKPAAPKAAAKPAKDAAKPKKKASAKPKKAAAAGTKRKAPEKKKLVAKAKKSPAAKAKAKPKTVRSPAAKKARKVASA

SEQ ID NO: 133441 - protein, 68 aa, Triticum aestivum; identical to SEQ ID NO: 133335
  Clone ID: PAT_TA_27859.pep

SEQ ID NO: 133442 - protein, 68 aa, Triticum aestivum
  Clone ID: PAT_TA_27860.pep
MTTSRRLADRKTSKFQKNITKRGSVPETTVKKGNDYPVGPIVLGFFIFVVIGSSLFQIIRTASSGGMA

SEQ ID NO: 133443 - protein, 445 aa, Triticum aestivum
  Clone ID: PAT_TA_27861.pep
MREILHIQGGQCGNQIGAKFWEVICDEHGIDGTGRYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPSFGDLNHLISATMSGVTCCLRFPGQLNSDLRKLAVNLIPFPRLHFFMVGFAPLTSRGSQMYRALTVPELTQQMWDAKNMMCAADPRHGRYLTASACFRGKMSTKEVDEQMLNVQNKNSSYFVEWIPNNVKSSVCDMPPRGLKMAGTFVGNSTSIQEMFRRVSEQFTAMFRRKAFLHWYTGEGMDEMEFTEAESNMNDLVAEYQQYQDATADEEYDEEEEEERDAE

SEQ ID NO: 133444 - protein, 164 aa, Triticum aestivum
  Clone ID: PAT_TA_27862.pep
MARAPRPTGSQVMASGKHRRRRGTQTSGRVLPNDISDDRIGVCKGIFQTDNVSDESVVKIVDTFPGQSIDFFGALRARVYDDEVRKWVTSTGIENIGKKLVNSRDGPVTFEQPKMTVEKLLEYGHMLVQEQDNVKRVQLADTYMSQAALGDANQDAMKTGTFYG

SEQ ID NO: 133445 - protein, 313 aa, Triticum aestivum
  unsure (1)..(313): unsure at all Xaa locations
  Clone ID: PAT_TA_27863.pep
AGYYSDEALSLEELPKRAVILGGGYIAVEFASIWRGMGAEVDLFYRRELPLRGFDDEMRTVVASNLEGRGIKLHPGTNLTELSKTADGIKVVTDKGDELIADVVLFATGRAPNSNRLNLEAVGVEVDQIGAIKVDEYSXVHQVPSIWAVGDVTNRINLTPVAPXWEATCFAKTVFGGQTVKPDYKDVPCAVFCIPPLSVVGLSEQEALAEAKNDLLVYTSSFNPMKNSISKRVEKSTMKLVVDADTDKVLGAAMCGPDAAEIMQGIAVALKAGATKATFDSTVGIHPSAAEEFVTMRTLTRRVSPPSKPKTNL

SEQ ID NO: 133446 - protein, 117 aa, Triticum aestivum
  Clone ID: PAT_TA_27864.pep
RPRTRGIFSPQPARKRKRKRIESARARARTMAALRLAVRRFCDRALGRSAGIYELKAAKEFPDIDPGHLKAARKFPKLRVKDVDATALNVFKILRQSPVDGHVRMTLKTLAEIQEEE

SEQ ID NO: 133447 - protein, 620 aa, Triticum aestivum
  Clone ID: PAT_TA_27865.pep
MGMAHVVVLAAVLAMATTVSASPEAGVQPLSKIAIHKATVELHGSAYVRASALLLGDGDQQEGDTATVTVEYGWQNPATDDWIAVFSPSDFISGSCPNPRRYPTEPLLCTAPIKYQYANFSANYLYWGKGTIQFQLINQRSDFSFALFTGGLENPKLVGLTKLSPFKNPKAPVFPRLAQGKTHDEMAVTWTSGYDVGEAYPFVEWGMVTTGSGAGNPARTPAGTLTFNRGSMCGAPARTIGWRDPGFIHTAFMRGLWPNKEYFYKIGHELPDGTVVWGKPYTFRAPPTPGQSSLQRVIVFGDMGKAERDGSNEYANYQPGSLNTTDALVRDLDNFDMVFHIGDLPYANGYISQWDQFTAQVAPISARKPYMIASGNHERDWPDTGGFFDVEDSGGECGVLAETMYYYPAENRANFWYKVDYGMFRFCVADSEHDWREGTPQHKFIEECLSTVDRKHQPWLIFTAHRVLGYSSNKWYAEQGSFEEPEGRESLQKLWQRHRVDLAIFGHVHNYERTCPLYQNQCVTGERSRYSGTMNGTIFVVAGGGGSHLNGYTSAVPKWSVFRDRDYGFTKLTAFNHSSLLFEYKRSSDGKVYDNFTIHRDYRDVLGCVHDSCFPTTLAT

SEQ ID NO: 133448 - protein, 221 aa, Triticum aestivum
  Clone ID: PAT_TA_27866.pep
MAGSGGGAYRAEDDYDYLFKAVIIGDSGVGKSNLLSRFTKNEFCLESKSTIGVEFATRSLQVDGKVVKAQIWDTAGQERYRAITSAYYRGAVGALLVYDVTRRATFDNVARWLKELRDHTDSSIVVMLVGNKSDLRHLVAVSTEDGQEYAEAESLYFMETSALDATNVDNAFSEVLTQIYRIASRKTVDAGDDGSSAPSKGENINVKDDVSSLKKAGCCSS

SEQ ID NO: 133449 - protein, 317 aa, Triticum aestivum
  unsure (1)..(317): unsure at all Xaa locations
  Clone ID: PAT_TA_27867.pep
MQVKQKVYELYKGTVERVTGPRTVSAFLEKGVLSVPEFILAGDNLVSKCPTWSWEAGDPSKRKPYLPSDKQFLVTRNVPCLXRRAVAVEEEYDAAGAEVVLDDDEDGEGWLATHGLQASESKEEEDIPSMDTLDIGKVEEIKSIPSYFGAGEKPDDEEDIPDMDTYEDTGDHSTATPQPSYFVAEEPDDDNILLTRTYDVSITYDKYYQTPRVWLTGYDEARMPLKPELVFQDISQDHAHKTVTIEDHPHLLVGQHASVHPCKHAAVMKKIIDVIVSQGGAPEVDKYLFIFLKFMASVIPTIEYDYTMDFDLGSTST

SEQ ID NO: 133450 - protein, 498 aa, Triticum aestivum
  unsure (1)..(498): unsure at all Xaa locations
  Clone ID: PAT_TA_27868.pep
MAAAVVDAAVPVAAKANGAGARCCAAKGPGYATPREAMEKGPREGLLYVTCVYNGTGIDKPDYLATVDVDPNSATYSQVIHRLQATHIGDELHHSGWNACSSCHGDPSTSRRFLILPSLLSGRLYVVDTAKNPRAPALHKVVQAEDIAEKTGLGFPHTSHCLATGDIMISCLGDKEGNAAGNGFLLLDSEFNVKGRWEKPGHSPLFGYDFWYQPRHKTMISSSWGAPAAFRTGFDLQXHVQDGLYGRHLHVYDWPGXGELKQTLDLXGSTGLLPLEVRFLHDPSKDTGYVGCALTSNMVRFFKTADGSWSHEXLAISIKPLKVRNWILPEMPGLITDFVISLDDRYLYLVNWLHGDIRQYNIEDPAKPVLAGQVFVGGLLQKGSDVVYVTDDDKEEQYAVPEVKGHRLRGGPQMIQLSLDGKRVYVTNSLFSRWDEQFYGPDLLKKGSHMLQIDVDTEEGGLAVNPNFFVDFGTEPEGPSLAHEMRYPGGDCTSDIWI

SEQ ID NO: 133451 - protein, 458 aa, Triticum aestivum
  Clone ID: PAT_TA_27869.pep
MPSGSTQFRYTQTPSKVLHLRNMPWESTEEELVELCKPFGRVVNTMCNVGANRNQAFVEFADQNQAISMVSYYASSSEPAQVRGKTVYIQYSNRQEITNNKGTGDSSGNVLLVTFEGVQPNDVSIDVIHLVFSAFGFVHKIATFEKAAGFQALIQYTDAPTALEAKNSLDGRSIPRYLLAQHVSICHLRITFSAHKDLNIKFQSHRSRDYTNPYLPVNPTAIEGIAQPMLGSDGKIKEPESNVLLASIENMQYAVGVDVLHTVFSSFGAVRKIAMFEKNGGMQALIQYPDITTAGVAKQALEGHCIYDGGYCKLHLSYSRHTDLNVKAHDERSRDYTVSDPSAQVQAAGQAPGLSTPGAAWQSTTPAAFYGSSARAASIGQVPAWNPNMQRGAFAPASTSYPTQLLMANPGPHFPAVGSSSGAPPMLYQASQQMAQYGTAPTALPHAALSGEPMYFPK

SEQ ID NO: 133452 - protein, 95 aa, Triticum aestivum
  Clone ID: PAT_TA_27870.pep
MTKGTGSFGKRRNKTHTLCIRCGRRSFHLQKSTCSSCGYPAARIRKYNWSVKAIRRKTTGTGRMRYMRHVPRRFKEQLQEKVPEGCRPRNRAAAN

SEQ ID NO: 133453 - protein, 316 aa, Triticum aestivum
  unsure (1)..(316): unsure at all Xaa locations
  Clone ID: PAT_TA_27871.pep
SARGGSNEYANYQPGSLNTTDALVKDLDNFDMVFHIGDLPYANGYISQWDQFTAQVAPISARKPYMIASGNHERDWPNTGGFFDVEDSGGECGVLAETMYYYPAENRANFWYKVDYGMFRFCVADSEHDWREGTPQYKFIEECLSTVDRKHQPWLVFAAHRVLGYSSNKWYAEQGSFEEPEXGRESLQKLWQRHRVDLAIFGHVHNYERTCPLYQNQCVSNERSRYSGTMNGTIFVVAGGGGSHLNGYTSAVPKWSVFRDRDYGFTKLTAFNHSSLLFEYKRSSDGEVYDNFTIHMDYRDVLGCVHDSCFPTTLAT

SEQ ID NO: 133454 - protein, 316 aa, Triticum aestivum
  Clone ID: PAT_TA_27872.pep
MQMKQKVYELYKGTVERVTGPRTVSAFLEKGVLSVPEFILAGDNLVSKCPTWSWEAGDPSKRKPYLPSDKQFLVTRNVPCLRRAVAVEEEYDAAGAEVVLDDDEDGEGWLATHGLQASESKEEEDIPSMDTLDIGKVEEIKSIPSYFGASEKPDEEEDIPDMDTYEDTGDHSTATPQPSYFVAEEPDDDNILLTRTYDVSITYDKYYQTPRVWLTGYDEARMPLKPELVFQDISQDHAHKTVTIEDHPHLLVGQHASVHPCKHAAVMKKIIDVIVSQGGAPEVDKYLFIFLKFMASVIPTIEYDYTMDFDLGSTST

SEQ ID NO: 133455 - protein, 221 aa, Triticum aestivum
  Clone ID: PAT_TA_27873.pep
HPLNIAVPPHVQLPGMYNKEENPRVPIVVTGNDFSTLYAPLIRDGRMEKFYWAPTRDDRIGVCKGIFQTDNVSDESVVKIVDTFPGQSIDFFGALRARVYDDEVRKWVTSTGIENIGKKLVNSRDGPVTFEQPKMTVEKLLEYGHMLVQEQDNVKRVQLADTYMSQAALGDANQDAMKTGTFYGKGAQQGTLPVPAGCTDQTAKNFDPTARSDDGSCLYTF

SEQ ID NO: 133456 - protein, 110 aa, Triticum aestivum
  Clone ID: PAT_TA_27874.pep
MTKGTGSFGKRRNKTHTLCIRCGRRSFHLQKSTCSSCGYPAARIRKYNWSVKAIRRKTTGTGRMRYMRHVPRRFKSNFREGTEAAPRSKGASSSGQLGAAALTCYAKREP

SEQ ID NO: 133457 - protein, 378 aa, Triticum aestivum
  unsure (1)..(378): unsure at all Xaa locations
  Clone ID: PAT_TA_27875.pep
MRGKQHPHGTGGSEQKIIGLSPIELPRETMGSAGALLSHPPPQLGSILLRRHHISLPHLSSCMPEPLHCRRRHLRCSAVEGSSRQDTNLPASQREESPSSSLGATLQDPLPGRVENGSFEGVTQEEDQSSLYNFLYPSKELLPDDKEMSIFDHLEELRARIFISVLAVGASIIGCFAFSKDIIKILEAPVSVQGVRFLQLSPGEFFFTTLKVSGYCGLLIGSPIILYEIIAFVLPGLTKDERKFLGPIVLGSSVLFYLGILFSYTVLAPAALNFFVNYAEGAVESIWSIDQYFEFVLVLLFSTGLSFQVPVIQLLLXGQVGLVSSEQMLSIWRYVVVGAVVAAAVLTPSTDPLTQMLLAGPLLGLYLGGAWMVRLTGR

SEQ ID NO: 133458 - protein, 444 aa, Triticum aestivum
  Clone ID: PAT_TA_27876.pep
MREILHIQGGQCGNQIGAKFWEVICDEHGIDGTGRYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPSFGDLNHLISATMSGVTCCLRFPGQLNSDLRKLAVNLIPFPRLHFFMVGFAPLTSRGSQMYRALTVPELTQQMWDAKNMMCAADPRHGRYLTASACFRGKMSTKEVDEQMLNVQNKNSSYFVEWIPNNVKSSVCDMPPRGLKMAGTFVGNSTSIQEMFRRVSEQFTAMFRRKAFLHWYTGEGMDEMEFTEAESNMNDLVAEYQQYQDATAEEEYDDEEEEERDA

SEQ ID NO: 133459 - protein, 112 aa, Triticum aestivum
  Clone ID: PAT_TA_27877.pep
MAPSQPKSGLFVGINKGHVVTKRELPPRPSDRKGKGTKRVHFVRNLIREVAGFAPYEKRITELLKVGKDKRALKVAKRKLGTHKRAKKKREEMSSVLRKMRSAGGGAGDKKK

SEQ ID NO: 133460 - protein, 97 aa, Triticum aestivum
  Clone ID: PAT_TA_27878.pep
RYKVDYGMFRFCVADSEHDWREGTPQHKFIEECLSTVDRKHQPWLIFTAHRVLGYSSNKWYLPGRPRFFFLPNQQGRGRGSGSSRRERGRGRWRRSG

SEQ ID NO: 133461 - protein, 68 aa, Triticum aestivum; identical to SEQ ID NO: 133371
  Clone ID: PAT_TA_27879.pep

SEQ ID NO: 133462 - protein, 448 aa, Triticum aestivum
  unsure (1)..(448): unsure at all Xaa locations
  Clone ID: PAT_TA_27880.pep
MREILHIQGGQCGNQIGAKFWEVVCAEHGIDPTGRYAGDTDLQLERVNVYYNEASCGRFVPRAVLMDLEPGTMDSVRSGPYGGIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSXRGSQQYRALTVPELTQQMWDAKNMMCAADPRHGRYLTASAMFRGKMSTKEVDEQMLNVQNKNSSYFVEWIPNNVKSTVCDIPPTGLKMASTFIGNSTSIQEMFRRVSEQFTAMFRRKAFLHWYTGEGMDEMEFTEAESNMNDLVSEYQQYQDATADEEGEYEDEEDDADLQD

SEQ ID NO: 133463 - protein, 411 aa, Triticum aestivum
  unsure (1)..(411): unsure at all Xaa locations
  Clone ID: PAT_TA_27881.pep
MAGLSLRCGDCGVQLRSVEEAQAHAEATSHTNFAESTEAVLNLVCADCGKPCRSQTEVDLHRKRTGHAEFTDKTMEAAKPIDLEAPPKPALEAMDVDASGSAEPQELVAPEVNKEMLGELESMGFSTARATRALHFSGNSTIEGAINWLSEHQEDPDIDEMPMVPANTEANKPSLTEEEKKIKAQELRERARKKKEEEEKRMEREREKERIRIGKELLEAKKMEELNERKRIIELRRLEKEEEKRAREKIRQKLEEDKAERRRKLGLPAEAPAASKPSAPPPVEEKKSAFLPVRPATKAEXMRDCLRNIKQQNKEEDAKVKRAFQTLLTYIGNVVKNPDEEKFRKIRLNNATFQERVGSLGGIEFLELCGFEKPEGEEILFLARDKVDKAVLNVAGAELNSAITNPFFGVL

SEQ ID NO: 133464 - protein, 189 aa, Triticum aestivum
  Clone ID: PAT_TA_27882.pep
MPALAKPAARPAKPAAAAPKPKPAAAKPKAAAAGAAHPTYFEMIKEAIAALKDRTGSSSVAIAKYIEEKHGKALPANFKKMLSVQLRSSAAKGKLVKVKASYKLSDAAKKDSPKAKPAAKPAKDAAKAKKTVAAKPKKTAAAGTKRKAPEKKKLVTKAKKSPAAKAKAKPKTVRSPAAKKARKVARRLI

SEQ ID NO: 133465 - protein, 235 aa, Triticum aestivum
  Clone ID: PAT_TA_27883.pep
INSSRQSKTLTPFSLTDKGANSRCGVITLTKVYDSRIGNKARAAQFYVYGVIDFQRFPPPPPIFGPLEPRAEFGTSAAAAAAADAEAAAASSSPPRRCRPTRPSASSRSWPRSSARTAPSPTGSACGPTTPSGTTRSAGTGAAPSSGSRSGPPGRGVVEPWLKSYLHFVLWTFQCLLCKLGSDSRICLCYQFRRVMRILLVLWCTHVTMLCQVKNLCYMPPLLNLSPWLNFGSNG

SEQ ID NO: 133466 - protein, 168 aa, Triticum aestivum
  Clone ID: PAT_TA_27884.pep
MAPTVASPATGAVASPIASDLGKAARSVGLGLPALPPLPGLASHGQPRVASFCKRLARNVVSMAAGEPAAPLADNAELTEFFNGLKQEWDRVEDKYAVTTLAVAATLGMWSAGGVVSAIDRLPVVPGLMEVVGIGYSGWFAYKNLLFKPDRKAFFAKVRNIYEDIISG

SEQ ID NO: 133467 - protein, 174 aa, Triticum aestivum; identical to SEQ ID NO: 133429
  Clone ID: PAT_TA_27885.pep

SEQ ID NO: 133468 - protein, 174 aa, Triticum aestivum
  Clone ID: PAT_TA_27886.pep
MAPAVMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 133469 - protein, 174 aa, Triticum aestivum
  Clone ID: PAT_TA_27887.pep
MAPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 133470 - protein, 155 aa, Triticum aestivum
  Clone ID: PAT_TA_27888.pep
LSCSSPTRHHSISRARVWPPLLSPSPLSPRTTELGAPPPWPWPRKPRRRRATSSPRPGRPPPSPAIMREGPNLLKLARKEQCLALGNRLRSKYKIAYQFYRVFPNGEVQYLHPKDGVYPEKVNAGRQGVGQNFRSIGKNVSPIEVKFTGKNSFDI

SEQ ID NO: 133471 - protein, 112 aa, Triticum aestivum; identical to SEQ ID NO: 133459
  Clone ID: PAT_TA_27889.pep

SEQ ID NO: 133472 - protein, 175 aa, Triticum aestivum
  Clone ID: PAT_TA_27890.pep
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 133473 - protein, 501 aa, Triticum aestivum
  unsure (1)..(501): unsure at all Xaa locations
  Clone ID: PAT_TA_27891.pep
MARKMLKDGEAPLVADDGGGEGEGSYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVXNRINLTPVALMEATCFAKTVFGGQTVKPDYKDVPCAVFCIPPLSVVGLSEQEALAEAKNDLLVYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 133474 - protein, 112 aa, Triticum aestivum; identical to SEQ ID NO: 133274
  Clone ID: PAT_TA_27892.pep

SEQ ID NO: 133475 - protein, 549 aa, Triticum aestivum
  unsure (1)..(549): unsure at all Xaa locations
  Clone ID: PAT_TA_27893.pep
MGEAVAAAEDTLKKEGAVVVPAPRPSKGVASWAVDLLERLAVRLGHDKAKPLHWLSGNFAPVRDETPPAAGLPVRGHLPECLNGEFVRVGPNPKFVPVAGYHWXDGDGMIHAMRIKDGKATYVSRYVKTSRLKQEEYFGGAKFMKIGDLKGFFGLFMVQMQALRKKLKILDVTYGFGTANTALIYHHGKLLALSEADKPYVVKVLEDGDLQTLGLLDYDNRLKHSFTAHPKVDPFTDEMFTFGYSHEPPYCTYRVITKDGVMLDPVPITIPESVMMHDFAITENYSIFMDLPLLFRPKEMVKNGEFIYKFDPTKKARFGILQRYEKDEKTIRWFELPNCFIFHNANAWEEGDEVVLITCRLENPDLDKVNGTQNDKLENFGNELYEMRFNMKTGAASQKQLSVSAVDFPRINESYTGRKQQYVYCTILDSIAKVTGIIKFDLHAEPESGKKQLEVGGNVMGIYDLGPGRFGSEAVFVPKEPGVSGQEDDGYLILFVHDENTGKSEVNVIDAKTMSPDPVAVVELPNRVPYGFHAFFVNEEQLVHQQAEV

SEQ ID NO: 133476 - protein, 169 aa, Triticum aestivum
  unsure (1)..(169): unsure at all Xaa locations
  Clone ID: PAT_TA_27894.pep
QYSNRTSYSTLRQNETQTEILSALHHTCASLGPLRQQCITLXDYYIPVFFLEVSVVKPEELCESAHLCPKGAATRSSTRGDACGLCHHVLVEVLMMLKDPNTKLEIVGLLFKTCSKAKNYEPQCKRLVLDYIPLILVKTQEFLETTDVCFATHACKTGMQATIPLSAAL

SEQ ID NO: 133477 - protein, 176 aa, Triticum aestivum
  unsure (1)..(176): unsure at all Xaa locations
  Clone ID: PAT_TA_27895.pep
MAPAVMASSATTVAPFQGLKSTAGLPVSCRSGSTGLSSVSNGGRIRCMQVWPIEGIKKFETLSYLPPLSTEXALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 133478 - protein, 445 aa, Triticum aestivum
  unsure (1)..(445): unsure at all Xaa locations
  Clone ID: PAT_TA_27896.pep
MREILHIQGGQCGNQIGAKFWEVICDEHGIDQTGKYAGDSDLQLERINVYYNEASGGRFVPRAVLMDLEPGTMDSLRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGXQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSSVCDIPPTGLSMSSTFVGNSTSIQEMFRRVSEQFTAMFRRKAFLHWYTGEGMDEMEFTEAESNMNDLVAEYQQYQDATADEEEEYDEEEEEDA

SEQ ID NO: 133479 - protein, 620 aa, Triticum aestivum
  unsure (1)..(620): unsure at all Xaa locations
  Clone ID: PAT_TA_27897.pep
MGMAHVALAAVLAMAAAAATVSASPALGVQPLSKIAIHNATVHLDLHRSSACVRATPAVLGGHDDDTVLVTVKYXGLNPTPDDWIAVFSPADFISXPCPNPERYPAEPLLCTAPIKYXKYANYSANYLKGGKGSIRLQLINQRADFSFALFTGGLENPKLVSVSKKXGVQEPQAPVFPRLAQGKTHDEMTVTWTSGYDVGEAYPFVEWGMVGAAGARTPAGTLTFNRGSMCGEPARTVGWREPGFIHTAFMRNLWPNKEYFYKIGHELSDGTVVWAKPYTFRAPPTPGQNSLQRIIVFGDMGKAEXRDGSNEFANYQPGSLNTTDRLIEDLDNYDIVFHIGDMPYANGYLSQWDQFTAQVAPISAKKAYMVASGNHERDWPNTGGFFDVEDSGGECGVPAETMYYYPAENRANFWYKVDYGMFRFCVADSEHDWREGTPQYKFIEECLSTVDRKHQPWLIFTAHRVLGYSSNSWYADQGSFEEPEGRESLQKLWQKYRVDIAYFGHVHNYERTCPLYQSQCVNNEKSHYSGTMNGTIFVVAGGGXGSHLSEYTTAIPKWSIFRDHDYGFTKLTAFNHSSLLFEYMKSSDGKVYDSFTIHRDYRDVLSCVHDSCFPTTLAS

SEQ ID NO: 133480 - protein, 445 aa, Triticum aestivum
  Clone ID: PAT_TA_27898.pep
MREILHIQGGQCGNQIGAKFWEVICDEHGIDQTGKYAGDSDLQLERINVYYNEASGGRFVPRAVLMDLEPGTMDSLRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSSVCDIPPTGLSMSSTFVGNSTSIQEMFRRVSEQFTAMFRRKAFLHWYTGEGMDEMEFTEAESNMNDLVAEYQQYQDATADEEEEYDEEEEEEAA

SEQ ID NO: 133481 - protein, 255 aa, Triticum aestivum
  Clone ID: PAT_TA_27899.pep
MSEATLYIPPSFLHPPPPPPPPAPPPTGESATESNPRIRVGGRRRRHMAHRVDNEYDYLFKIVLIGDSGVGKSNILSRFTRNEFCLESKSTIGVEFATRTLQVEGKTIKAQIWDTAGQERYRAITSAYYRGAVGALLVYDITKKLSFENINRWLSELRNHADSNIVIMMVGNKSDLNHLRSVQEEEGQALAEKEGLSFLETSALEALNVEKAFQTILSDIHQIISKKALAAQEAAGSGPPTQGTHPSCWRFIPQQ

SEQ ID NO: 133482 - protein, 494 aa, Triticum aestivum
  Clone ID: PAT_TA_27900.pep
MAAAVADAAVPAVAKANGAGAGCCAAKGPGYATPREAMEKGPREGLLYVTCVYNGTGINKPDYLATVDVDPNSATYSQVIHRLPATHIGDELHHSGWNACSSCHGDPSTSRRFLILPSLLSGRVYVVDTAKDPRAPALHKVVQAEDIAEKTGLGFPHTSHCLATGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIEPLKVRNWMLPEMPGLITDFVISLDDRYLYLVNWLHGDIRQYNIEDPAKPVLAGQVFVGGLLQKGSDVVYVTDDDKEEQYAVPQVKGHRLRGGPQMIQLSLDGKRVYVTNSLFSRWDEQFYGPDLLKKGSHMLQIDVDTEEGGLTVNPDFFVDFGTEPEGPSLAHEMRYPGGDCTSDIWI

SEQ ID NO: 133483 - protein, 456 aa, Triticum aestivum
  Clone ID: PAT_TA_27901.pep
HAQGKSAILVRTETSPEDVGGMHAAAGILTARGGMTSHAAVVARGWGKCCVSGCSSMRVNEIEKVVAIEDKMLYEGDWISLNGSTGEVILGKQPLFPPALSADLETFMSWVDEVRQLKVMANADTPGDALAARKNGAEGIGLCRTEHMFFASDERIKAVRQMIMAPTVELRQKALDRLLPYQRSDFEGIFRAMDGLPVTIRLLDPPLHEFLPEGHVEDIVRELCAESGAAEDDVLARMEKLSEVNPMLGFRGCRLGISYPELTEMQARAIFEAAISMTNQGIQVFPEIMVPLVGTPQELGHQVALIRQIANNVFTNMGKTIDYKVGTMIEIPRAALVADEIAEQAEFFSFGTNDLTQMTFGYSRDDVGKFLPIYLAQGILQHDPFEVLDQRGVGELVKIATERGRKARPNLKVGICGEHGGEPSSVAFFAKAGLDYVSCSPFRVPIARLAAAQVLV

SEQ ID NO: 133484 - protein, 473 aa, Triticum aestivum
  Clone ID: PAT_TA_27902.pep
MDHIVGGKFKLGKKIGSGSFGELFLAVNVQTGEEVAVKLENVKTKHPQLHYESKLYMLLQGGTGIPHLKWFGVEGEYNVMVIDLLGPSLEDLFNYCSRKFSLKTVLMLADQMINRVEYMHQKGFLHRDIKPDNFLMGLGRKANQVYIIDYGLAKKFRDLQTHKHIPYRENKNLTGTARYASVNTHLGVEQSRRDDLESLGYVLMYFLRGSLPWQGLKAGTKKQKYDKISEKKMLTPVEVLCKSYPSEFISYFHYCRSLRFEDKPDYSYLKRLFRDLFIREGYQFDYVFDWTILKYPQIGSNPRMRPSERVSGAAGPSIEKIEKAPGEASARRNPSASLNQSDNHATRPRETVSMSLKEIMHSTDRSGERTVERTTERPRTSSRTGSASRRAVASSSRPGSSMQPSEQQYSRTSRLFSSSNNGGSRPSSTQRVNPGVSESRATSLSRAAVARGSRDEPLHRSLELLSLGTGKRK

SEQ ID NO: 133485 - protein, 175 aa, Triticum aestivum; identical to SEQ ID NO: 133472
  Clone ID: PAT_TA_27903.pep

SEQ ID NO: 133486 - protein, 191 aa, Triticum aestivum
  Clone ID: PAT_TA_27904.pep
MPALAKPAAAAPKAKPSAAKPKKVAAGPSHPAYFEMIKEAIAALKDRTGSSSVAIAKYIEEKHGKSLPANFKKMLSVQLRASASKGKLIKVKASYKLSDAAKKDAPKPKPKAKPAAPKAAAKPAKDAAKPKKKAAAKPKKAAAAAAGTKRKAPEKKTLVAKAKKSPAAKAKAKPKTVRSPAAKKGRKVAAA

SEQ ID NO: 133487 - protein, 112 aa, Triticum aestivum; identical to SEQ ID NO: 133343
  Clone ID: PAT_TA_27905.pep

SEQ ID NO: 133488 - protein, 303 aa, Triticum aestivum
  unsure (1)..(303): unsure at all Xaa locations
  Clone ID: PAT_TA_27906.pep
ERIDAMEEDTFMVAAAVLDPYTHYSLNLCNHTDYATALTDAIAKILDPKSALSAIDEVSKFREFVTRLAQEAAARMEPTQWWFQFGGDLPALQKCAMRVCSQCVSSSGCERNXSAFALVHTKQRNRLLYDKLHKLVSVRYNLKIRAEEDQEKERDIDKETNPIMEWLNEDEEDPVLDGADAASAVFEKIRRLNSSRKDSYVGTKANKKKRKRNHDEENEYVETDSEDDDNDNEYVDNESEDDDGVSEDDEDDQQDQQETQMQVEEETQVQVEKETQASIGNLETRRSGRLVRKKTKEINSLYS

SEQ ID NO: 133489 - protein, 240 aa, Triticum aestivum
  unsure (1)..(240): unsure at all Xaa locations
  Clone ID: PAT_TA_27907.pep
MAVASSTRTSRRLAFVLLVLAFSAALAESRDAYMRSADRYACILTQGKLPPWQAEVKINFSANGKLCVLCXEQYSTEALXYLRQNETQAEILKXLHHTCASLGPLRQQCITLVDYYIPAFFLEVSVVKPEELCESAHLCPKGAATRSSTRGEACGLCHHVLVEVLTMLKDPNTKLEIVGLLFKTCSKAKNYEPQCKRLVLDYIPLILVKTQNFLETTDVCFATHACKTGMQATIPLSAAL

SEQ ID NO: 133490 - protein, 79 aa, Triticum aestivum
  Clone ID: PAT_TA_27908.pep
MAGKYIVAGLVGSCVISYACDYIVSQKKIFGGTIPGTVSDKEWLKATEQRFQAWPRVAGPPVIMNPISRQNFIVKDLNP

SEQ ID NO: 133491 - protein, 175 aa, Triticum aestivum
  Clone ID: PAT_TA_27909.pep
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNMRQVQCVSFIAFRPPGCEESGKA

SEQ ID NO: 133492 - protein, 112 aa, Triticum aestivum; identical to SEQ ID NO: 133343
  Clone ID: PAT_TA_27910.pep

SEQ ID NO: 133493 - protein, 445 aa, Triticum aestivum; identical to SEQ ID NO: 133443
  Clone ID: PAT_TA_27911.pep

SEQ ID NO: 133494 - protein, 445 aa, Triticum aestivum; identical to SEQ ID NO: 133480
  Clone ID: PAT_TA_27912.pep

SEQ ID NO: 133495 - protein, 204 aa, Triticum aestivum
  Clone ID: PAT_TA_27913.pep
MAMATQASAATRHLITAAWSPSAKPRPATLGMPSARGPAPLCAAAPDTPAPAAPPAEPAPAGFVPPQLDPSTPSPIFGGSTGGLLRKAQVEEFYVITWTSPKEQVFEMPTGGAAIMREGPNLLKLARKEQCLALGNRLRSKYKIAYQFYRVFPNGEVQYLHPKDGVYPEKVNAGRQGVGQNFRSIGKNVSPIEVKFTGKNSFDI

SEQ ID NO: 133496 - protein, 93 aa, Triticum aestivum
  Clone ID: PAT_TA_27914.pep
MTKGTGSFGKRRNKTHTLCIRCGRRSFHLQKSTCSSCGYPAARIRKYNWSVKAIRRKTTGTGRMRYMRHVPRRFKSNFREGTEAAPRNRAAAN

SEQ ID NO: 133497 - protein, 176 aa, Triticum aestivum
  unsure (1)..(176): unsure at all Xaa locations
  Clone ID: PAT_TA_27915.pep
MAPTVMASSATSVAPFQGLKSTAGLPVSRRSSSAGLSSVSNGGRIRCMQVWPIEGIKKFETLSYLPPLSTEXALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 133498 - protein, 452 aa, Triticum aestivum
  unsure (1)..(452): unsure at all Xaa locations
  Clone ID: PAT_TA_27916.pep
MREILHIQGGQCGNQIGAKFWEVICDEHGIDQTGKYXGDSDLQLERINVYYNEASGGRYVPRAVLMDLXEPGTMDSLRSXGPYGQIFRPDNFVFGQSGAXGNNWAKGHYTEGXAELIDSVLDVVRKEAENCDXASKGFQVCHSLGGGTGSGMGTLLISKIREEYPDRMMMTFSVFPSPKVSDTVVEPYNATLSVHQLVENADECMVLDNEALYDICFRTLKLTTPTFGDLNHLISATMSGVTCCLRFPGQLNSDLRKLAVNLIPFPRLHFFMVGFAPLTSRGSQMYRALTVPELTQQMWDSKNMMCAADPRHGRYLTASAMFXRGKMSTKEVDEQMLNVQNKNSSYFVEWIPNNVKSSVCDIPPTGLKMSSTFVGNSTSIQEMFRRVSEQFTAMFRRKAFLHWYTGEGMDEMEFTEAESNMNDLVAEYQQYQDATVEEEEDYEDEQEDEEAA

SEQ ID NO: 133499 - protein, 447 aa, Triticum aestivum
  Clone ID: PAT_TA_27917.pep
MREILHIQGGQCGNQIGAKFWEVVCDEHGIDPTGRYTGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPTGLSMASTFVGNSTSIQEMFRRVSEQFTAMFRRKAFLHWYTGEGMDEMEFTEAESNMNDLVSEYQQYQDATADEEGEYEDEDQEAEEDM

SEQ ID NO: 133500 - protein, 79 aa, Triticum aestivum; identical to SEQ ID NO: 133490
  Clone ID: PAT_TA_27918.pep

SEQ ID NO: 133501 - protein, 175 aa, Triticum aestivum; identical to SEQ ID NO: 133472
  Clone ID: PAT_TA_27919.pep

SEQ ID NO: 133502 - protein, 445 aa, Triticum aestivum
  Clone ID: PAT_TA_27920.pep
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQMYRPLTVPELTQQMWDSKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEGEYEEEEELEQE

SEQ ID NO: 133503 - protein, 113 aa, Triticum aestivum
  Clone ID: PAT_TA_27921.pep
MAPSQPKSGLFVGINKGHVVTKRELPPRPSDRKGKGTKRVHFVRNLIREVAGFAPYEKRITELLKVGKDKRALKVAKRKLGTHKRAKKKREEMSSVLRKMRSAGGGGAGDKKK

SEQ ID NO: 133504 - protein, 96 aa, Triticum aestivum; identical to SEQ ID NO: 133380
  Clone ID: PAT_TA_27922.pep

SEQ ID NO: 133505 - protein, 125 aa, Triticum aestivum
  Clone ID: PAT_TA_27923.pep
TKLITETASWNHFLACITNTKTSIKQNADKSWNHGSPTRRSAGTDLEPELGAAPVPALRVVPDGVVGPHADPVGDGAVLALLLGQLLLDAEGLVGRHRRGGDEDAAAASAAAAAAGAKPPTRPRT

SEQ ID NO: 133506 - protein, 143 aa, Triticum aestivum
  Clone ID: PAT_TA_27924.pep
MLLSASVNSISSMPSPVYCTILDSIAKVTGVIKFDLHAEPESGKKQLEVGGNVMGIYDLGPGRFGSEAVFVPKEPGVSGEEDDGYLILFVHDENTGKSEVNVIDAKTMSPDPVAVVELPNRVPYGFHAFFVNEEQLVHQQAEV

SEQ ID NO: 133507 - protein, 79 aa, Triticum aestivum; identical to SEQ ID NO: 133490
  Clone ID: PAT_TA_27925.pep

SEQ ID NO: 133508 - protein, 397 aa, Triticum aestivum
  Clone ID: PAT_TA_27926.pep
TSLLSRTLLPDQSIFFLRYDLCLYLTIADKTSALDVIRQLIPHLTERTYALDELSGVARLLGKPEVEKKRSSKPLLIQIMQTKEGLKLGLACLKHGLAEDRKKIIKSLKGQNMKLALGDYGCLFLACLLSIVDNTELVTEVVIDVLKKQLKELIFDKNGRHPLLQLFHPLCSRYLTLGELFYLNYNVPSLVSKDEASESATKVNFGSKLDDVADKEHGGSEDTLIASDSKEDPIKRRQELLVKSELYEVLIETCIENVGQLLRTNFGKDVLYEVAVGGKNNFLEGVTDRIHVLHNAIACDAARPRTDDGDEHAFDNYHSSRTIRRMILDCPAFAATLWKKALKGKCKLYADGFSSKVLAAYLESRDSKVKDLAKSEVQLLIDGGILKNPDHKAAEKK

SEQ ID NO: 133509 - protein, 448 aa, Triticum aestivum
  unsure (1)..(448): unsure at all Xaa locations
  Clone ID: PAT_TA_27927.pep
MREILHIQGGQCGNQIGAKFWEVVCDEHGIDPTGRYTGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVXEWIPNNVKSSVCDIPPTGLSMASTFVGNSTSIQEMFRRVSEQFTAMFRRKAFLHWYTGEGMDEMEFTEAESNMNDLVSEYQQYQDATADEEGEYEDEDQEPEEDM

SEQ ID NO: 133510 - protein, 149 aa, Triticum aestivum
  unsure (1)..(149): unsure at all Xaa locations
  Clone ID: PAT_TA_27928.pep
RALPQXGRYAQRVGSGAPVYLAAVLESSAEVFFSPQPARKRKRKRIESARARARTMAALRLAVRRFCDRALGRSAGIYELKAAKEFPDIDPGHLKAARKFPKLRVKDVDATALNVFKILRESPVDGHKDVTLREVRMTLKTLAEIQEEE

SEQ ID NO: 133511 - protein, 68 aa, Triticum aestivum
  Clone ID: PAT_TA_27929.pep
MTTSRRLADRKTAKFQKNITKRGSVPETTVKKGNDYPVGPIVLGFFIFVVVGSSLFQIIRTASSGGMA

SEQ ID NO: 133512 - protein, 175 aa, Triticum aestivum
  unsure (1)..(175): unsure at all Xaa locations
  Clone ID: PAT_TA_27930.pep
MAPAVMASSATTVAPFQGLKSTAXGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 133513 - protein, 174 aa, Triticum aestivum; identical to SEQ ID NO: 133429
  Clone ID: PAT_TA_27931.pep

SEQ ID NO: 133514 - protein, 187 aa, Triticum aestivum
  Clone ID: PAT_TA_27932.pep
MPALAKPAARPAKPAAAAPKPKPAAAKPKAAAAGAAHPTYFEMIKEAIAAFKDRTGSSSVAIAKYIEEKHGKALPPNFKKMLSVQLRASAAKGKLVKVKASYKLSDAAKKDSPKAKPAAKPAKDAAKPKKKAAEKPKKTAAVGTKRKAPEKKKLVTKAKKSPAAKAKAKPKTVRSPAAKKARKVAAA

SEQ ID NO: 133515 - protein, 343 aa, Triticum aestivum
  unsure (1)..(343): unsure at all Xaa locations
  Clone ID: PAT_TA_27933.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEPXAKLIRQRYREAADMIKKGXKMCCLFINDLDAGAGRMGGTTQYTVNNQMVNSRDGPVTFEQPKMTVEKLLEYGHMLVQEQDNVKRVQLADTYMSQAALGDANQDAMKTGSFYGGKGAQQGTLPVPAGCTDQTAKNFDPTARSDDGSCLYTF

SEQ ID NO: 133516 - protein, 496 aa, Triticum aestivum
  unsure (1)..(496): unsure at all Xaa locations
  Clone ID: PAT_TA_27934.pep
MAAAVADAAVPAAARANGAGAGCCAAKGPGYATPREAMEKGPREGLLYVTCVYNGTGIDKPDYLATVDVDPNSATYSQVIHRLPATHIGDELHHSXGWNACSSCHGDPSTSRRFLILPSLLSGRVYVVDTAKDPRAPALHTVVQAEDIAEKTGLGFPHTSHCLAXGDIMISCLGDKEGNAAGNGFLLLDSXEFNVKGRWEKPGHSPLFGYDFWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIEPLKVRNWMLPEMPGLITDFVISLDDRYLYLVNWLHGDIRQYNIEDPAKPVLAGQVFVGGLLQKGSDVVYVTDDDKEEQYAVPQVKGNRLRGGPQMIQLSLDGKRVYVTNSLFSRWDEQFYGPDLLKKGSHMLQIDVDTEEGGLAVNPNFFVDFGTEPEGPSLAHEMRYPGGDCTSDIWI

SEQ ID NO: 133517 - protein, 113 aa, Triticum aestivum; identical to SEQ ID NO: 133503
  Clone ID: PAT_TA_27935.pep

SEQ ID NO: 133518 - protein, 136 aa, Triticum aestivum
  Clone ID: PAT_TA_27936.pep
GFAPAAAAAAEVAAASSSPPRRCRPTRPSASSRSWPRSSARTAPSPTGSACGPTTPSGTTRSAGTGAAPSSGSRSGPADRRVGEPWLKSYLHFVLWTFQCLLCKLGSDPRMSLLSISSCYEDCLYPGVLMLPCCAK

SEQ ID NO: 133519 - protein, 452 aa, Triticum aestivum
  unsure (1)..(452): unsure at all Xaa locations
  Clone ID: PAT_TA_27937.pep
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMXLTFSVFPSPKVSDTVVEPYNATLSVHQLVENADECMVXLDNEALYDICFRTLKLTTPSFGXDLNHLISATMSGVTCCLRFPGQLNSDLRKLAVNLIPFPRLHFFMVGFAPLTSRGSQMYRSLTVPELTQQMWDSKNMMCAADPRXHGRYLTASAMFRGKMSTKEVDEQMINVQNKNSSYFVEWIPNNVKSSVCDIAPRGLSMASTFIGNSTSIQEMFRRVSEQFTAMFRRKAFLHWYTGEGMDEMEFTEAESNMNDLVAEYQQYQDATADEEEELXYEDEDDADLQE

SEQ ID NO: 133520 - protein, 93 aa, Triticum aestivum; identical to SEQ ID NO: 133496
  Clone ID: PAT_TA_27938.pep

SEQ ID NO: 133521 - protein, 175 aa, Triticum aestivum
  unsure (1)..(175): unsure at all Xaa locations
  Clone ID: PAT_TA_27939.pep
MAPAVMASSATTVAPFQGLKSTAGLPVSRRSSGSLGSVSNGGRIRCMQVWPIEGIKKFETLSYLPPLSTEXALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 133522 - protein, 218 aa, Triticum aestivum
  Clone ID: PAT_TA_27940.pep
MAAGYRAEDDYDYLFKVVLIGDSGVGKSNLLSRFTRNEFSLESKSTIRGVEFATRSLQVDGKVVKAQIWDTAGQERYRAITSAYYRGAVGALLVYDVTRHATFENAERWLKELRDHTDPNIVVMLVGNKSDLRHLVAVPTDEGKAFAERESLYFMETSALESTNVEDAFAEVLKQIYRIVSKRAVEAGEDSAAGPGKGEKINMKDDVSAVKKGGCCSS

SEQ ID NO: 133523 - protein, 111 aa, Triticum aestivum; identical to SEQ ID NO: 133432
  Clone ID: PAT_TA_27941.pep

SEQ ID NO: 133524 - protein, 448 aa, Triticum aestivum
  unsure (1)..(448): unsure at all Xaa locations
  Clone ID: PAT_TA_27942.pep
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDIXCFRTLKLTTPSFGDLNHLISATMSGVTCCLRFPGQLNSDLRKLAVNLIPFPRLHFFMVGFAPLTSRGSQMYRSLTVPELTQQMWDSKNMMCAADPRHGRYLTASAMFRGKMSTKEVDEQMINVQNKNSSYFVEWIPNNVKSSVCDIAPRGLSMASTFIGNSTSIQEMFRRVSEQFTAMFRRKAFLHWYTGEGMDEMEFTEAESNMNDLVAEYQQYQDATADEEEELYEDEDDADLQE

SEQ ID NO: 133525 - protein, 89 aa, Triticum aestivum; identical to SEQ ID NO: 133435
  Clone ID: PAT_TA_27943.pep

SEQ ID NO: 133526 - protein, 445 aa, Triticum aestivum
  Clone ID: PAT_TA_27944.pep
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQMYRSLTVPELTQQMWDSKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEGEYEEEEDLEQE

SEQ ID NO: 133527 - protein, 111 aa, Triticum aestivum; identical to SEQ ID NO: 133337
  Clone ID: PAT_TA_27945.pep

SEQ ID NO: 133528 - protein, 111 aa, Triticum aestivum; identical to SEQ ID NO: 133337
  Clone ID: PAT_TA_27946.pep

SEQ ID NO: 133529 - protein, 447 aa, Triticum aestivum
  Clone ID: PAT_TA_27947.pep
MREILHIQGGQCGNQIGAKFWEVVCDEHGIDPTGRYTGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPTGLSMASTFVGNSTSIQEMFRRVSEQFTAMFRRKAFLHWYTGEGMDEMEFTEAESNMNDLVSEYQQYQDATADEEGEYEDEDQEPEEDM

SEQ ID NO: 133530 - protein, 155 aa, Triticum aestivum
  Clone ID: PAT_TA_27948.pep
MATVPAPAAETAASTARTVKDVNPHEFVKAYSAHLKRSGKMELPEWVDIVKTARFKELPPSDADWYYIRAASMARKIYLRQGIGIGGFQKIYGGRQRNGSRPPHFCKSSGAVSRNILQELQKMGIIDVDPKGGRLITSQGRRDLDQVAGTVPAEF

SEQ ID NO: 133531 - protein, 447 aa, Triticum aestivum
  Clone ID: PAT_TA_27949.pep
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQMYRSLTVPELTQQMWDSKNMMCAADPRHGRYLTASAMFRGKMSTKEVDEQMINVQNKNSSYFVEWIPNNVKSSVCDIAPRGLSMASTFIGNSTSIQEMFRRVSEQFTAMFRRKAFLHWYTGEGMDEMEFTEAESNMNDLVAEYQQYQDATADEEEELYEDEDDADLQE

SEQ ID NO: 133532 - protein, 194 aa, Triticum aestivum
  unsure (1)..(194): unsure at all Xaa locations
  Clone ID: PAT_TA_27950.pep
VQELSEICSXGYKLAFCPEPNYHLQGMKDQLIAVSNKLLDGSGELNPQHSEELRQQRAHLNKQIQILGDYMARPTQDDERQRSHSMASTTAAEGHHPPMTPSTFVDNNRSQSQFYDMNAPWDGGSCLAPPPPQLPPRRHDAVAQDLPDQAEAGQEAAPEPPHPLLDPHEDRQHHQVQRQAQALAPHQARILSGG

SEQ ID NO: 133533 - protein, 142 aa, Triticum aestivum
  Clone ID: PAT_TA_27951.pep
PPPPGFIGRFKGGSLFPLGFATFLKGDWFGAFLFFPHLGKGDFFPSDLIWVTPGFFHSPVFKRRAINLILGALLKKFYVPFPGLLNLVLLKGPPLFFFFFFFFFFFFFFFFFFFFFFFFFFFFFFFFFFFTQDKRGSIISKI

SEQ ID NO: 133534 - protein, 386 aa, Triticum aestivum
  Clone ID: PAT_TA_27952.pep
SSSSWAEDDIEPPVAAASFGPDVVGLVVGVGAAGVAALDVDAGAAGEVHGEVVPVDHRDVVEVLRAEGELRQRQRGLAGQGAGQRAAAVAGAASPAVAVEAAARAAPDPAGAGAAGDIEVPRFASVELPATAHGGGRRPHREGAAVGDGEAGGAGTGDEPHGQEEDERRRRGGHCCSCRIRHELVPNSARGHSSLITSTAAHPPLLARSSKQHRDGCCLLLHRRCPGFYADQLPREEAQEAGDLGRELPWQELQGQQVHGHGKRKTSTKKRNTDKWKGLAYDISRRPSRTSPRGKGHRGTPSSKAPHWATGTHEGRSSSSIRSTSAKGTSKKLRLRQHHGRLLHRSCFQWTSLLSSLQELHDPAQHQDPTHLGYLGRQGSRKILSV

SEQ ID NO: 133535 - protein, 162 aa, Triticum aestivum
  Clone ID: PAT_TA_27953.pep
MVLKTELCRFSGQKIYPGKGIRFIRSDSQVFLFANSKCKRYFHNRLKPAKLCWTAMYRKQHKKDIHAEAAKKRRRTTKKPYSRSIVGATLEVIQKKRAEKPEVRDAAREAALREIKERIKKTKDEKKAKKAEVTKSQKSQGGKGAVQKGSKGPKIGGGGGKR

SEQ ID NO: 133536 - protein, 175 aa, Triticum aestivum
  Clone ID: PAT_TA_27954.pep
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 133537 - protein, 195 aa, Triticum aestivum
  unsure (1)..(195): unsure at all Xaa locations
  Clone ID: PAT_TA_27955.pep
MARALGGASAPNVGRGGRRAQASHASLDSDLEAFSHNPXHGSFAPLAFQPSAMTNCVNQRFLSYXVELLSRHCHQXGKTNLSHDGLNPAHVPYWWVNNPTLGEFCFTMIGRADIEGSKSNVAMNAWLXPQASYPCGNFSDTSSFKLRRSKGSXATLSRFVFVLEIRIKRAFTLLFHTRFLFSLSSXLGHLRYLLT

SEQ ID NO: 133538 - protein, 51 aa, Triticum aestivum
  Clone ID: PAT_TA_27956.pep
MPSHKTFRIKQKLAKKQRQNRPIPYWIRMRTDNTIRYNAKRRHWRRTKLGF

SEQ ID NO: 133539 - protein, 155 aa, Triticum aestivum; identical to SEQ ID NO: 133530
  Clone ID: PAT_TA_27957.pep

SEQ ID NO: 133540 - protein, 162 aa, Triticum aestivum; identical to SEQ ID NO: 133535
  Clone ID: PAT_TA_27958.pep

SEQ ID NO: 133541 - protein, 175 aa, Triticum aestivum
  Clone ID: PAT_TA_27959.pep
MAPTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 133542 - protein, 162 aa, Triticum aestivum; identical to SEQ ID NO: 133535
  Clone ID: PAT_TA_27960.pep

SEQ ID NO: 133543 - protein, 155 aa, Triticum aestivum; identical to SEQ ID NO: 133530
  Clone ID: PAT_TA_27961.pep

SEQ ID NO: 133544 - protein, 572 aa, Triticum aestivum
  unsure (1)..(572): unsure at all Xaa locations
  Clone ID: PAT_TA_27962.pep
MAAVVAAAAADQPRRRKPTPGRGGVVLPAGLSEEEARVRAIAEIVSEMGEXLSRRGEDVDLNALKSAACRRYGLARAPKLVEMIAAVPEADRAALLPRLRAKPVRTASGIAVVAVMSKPHRXCPHIATTGNICVYCPGGPASDFEYSTQSCTGYEPTSMRAIRARYNPYVQARSRIDQLKRLGHSADKVEFILMGGTFMSLPADYRDYFIRNLHDALSGHTSANVEEAVCYSEHSAVKCIGMTIETRPDYCLGPHLRQMLSYGCTRLEIGVQSTYEDVARDTNRGHTVAAVADCFSLAKDAGFKVVAHMMPDLPNVGVERDMESFREFFENPAFRADGLKIYPTLVIRGTGLYELWKTGRYRNYPPELLVDIVARILSMVPPWTRVYRVQRDIPMPLVTSGVEKXGNLRELALARMEDLGLKCRDVRTREAGIQDIHHKIRPDEVELVRRDYAANDGWETFLSYEDTRQDILIGLLRLRKCGRNVTGPELVGRCSIVRELHVYGTAVPVHGRDAEKLQHQGYGTLLMEEAERIARKEHRSKKLAVISGVGTRHYYRKLGYELEGPYMVKCLA

SEQ ID NO: 133545 - protein, 388 aa, Triticum aestivum
  unsure (1)..(388): unsure at all Xaa locations
  Clone ID: PAT_TA_27963.pep
TRSRTRSSQAPTGDGTHEAVLSSYEYVSQGXLKKYDFDNTMGGFYIAPAFMDKLVVHLSKNFMTLPNIKIPLILGIWGGKGQGKSFQCELVFAKMGINPIMMSAGELESGNAGEPAKLIRQRYREAADMIKKGKMCCLFINDLDAGAGRMGGTTQYTVNNQMVNATLMNIADAPTNVQLPGMYNKEENPRVPIVVTGNDFSTLYAPLIRDGRMEKFYWAPTRDDRIGVCKGIFQTDNVSDESVVKIVDTFPGQSIDFFGALRARVYDDEVRKWVTSTGIENIGKRLVNSRDGPVTFEQPKMTVEKLLEYGHMLVQEQDNVKRVQLADTYMSQAALGDANQDAMKTGSFYGGKGAQQGTLPVPAGCTDQTAKNFDPTARSDDGSCLYTF

SEQ ID NO: 133546 - protein, 466 aa, Triticum aestivum
  unsure (1)..(466): unsure at all Xaa locations
  Clone ID: PAT_TA_27964.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEPAXKLIRQRYREAADMIKKGKMCCLFINDLDAGAGRMGGTTQYTVNNQMVNATLMNIADAPTNVQLPGMYNKEENPRVPIVVTGNDFSTLYAPLIRDGRMEKFYWAPTRDDRIGVCKGIFQTDNVSDESVVKIVDTFPGQSIDFFGALRARVYDDEVRKWVTSTGIENIGKKLVNSRDGPVTFEQPKMTVEKLLEYGHMLVQEQDNVKRVQLADTYMSQAALGDANQDAMKTGTFYGGKGAQQGTLPVPAGCTDQTAKNFDPTARSDDGSCLYTF

SEQ ID NO: 133547 - protein, 159 aa, Triticum aestivum
  Clone ID: PAT_TA_27965.pep
MAEQTEKSFLKQPKVFLSTKKADKAKRPGKAGNRFWKSVGLGFKTPREAIDGTYIDKKCPFTGTVAIRGRIIAGTCHSAKMNRTIIVRRNYLHFVKKYQRYEKRHSNIPAHISPCFRVKEGDHVIIGQCRPLSKTVRFNVLKVVPAGTTGGGKKAFIAA

SEQ ID NO: 133548 - protein, 465 aa, Triticum aestivum
  Clone ID: PAT_TA_27966.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEPAKLIRQRYREAADMIKKGKMCCLFINDLDAGAGRMGGPTQYTVNNQMVNATLMNIADAPTNVQLPGMYNKEENPRVPIVVTGNDFSTLYAPLIRDGRMEKFYWAPTRDDRIGVCKGIFQTDNVSDESVVKIVDTFPGQSIDFFGALRARVYDDEVRKWVTSTGIENIGKKLVNSRDGPVTFEQPKMTVEKLLEYGHMLVQEQDNVKRVQLADTYMSQAALGDANQDAMKTGSFYGGKGAQQGTLPVPAGCTDQTAKNFDPTARSDDGSCLYTF

SEQ ID NO: 133549 - protein, 451 aa, Triticum aestivum
  unsure (1)..(451): unsure at all Xaa locations
  Clone ID: PAT_TA_27967.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPPHGIQVERDKLNKYGRPLLGCTIKPKLGLSAKNYGRACYECLRGGLDFTKDDENVNSQPFMRWRDRFVFCAEAIYKSQAETGEIKGHYLNATAGTCEEMIKRAVFARELGVPIVMHDYLTGGFTXANTTLAHYCRDNGLLLHIHRAMHAVIDRQKNHGMHFRVLAKALXRMSGGDHIHSGTVSKLSLERGTPNDLXFVDLIXPDDFIEKDRARGIFFTQDWVSMPXVIPVASGGIYGWHMPPLTKSLGKFCLPIGGGTLGLLGECTCAELFNGLKPVQALRRPSSPKYEYPTLEWILLPT

SEQ ID NO: 133550 - protein, 95 aa, Triticum aestivum
  Clone ID: PAT_TA_27968.pep
GFIYLVSVNGVTGPRENVNLRVKSLIQEIKKVTDKPVAVGFGISKPEHVKQIAGWGADGVIIGSAMVRQLGEAASPREGLKRLEAYARSMKNALP

SEQ ID NO: 133551 - protein, 209 aa, Triticum aestivum
  Clone ID: PAT_TA_27969.pep
MKIGIIAASGKAGNIIMREAISRNHEVTAIVRNKNKINIDCNIIEKSLNELDDDDLKNIDVLVNAFDSAPGNEIEHVIFGKKLIVLLENKKTRLIVVGGAGSLFINDEKTIKLYDTPDFPKEYLNVSINSSKNLDNLKKSKNINWTYISPAAIFDPNGERTGKYKIGKDNLILNKNKQSYISYEDYAIALIDEIENPKHINSRFCVVSE

SEQ ID NO: 133552 - protein, 168 aa, Triticum aestivum
  Clone ID: PAT_TA_27970.pep
RLGEDYDERVLPSIGNEVLKSIVAQFDASELITQREVVSAKIREELYKRAREFNIALEDVSITHMTFGREFTNAVEQKQIAQQEAERAKFIVERAEQEKQAAIIRAEGDSQAAEMISSALSKAGDGFIAFRKIEASKEIAQTLSQASNVTYLPNNKQGSNLLLNVGNA

SEQ ID NO: 133553 - protein, 195 aa, Triticum aestivum
  unsure (1)..(195): unsure at all Xaa locations
  Clone ID: PAT_TA_27971.pep
RESIAAVLLVLSLGALVGLAADDHVDTIRLPSNGLADEVATAATEIGAEKKRPWKCCDSPLCSRSIPPRCRCMDAVEQCDEACTRCEASKSDPSKRICNDRYHGWPGPNCTEPDADDVPSGPVVVAHQETVAEETTPWGRCCDRPLCTRSVPPAXRWLDNVNRCAPTCKRCVVSIFDPTDHSCDDMCHGEPGPRC

SEQ ID NO: 133554 - protein, 193 aa, Triticum aestivum
  Clone ID: PAT_TA_27972.pep
MKRCIAAVLLVLSLEALAAGRLSATVADDHVDTIRLPSNGLADEVATAATEIGAEKTRPWKCCDRPLCSRSIPPRCRCMDAVEQCDEACTRCEASQSDPSKRICNDRYHGWPGPSCTNPDAERHPKPWKCCDDTLCTRSAPPTCACNDKVKKCAKTCKKCEKDESDASRFVCRDRYFGWPGPKCSGIEPRRGF

SEQ ID NO: 133555 - protein, 373 aa, Triticum aestivum
  Clone ID: PAT_TA_27973.pep
VKQIGRSNVIAKVATVSQTRSVHDLTFRKKTEQPMIRYGLGGRSSTNGHIATVFGCTGFLGRYVVNRLAQQGTQVVVAYRDPDEARHLKVTGDLGQIVPLEFDLRNKEQLAECVRHSDIVYNLIGRDYETKNFTFENVHVDGTRALAEACVENGVARFVQVSALNASEDSPSKFLRTKALGEKVAREIIPETTVVRPGIMWGHEDRFLNRIGDGDGWQYWVNQGNTKILPVSAIDVAQALEVMLTAESTMGKTYELYGPKEYKMKEIYELAREISMQPLPIRNVPDSVLKFMATIVDKLPYNQQVSPDLIERLKMDDKPTPGALTFKDLYIEPTQLETVAIHFLRRFRSNAVFDLPYEKGEGQVKKGVYHLID

SEQ ID NO: 133556 - protein, 254 aa, Triticum aestivum
  Clone ID: PAT_TA_27974.pep
RKGSEKVEEKKQEVKKPEIVSTAESVSAPVIASPIPSKASIKEEQHEEKKKKFESKQPNKQSQQKHESNKMTAKTWANLTAAAAASNGFTTIPATTTTATTATAATAATAVPTTPTTPAPAPTTPAPAPTPTPAPAEVSVPVTPAAEPPVTSNTEKPVQPQQQTHQHKNQAPRNKDSITQIFVKQVTVLAEERRFTNSNQSGNRYNNQGRNQNYNNANNNFERRPNNHRRQGQNTRNNNNTGKGRGTTVNNNQK

SEQ ID NO: 133557 - protein, 189 aa, Triticum aestivum
  Clone ID: PAT_TA_27975.pep
MADAPAVDVEKAGAPAGGAPDGSGGGGAVGAIVGRWRRQDLLDKSGSALRAAAWAFSLLAFLVMVANEHGDWRQFDHYEEYRYIVAVGLLAFIYTTLQLVRHGVRLSGGQDLQSKVGLLVDFAGDQATAYLLMSALSAAIPITNRMREGSDNVFTDSSAASISMAFFAFVCLALSALISGFKLSKQTYI

SEQ ID NO: 133558 - protein, 207 aa, Triticum aestivum
  Clone ID: PAT_TA_27976.pep
EWKSRRKAKQHAFYPHQFLLYCSHLATSPAAAPLQPRRPRRHGAPVALSFRRPKSAAALASHQTEEATLAHWRRRPARAAAYGPDARTYGGGSSHPLQRRPSHLLRRARVLAVVPWPLTSRRGAAAPPAPAWSPATLGLAVGVAPSTHLSGVSSSVDEHESPPVALHATGSRGGLRLCRVDWGSKKLEISGRSSLSFRCDQASSNDG

SEQ ID NO: 133559 - protein, 196 aa, Triticum aestivum
  unsure (1)..(196): unsure at all Xaa locations
  Clone ID: PAT_TA_27977.pep
MHTSMAMKRTCRTALVAAVVVMALAAMAPPAVCESKTSKQQEKKGPLATAVIVFGDSIMDPGNNNGLHTAVKANHAPYGKDFANHEPTGRFSNGLIPTDFMAQGLNVKQLLPPYLGVEHTPEDLLTGVSFASGATGFDPLTPVIVNVISLEQQLAYFDEYRGKLVGIAGEEETRRIIDGALFVVCAGTDDIXNTYY

SEQ ID NO: 133560 - protein, 280 aa, Triticum aestivum
  Clone ID: PAT_TA_27978.pep
PTRPPTRPPTRPIPKENADQWLKYLRNEYPAIAFKASTQHQREKLKQSNVSTNAASESLLNTSECLGADDLIKLLKNYCRNLNLKTSITVGIIGYPNVGKSSVINSLKRSRVCGVGATPGFTKVAQQITLDKNIKLLDCPGIVFAQQGQGDQNEAEITLRNCVKVELLEDPVTPVEVILSKCGIEQLRKTYNLSFFSNVHEFLVLLAQQRGKLKKGGIPDVDQAARHVLNDWNGGKIPFYSVPPSSKQSHIDAAVVNTFAQEFDVQSIAPSNLDSAMSID

SEQ ID NO: 133561 - protein, 154 aa, Triticum aestivum
  unsure (1)..(154): unsure at all Xaa locations
  Clone ID: PAT_TA_27979.pep
RVAPAVRFYLGKGQPXGXDAARKLRIHRRDQRWADKQYKKRALGTAFRSSPFGGSSHAKGIVLEKIGVEAKQPNSAIRKCVRVQLIKNGKKVTAFVPNDGCLNYVDENDEVLIAGFGRKGRAIGDIPGVRFKIVKVAGVSLLALYKEKKEKPRS

SEQ ID NO: 133562 - protein, 146 aa, Triticum aestivum
  Clone ID: PAT_TA_27980.pep
TMEPNRHFYLKQIQRGLYVDVENNSVDVDAYIVLKDKTDNDWEGKQVWYFDEKEQIVNVQSGKVIGFLDHDPNTSNHYTLVQKENQQNPEFQWWYEEERMIIYSKLLGPAYNLGPHAGNAFDGAKLCMEQGTPAPGPSERFEVIYK

SEQ ID NO: 133563 - protein, 253 aa, Triticum aestivum
  unsure (1)..(253): unsure at all Xaa locations
  Clone ID: PAT_TA_27981.pep
PLTGPTSIGLAIGAAFMGHRXLVLTMPSYTSLERRVVVKASGAQLVLTDPAKGMGGTVRKATQRHPNPPSAFMPQQCASPARVQLPYETTGPALAGRHLGQGNSFVMGIGRGATVTGVGXYLKEKNPNAKIYGVEPAEANVLNGGKPGPHLITGNGVGFKPDILDMDIMEKVLEVKSEDAVKMAQQLALQEGLLVGISSGANTVAAIELAKRPENKGKLIVTVHPSAGERYLSSALFEGLRKEAEAMQPVPVD

SEQ ID NO: 133564 - protein, 54 aa, Triticum aestivum
  Clone ID: PAT_TA_27982.pep
EGAAFGFFNGDRVGEWYSDGMAMEWDEGRSYCSFYPSYGGEACAEQPYISPLWE

SEQ ID NO: 133565 - protein, 88 aa, Triticum aestivum
  Clone ID: PAT_TA_27983.pep
TPCLDDGLIIRLLSAHLIHSDALLCPCSINAHLLCTQAHQPTCALAVRLPDKHRLDHAPHIVPPTHPADTSVGLRHLLSNDSVHQCLR

SEQ ID NO: 133566 - protein, 135 aa, Triticum aestivum
  Clone ID: PAT_TA_27984.pep
MAPKAAEKKPVEKTPAVKKPKAEKKVPTSKEGGEKKGKKKSKKSMETYKIYIFKVLKQVHPDIGISSKAMSITNSFINDIFEKLAGESAKLARYNKKPTITSREIQTSVRLVLPGELAKHAVSEGTKAVTKFTSA

SEQ ID NO: 133567 - protein, 86 aa, Triticum aestivum
  Clone ID: PAT_TA_27985.pep
KLKELIPRQMFKIPIQACIGAPVVRPRVRSAIRKDVLSKCYGGDISRKKKLLKKQAEGKKRMKAIGRVEVPQEAFMAVLKLEKEVL

SEQ ID NO: 133568 - protein, 218 aa, Triticum aestivum
  unsure (1)..(218): unsure at all Xaa locations
  Clone ID: PAT_TA_27986.pep
QGQIKKEEMFIKMHLRLGTSASDTGLLTVVILGTACIEGTLTIAFVLVTRNTFTRIRIRINFAITDTVYTAVNTIIAGITTITLVAIAILETLRSRGTLAWGSSSGGCSSLRSSSLGCCVGRTIADAAYTAVDTIITIITAVSFVAITITKSLRSGSALASRSRSRSRIRLGRSIADTLNAGIKTQXHHCPLAAXXPLVTITITLPEEPEMHLEAAAV

SEQ ID NO: 133569 - protein, 207 aa, Triticum aestivum
  unsure (1)..(207): unsure at all Xaa locations
  Clone ID: PAT_TA_27987.pep
AYKRVEKKQKHXXXSSSAGTAYVTFEKVKVPVENLLGQENXGLFVILSNFNHERWSMLTSATMTARVAVEECFKWAHQRXMFGKRLIDQPVIRFKLARMISSVESVHHWLENLTYQMNHMSYKEQATKLAGPIALCKYKVTRMLHEVSDDACQIFGGRAITKTGMGRQIETLQRTYKFTAILGGSEEVMADLGVRQAMKNFPMGARL

SEQ ID NO: 133570 - protein, 359 aa, Triticum aestivum
  Clone ID: PAT_TA_27988.pep
KKGLLDIVPAGVVTGKNLLKLFEYAREHKFAIPAINCTSTSTVNAALEAARDIKSPIIIQFSQGGSAFFAGKGLDNKNQEASIIGAVAGAQYVRAVAKAYGIPVVVHSDHCAKKLLPWFDGMLDADEKYYKAHGEPLFSSHMLDLSEEPKEENIEICLKYLKRMAAIDCWLEMEIGITGGEEDGVDNSGVDNAALYTQPEDIWDIYKAFKELSPLFSIAAGFGNVHGVYAPGNVKLHPELLGKHQGYVKEQLKNNDPKPVFFVFHGGSGSSEEEIAEAVRNGVVKMNVDTDTQWAYWKGLKEFYENKKDYLQSQVGNPEGPNKPNKKFYDPRVFIRESEKTMIQRVQQACKDLGNVNTL

SEQ ID NO: 133571 - protein, 196 aa, Triticum aestivum
  Clone ID: PAT_TA_27989.pep
MSLSNKLSIRDLDLKNKRVLIRVDFNVPMKDGAITNNNRIVQALPTVKYALDNGASAVILMSHLGRPNGEAVAKYSLKPVAAEVEKLLGQPVEFLNDCVGPDVEKACQSATGGKVILLENLRFHIEEEGSAKVEGQKVKADAEAVKKFRASLTALADIYVNDAFGTAHRAHSSMVGVDLPQRAAGFLMQKELEYFA

SEQ ID NO: 133572 - protein, 193 aa, Triticum aestivum
  unsure (1)..(193): unsure at all Xaa locations
  Clone ID: PAT_TA_27990.pep
MAAQAQTIEVPTDAELLQAQADLWRHSLYYLSSMGLRCAVELEIPTAIHRLGGAASLPDLMSALSLPSVKMPFLRRVMRVLVTSGVFAADNESGSGMAIYRLTPLSRILVHGVVADEHHSQRYFVIGVTSPHYTEAALGLAGWFKKDTEPPVPSPFEDIFGVPLCDDRTPLLDEELDDVVTQGVAAHDNLXIA

SEQ ID NO: 133573 - protein, 367 aa, Triticum aestivum
  unsure (1)..(367): unsure at all Xaa locations
  Clone ID: PAT_TA_27991.pep
MAAQAETIEVPSDAELLQAQADLWRHSLYYLTSMALRGPVDLELPPASRRLGGAASLPDPIPALALPSVTMPVLARVMRVLRNPRGLPAGDDCEPRAELYRLTPLSRVLVHGVVADEHHSQKYFVLGVTSPHYTEVALGLANWFKKDIQPPVPSXFRGALRDASPSRENWPLRPLAARRFPTHGGLRLPPARGRRHATCERRHLLTGSGPGLGAAARAIITAYPHTKCTALDLPKVVXKAPADGXVTCVAGDLFHSVPSSQVVVVXLVLHLXSCEDCXKIITHCKKAKPAAXMEGGKIIIIEIVVGPSLGPILFEAQXPLVDMLMMVNSKGRQRDENDWSKLFAKAGFTDYKIVKKLGARCVIEVYP

SEQ ID NO: 133574 - protein, 124 aa, Triticum aestivum
  Clone ID: PAT_TA_27992.pep
NTQLNKARPCNKFASQAPQHPRNHHSKICNAPSLLADLGHRNIHAFRLHLLDFARRNISIFLHPTLRIADWINRSIPSIPTFFVRSYGGFLPLESEVCGGCCGDRSGEEGDSRHDWERFSCDLN

SEQ ID NO: 133575 - protein, 73 aa, Triticum aestivum
  Clone ID: PAT_TA_27993.pep
KEARTHRKNVLYPVIIIIIIHWAYAIYIHLHTHIYCRPSTLTTYSLLINIQLDGIRAPPCPGTAGGRGVGSFL

SEQ ID NO: 133576 - protein, 230 aa, Triticum aestivum
  Clone ID: PAT_TA_27994.pep
RRAEKRGIRSPPRESVAIATTSRALPPRFPSALLRRRRRAASFVPVASASKRRDGGEGEDAGAHKPSRRPSSSSGGEPTGLAPYGLSFSPFSKDAAMGLVMSAATGSGWTTGSGMEGPPMAGGAANRPEVSTLPWSLFTKSPRRRMRVAFTCNVCGQRTTRAINPHAYTDGTVFVQCCGCNIFHKLVDNLNLFHEMKCYVGPDFRYEGDAPFNYLDGGDDDDTGNIFPLL

SEQ ID NO: 133577 - protein, 71 aa, Triticum aestivum
  Clone ID: PAT_TA_27995.pep
MSSSDDLAGGKKTSWPEVVGLTIKEAKEIILKDKPDADIVVVPVGSAVTEDLRPNRVRIFVGTVAETPHVG

SEQ ID NO: 133578 - protein, 273 aa, Triticum aestivum
  Clone ID: PAT_TA_27996.pep
MYAIVRDVPTTFDKCVTTVDNTVSPIDISLAKKQYKEYVNALREHVDHIVEIPADPLHPDCCFIEDTAIVIEDTAVVNCLGAESRRKEISAVEKALRKIPVIKDVVRMDEIDPQATLDGGDVLYTGEHLFVGLSHRTNQRGADVLKKVFSEKCPVYTIHSLLAHNLLHFKCIVTMLNDKTLLVYDHKAGLDVVSEIEGYTKDWYNIIKIPEQIPSNIVSLSHGKVVIYQQGFSESENVLMKELKEKRNVKLKSLNMSEFIKADGSLTCCSILV

SEQ ID NO: 133579 - protein, 167 aa, Triticum aestivum
  Clone ID: PAT_TA_27997.pep
MGGEDAPGRLESILTDTSAPLAERAWAAGAVELRMLARLAAPAVVVYMINYVMSMSTQIFSGHLGNLELAASSLGNTGVQPFAYGLMLGMGSAVETLCGQAYGAHKYDMLGIYLQRSVILLGLTGIPLAVMYAFSEPLLLLMAQSPEIARAASIFGNGLIPQIFAYA

SEQ ID NO: 133580 - protein, 204 aa, Triticum aestivum
  unsure (1)..(204): unsure at all Xaa locations
  Clone ID: PAT_TA_27998.pep
MPGGGEMPETKQIPKNKACLICIDGWGISPEEDHKGDAIYNAETPVMDKLEKEHPFTSIAAHGLAVGLPDGLMGNSEVGHLNIGAGRVVYQDIVRIDLTMKKKEFGQVENIKNAFERAKSTNGRLHFMGLVSDGGVHGHINHLVSLLEAARDAGVPKSFIHFFGDGRDTAPKSAAGYMKQLLESLDKLQYGKIADVXGRYYAMD

SEQ ID NO: 133581 - protein, 126 aa, Triticum aestivum
  Clone ID: PAT_TA_27999.pep
PTRPPTRPLPSPPSPSASPSLDGRRYSFSQSARAMARSRDTRLRLRLTLLLVTLLLLVDMASVSHGRRTPDVDAMALVGGGPPPAKAYSSEQSSSSTSREHTARVYRRMHRVSKRLVPQGPNPLHN

SEQ ID NO: 133582 - protein, 189 aa, Triticum aestivum
  unsure (1)..(189): unsure at all Xaa locations
  Clone ID: PAT_TA_28000.pep
AEELMRTLIRVNVEGVTRVRPAVPSAAVSGPPARAFHGAXHAVLPGMVDRKRGAIVNIGSGAASVVPSDPLYSVYAATKAYVDQFSRCLYVEYKGKGIDVQCXQVPLYVATKMASIRRSSFLVPSADTYARAAIRHIGYEPRCTPYWPHSVLWFLISLLPESLVDSTRLSMCIKIRKKGQAKDAKKKSQ

SEQ ID NO: 133583 - protein, 155 aa, Triticum aestivum
  unsure (1)..(155): unsure at all Xaa locations
  Clone ID: PAT_TA_28001.pep
IKTTCTIKPIIQAWGTNPLTKHTSKADTHRIICTCTGLRYARGSRPGRRSWARRTRRAPAGSSRASCTAASSPGRTXTTPCPGRARPAAASRRTGPSSSPAPRPAAAVPAPPEPPRRSSSRCAAAGGTPAPRRRPGTCRRTTRRRRASGTRRCAC

SEQ ID NO: 133584 - protein, 105 aa, Triticum aestivum
  Clone ID: PAT_TA_28002.pep
MWRGSRARRRRSTLAPSSTPAGYPVGRGPCAGARPSRWRRAGPRPRAPLAPCSDSGTGHSNGTGARSAFRGVAAEYGRGRRRGGKRPAATRAPVAAEAEAIPLAL

SEQ ID NO: 133585 - protein, 216 aa, Triticum aestivum
  Clone ID: PAT_TA_28003.pep
MSKVSASAVRDIVSEILKGSEEKKRNFTETIELQIGLKNYDPQRDKRFSGTIKLPHVARPRMTVCVLGDAFHCDQAKGAGMEFQSVDDLKKLNKNKKLIKKLAKKYDAFLASEALIKQIPRLLGPGLHKVGKFPTPVSHNDSLTDKANEIRATIKFQLKKVLCLGVAVGHVAMTEDQLIANIMLSVNFLVSLLKKNWQNVKSLYLKSSMGKPPRLF

SEQ ID NO: 133586 - protein, 221 aa, Triticum aestivum
  Clone ID: PAT_TA_28004.pep
FAPFVAYNARWRMPHEESGSASNLYYSFDAWGGAAHVVMLGSYAEFEEGSAQRAWLERDLAGVDRRRTPWLLVLLHAPWYNTNQAHQGEGEAMRAAMETLLYEARVDVVFSGHVHAYERFTRVYDNEADGRGPMYITIGDGGNREGLALKFLEDHKSAHLSVFQEASFGHGRLRIVDETSAVWTWHRNDDEYATVRDEVWLESLASPKLSMAAAGSHDEEL

SEQ ID NO: 133587 - protein, 260 aa, Triticum aestivum
  Clone ID: PAT_TA_28005.pep
MSSAGSARVPKRRRTTKTSEAADRQLQERQFLDLNLFPAVEVASTGGSLSINEPVSHRQPPPTVAALLYETTQVVVSSAAAESNIGMNSFPINVEVIDDDVAIYTSGPPPQARQQSSRTGPITVIIDDDSETTAGPAGEALDEHVNTLLSLGMNPRHNPSRAQPNTDLVINIVDTPETNNIPPKVVQAVPEPVKEIPKETKFSCPVCMNELVNASSTICGHIFCQKCIKASIQAQKKCPTCRRKLTMSNFHRVYLPTADN

SEQ ID NO: 133588 - protein, 251 aa, Triticum aestivum
  Clone ID: PAT_TA_28006.pep
RPRSHRASRDFPHKRSFPPGRPSQTRSAATDPSQTPAVSRPLPLVSDCVRLGRRPPNIAPTDRVRSAGAGTPPRQNAMRDVADRSAGVDPNFFVLRNSIRQKMFEHIERKQPSAIWRWRLPDLARRLEEVLFREYPNKREYYNMTKGPIERHLQFAMKLSSVRNRQRQQNRQLSRQITCSPCYGIMIVTPGITQGASENSRMSFVTRCTGPLSSGANMVPQNTNMGTLLPGEAPNEHVNTLLSLGDEPSPP

SEQ ID NO: 133589 - protein, 463 aa, Triticum aestivum
  unsure (1)..(463): unsure at all Xaa locations
  Clone ID: PAT_TA_28007.pep
MPNGAGPKPPNLRETGAKLNPARFRSEGPDHPARSAKARARTLTFLAKNHRGQRSLAVVATTDTSRLRVGNFDGSFRIRARLYSGTVLRVHKPYAQFLVFKSIGQSHFHSSIKYGVWSXVPSSGNSKLDCAYRDADRIAKRNSTKYPXVFLFFSVKNSGHFCGMVLDIGXSKMIENGDNXFWGQDQIGGSCRVFXRRESEVPYYTLQNIAVQKNEXKPVTDTIDTVDDPYVPGISVLEVFKDIIVKECLSDDFLXYKDEEARMEQTKMVQVXLAKQHGFVPVSKAVTSDDSKVXMPKFGGVLIGHEXLEIQNMSEKPHDCNGIKQQDAVEKQVGIEAGKENGHQENRFYGKQDNEKAPRSSTSQPQTSTLEMSMDGKQQYWKKVVHPIPGPDGAGHGSSKLRENGVNISSAIVRLEAPEDDSIVAKVGSLTISSKTRKAEDKSPLVDVVTIGSLPIRVNKSVA

SEQ ID NO: 133590 - protein, 198 aa, Triticum aestivum
  Clone ID: PAT_TA_28008.pep
ASMETITKAAEPWCSSKDNSNNSILSNSPEETKGFTMHSDDLQPTSALHSSIAQPFDSRLVVVGSYKKPVTLGRGGASTIKIGRRNRQISRIHVSIEFNAESQCFQLTILGLNGANIDYVGYNQNAIVVLEDKSFIDVLGDHIEFRVPPRPTEEENNETVPSKASLQDQKSGKYDVKAELDYTVIEHKGRKHVLFGCF

SEQ ID NO: 133591 - protein, 350 aa, Triticum aestivum
  Clone ID: PAT_TA_28009.pep
GRVGRSLTLLATLALVCLFGNTSAAVIQRDIVVPEVVGNGISVLKDAKTDVNVDHNKVGNGNKLELRKRGIDVIPVVDHNIVSALDGAKTDVNVDHNKVANGNKVDLRKRGIDVIPVVDHNIVSALDGAKTDVNVDHNQAGNGNKVELRKRGIDIIPVVEHNTASVLDGAKTDVNVDHNKALNGNKVDLRKRGLDVIPVVEHNTVSVLDGAKTDVNVDHNKALNGNKVELRKRGIDTIPVVEHNTASALDHAKTDVNIDHNQVGNGNKLDLRKRGVDIIPVVEHNTASVLDGAKTDVNVDHNQAGNGNKVDLRKRGIDIIPVVDHNIVSALDGAKTDVNVDHNKIGNDNH

SEQ ID NO: 133592 - protein, 229 aa, Triticum aestivum
  Clone ID: PAT_TA_28010.pep
FYSTSRRSLTLLATLALVCLFGNTSAAVIQRDIFVPEVVGNGISVLDHAKTDVNVDHNKALNGNKVDLRKRGIDIIPVVDHNTVSALDGAKTDVNVDHNKVGNGNKVELRKRGIVAIPVVDHNIVSALDGAKTDVNVDHNKVGNGNKLELRKRGIDIIPVVEHNTASALDHAKTDVNIDHNQVGNGNKLELRKRGVDIIPVVEGDTVTVLKDADTTVTVKDNKIANDNH

SEQ ID NO: 133593 - protein, 110 aa, Triticum aestivum
  Clone ID: PAT_TA_28011.pep
MAGTKVTMASAVAVALLLAMAAVSGAGAAPGPLMMCNVDVYRMIGACRSYCARGSREATPSGQCCAALRGANLRCVCQKKGLLASAGNIDARRAMQIPSKCGIGNVPSRC

SEQ ID NO: 133594 - protein, 172 aa, Triticum aestivum
  unsure (1)..(172): unsure at all Xaa locations
  Clone ID: PAT_TA_28012.pep
MSNLVVETITSKGLKLKLQTGLFINNEFVKGSDTLETVNPATGKVIAAVQAAEAKDVDAAGEAAEKAFHGPWGEMRALQRAALMHKLAELIDRDNEELSQIESLDSGKGITFSRFFDAKQISLTLRYFAGFADKVHGKVIDTECCLSYTXHEPIGVCGAIIPWNFPLLIYGL

SEQ ID NO: 133595 - protein, 120 aa, Triticum aestivum
  Clone ID: PAT_TA_28013.pep
WPWWPGAPLPGLLLGACSGCCCCCSWCSSCCCCGGGGSGPNRTRRGGFFLPRFGCLGCCSGGGAPCSGAGAGCSGCGWGSCWGGGAWGSGCCCCCGGGFGGIMCTELVPLKVTVRATGRM

SEQ ID NO: 133596 - protein, 247 aa, Triticum aestivum
  unsure (1)..(247): unsure at all Xaa locations
  Clone ID: PAT_TA_28014.pep
MATTTLSLHGLPSPTAKKLTSSFLGAPSSFLRPAALAAAATPTRRVFAVRAMAXPPKPGAKPKKVVGIIKLALEAGKGTPAPPVGPALGAKGVNIMAFCKEYNAKTADKPGYITPVEXTVLDDKPSILTSWHTARITMPSRPTSPATSSQSRXPVFDDKSFTFILKTPPASVLLLKAAGVEKGSKEPQREKVGKVTVDQVRTIAQEKLPDLNCKTIESAMRIIAGTAANMGIDVDPPILVKKEKVIF

SEQ ID NO: 133597 - protein, 135 aa, Triticum aestivum
  Clone ID: PAT_TA_28015.pep
VLAAPLRFRSPLSLLFASISKGNVCVAGDALHPTTPDLAQGACTALEDGVILARCLGDAIVGAGSGEQKERAMAALRRYAGIRRWRSAQVIAVSYAVGFVQESDHSVVSFVRDKLLSGVLAKTLLMMPDYDCGKL

SEQ ID NO: 133598 - protein, 304 aa, Triticum aestivum
  Clone ID: PAT_TA_28016.pep
HASVKFFSSKLLLCLLALSASTIFASPLKDISTTSIDLSENQLNTKGDETLFVTVTRVDDLIDDDGSLLAERVMAVRVTFEVFENQLMCNGHPVEIGVSNIQVEAQMASNPEKLTITSEEDAAILADSFDVGLVTVEVTATLLDELKTDDGMTFRRLGVKELITEINGLKVVQTEAAQQILDVFDNGSLTKWAVDPLTGFMLPAEDESTPTITFVDDSFSDRAFGWWDRQSTLTQGLLAGIACGFTSLSFIFVVAHTILKRRRASQYMAVHEQEEEEIKEQPPAYVEQGKTMTEEHEEKKPFLA

SEQ ID NO: 133599 - protein, 170 aa, Triticum aestivum
  Clone ID: PAT_TA_28017.pep
RARAGAQFASLDLKRFFKMAITVQTTGSSAMSLEKMQASNKQITLPSWLSEEDVSYLASVYAKTGFAGGLNSHASADAWADAWAPWTGAKVQVPTKFIVGDGDLAYHHPGVKGYIHKGGLKRDVPMLDEVVVIKGAGHFIQQERAQEISEHIYEYIKKFSTDPTRELSKL

SEQ ID NO: 133600 - protein, 113 aa, Triticum aestivum
  Clone ID: PAT_TA_28018.pep
WRSILLVVVVALALAPAPALGIPFTEKDLASEENLRGLYERWRSHYTVSRRGLGADAEERRFNVFKENARYVHEGNKKDRPFRLALNKFADMTTDEFRRTYAGSRVRHHLSLS

SEQ ID NO: 133601 - protein, 131 aa, Triticum aestivum
  unsure (1)..(131): unsure at all Xaa locations
  Clone ID: PAT_TA_28019.pep
QLSLXNQVLKRLKKIHADDRQQQKLVEVSCGTTDPVHTHHSRHCLDFISGNGDDSVHPTKLKMLHQLDANIMEDEFASSQKHNGCNYLSPSVELGPKRLKILGPSFPRGNHELEISCRFQEDSDLASHHAR

SEQ ID NO: 133602 - protein, 188 aa, Triticum aestivum
  Clone ID: PAT_TA_28020.pep
RSEYEGGRPQHDGIIRYGDHVSLKHVATNRYLTSRPGSYDGGSYQQKIFTVECSPEEESTWIVLPPAETEEEPGYEVGWDDPVRLKHVPTRVNLHTHGIQSPVSGQQEVSGFGDDETSDENDVWKVQQYNEDDEQYDDFWRVGQPFVLRHVETDRLLHSHEMLLEEGANEVTGYEENDENSMWVVTFD

SEQ ID NO: 133603 - protein, 181 aa, Triticum aestivum
  Clone ID: PAT_TA_28021.pep
MSGYDRALTVFSPDGHLFQVEYASEAVRKGTCAVGVRGKNVVVLGVEKKSVLKLQDARTVRKICMLDDHICMAFAGLTADARVLINKARIECQSHRLTVEDPASVEYITRHIAQIQQKYTQSGGVRPFGISTLIVGFDHNEPKLYMTEPSGIYTAWKANAIGRSSKTVREFLEKNYNEDME

SEQ ID NO: 133604 - protein, 149 aa, Triticum aestivum
  Clone ID: PAT_TA_28022.pep
LLSAGAKRVAIISMPPIGCVPSQRTLSGGMARDCSSGHNEIAEMINAGMGTTVESLKAKHPGARVVLMDIYGYLLDMMMRPEGYGFKESTLGCCGTGMMEVSVLCNGVTSAVCGDVTDYLFWDSYHPTEKAYRILVDFVYDNYLKELID

SEQ ID NO: 133605 - protein, 119 aa, Triticum aestivum
  unsure (1)..(119): unsure at all Xaa locations
  Clone ID: PAT_TA_28023.pep
PVPPPRPPPRSRAPVPPGPVAPARPXLAVTCARPFARRGERAGDSWSTQKWSGAQLAMPGCSRPCRAACPQPQPWEKGLRKSSSGLMPGSESNNQARSCQVQDVMKVGQGIMIKKKALR

SEQ ID NO: 133606 - protein, 250 aa, Triticum aestivum
  unsure (1)..(250): unsure at all Xaa locations
  Clone ID: PAT_TA_28024.pep
RYAVLHVKKYEQPFGKIDFFAISKSTCQLPAWDPHGMFSGSCVLKHLNILEFNGSLVSNEYYKRMCALSVLSALFMKFRSLSTKWFEIQTNFANRHLFDGVIFYDGILEPMALAEFGGAKCNDDXVNSDTLEVYRNALRILNEIAAKTKKGETPKVFIVLFHKAILRFETLALLDNCMYVRTRHAKIRSPRTSEELKLVFPELRKAISWRDALVENVDHLHVDSSEGSSPDCIYETSSVCSTPWCKLLLL

SEQ ID NO: 133607 - protein, 241 aa, Triticum aestivum
  Clone ID: PAT_TA_28025.pep
MNRKVKLTHKKRPPLVRSPSLSTIQSGNKPKKSVRFRDSGSLEDVRLFLKSEMPIACQSDPTCSIQYVYHLRHLNWPSVRHHEGGLAVCVENIQFDASDLIGTCQVANLAYEKKINIRYSFDDWSTCHEVQANYKESIIDTWDRFSFKIKCHPFVRHLDFAVQYLVSGREFWDNNKQQNYQLDITTNAQIMNEEDDESSSSSSEDEPVDILWPTHTPVCFDQRKTSSNELLQQQQQQIILL

SEQ ID NO: 133608 - protein, 212 aa, Triticum aestivum
  Clone ID: PAT_TA_28026.pep
GDTAPDFEAKTTKGDIRFHEFIGDNWTILFSHPADFTPVCTTELGIVAALQDEWDARNVKVIGLSANGLEEHEKWIADINEVSQVKLNFPLIADADRKVSALYDMLDHQDATNVDAKGIAFTIRSVFIIDPKKTIRLILTYPASTGRNFDEILRVVDSLQLGDKYRITTPGNWKKGDDVIVHPSVSNELAQELFPKGIKVIKPYLRLTPSPF

SEQ ID NO: 133609 - protein, 137 aa, Triticum aestivum
  unsure (1)..(137): unsure at all Xaa locations
  Clone ID: PAT_TA_28027.pep
NGPPLFFFFFFFFXFRVEQNFIQFTEHSCSALFTCFHHLLLLFPCKQFHVYILHCPQRKPPRRRGIDTGLSMPVLPETGRRWYLAGSDXAXFVXXXAXPXVXGPCXXMXLRPCRSPKRRXXRQXDQXXHXCRRARRR

SEQ ID NO: 133610 - protein, 337 aa, Triticum aestivum
  unsure (1)..(337): unsure at all Xaa locations
  Clone ID: PAT_TA_28028.pep
MGGVRQQLMAAVLVAVALMATAAEGYITQKTWGAIRRANRAGPFVGXSSCPTHTRWSPCSSRPASVVMVMTGLSMLNAGLTTQMLLSLFRVKGIVHWGIAGNANEDLQIGDVTIPEYWAHVSLWNWQRFGDGKDNELSLEAAGDYTREYGFLNFSDYTVGQSNPALSANQLNSIWYQPEEIFPKSGEPEERQHAFWVPASKRYYELAKKLEGMELPACVNATTCLPRAPRVTRVSKGCSANVFLDNAEYRQFLRKQFGCTPVEMESAAVALVAHTQGVPFLTIRSLSDLAGGGSALGNEASTFLDIAAQNAVTVMLKFVPLLGKSGSEMDDGAAADM

SEQ ID NO: 133611 - protein, 171 aa, Triticum aestivum
  unsure (1)..(171): unsure at all Xaa locations
  Clone ID: PAT_TA_28029.pep
MKSFLSLLCSVFLLPLVVQSVPVIKRASASDWENRVIYQLLTDRFAKSTDDTNGCSNLSDYCGGTFQGIINHLDYIAGMGFDAIWISPIPKNVNGGYHGYWASDFSQINEHFGTADDLKKLVAAAHAKNMYVMLDVVANHAGTPSSGGDYSGYTFGQSFEYHXSLXIIKLQ

SEQ ID NO: 133612 - protein, 85 aa, Triticum aestivum
  Clone ID: PAT_TA_28030.pep
LARIRGVTHSCVPVWASVGGAGGEAIGDGADAVGDDLVGGAGSGAILGAGMGPCAAAAMARRATMAATTAKRAIWLVLVGGRKAG

SEQ ID NO: 133613 - protein, 173 aa, Triticum aestivum
  unsure (1)..(173): unsure at all Xaa locations
  Clone ID: PAT_TA_28031.pep
XXPTEXXRPXPGGHXWGFVRAAAAXRITGDRRGAXPVARXXEAAGEASSATRGKAWATGAAXSTASAGIXSRTPGPGKASRGGGKVRNFSVSLCRMQSGISLLFVSGGGGDEKIEEKNCMRRKGAVDRSTNSEEENNGEKVSNYKNRNQSRVMRFRGLLMPKEEVLEGEVEEI

SEQ ID NO: 133614 - protein, 232 aa, Triticum aestivum
  unsure (1)..(232): unsure at all Xaa locations
  Clone ID: PAT_TA_28032.pep
LAILFPDWSFWGWPEVNVRPWAPLMEELVRENARLPWPEREPYAFWKGNPDVSEVRQDLFRCSNDSAAGKEWNARLFKQDWDAAGRNGFRDSDLTKQCRYRYKMYVQGHTWSVSEKYILACDSPMLAIDTPFRDFFSRGLVAGKHYWPIDPANKCRAVKFAVDWGNAHPAPARRMGEEGSGFAREEMGMDYVYEYMLSVLTRYSALXRLLRYKPAVPEKAVEVSLESMACPR

SEQ ID NO: 133615 - protein, 181 aa, Triticum aestivum
  unsure (1)..(181): unsure at all Xaa locations
  Clone ID: PAT_TA_28033.pep
VSGEFGGSPVSWSGLLSLLVPCLLSFVLLRFSALLDPGAAVPRVKRSPPLPLRFRHDGAFKILQVADMHFGNGAATRCRDVAPEVGGARCSDRNTTRFLRRLIEAERPDLIAFTGDNIFGXSATDAAESLLRAISPAIEXYKVPWXAAILGNHDQESTMTREELMMFLSLMDYSVSQVNPP

SEQ ID NO: 133616 - protein, 300 aa, Triticum aestivum
  Clone ID: PAT_TA_28034.pep
KNNNKFIIDFLMGGVSAAVSKTAAAPIERIKLLIQNQDEMIKQGRLSTPYKGIGDCFARTMKDEGAISLWRGNTANVIRYFPTQALNFAFKDKFKRMFNKDKNRDGYWAWFAGNLASGGAAGAASLFFVYSLDYARTRLANDAKSAKKGGERQFNGLVDVYKKTLKSDGIAGLYRGFNISCVGIIVYRGLYFGMYDSIKPLMPQNLQDSFLATFALGWAVTTGSGLASYPIDTVRRRMMMTSGAAVKYDSSLHCFREILANEGAKSLFKGAGANILRAIAGAGVLSGYDYLQVWMFGKKY

SEQ ID NO: 133617 - protein, 49 aa, Triticum aestivum
  Clone ID: PAT_TA_28035.pep
VITTGGVTAGLDASLYLVGSLASHDSALEVARAMQYSWVKGVTVDAIDV

SEQ ID NO: 133618 - protein, 182 aa, Triticum aestivum
  unsure (1)..(182): unsure at all Xaa locations
  Clone ID: PAT_TA_28036.pep
MERSSRLFETETHGGRAAYRLHAVTVAAGILLLLYYRATRVPAAGEGRAAWLGMLAAELWYAAYWVVTQSVRWSPVRRRPFIDRLAARHGERLPSVDIFVCTADPYSEPPSLVVSTILSLMAYNYPPEKLSVYLSDDGGSILTYYGMWEASLFAKHWLPXFCKRYNIEPRXPXVYXXQXDGD

SEQ ID NO: 133619 - protein, 298 aa, Triticum aestivum
  Clone ID: PAT_TA_28037.pep
PRVDMEKIWHHTFYNELRVAPEEHPVLLTEAPLNPKSNREKMTQIMFETFNAPAFYVAIQAVLSLYASGRTTGIVLDSGDGVTHTVPIYEGYALPHAILRLDMAGRDLTDYLMRILAERGHSFTTTAEREIVRDIKEKLCYVALDFEQEMQTAAQSSALEKSYELPDGQVITVGNERFRAPEALFQPSLLGLESAGIHETTYNSIMKCDVDIRKDLYSNIVMSGGTTMYPGIADRMQKEITALAPSSMKIKIVAPPERKYSVWIGGSILASLSTFQQMWISKQEYDESGPSIVHRKCF

SEQ ID NO: 133620 - protein, 55 aa, Triticum aestivum
  unsure (1)..(55): unsure at all Xaa locations
  Clone ID: PAT_TA_28038.pep
FXFLEGAKFTTWEIYCYCFNSSKERKNRTKVIFYTYGTSLPDHNHITRTTSGQHL

SEQ ID NO: 133621 - protein, 334 aa, Triticum aestivum
  unsure (1)..(334): unsure at all Xaa locations
  Clone ID: PAT_TA_28039.pep
MEGEDGGGGVDWDSLAEAASGAVGALVSTTVLYPLDTCKTKFQADVQTDQGAHKYRNLSDVFWEAIRKKQFLSLYQGLKTKNIQSFISQFVYFYGYSYFKRLYLEKSGAKSIGTKANLLIAAAAGACTVVVTQPLDTASSRMQTSAFGKSKGLRATLAEGTWLEAFDGLGISLMLTCNPSIQYTVFDXLKQKLILRQTRKNAESAGDSSPVALSAFSAFLLGAISKSVATILTYPLIRCKVMIQAADPDEDDEDESEKPGNSRPPKTMLGAMHAMWNKEGIPGFFKGLHAQILKTVLSSALLLMIKEKISKFTWIXLLALRRYLFVSRKRIKSA

SEQ ID NO: 133622 - protein, 139 aa, Triticum aestivum
  unsure (1)..(139): unsure at all Xaa locations
  Clone ID: PAT_TA_28040.pep
MAPKAEKKPVAGKAEXKTTTAKKTKAEKRPPASKEGGEKKGKKKAKKSVETYKIYIFKVLKQVHPDIGISSKAMSIMNSFISDIFEKLAGESAKLARYNKKPTITSREIQTSVRLVLPGELAKHAVSEGTKAVTKFTSS

SEQ ID NO: 133623 - protein, 211 aa, Triticum aestivum
  Clone ID: PAT_TA_28041.pep
MKMKRCVIPSILLMLALEAAVLVAGHPSAMAVTNDEGTILLPSEGKDQVGTAAASRPWDCCDNTICTRSLPPICICLDEVDECASTCMACVPSVSNPFRRVCGDQYFGDPGPKCNDDVLKAQGDHQVSVAAVAAEKNGAEEEKPWECCDMPLCTRSYPPMCRCVDEVEQCAATCNSCGVSILNPFRRVCNDWYNGFPGRRCTEAAGSGGNN

SEQ ID NO: 133624 - protein, 201 aa, Triticum aestivum
  Clone ID: PAT_TA_28042.pep
MKMKRCILLMLALEAAVLVAGRPSAVAVSNDVGTILMPTEGKGQVGTAAASRPWDCCDNTICTRSLPPICICLDEVDECASTCMACVPSVSNPFRRVCGDRYYGDPGPKCTYNTVAGDNNDDALVAAAAQEEKPWECCDMALCTRSYPPMCRCVDEVEQCAATCKSCGVSILNPFRHVCNDWYNGFPGRKCTEAAHAGGNN

SEQ ID NO: 133625 - protein, 245 aa, Triticum aestivum
  unsure (1)..(245): unsure at all Xaa locations
  Clone ID: PAT_TA_28043.pep
MASNGSAGEVRDVHSSETTKTLLKSNDLYDYMLKTMVYPRENEFMRELRQITNEHIFGFMSSPPDEGLVLSLLLKLMGAKRTIEVGVYTGCSVLATALAIPDDGRIVAIDVSREYFDLGLPVIKKAGVAHKVDFREGPAGPILDKLXADEDEGSFDFAFVDADKYNYGNYHEQLLRLVRXGGVLAYDNTLWGGTVAMPDETPLTEEDRKKRDSLRGFNAMIAADTRVDPVQLPIADGITLCRRVA

SEQ ID NO: 133626 - protein, 58 aa, Triticum aestivum
  Clone ID: PAT_TA_28044.pep
MKLVVVLSALLLLSLLAVSSAEEFDFFYLVQQWPGSFCDTKKGCCLPLPPSVGVWCGG

SEQ ID NO: 133627 - protein, 65 aa, Triticum aestivum
  Clone ID: PAT_TA_28045.pep
FRIWHADTGQDTSNFIWIHLCTELYAGETQLFQVYQCIDRAGKNLIDCPLPMQGNCKDRVQLPAF

SEQ ID NO: 133628 - protein, 244 aa, Triticum aestivum
  Clone ID: PAT_TA_28046.pep
IPRVRLVVVLSALLLLSLVAVSSAEEFDFFYLVQQWPGSFCDTKKGCCFPDTGKPATDFGIHGLWPNYAKCKTRGELDGALEMVTKRKKKCWPENCNSERLKLWEIKDLVTELDANWPTLACKGGKSIEFWTHEWEKHGTCSNLDQHGYFATALGFKARHNLTGILADAGIVPSDSETYFLSSIRDAIKQGTGFTANLECNRGVAGETQLFQVYQCIDRAGENLIDCPLPMQGNCKDRVQLPAF

SEQ ID NO: 133629 - protein, 149 aa, Triticum aestivum
  Clone ID: PAT_TA_28047.pep
SKPTSGYTAVFRSATRMARSRVPLDHLPLSRANIERRAQKQQASKNSRRNFCLLSKPYQLICTARDMCWRTSGGVPAAACTIETISTSTASTRRSQTTPSTLRSCLPTRTHRAWRTLALRSRRSRWFATSRLRGVDKLSTREGSMVNSM

SEQ ID NO: 133630 - protein, 118 aa, Triticum aestivum
  Clone ID: PAT_TA_28048.pep
ILVACLLFGISNRGSAAGCRTSDLVVTSHTYPDPGGRPVQYKKLVNNCDCTQKNVKLACPRFNSSIEVYPDTAIKPDGHGILCSLYAGRPVGPKEKVFFDIHSSTQFSFQPVSSTIVC

SEQ ID NO: 133631 - protein, 90 aa, Triticum aestivum
  Clone ID: PAT_TA_28049.pep
MAAPAKASWLVAMSVGAVEALKDQAGLCRWNYALSSIHRAAKARANVRGGVSQGPKQLAASAAAVAERRRAEKAEEGLRTMMYLSCWGPN

SEQ ID NO: 133632 - protein, 88 aa, Triticum aestivum
  Clone ID: PAT_TA_28050.pep
IAEKWRQCRSQSSTVQVPVPRETQTSYYIKVQTSESWSLSSLSPTLSSSSQKRRLNHSITRRHTTPLAPSISPATTVVPPYPVLPSSE

SEQ ID NO: 133633 - protein, 102 aa, Triticum aestivum
  Clone ID: PAT_TA_28051.pep
KDSAMFDEWPVELKAMADRIISMRGQLFDALKIRETPGDWSPIIKQIGVFPFPGLTSEQVAFLRREYPISMTFYGGISMAGLSSRTVPHFADAIHAAVSKLK

SEQ ID NO: 133634 - protein, 72 aa, Triticum aestivum
  Clone ID: PAT_TA_28052.pep
SPCGADEEPVDPKKYLEERCKPQCVKPLYEYEKCIKRVEADDTGHKHCTGQYFDYWSCIDKCVAPKLFEKLK

SEQ ID NO: 133635 - protein, 119 aa, Triticum aestivum
  unsure (1)..(119): unsure at all Xaa locations
  Clone ID: PAT_TA_28053.pep
MFLTRTEYDRGVNTFSPEGRLFQVEYAIEAIKLGSTAIGLKTKDGXVVLAVEKRVTSPLLEPSSVEKIMEIDEHIGCAMSGLIADARTLVEHARVETXNHXFSYGEXMTVESSTQAICD

SEQ ID NO: 133636 - protein, 121 aa, Triticum aestivum
  Clone ID: PAT_TA_28054.pep
RCITKEYDYYAYSGNTLHWPTYANSLLWYEHHEEYIYSSTMDVEKYASTGKTEPLQPNYKMSRTRHSYYLLQLKKANVASITYFSPSSSIHLERRYLDSLVSICCHFFCNILHIYDTDWMH

SEQ ID NO: 133637 - protein, 89 aa, Triticum aestivum
  Clone ID: PAT_TA_28055.pep
MAGAAKASWMVAMSVGGVEALKDQAGLCRWNYALRSIHRAAKARANVRGGVLQGAKQLPASAAVAERRRGEKAEEGLRTVMYLSCWGPN

SEQ ID NO: 133638 - protein, 81 aa, Triticum aestivum
  Clone ID: PAT_TA_28056.pep
RGQNMLNANICITKEYDYYTYSGNTLHWPTYANSLIWYEHHEEYMYSMDVEKYTRKHREDGAAAAKLQNEPDKTQLLLTAT

SEQ ID NO: 133639 - protein, 159 aa, Triticum aestivum
  unsure (1)..(159): unsure at all Xaa locations
  Clone ID: PAT_TA_28057.pep
MFLTRTEYDRGVNTFSPEGGGCSRSEYAIEXAIKLGSTAIRLXMTKDGVVLAVXEKRVTSPLLXEPSSVGENMEIDEHVGCAMSGLIADXQNHRFSYGEPMTVESTTQAICDLALRFGEGDEESMSRPFGVSLLIAGHDEHGPSLYYTDPSGTFWQCKA

SEQ ID NO: 133640 - protein, 154 aa, Triticum aestivum
  unsure (1)..(154): unsure at all Xaa locations
  Clone ID: PAT_TA_28058.pep
GIRHEEAPKYMVFACADSRVCPSVTLGLEPGEAFTIRNIANMVPSYCKNKYAXGVGSAIEYAVCALKXVEVIVVIGHSRCGGIKALLSLKDGADDSFHFVEDWVRIGFPAKKKVQTECXLLTYPFVKEGVSNGTLKLVGGHYDFVSGKFETWEQ

SEQ ID NO: 133641 - protein, 124 aa, Triticum aestivum
  Clone ID: PAT_TA_28059.pep
VSPLIRSQKNGDNAGHRVAQYRSQYQEKHRRVTTSKFRLQNHGPSPHSLQHSLLPRRNAGSIIQSQGDTRRTHTDTIATHRTRFYLDTATLFATSGRGLLRRRWTDGRRLGAGGLVPRVRPRVR

SEQ ID NO: 133642 - protein, 38 aa, Triticum aestivum
  Clone ID: PAT_TA_28060.pep
RESLWPLMLYTGTGPIDNLFAHLADPGHATIFRAFAPK

SEQ ID NO: 133643 - protein, 90 aa, Triticum aestivum
  Clone ID: PAT_TA_28061.pep
MAAPAKASWMVATSVGTVEALKDQAGLCRWNYALSSIHRAAKARTNVCGGASQGTKQLSASAAAVAERRRVEKADEGLRTVMYLSCWGPN

SEQ ID NO: 133644 - protein, 258 aa, Triticum aestivum
  unsure (1)..(258): unsure at all Xaa locations
  Clone ID: PAT_TA_28062.pep
CIRMVSNIYLNFDAFEGEPDLQDGTVVGLWEWNEGGNQCWKILPWGTDADAPPPAAAYGDDDEFGGYHGGQDQETARFSYGGDDAVSQDQGQGYDGGLPPALSSECTVRIFCSAGGEEYSVAARDGTVCLAPTDPGDDSQHWVKDMRRSTSIKDEDGYPAFALVNKLTGEAIKHSLGESHPVRLVPYDPEYLDESVLWTESEDVGDGFRCVRMVNNIHLNFDALDAXRGQGGVHDGTTIVLWEWXEGENQRWKSFLGC

SEQ ID NO: 133645 - protein, 155 aa, Triticum aestivum
  Clone ID: PAT_TA_28063.pep
ICRSTGSGQCSVQRIQTSLAVHHKENATVGQFAFTTSEAGNYLACFWLDSAEKGSGVSLNLDWKIGIATKDWDSVAKKEKIEGVELELVKLEAAVESIHHNLLYLKAREAEMREVSEKTNSRVAWFSILSLGVCVVVSALQLWHLQGFFQKKKLI

SEQ ID NO: 133646 - protein, 104 aa, Triticum aestivum
  Clone ID: PAT_TA_28064.pep
TREKLRILPPPGNGQQIYEIDPTLRDFKYHLEYRYSLYRRIRSDIDEHEGGMDVFSRGYEKFGFMRSAEGITYREWAPGADSAALVGDFNNWDPNADHMSKVCM

SEQ ID NO: 133647 - protein, 151 aa, Triticum aestivum
  Clone ID: PAT_TA_28065.pep
LADVDRSARKKNSLRLDDWVLCRIYNKKGASERPGAGDRTASASPGHAAVGSPPEQKPALLPPYAPQPFSDLAAYYEVRPSDSMPRAHADSSCSEHVLTASCERPEVQSQPRISEWERTFASATPGVNPAAGLPAGDPLLQDILMYWGKPF

SEQ ID NO: 133648 - protein, 47 aa, Triticum aestivum
  Clone ID: PAT_TA_28066.pep
RRIRVRFRRGSLRNDIQILRCGPPPMNKAMAANLDDLGYTKEMQFQF

SEQ ID NO: 133649 - protein, 107 aa, Triticum aestivum
  Clone ID: PAT_TA_28067.pep
LDGSHGLRAGDASFKFPPSPPPPSRLSSPPAATASSPSPSSRSSSPTRPRASRRPPRKEKINSKRTKLSAEEASKIKAAGKAWYQTMISDSDYTEFDVFSKWLGVSQ

SEQ ID NO: 133650 - protein, 224 aa, Triticum aestivum
  Clone ID: PAT_TA_28068.pep
LPHPQQVLSLSSSHPPPPSLLEMDPAVERLKTGFEKFKTEVYDQKPDLFEPLKAHQSPKYMVFACADSRVCPSVTLGLEPGEAFTVRNIAAMVPCYCKNKHTGVGSAIEYAVCALKVEVIVVIGHSRCGGIKALLNLKDGADDTFHFVEDWVRIGFPARKKVKDECSEMSPEEQCGVLEKEAVNVSLQNLNTYPFVKEAVANGTLKLVGGHYDFVSGKFDTWAL

SEQ ID NO: 133651 - protein, 89 aa, Triticum aestivum
  Clone ID: PAT_TA_28069.pep
TTAAAAKASWMVAMSVGALEALKDQAGLCRWKYALRSIHRAAKANVRSGVSQGNKQLPATVAAVAERWRAEKAEEGLRTVMYLSCWGLN

SEQ ID NO: 133652 - protein, 90 aa, Triticum aestivum
  Clone ID: PAT_TA_28070.pep
MAIAAKASWMVAMSVGTVEALKDQARLCRWNYALRSIHRAAKAKATVRGGVSLGTEQLLASTAAVAERRRATKAEEGLRTVMYLSCRGPN

SEQ ID NO: 133653 - protein, 197 aa, Triticum aestivum
  Clone ID: PAT_TA_28071.pep
DSDEAEDQYDFDPLDDTKTWPEDLLPLQPVGRLVLDKNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAPPVPIPARPVVGKRQKETIRKPNDFKQPGERYRSWDADRQERFVRRFADSLGHPKGSQELRSIWIDL

SEQ ID NO: 133654 - protein, 158 aa, Triticum aestivum
  Clone ID: PAT_TA_28072.pep
AQDRAQYQKKHKRVTTSKFKLQNHGPFPNFFQHFFFPRKNPGSIIQSQGDTRRTHTNPIATHCTRFYLDTATFFATSGRGLLQPQWTDGQQLGAGGLVPGLIHGDVSMAMQKLSWHFIYQGRIFQRWLSPSHHFQNTTSVPSWTPPWALSPWKASKLR

SEQ ID NO: 133655 - protein, 91 aa, Triticum aestivum
  Clone ID: PAT_TA_28073.pep
MAGAAKASWMVAMSVGAVEALKDQDGLCRGKYALRSIIHRAAKARANVRGGVSQGAKQLPASAAAAAERRRAEKAEEGLRTVMYLSCWGPN

SEQ ID NO: 133656 - protein, 91 aa, Triticum aestivum
  unsure (1)..(91): unsure at all Xaa locations
  Clone ID: PAT_TA_28074.pep
MAGAAKASWMVAMSVGAVEALKDQXVGLCRWNYALRSIHRAAKASANVRRXISQGAKQLPASAVAVAERRREEKAEEGLRTVMYLSCWGLN

SEQ ID NO: 133657 - protein, 137 aa, Triticum aestivum
  Clone ID: PAT_TA_28075.pep
VGSLLLQGRTTGEDSAPMLCLSMCLRKPSSDAVVARHHLSRCLLAREPWLSSLWLMLMRSVRVRTCIPFQQINFSHRSSSTDLFFPFSSNFLVVHTTAARFLASASSVCMSAPFVPRSEGGGGDAGEAESEVAEDGR

SEQ ID NO: 133658 - protein, 161 aa, Triticum aestivum
  unsure (1)..(161): unsure at all Xaa locations
  Clone ID: PAT_TA_28076.pep
LGLWQPRRHKDNKGYYPISPXQRAQGHHIXQGQPGYYPTSLRQPRQWQQPGHGQQPGQGQQGQQPGQGQQSGQGQQGYYPTSLQQPGQGQQLGQGQPGYYPTSQQSEQGQQPGQGKQPGQGQQGYYPTSPQQSGQGQQLGQGQPGYYPTSPQPVCVGAVCP

SEQ ID NO: 133659 - protein, 126 aa, Triticum aestivum
  Clone ID: PAT_TA_28077.pep
RPSAGDRTASASPGHAAVGSPPEQKPALLPPYAPQPFSDLAAYYEVRPSDSMPRAHADSSCSEHVLTASCERPEVQSQPKISEWERTFATATPGVNPAGLMLDPAAGLPAGDPLLQDILMYWGKPF

SEQ ID NO: 133660 - protein, 35 aa, Triticum aestivum
  Clone ID: PAT_TA_28078.pep
AWSRPRYTGTGPIDNLFAHLADPGHATIFRAFAPK

SEQ ID NO: 133661 - protein, 134 aa, Triticum aestivum
  Clone ID: PAT_TA_28079.pep
LAAAVRLRSPSSKLIKHTQQLDLGVVVDDLDLVDAVALAAGDGVLEAVATAVAAGGGAVVFQGVARAVEQLAVGQRLDAEVKVLAAQVLHRNLAARLAVLGILTGGGHGSRCQRHGEEESRHGLGERHWLLLAG

SEQ ID NO: 133662 - protein, 222 aa, Triticum aestivum
  Clone ID: PAT_TA_28080.pep
LCFVLLQISVWKKFNLIFLFFLLRKLILPFYSFTLFCIILPMTMFVPEAELPDWVVCYIPALMSLLNILPSPKSFPFIIPYLLFENTMSVTKFNAMISGLFQLGSAYEWVVTKNSGRSSESDLISLAAAPPRELRHHPKTGSAPSMEALMVLKEQPSPKKEGKKQQKKHNRIYKKELALSLLLLTAAARSLLTKQGIHFYFLLFQGISFLLVGLDLIGEQVE

SEQ ID NO: 133663 - protein, 306 aa, Triticum aestivum
  unsure (1)..(306): unsure at all Xaa locations
  Clone ID: PAT_TA_28081.pep
VSYLMLVNDLIHGLYPEAVTIGEDDSGMPTFALPVQVGGVGFDYRLHMAVADKWIELLKGNDEAWEMGNIVHTLTNRRWLEKCVTYAESHDQALVGDKTIAFWLMDKDMYDFMALNGPSTPNIDRGIALHKMIRLITMGLGGEGYLNFMGNEFGHPEWIDFPRGPQVLPTGKFIPGNNNSYDKCRRRFDLGDAEFLRYHGMQQFDQAMQHLEEKYGFMTSDHQYVSRKHEEDKVIVFEKGDLVFXVFNFHWSNSYFDYRVXGCLKPGKYKXVVLDSDAGLFGGXGRIHHTAEHFTSDCQHDNRPHS

SEQ ID NO: 133664 - protein, 111 aa, Triticum aestivum
  Clone ID: PAT_TA_28082.pep
VTRAILENPNDNTKVHLIYANVTYDDILLLEELDNMAKNYPDRFKIYYVLNQPPEVWDGGVGFVSKEMIQAHCPAPAADIQILRCGPPPMNKAMAANLDDLGYTKEMQFQF

SEQ ID NO: 133665 - protein, 171 aa, Triticum aestivum
  Clone ID: PAT_TA_28083.pep
AAACSIPQQQGWFDSHHPFCLLPISFLPVSLRFWIAAFPHPPLLELSDSFGVIAPSPIDPLPPPVDDSVDPARSTRSALPVNDSTYRAMGLGLRLPFFLLLLLLVSLGAAQGRSTVFLDIKEARDPDQILMDQITSSKTPVRVERGSPLCPACEKFTDEALSYLSQETITR

SEQ ID NO: 133666 - protein, 90 aa, Triticum aestivum
  Clone ID: PAT_TA_28084.pep
MAGPAKASWMVAMSVGAVEALKDQAGLCRWNYALSSIHRAAKAKANVRGGVSQGKKQLPAFAAAVAERRRAEKAEEGLRTVMYLSCWGPN

SEQ ID NO: 133667 - protein, 160 aa, Triticum aestivum
  Clone ID: PAT_TA_28085.pep
MATAYAPPMASQVMKSGLVSSKPRGLSGASLTRRPRFVVSPLLRGIEVGLAHGYLLVGPFALTGPLRNTPIHGQAGTLGAIGLVSILSVCLTMYGVASFNEGAPSTAPALTLTGRKKEADKLQTAEGWSQFTGGFFFGGVSGAIWAYFLLYVLDLPYFFK

SEQ ID NO: 133668 - protein, 103 aa, Triticum aestivum
  Clone ID: PAT_TA_28086.pep
MAGAAKASWMVAMSVGAVEALKDQAGLCRWNYALRSIHRAANIRAGVSQGKKQLPASAAAVAERRRAEKAEEGLRTVMCLSCWGVQNTCCAMNWLQVQVLPVG

SEQ ID NO: 133669 - protein, 114 aa, Triticum aestivum
  Clone ID: PAT_TA_28087.pep
AAVILVACLLFGISNRGSAAGCRTSDIFVTTEAYPDPGGRLVQYVTLVNNCARCTQKNVKLACPGFSSSIEVYPDTAIKPDGDGKLCTLYAGRPVGPKENVFFNYVPVSSTIVC

SEQ ID NO: 133670 - protein, 89 aa, Triticum aestivum
  Clone ID: PAT_TA_28088.pep
MEGAAKASWMVAMSVGGVEALKDQAGLCRWNYALRSIHRAAKARANVRGGVLQGAKQLPASAAVAERRRGDKAEEGLRTVMYLSCWGPN

SEQ ID NO: 133671 - protein, 130 aa, Triticum aestivum
  unsure (1)..(130): unsure at all Xaa locations
  Clone ID: PAT_TA_28089.pep
AGEQEYFTXTPPTLFIVELILIGWAEGRRWADIIKPGCVNTDPIFPNNKLTGTDVXGYPGGLWFDPLGYGTGSPEKLKELRTKEIKNGRLAMLAVMGAWFQAEYTGTGPIDNLFAHLADPGHATIFRVRI

SEQ ID NO: 133672 - protein, 223 aa, Triticum aestivum
  unsure (1)..(223): unsure at all Xaa locations
  Clone ID: PAT_TA_28090.pep
KPTHHPPQGPSLSSSSSTTLEDRKMERLRTGFDKFKTEVYDKKPDLFEPLKDNQEPTYLLFACADSRVCPSVTLGLEPGEAFTVRNIGAMVPCYCKEQAHXGVGSAIEYAVCALKVKVIVVIGHSRCGGIKALLSLKDGEDDSFHFVEDWVRIGFSAKKKVKDECCDLPFEDQCAVLEKEAVNVSLQNLKXYPFVKEGVANGTLKLIGGHYDFVSGKFDTWEL

SEQ ID NO: 133673 - protein, 90 aa, Triticum aestivum
  Clone ID: PAT_TA_28091.pep
RGRGRGVAASSALLPFTTTSPASTHPTSMHCSTITYHHPRSTSQERKKSSSTSDLLPRGSTLLGLVANSHRVPYLGAKARKMVAWPGSAR

SEQ ID NO: 133674 - protein, 91 aa, Triticum aestivum
  Clone ID: PAT_TA_28092.pep
MAGAAKASWTVAMSVGAVEALKDQAGLCRWNYALKSIHRTAKARVNVHGGASQSTKQLPASAAAVAERRRAEKAEEGLRTVMYLGCWGPNC

SEQ ID NO: 133675 - protein, 88 aa, Triticum aestivum
  unsure (1)..(88): unsure at all Xaa locations
  Clone ID: PAT_TA_28093.pep
PSQITRFKPHAFVVPENRFSTALQACCGAGGRALQFNPEEEVRQGGXSVCSNPSAYVSWDGIHMTEAAYRMVANGWLNGPYASPPIMK

SEQ ID NO: 133676 - protein, 213 aa, Triticum aestivum
  Clone ID: PAT_TA_28094.pep
MGWAAPERPIWFPGSTPPPWLDGSLPGDFGFDPWGLGSDPESLRWNVQAELVHCRWAMLGAAGIFIPELLTKIGILNTPSWYTAGEQEYFTDTTTLFIVELILIGWAEGRRWADIIKPGSVNTDPIFPSNKLTGTDVGYPGGLWFDPLGWGSGSPEKIKELRTKEIKNGRLAMLAVMGAWFQAEYTGTGPIDNLFAHLADPGHATIFQAFTPK

SEQ ID NO: 133677 - protein, 301 aa, Triticum aestivum
  Clone ID: PAT_TA_28095.pep
MSGGGGGGSAATQGQQDLQLPPGFRFHPTDEELVMHYLCRRCAGLPISVPIIAEVDLYKFDPWQLPRMALYGEKEWYFFSPRDRKYPNGSRPNRSAGTGYWKATGADKPVGTPKPLAIKKALVFYAGKAPKGDKTNWIMHEYRLADVDRSARKKNSLRLDDWVLCRIYNKKGASERPSAGDRTASASPGHAVVGSPPEQKPALLPPYAPQPFSDLAAYYEVRPSDSMPRAHADSSCSEHVLTASCERPEVQSQPKISEWERTFASATPGVNPAGSMLDPSAGLPAGDPLLQDILMYWGKPF

SEQ ID NO: 133678 - protein, 83 aa, Triticum aestivum
  Clone ID: PAT_TA_28096.pep
MAAPAKASWMVAMSVGAVEALKDQAGLCRWNYALGSIHRAAKANVRGGVSQGTKHLPVSAPTVTEKAEEGLRTVMYLSCWGPN

SEQ ID NO: 133679 - protein, 237 aa, Triticum aestivum
  Clone ID: PAT_TA_28097.pep
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQFNKELTLQEAETIALSILKQVMEEKVTPNNVDIAKVAPNYHLYTPAEVEAVIARL

SEQ ID NO: 133680 - protein, 88 aa, Triticum aestivum
  unsure (1)..(88): unsure at all Xaa locations
  Clone ID: PAT_TA_28098.pep
MAAPAKASWMVAMSVGAVEALKXQAGLCRWNYALKSIHRAAKANVCGGISAGHQAASXSASAVAERRRAEKAEEGLRTVMYLSCWGPN

SEQ ID NO: 133681 - protein, 206 aa, Triticum aestivum
  Clone ID: PAT_TA_28099.pep
LNGPSTPNIDRGIALHKMIRLITMGLGGEGYLNFMGNEFGHPEWIDFPRGPQVLPSGKFIPGNNNSYDKCRRRFDLGDAEFLRYHGMQQFDQAMQHLEEKYGFMTSDHQYVSRKHEEDKVIVFEKGDLVFVFNFHWSSSYFDYRVGCLKPGKYKVVLDSDAGLFGGFGRIHHTAEHFTSDCQHDNRPHSFSVYTPSRTCVVYAPMN

SEQ ID NO: 133682 - protein, 179 aa, Triticum aestivum
  Clone ID: PAT_TA_28100.pep
MATASVSFKSREDHRKQLELEEARKAGLAPAEVDEDGNEINPHIPQYMSSAPWYLNAEKPSLKHQRKWKSDPNYTKAWYDRGARLFQANKYRKGACENCGAMTHNKKECMDRPRNVGAKYTNMNIAPDEKVESFELDYDGKRDRWNGYDTSTYTRVIQDYEAREEARKKFLKEQQLKKL

SEQ ID NO: 133683 - protein, 225 aa, Triticum aestivum
  Clone ID: PAT_TA_28101.pep
HCFILLQISVWKKFNLIFLFFLLRKLILPFYSFTLFCIILPMTMFVPEAELPDWVVCYIPALMSLLNILPSPKSFPFIIPYLLFENTMSVTKFNAMISGLFQLGSAYEWVVTKKSGRSSEGDLISLAAAAPPPRELGHHPKTGSAPSLEALMVLKEQQPSPKKEGKKQQKKHNRIYKKELALSLLLLTAAARSLLTKQGIHFYFLLFQGISFLLVGLDLIGEQVE

SEQ ID NO: 133684 - protein, 186 aa, Triticum aestivum
  unsure (1)..(186): unsure at all Xaa locations
  Clone ID: PAT_TA_28102.pep
MATASVSFKSREDHRKQLEXLEEARKAGLAPAEVDEDGNEINPHIPQYMSSAPWYLNAEKPSLKHQRKWKSDPNYTKAWYDRGARLFQANKYRKGACENCGAMTHNKKECMDRPRNVGAKYTNMNIAPDEKVESFELDYDGKRDRWNGYDTSTYTRVIQDYEAREEARKKFLKEQQLKKLEEKDGE

SEQ ID NO: 133685 - protein, 293 aa, Triticum aestivum
  Clone ID: PAT_TA_28103.pep
FVDPGCKLPDGLGNLINLQELDWVDALQLKHVEELGKLTNLRKLRIKLDTDGIEGNKLEQSKEKLVSSLCKLDECGLRSLSIDYYLREKDGGEPFLPALGCIQEVCVDGQDISRISRWLASLPNLHMLFFNGPKIEQQDIEMIGLIPNLIDLLLPLHKTDDAGRLIIRREGFQQLQSFRVYNTRMGVLMFEPGAMPRLKELELYNFIERPKSAAVDFDFGIQRLSSLARLTVSLACYRSTAAEVEATEDAFKSMAEANPNRPILEMTRLYPQHMVRDEQIDMAGSATTPAVKS

SEQ ID NO: 133686 - protein, 203 aa, Triticum aestivum
  Clone ID: PAT_TA_28104.pep
TEPAMRPKTIYGTGRMFIIPSIPCIYNIISDNHNAFFLFSPPPVRASARRDDPSRDQECVAPGPSISMEKQECFARRNAVRVHAPRRGKRASSMVVLRERPPSPLLRRVMQPRSVCWQQNHRTERVSAITVTRQRSRCRCGMLVAYVCDGDWTRIACMPMAGRHATHRSVEISSCSEPPPKSSTTPLCWTSEPWVGSRCSTYP

SEQ ID NO: 133687 - protein, 143 aa, Triticum aestivum
  Clone ID: PAT_TA_28105.pep
MIFTKKNHRATTTMFQSRSGRTRILESQAAQSSDSQCLALITELREMQERVESRRRYDESGRAFMLAGLSSHSWQRATARGDSTELNTQIHTYQTPSMVDMLHRSQTLVPAVVEMLNRSPTVAPSRGSGRSVRSTKSFSERLA

SEQ ID NO: 133688 - protein, 92 aa, Triticum aestivum
  Clone ID: PAT_TA_28106.pep
MAGPAKASWMVAMGVGAVEALKDQAGLCRWNYALRSIHRTAKAKANVRGGGGVSQGKKQLPTSAAAVTERRRADKAEEGLRTVMYLSCWGPN

SEQ ID NO: 133689 - protein, 153 aa, Triticum aestivum
  Clone ID: PAT_TA_28107.pep
FERPPGQVPKYSGVSMTQHPQYITVRNERGREMLSLIEGLLESTPTVSSGARQPFVMETVKADDAAKMGKGPANPAPIFVGNIIAFLLNLIGPKGLEFGRYSLDYHTIRNYLYVNRAWGRARAEQHMPSYAKKIVEAYNKDGRIDSMLEQNKQ

SEQ ID NO: 133690 - protein, 175 aa, Triticum aestivum
  Clone ID: PAT_TA_28108.pep
TNHCLAKIVEGGRSSEGGKSPISLFSRHSGRSTSSSEDGSVKSGGSKKADSKCPNSGNPFHECGEHCTTKMKELEKQKKADKKSPRKKGGKDGAVVQNWKVDPRCPNAGNPFHICAQYCFDHLNEAPSTPTSKPDSRKGKAVMKAEPTEEINPDCVNASNPYHKCGEYCKRNGNR

SEQ ID NO: 133691 - protein, 85 aa, Triticum aestivum
  Clone ID: PAT_TA_28109.pep
MAGPAKASWMAATSVGAVEALKDQAGLCRWNYALRSIHRAAKANVRGGVSQGTKQLPAAVAERRRAEKAEEGLRTVMYLSCWGPN

SEQ ID NO: 133692 - protein, 209 aa, Triticum aestivum
  Clone ID: PAT_TA_28110.pep
MATAYAPPMASQVMKSGLVCSKPRGMSGASLTRRPRLVVKAVKSDKPTYQVVQPINGDPFIGSLETPVTSSPLVAWYLSNLPAYRTAVSPLLRGIEVGLAHGYLLVGPFALTGPLRNTPIHGQAGTLGAIGLVSILSVCLTMYGVASFNEGAPSTAPALTLTGRKKEADKLQTAEGWSQFTGGFFFGGVSGATWAYFLLYVLDLPYFFK

SEQ ID NO: 133693 - protein, 823 aa, Triticum aestivum
  Clone ID: PAT_TA_28111.pep
MATFAVSGATLGVARPAGAGGGLLPRSGSERRGGVDLPSLLLRKKDSSRAVLSRAASPGKVLVPDGESDDLASPAQPEELQIPEDIEEQTAEVNMTGGTAEKLESSEPTQGIVETITDGVTKGVKELVVGEKPRVVPKPGDGQKIYEIDPTLKDFRSHLDYRYSEYRRIRAAIDQHEGGLEAFSRGYEKLGFTRSAEGITYREWAPGAHSAALVGDFNNWNPNADTMTRDDYGVWEIFLPNNADGSPAIPHGSRVKIRMDTPSGVKDSISAWIKFSVQAPGEIPFNGIYYDPPEEEKYVFQHPQPKRPESLRIYESHIGMSSPEPKINSYANFRDEVLPRIKRLGYNAVQIMAIQEHSYYASFGYHVTNFFAPSSRFGTPEDLKSLIDRAHELGLLVLMDIVHSHSSNNTLDGLNGFDGTDTHYFHGGPRGHHWMWDSRLFNYGSWEVLRFLLSNARWWLEEYKFDGFRFDGVTSMMYTHHGLQMTFTGNYGEYFGFATDVDAVVYLMLVNDLIHGLHPDAVSIGEDVSGMPTFCIPVPDGGVGLDYRLHMAVADKWIELLKQSDESWKMGDIVHTLTNRRWLEKCVTYAESHDQALVGDKTIAFWLMDKDMYDFMALDRPSTPRIDRGIALHKMIRLVTMGLGGEGYLNFMGNEFGHPEWIDFPRGPQTLPTGKVLPGNNNSYDKCRRRFDLGDADFLRYHGMQEFDQAMQHLEEKYGFMTSEHQYVSRKHEEDKVIIFERGDLVFVFNFHWSNSFFDYRVGCSRPGKYKVALDSDDALFGGFSRLDHDVDYFTTEHPHDNRPRSFSVYTPSRTAVVYALTE

SEQ ID NO: 133694 - protein, 230 aa, Triticum aestivum
  unsure (1)..(230): unsure at all Xaa locations
  Clone ID: PAT_TA_28112.pep
DILPPLHKFRLSHPHLLLFLRFVPSRDGPRPLERLKTGFEKFKTEVYDQRXNLFEPLKAHQSPKYMVSACADSRVCPSVTLGLEPGXAFTVRNIARHGPVLLQRTSTLGVGSAIEYAVCALKVEFIVVIGHSRCGGIKALLNLXDGADDTFHFVEDWVRIGYPARKKVKDECSEMPFEEQCGVLEKEAVNVSLQNLSTYPFVKEGVANGTLKLVGGHYDFVSGKFDTWTL

SEQ ID NO: 133695 - protein, 89 aa, Triticum aestivum
  Clone ID: PAT_TA_28113.pep
MAGAAKASWMVAMSVGAVEALKDQAGLCRWNYALRSIHRTAKARANVRGGVSQGARQLPASAAVAEKRRAEKTEEGLRTVMYLSCWGPN

SEQ ID NO: 133696 - protein, 168 aa, Triticum aestivum
  Clone ID: PAT_TA_28114.pep
WWRPKGRGRAISNGPPPYDWGEEWEEDGDYYYNGRGRGRGRLRGRGRARGYYGGGRRGGYGYDYGYGGRGGYYEEQGGYFDGEPDEYHPPPGRGRGRGRRMEQSEYYNGEPDEYRPPPGRGRGRGRWMEQNEYFDEPYEYPPPGRGRGMGRRGGPWRARGRGRGPMLD

SEQ ID NO: 133697 - protein, 102 aa, Triticum aestivum
  Clone ID: PAT_TA_28115.pep
FTDTTTLFIVELILIGWAEGRRWADIIKPGCNTDPIFPNNKLTGTDVGYKVALDSDDALFGGFSRLDHDVDYFTTEHPHDNRPRSFSVYTPSRTAVVYALTE

SEQ ID NO: 133698 - protein, 236 aa, Triticum aestivum
  Clone ID: PAT_TA_28116.pep
EFGTRKKVMALMRSYNRQGAAHRHGLRTGFKVGQSVENGGVVEYFFGNDGNEPLHFDKFTSFLKELHEEIIRLEFSHYDVKSTNTIPAKDFALSMVASADMNHISKLLDRADTLGNDPYLKNLRITFEEFKAFADLRRRLESLTMAIFAYGQVNGLLTKQDLKRAAQHVCGVELTDRVVDIIFHVFDMNNDGHLSSEEFLRALQRREADIHQPAARGGPMGWLNPKNRSSLLQMLR

SEQ ID NO: 133699 - protein, 150 aa, Triticum aestivum
  Clone ID: PAT_TA_28117.pep
KKKKKKKKKKKKKKKKKKKKKKKKQTPDHHEFVREQIISQLKSNREAYDGYVPMAYDEYLEKVSRNGEWGDHVTLQAAADKYGVKIFVMTSFKDTCYIEIQPKVQKSNKVVLLSFWAEVHYNSIFPQNDAPRLHHTAKKRRWWPFSQHHH

SEQ ID NO: 133700 - protein, 143 aa, Triticum aestivum
  Clone ID: PAT_TA_28118.pep
VRKKETEPASSTLAAASSSFSHLSRLPPPPPPASLFHPYLTAARLHPLPPQPRTPPAAAVVPDLSRLQCVERRRSAPSFSTVARRERTQPRCGSAPRSATGDARPPFSSPPWLPRLARRCPAFSRSPPILSSSKVNFVTYRRC

SEQ ID NO: 133701 - protein, 124 aa, Triticum aestivum
  Clone ID: PAT_TA_28119.pep
FKKIYSVLSVPQLRKTHYYTRITSQSPLFSSAARTRRRRRDDGWSGEGVVDGGDERGHCGGAKRTRPGSAAGTTRSGPSTVQPRPTSAAASRRVTKQLPASVSAVAERRPAEKAGGGAEDCHVP

SEQ ID NO: 133702 - protein, 237 aa, Triticum aestivum
  Clone ID: PAT_TA_28120.pep
AGRVREKPTQHPPPPSSKQVPSLSSSPPPPPSLLEMDPAVERLKTGFEKFKTEVYDQKPDLFEPLKAHQSPKYMVFACADSRVCPSVTLGLEPGEAFTVRNIAAMVPSYCKNKHTGVGSAIEYAVCALKVEFIVVIGHSRCGGIKALLNLKDGADDTFHFVEDWVRIGYPARKKVKDECSEMPFEEQCGVLEKEAVNVSLQNLSTYPFVKEAVANGTLKLVGGHYDFVSGKFDTWAL

SEQ ID NO: 133703 - protein, 203 aa, Triticum aestivum
  unsure (1)..(203): unsure at all Xaa locations
  Clone ID: PAT_TA_28121.pep
MATAYAPPMASQVMKSGLVSSKPRGLSGASLTRRPRFVVKAVKSDKGTYQVXVQPINGDPFIGSLXETPVTSSPLVAWXYLSNLPAYRTAVSPLLRGIEVGLAHGYLLVGPFALTGPLRXNTPIHGQAGTXGAIGLVSILSVCLXMYGVASSTRARPSNAPALKLXGRKKEATTANAEVSNRRFSSSRRIGLFSTVTPLNICW

SEQ ID NO: 133704 - protein, 90 aa, Triticum aestivum
  unsure (1)..(90): unsure at all Xaa locations
  Clone ID: PAT_TA_28122.pep
MAGAAKASWMVAMSVGAVEALKDQAGLCRWNYALRSIHRAAKARANVRGTVSLGTKQLPASTAAXAERRRAEKAEEGLRTVMYLSCWGTN

SEQ ID NO: 133705 - protein, 320 aa, Triticum aestivum
  unsure (1)..(320): unsure at all Xaa locations
  Clone ID: PAT_TA_28123.pep
ERERERERERERERERALLEYHNIEGMILFSELSRRRIRSISSLIKVGRQEPSMVLRVDRDKGYIDLSKRRVSEEEAATCEDRYNKSKLVHSIMRHAADTLGVDLEPLYQRIGWPLYRRYGHAFEAFKLIVTDPDAXLDVLTYEETVVGPDXEEVTKVVPAVTPEVKDALVRNIRRRMTPQPLKIRADVEMKCFQFDGVLHIKEAMRKAEAAGNADCPVKIKLVAPPLYVLTTQTLDKDQGIAVLTNATKICAEAIEKHKGKLVVKEAARAVSERDDKLFADTIEKLKLAGEEVDGDNDSEEEDNGMGDVDFTKAGAGAD

SEQ ID NO: 133706 - protein, 139 aa, Triticum aestivum
  unsure (1)..(139): unsure at all Xaa locations
  Clone ID: PAT_TA_28124.pep
EVYGSFEASXLQEKGFVLPRPKMTNADLGRLINSDEVQSVVKPINKEVKRREARKNPLKNAAAVLKLNPYFGTARRMAVLAEAARVKARKDKINSKRTKLSVEEASKIKAAGKAWYQTMISDSDYMEFDVFSKWLGVSQ

SEQ ID NO: 133707 - protein, 182 aa, Triticum aestivum
  unsure (1)..(182): unsure at all Xaa locations
  Clone ID: PAT_TA_28125.pep
MATAYAPPMASQVMKSGLVCSKPRGLSGASLTRRPRFVVKAVKSDKGTYQVXVQPINGDPFIXGAWETPVTSNPLRRVGTSPTFPAYRTAVKPAPPVASEVGLAHGYLLVGPFALNGPLXRNTPIHGKXGNLRRIGLVXILSVCLTCTAPSFNEGAPQRAASSRAKKERQLRRRRWSYGGSL

SEQ ID NO: 133708 - protein, 359 aa, Triticum aestivum
  Clone ID: PAT_TA_28126.pep
LPSPPHPVPPPPPAAAAAREEPPNLECRMYEPRFPEVDAAVMIQVKHIADMGAYVSLLEYNNIEGMILFSELSRRRIRSISSLIKVGRQEPSMVLRVDRDKGYIDLSKRRVSEEEAATCEDRYNKSKLVHSIMRHAADTLGVDLEPLYQRIGWPLYRRYGHAFEAFKLIVTDPDAVLDVLTYEETVVGPDGVEVTNTVPAVTPEVKDALVKNIRRRMTPQPLKIRADVEMKCFQFDGVLHIKEAMRKAEAAGNADCPVKIKLVAPPLYVLTTQTLDKDQGIAVLTNATKVCAEAIEKHKGKLVVKEAARAVSERDDKLFADTIEKLKLAGEEVDGDDDSEEEDNGMGDVDFTKAGAGTD

SEQ ID NO: 133709 - protein, 339 aa, Triticum aestivum
  Clone ID: PAT_TA_28127.pep
MPNLECRMYEPRFPEVDAAVMIQVKHIADMGAYVSLLEYNNVEGMILFSELSRRRIRSISSLIKVGRQEPAIVLRVDRDKGYIDLSKRRVSEEEARSCEDKYNKSKLVHSIMRHVAETLEIDLERIYQRIGWPLYRKYGHAFEAFKLIVADPDAILDVLTYEERETGPDGQEVTKVVPAVTPEIKETLVQNIRRRMTPQPLKIRADVEMKCFQFDGVLHIKQAMRKAEAAGNTNCPVKIKLVAPPLYVLTTQTLDKDQGISVLTDAVKACTAEIEKHKGKLVVKEAPRAVSEREDKLLNAQLDTLVEQNAEVAGDDDSEDEEDTGMGDIDLTNSGVHAD

SEQ ID NO: 133710 - protein, 226 aa, Triticum aestivum
  unsure (1)..(226): unsure at all Xaa locations
  Clone ID: PAT_TA_28128.pep
GWGRRVRGKVQYADLGAENWKPISNLHDMSSSHSKTLGYKRLTKSNPISCQILLYKSRSKGRKNQRSTRTHCHHPSPKIYSASAKEPWILATNLPVEIXRTPKQLVNIYSKRMQIEETFRDLKSPAYGLGLRHSRTSSSERFDIMLLIALMLQLTCWLAGVHAQKQGWDKHFQANTVRNRNVLSTVRLGMEVLRHSGYTITREDLLVAATLLAQNLFTHGYALGKL

SEQ ID NO: 133711 - protein, 358 aa, Triticum aestivum
  Clone ID: PAT_TA_28129.pep
TLLCWHCLKKKKKKLETSSCRIRHEGSHPVSLNSENLQLLRQRYYYATWKADGTRYMMLIMRDGCFLIDRNFCFRRVQMRFPIRNVNDGFHNFTLIDGEMVVDAIPGGGLKRRYLAYDLMAINFSSKVKLPFSDRWKLLEDEIIRPRIYERKQFETGLKGNPSYRYDLELFSVRRKDFWLLSTVKKLLKEFIPALSHESDGLIFQGWDDPYVNRTHEGLLKWKYPEMNSVDFLFETGSENRQLIFLYERGKKKLMDGTRVVFPDDVDPSSISGKIVECSWNKQEDCWFCMRIRADKSTPNDINTYRKVMRSITDNITEDKLLGEMNEISSLPMYADRKAHADRKAHAEKMAHQHRRRG

SEQ ID NO: 133712 - protein, 833 aa, Triticum aestivum
  Clone ID: PAT_TA_28130.pep
VRSGRLADSITTRGWRRFAVSGATLGVARAGVGVARAGSERRGGADLPSLLLRKKDSSRAVLSRAASPGKVLVPDGESDDLASPAQPEELQIPEDIQEQTAEVNMTGGTAEKLQSSEPTQGIVETITDGVTKGVKELVVGEKPRVVPKPGDGQKIYEIDPTLKDFRSHLDYRYREYKRIRAAIDQHEGGLEAFSRGYEKLGFTRSAEGITYREWAPGAHSAALVGDFNNWNPNADAMTRDDYGVWEIFLPNNADGSSAIPHGSRVKIRMDTPSGVKDSISAWIKFSVQAPGEIPFNGIYYDPPEEEKYVFQHPQPKRPESLRIYESHIGMSSPEPKINSYANFRDEVLPRIKRLGYNAVQIMAIQEHSYYASFGYHVTNFFAPSSRFGTPEDLKSLIDRAHELGLLVLMDIVHSHSSNNTLDGLNGFDGTDTHYFHGGPRGHHWMWDSRLFNYGSWEVLRFLLSNARWWLEEYNFDGFRFDGVTSMMYTHHGLQMTFTGNYGEYFGFATDVDAVVYLMLVNDLIHGLYPDAVSIGEDVSGMPTFCIPVPDGGVGFDYRLHMAVADKWIELLKQSDESWKMGDIVHTLTNKRWLEKCVTYAESHDQALVGDKTIAFWLMDKDMYDFMALDRPSTPRIDRGIALHKMIRLVTMGLGGESYLNFMGNEFGHPEWIDFPRGPQTLPTGKVLPGNNNNYDKCRRRFDLGDAEFLRYRGMQEFDQAMQHLEEKYGFMTSEHQYVSRKHEEDKVIIFERGDLVFVFNFHWSNSFFDYRVGCSKPGKYKVALDSDDALFGGFSRLDHDVDYFTTEHPHDNRPRSFSVYTPSRTAVVYALTE

SEQ ID NO: 133713 - protein, 325 aa, Triticum aestivum
  Clone ID: PAT_TA_28131.pep
MDRYQRVEKPRNETPIRENEIRITALGRMRNYIGYGMSLLEENGHDEITIKAMGRAINKTVMVAELIKRRVAGLHQNTSIESVGITDTWEPLEEGLVPLETTRHVSMITLTLSKEPLDTSSPGYQPPIPAEEVKPAFDYEHEGSFPSARGRGRGGPGGGRRGRGRAISNGPPPYDWGEEWEEDGDYYYNGRGRGRGRLRGRGRARGYHGGGRRGGYGYDYGYGGRGGYYEERGGYFDGEADEYQPPPGRGRGRGRRMEQSEYYNGEPDEYRPPPGRGRGRGRWMEQNEYFDGEPYEYPPPGRGRGMGRRGGPWRARGRGRGPMLD

SEQ ID NO: 133714 - protein, 90 aa, Triticum aestivum
  Clone ID: PAT_TA_28132.pep
MAGAAKASWMVAMSVGAVEALKDQAGLCRWNYALRSIHRAAKAKSNIHAGVSQGKKQLPASAAAVPERRRAEKAEEGLRTVMYLSCWGPN

SEQ ID NO: 133715 - protein, 170 aa, Triticum aestivum
  unsure (1)..(170): unsure at all Xaa locations
  Clone ID: PAT_TA_28133.pep
MFGFGHHHKDQAPAASGPNQIFKIYCRASEDYCLAVRDGEVVLAPVNPKDETQHWLKDMRFSTTVKDEEGMPAFALVNKATGLAVKHSIGQSHPVKLVPFNPAYXDESVLWTESKDVGKGFRCVRMVNNIYLNFDAFHGDKAHGGVHDGTEVVLWKWCEGDNQRWKILPW

SEQ ID NO: 133716 - protein, 162 aa, Triticum aestivum
  Clone ID: PAT_TA_28134.pep
RQPAPCAGVRVPVRVLCAAGEDYSLTVRNGTVCLAPTNPRDEFQHWVKDMRYSTKIKDEEGYPAFALVNKATGQAIKHSLGQSHPVRLVPYNPDYLDESVLWTESRDVGNGFRCVRMVNNIYLNFDALNGDKDHGGVRDGTEVVLWKWCEGDNQRWKLQPYY

SEQ ID NO: 133717 - protein, 123 aa, Triticum aestivum
  Clone ID: PAT_TA_28135.pep
KDFEYFASVRKPDGEMFMLPADLMRAVVPVFPPSESNVVREGRLRGEPSPGELHCAPSKFFVLFDTYTDGLISFAEYIFFVTLLSIPESSFSAAFKMFDVDLSGRVLFTEAAKGMLSPFVLFD

SEQ ID NO: 133718 - protein, 274 aa, Triticum aestivum
  unsure (1)..(274): unsure at all Xaa locations
  Clone ID: PAT_TA_28136.pep
HMAVADKWIELLKQSDEXWKMGDIVHTLTNRRWLEKCVTYAESHDQALVGDKTIAFWLMDKDMYDFMALDRPSTPRIDRGIALHKMIRLVTMGLGGEGYLNFMGNEFGHPEWIDFPRGPQTLPTGKVLPGNNNSYDKCRRRFDLGDADFLRYRGMQEFDQAMQHLEEXYGFMTSEHQYVSRKHEEDKVIIFERGDLVSVFNFHWSNSFFDYRVGCSKPGKYKVALDSDDALLGGFSRLDHDVDYFTTEHPHDNRPRSFLVYTPSRTAVVYALTE

SEQ ID NO: 133719 - protein, 252 aa, Triticum aestivum
  Clone ID: PAT_TA_28137.pep
FPLVVSDSAEGIEKTAQAIKVLKQLGAYADAEKAKLSVGIRPGKGKMRNRRYINRKGPLIVYGTEGSKIVKAFRNLPGVDVANVERLNLLDLAPGGHLGRFVIWTESAFKKLDEVYGSFEASSSKKKGFVLPRPKMTNADLGRLINSDEVQSVVKPINKEVKRREARKNPLKNAAAVLKLNPYFGTARRMAVLAEAARVKARKEKINSKRTKLSAEEASKIKAAGKAWYQTMISDSDYTEFDVFSKWLGVSQ

SEQ ID NO: 133720 - protein, 136 aa, Triticum aestivum
  Clone ID: PAT_TA_28138.pep
TVHQKENATVGQFAFTTSEAGNYLACFWLDSAEKGSGVSLNLDWKIGIATKDWDSVAKKEKIEGVELELAKLEAAVESIHHNLLYLKAREVEMREVSEKTNSRVAWFSILSLGVCVVVSALQLWHLQGFFQKKKLI

SEQ ID NO: 133721 - protein, 288 aa, Triticum aestivum
  unsure (1)..(288): unsure at all Xaa locations
  Clone ID: PAT_TA_28139.pep
MDRYQRVEKPRNETPIRENEIRITALGRMRNYIGYGMSLLEENGHDEITIKAMGRAINKTVMVAELIKRRVAGLHQNTSIESVGITDTWEPLEEGLXPLETTRHVSMITLTLSKEPLDTSSPGYQPPIPAEEVXPAFDYEHEEWEEDGDYYYNGRGRGRGRLRGRGRARGYHGGGRRGGYGYDYGYGGRGGYYEERGGYFDGEADEYQPPPGRGRGRGRRMEQSEYYNGEPDEYRPPPGRGRGRGRWMEQNEYFDEPYEYPPPGRGRGMGRRGGPWRARGRGRGPMLD

SEQ ID NO: 133722 - protein, 369 aa, Triticum aestivum
  unsure (1)..(369): unsure at all Xaa locations
  Clone ID: PAT_TA_28140.pep
MEHRGLLLVLVAALCLAGGADARHAKKSYQAVFSFGDSLSDAGNLIVDGIPKSLTTARAPYGMTFFGRPTGRCSNGRVVVDFLAEHFGLPLPPASQAHGKGFKKGANFAITGATALEYSFLRXHGIDQRIWNTGSINTQIGWLQKMKPSLCKSEKECKDYFSKSLFVVGEFGGNDYNAPLFSGVAFSDVKTYVPLVAKAIANGVEKLIELGATDLLVPGILPIGCFPLYLTLYNSSKKSDYNARTGCLRRYNRLAFHHNRELKQQLDQLQKKYPKTKIMYGDYFKAAMQFVVSPGKFGFSTAVQACCGAGGSGAYNFNLKKKCGEAGASVCSNPSAYVSWDGIHMTEAAYRMVANGWLNGPYASPPIMK

SEQ ID NO: 133723 - protein, 302 aa, Triticum aestivum
  Clone ID: PAT_TA_28141.pep
MIALSFVRKGSDLVTVRQLLGQHAKRIKLMSKVENQEGIVNFDDILRETDVFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILQAALKSAVKKQLCKAGDAVVVLHRIGVASVIKICTVK

SEQ ID NO: 133724 - protein, 535 aa, Triticum aestivum
  Clone ID: PAT_TA_28142.pep
MATASVSFKSREDHRKQLELEEARKAGLAPAEVDEDGNEINPHIPQYMSSAPWYLNAEKPSLKHQRKWKSDPNYTKAWYDRGARLFQANKYRKGACENCGAMTHNKKACMDRPRNVGAKYTNMNIAPDEKVESFELDYDGKRDRWNGYDTSTYTRVIQDYEAREEARKKFLKEQQLKKLEEKDGEQDGENVGSEEDEEDGLKIDEAKVDESAQMDFAKVEKRVRTTGGGSTGTVRNLRIREDTAKYLLNLDVNSAYYDPKTRSMREDPLPDADPNDKFYVGDNQNRLSGQALEFKQLNVHAWEAFDKGQDFHMQAAPSQAELLYKSFKIKKEKLKSESKDKIMEKYGNAASDEPIPRELLLGQSEKEIEYDRTGRIIKGQDVALPKSKYEEDVLINNHTTVWGSWWKDHQWGYKCCKQTIKNSYCTGLAGIEAAEASADLMRENMARKEAAEEEPVRQEEKKLATWGTDIPQDLVLDQKLLEESLKKEAKRKKEEMDERKRKYNVKWNDEVTAEDMEAYRMTRVRHDDPMKDFLN

SEQ ID NO: 133725 - protein, 309 aa, Triticum aestivum
  unsure (1)..(309): unsure at all Xaa locations
  Clone ID: PAT_TA_28143.pep
RPSTPCPCSRRAPQAPGATAARGRLLVPAARRFPSLRAARRVVAARAAPVDADDEWGKEPAVGGTAVAEAPSEAAAAASEVAALKLKLKAALYGTERGLRASSETRAEVVELITQLEARNPTPAPTEALTLLNGKWILAYTSFSQLFPLLGSGRLQALVKVDEISQTIDSENFAVQNCIKFSGPLASTSVSTNAKFEIRSPKRVQIKFEEGIIGTPQLTDSIVLPEKFEFFGQNIDLSPLXGIFTSIENAASSVAKTISGQXPPLKIPFRSESAGSWLLTTYLDAELRISRGDGSSIFVLFKEGSSLSI

SEQ ID NO: 133726 - protein, 222 aa, Triticum aestivum
  unsure (1)..(222): unsure at all Xaa locations
  Clone ID: PAT_TA_28144.pep
QIRHEDPPQSPSLSSSSSTLADRKMERLRTGFDKFKTEVYDKKPDLFEPLKDNQEPTYMLFACADSRVCPSVTLGLEPGEAFTVRNIXAMVPCYCKNKHXGVGSAIEYAVCALKVKVIVVIGHSRCGGIKALLSLKDGEDDSFHFVEDWVRIGFSAKKKVKDECCDLPFEDQCAXLEKEAVNVSLQNLSTYPFVKEGVANGTLKLIGGHYDFVSGKFDTWEL

SEQ ID NO: 133727 - protein, 237 aa, Triticum aestivum
  Clone ID: PAT_TA_28145.pep
MFLTRTEYDRGVNTFSPEGRLFQVEYAIEAIKLGSTAIGLMTKDGVVLAVEKRVTSPLLEPSSVEKIMEIDEHVGCAMSGLIADARTLVEHARVETQNHRFSYGEPMTVESTTQAICDLALRFGEGDEESMSRPFGVSLLIAGHDEHGPSLYYTDPSGTFWQCKAKAIGSGSEGADSSLQEQYNKELTIAEAETIALSILKQVMEEKVTPNNVDIAKVSPSYHLYTPSEVEAVISRL

SEQ ID NO: 133728 - protein, 302 aa, Triticum aestivum
  unsure (1)..(302): unsure at all Xaa locations
  Clone ID: PAT_TA_28146.pep
MSGGQELNLPPGFRFHPXTDEELVTHYLCRRCAXGAPIAVPIITEIDLYKFDPWQLPKMALYGEKEWYFFSPRDRKYPNGSKPNRADGSGYWKATGADKPVGTXKPXAIKKALVFYAGKAPKGEKTNWIMHEYRLADVDRSARKKNSLRLDDWVLCRIYNKKGGLEKPASVDRKPAAMGGYGGPPGAMVSSPQEQKPVMGMNANAAGGRAXFPDFAAYYDRPSDSMPRLHADSSCSEQVLSPDFPAGEVQSQPKISEWERSFASGGDPVNPGGRLHARAQRRVRAGDPLLQDILMYXWGKPF

SEQ ID NO: 133729 - protein, 175 aa, Triticum aestivum
  Clone ID: PAT_TA_28147.pep
MAPETPPKKKPPVNWDQPSAGLQLVGLLLAAGEREGGRRSYRKNTMATTTNQLKSSKEDSDTKQGQEFLYVKVSMDGAPYLRKVDLKTYKNYKDMVVALGKMFIGFRTGKDGASENRKDGEYVMTYEDKDGDWMLVGDVPWEMFTEACRRIRVMKSSDVVGLGVTRAGVKSKNKN

SEQ ID NO: 133730 - protein, 258 aa, Triticum aestivum
  unsure (1)..(258): unsure at all Xaa locations
  Clone ID: PAT_TA_28148.pep
PELMPLTHMLATKLGARLTEVRKNGTCAWLRPDGKTQVTIXYLNEGGAMVPVRVHTVLISTQHDETVTNDEIAADLKEHVIKPVIPGKYLDENTIFHLNPSGRFVIGGPHGDAGLTGRKIIIDTYGGWGAHGGGAFSGKDPTKVDRSGAYIARQAAKSIIASGLARRCIVQISYAIGVPEPLSVFVDSYGTGKIPDREILKLVKENFDFRPGMISINLDLKKGGNRFIKTAAYGHFGRDDADFTWEVVKPLKFDKASA

SEQ ID NO: 133731 - protein, 171 aa, Triticum aestivum
  Clone ID: PAT_TA_28149.pep
RPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILQAALKSAVKKQLCKAGDAVVVLHRIGMASVIKICTVK

SEQ ID NO: 133732 - protein, 209 aa, Triticum aestivum; identical to SEQ ID NO: 133692
  Clone ID: PAT_TA_28150.pep

SEQ ID NO: 133733 - protein, 314 aa, Triticum aestivum
  Clone ID: PAT_TA_28151.pep
MAGVAASLNAASLSAPSPQAPGATAARGRLLVPAAARRFPSLRAARRVVAARAAPVDADDEWGKEPAVGGTSVAEAPSEAAAAAVEVAALKQKLKAALYGTERGLRASSETRAEVVELITQLEARNPTPAPTEALTLLNGKWILAYTSFSQLFPLLGSGRLQALVKVDEISQTIDSENFAVQNCIKFSGPLASTSVSTNAKFEIRSPKRVQIKFEEGIIGTPQLTDSIVLPEKFEFFGQNIDLSPLSGIFTSIENAASSVAKTISGQPPLKIPFRSESAGSWLLTTYLDAELRISRGDGSSIFVLFKEGSSLSI

SEQ ID NO: 133734 - protein, 267 aa, Triticum aestivum
  Clone ID: PAT_TA_28152.pep
HEATSSTPPSSPPSSPSPSCYSPVHVLLLPMSPPLELDYIGLSAAAGGRPDDDLKGTELRLGLPGCESPDRRPVAATTTLDLLPAKGAKRGFSDEVVPPAPVSAAGKDKDASGDEKDKKVAAPPQPAAKAQVVGWPPVRSYRKSTMATTTNQLKSSKEDSDTKQGQEFLYVKVSMDGAPYLRKVDLKTYKNYKGMVVGLGKMFIGFRTGKDGEYVMTYEDKDGDWMLVGDVPWEMFTESCRRIRVMKSSDVIGLGVTRAGVKSKNKN

SEQ ID NO: 133735 - protein, 360 aa, Triticum aestivum
  Clone ID: PAT_TA_28153.pep
LLGNNFPVFFIRDGIKFPDVIHAFKPNPKSHVQEYWRVFDFLSHHPESLHTFFFLFDDVGIPTDYRHMDGFGVNTYTFVTRAGKSHYVKFHWRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRQAEPASFPVPTRPVVGRREKTRIKKENDFVQPGERYRSWAPDRQDRFVRRFADALAHPKVSHELRVIWIDFLSKCDKSCGMKVANRLNVKPSM

SEQ ID NO: 133736 - protein, 90 aa, Triticum aestivum
  Clone ID: PAT_TA_28154.pep
MAGAAKASWMVAMSVGAVEALKDQVGLCRWNYALKSIHRAAKARANVCGGVSQGAKQLPASAAAVAERRQGEKAEEGLRTVMYLSCWGPN

SEQ ID NO: 133737 - protein, 238 aa, Triticum aestivum
  unsure (1)..(238): unsure at all Xaa locations
  Clone ID: PAT_TA_28155.pep
MFLTRTEYDRGVNTFSPEGRLFQVEYAIEAIKLGSTAIGLMTKDGVVLAVEKRVTSPLLEPSSVEKIMEIDEHVGCAMSGLIADARTLVEHARVETQNHRFSYGEPMTVESTTQAICDLALRFGEGDEESMSRPFGVSLLIAGHDENGPSLYYTDPSGTFWXQCNAKAIGSGSEGADSSLQDQYNKELTIAEAETIALSILKQVMEEKVTPNNVDIAKVSPSYHLYTPAEVEAVIARL

SEQ ID NO: 133738 - protein, 232 aa, Triticum aestivum
  Clone ID: PAT_TA_28156.pep
FPHRRLGQTGSPRSEQMTAAAGAATRPALVVGALVAALMMLGSEAVWLDLPPSGTKCVSEEIQPNVVVVADYMLMYEAHATAHPTVAVKVTSPYGNTVHHKENATVGQFAFTTSEAGNYLACFWLDSAEKGSGVSLNLDWKIGIATKDWDSVAKKEKIEGVELELAKLEAAVESIHHNLLYLKAREAEMREVSEKTNSRVAWFSILSLGVCIVVSALQLWHLQGFFQKKKLI

SEQ ID NO: 133739 - protein, 257 aa, Triticum aestivum
  Clone ID: PAT_TA_28157.pep
MANIDMAAVLADMERDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLSVLSCDPAAGTVRCRCENTAMLGERKNCNLPGIVVDLPTLTEKDKEDILGWGVPNDIDMIALSFVRKGSDLVTVRQLLGQHAKRIKLMSKVCILLLSVIYLFS

SEQ ID NO: 133740 - protein, 216 aa, Triticum aestivum
  unsure (1)..(216): unsure at all Xaa locations
  Clone ID: PAT_TA_28158.pep
MAAAAGAATRPALVLGALVAALMMLGAEAVWLDLPPTGTKCVSEEIQPNVVVVADYMLMYEAHATXHPTVAVKVTSPYGNTVHHKENATVGQFAFTTSEAGNYLACFWARQRXKGSGVSLNLDWKIGIATKDWDSVAKKEKIEGVELELAKLEAAVESIHHNLLYLKAREAEMREVSEKTNSRVAWFSILSLGVCVVVSALQLWHLQGFFQKKKLI

SEQ ID NO: 133741 - protein, 70 aa, Triticum aestivum
  unsure (1)..(70): unsure at all Xaa locations
  Clone ID: PAT_TA_28159.pep
MANEEPVDPKKYLEERCKPQCVKPLYEYEKCIKRVEADDTGHKHCTXGQYFDYWSCIDKCVAPKLFEKLK

SEQ ID NO: 133742 - protein, 388 aa, Triticum aestivum
  Clone ID: PAT_TA_28160.pep
WDSRLFNYGSWEVLRFLLSNARWWLEKYKFDGFRFDGVTSMMYTHHGLQMTFTGNYGEYFGFATDVDAVVYLMLVNDLIHGLYPDAVSIGEDVSGMPTFCIPVPDGGVGFDYRLHMAVPDKWIELLKQSDESWKMGDIAHTLTNRRWLEKCVTYAESHDQALVGDKTIAFWLMDKDMYDFMALDRPSTPRIDRGIALHKMIRLVTMGLGGEGYLNFMGNEFGHPEWIDFPRGPQTLPTGKVLPGNNNSYDKCRRRFDLGDADFLRYHGMQEFDQAMQHLEEKYGFMTSEHQYVSRKHEEDKVIIFERGDLVFVFNFHWSNSFFDYRVGCSRPGKYKVALDSDDALFGGFSRLDHDVDYFTTEHPHDNRPRSFSVYTPSRTAVVYALTE

SEQ ID NO: 133743 - protein, 241 aa, Triticum aestivum
  Clone ID: PAT_TA_28161.pep
MGLGLRLPFCLLLLLLVSLGSAQGRSTVFLDIQEEARGPGQIINDQLTLSKIPVRVERGSPLCPACEKFTDEALSYLSQKQSQDKMMEVLHEACSQTFSLEKKCVEFVDSYATLLFAKIAEIKPEEFCKRNGLCRDNALLSGVRSESTCVFCHHLMDEVLSKLKDPDAEFEIIQILLKECKKIEGHEQQCKRLVLQYIPLILVNGEKFLEKNDICTIVQACDAGKKTMVGPFSEEGLLRDA

SEQ ID NO: 133744 - protein, 237 aa, Triticum aestivum
  Clone ID: PAT_TA_28162.pep
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQFNKELTLQEAETIALSILKQVMEEKVTPNNVDIAMVAPNYHLYTPAEVEAVIARL

SEQ ID NO: 133745 - protein, 240 aa, Triticum aestivum
  Clone ID: PAT_TA_28163.pep
MGLGLRLPFFLLLLLLVSLGAAQGRSTVFLDIKEARDPDQILMDQITSSKTPVRVERGSPLCPACEKFTDEALSYLSQKQSQDKMMEVLHEACSQTFSLEKKCVELVDSYATLLFAKIAEIKPEEFCKRNGLCRDNALLSGVRSESTCVFCHHLMDEVLSKLKDPDAEFEIIQILLKECKKIEGHEQQCKRLVLQYIPLILVNGEKFLEKNDICTIVQACDAGKKTVVGSFSEEGLLRDA

SEQ ID NO: 133746 - protein, 299 aa, Triticum aestivum
  Clone ID: PAT_TA_28164.pep
MSGGQELNLPPGFRFHPTDEELVTHYLCRRCAGAPIAVPIITEIDLYKFDPWQLPKMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGMEKPAAVDRKPAAMGGYGGGPGAMASSPPEQKPVMGMNANGGGGGAQPFRDFAAYYDRPSDSMPRLHADSSCSEQVLSPEFPAGEVQSQPKISEWERSFASGGDPVNPAAGSMLEPNGGFGGDPLLQDILMYWGKPF

SEQ ID NO: 133747 - protein, 293 aa, Triticum aestivum
  unsure (1)..(293): unsure at all Xaa locations
  Clone ID: PAT_TA_28165.pep
MSTAAANWCYATVAPRARSSTIVASLGTPAPSNSSSFRPKLIRNTPVQAGAPSHPHCNPSGERREKTKEXVANASAIVEDERLPVPPLLLXKPSAPGGENNPAAAAAAIDSSSSSLLQKPTYHPPPPPPSNKMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKEAVNVSLQNLLTYPFVKEGXVSNGTLKLVGGHYDFVSGKFETWEQ

SEQ ID NO: 133748 - protein, 279 aa, Triticum aestivum
  Clone ID: PAT_TA_28166.pep
MEFLQGQSTETTVAVAVAVVAVAAGAGFLLLRSKKPKGCLDAENFKEFKLVQKRQISHNVAKFKFALPTPTSVLGLPIGQHISCRGQDATGEEVIKPYTPTTLDSDIGYFELVIKMYPQGRMSHHFREMKVGDYMSVKGPKGRFKYQPGQVRAFGMIAGGSGITPMFQVTRAILENPNDNTKIHLIYANVTYDDILLLEELDNMAKNYPDRFKIYYVLNQPPEVWDGGVGFVSKEMIQAHCPAPAADIQVLRCGPPPMNKAMAANLDDLGYTKEMQFQF

SEQ ID NO: 133749 - protein, 339 aa, Triticum aestivum
  Clone ID: PAT_TA_28167.pep
MPNLECRMYEPRFPEVDAAVMIQVKHIADMGAYVSLLEYNNVEGMILFSELSRRRIRSISSLIKVGRQEPAIVLRVDRDKGYIDLSKRRVSEEEARSCEDKYNKSKLVHSIMRHVAETLEIDLEPIYQRIGWPLYRKYGHAFEAFKLIVADPDAILDVLTYEEKETGPDCQEVTKVVPAVTPEIKETLVQNIRRRMTPQPLKIRADVEMKCFQFDGVLHIKQAMRKAEAAGNTNCPVKIKLVAPPLYVLTTQTLDKDQGISVLTDAVKACTAEIEKHKGKLVVKEAPRAVSEREDKLLNAQLDTLVEQNAEVAGDDDSEDEEDKGMGDIDLTNSGVHAD

SEQ ID NO: 133750 - protein, 272 aa, Triticum aestivum
  unsure (1)..(272): unsure at all Xaa locations
  Clone ID: PAT_TA_28168.pep
YRRHVRLTHNTIDKFYVGDNQNMXSGQALEFKQLNVHAWEAFDKGQDFHMQAAPSQAELLYKSFKIKKEKLKSESKDKIMEKYGNAASDEPIPRELLLGQSEKEIEYDRTGRIIKGQDVALPKSKYEEDVLINNHTTVWGSWWKDHQWGYKCCKQTIKNSYCTGLAGIEAAEASADLMRENMARKEAAEEEPVRQEEKKLATWGTDIPQDLVLDQKLLEESLKKEAKRKKEEMDERKRKYNVKWNDEVTAEDMEAYRMTRVRHDDPMKDFLN

SEQ ID NO: 133751 - protein, 164 aa, Triticum aestivum
  unsure (1)..(164): unsure at all Xaa locations
  Clone ID: PAT_TA_28169.pep
MAFSKPLAALLLAVALAATAMSAAGQDPQNCKPSRKVTVQNLCGKDLYLGIEPLANSKLLYSPGFLLRHGTHVSYDVCXWTGRVKVQDAVVTEFHIGYDGGAWYQVSTAQSHMPIRVSITPHGHPLKDHCPTAGCNSGGHCFEHSVPGGKCHGVDEIKIVFYNP

SEQ ID NO: 133752 - protein, 218 aa, Triticum aestivum
  unsure (1)..(218): unsure at all Xaa locations
  Clone ID: PAT_TA_28170.pep
MATAYAPPMASQVMKSGLVCSKPRGMSGASLTRRXPRLVVKAVKSDKPTYQVXSKPINGDPFIGQAWETPVTSXSPLVAWXYLSNLPAXRTAVKPAPPRGSKVGLAHGXYLLVGALRASTGPLXRNTPNSRASKHLGAIGLVSILSVCLTMYGVASFNEGAPSTAPALTLTGRKKEADKLQTAEGWSQFTGGFFFGGVSGATWAYFLLYVLDLPYFFK

SEQ ID NO: 133753 - protein, 369 aa, Triticum aestivum
  Clone ID: PAT_TA_28171.pep
MEHRGLLLVLVAAACLSGGAHARHAKKSYGAVFSFGDSLSDAGNLIVDGIPKSLTTARSPYGMTFFGRPTGRCSNGRVVVDFLAEHFGLPLPPASQAHGKDFKKGANFAITGATALEYSFFKAHGIDQRIWNTGSINTQIGWLQKMKPSLCKSEKECRDYFSKSLFVVGEFGGNDYNAPLFSGVAFSEVKTYVPLVAKAIANGVEKLIELGATDLLVPGILPIGCFPLYLTLYNSSKKSDYNARTGCLRRYNRLAFHHNRELKQQLDALQKKYPKTKIMYGDYFKAAMQFVVSPGKFGFSTALQACCGAGGTGAYNFNLKKKCGEAGASVCSNPSAYVSWDGIHMTEAAYRMVANGWLNGPYASPPIMK

SEQ ID NO: 133754 - protein, 267 aa, Triticum aestivum
  Clone ID: PAT_TA_28172.pep
NQEGIVNFDDTLWETNYFMARGDFGMEISVEKIFLAQKMMIYKCNLAGEPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILQAALKSAVKKQLCKAGDAVVVLHRIGMASVIKICTVK

SEQ ID NO: 133755 - protein, 164 aa, Triticum aestivum
  unsure (1)..(164): unsure at all Xaa locations
  Clone ID: PAT_TA_28173.pep
MAFPKPLAALLLAVALAATAMSAAGQDPQNCKPSRKVTVQNLCGKDLYLXIEPLANSKLLYSPGYLLRHGTHVSYDVCSWTGRVKVQDAXVTEFHIGYDGGAWYQVSTDQSHMPIRVSITPHGHPLKDHCPTAGCNSGGHCFEHSVPGGKCHGVDEIKIVFYNP

SEQ ID NO: 133756 - protein, 209 aa, Triticum aestivum
  Clone ID: PAT_TA_28174.pep
MATAYAPPMASQVMKSGLVCSKPRGMSGASLTRRPRLVVKAVKSDKPTYQVVQPINGDPFIGSLETPVTSSPLVAWYLSNLPAYRTAVSPLLRGIEVGLAHGYLLVGPFALTGPLRNTPIHGQAGTPGAIGLVSILSVCLTMYGVASFNEGAPSTAPALTLTGRKKEADKLQTAEGWSQFTGGFFFGGVSGATWAYFLLYVLDLPYFFK

SEQ ID NO: 133757 - protein, 69 aa, Triticum aestivum
  Clone ID: PAT_TA_28175.pep
MADEEPVDPKKYLEERCKPQCVKPLYEYEKCIKRVEADDTGHKHCTGQYFDYWSCIDKCVAPKLFEKLK

SEQ ID NO: 133758 - protein, 339 aa, Triticum aestivum
  Clone ID: PAT_TA_28176.pep
MPPNLECRMYEPRFPEVDAAVMIQVKHIADMGAYVSLLEYNNIEGMILFSELSRRRIRSISSLIKVGRQEPSMVLRVDRDKGYIDLSKRRVSEEEAATCEDRYNKSKLVHSIMRHAADTLGVDLEPLYQRIGWPLYRRYGHAFEAFKLIVTDPDGVLDVLTYEETVVGPDGEEVTKVVPAVTPEVKDALVKNIRRRMTPQPLKIRADVEMKCFQFDGVLHIKEAMRKAEAAGNADCPVKIKLVAPPLYVLTTQTLDKDQGIAVLTNATKICAEAIEKHKGKLVVKEAARAVSERDDKLFADTIEKLKLAGEEVDGDDDSEEEDSGMGDVDFTKAGAGAD

SEQ ID NO: 133759 - protein, 406 aa, Triticum aestivum
  unsure (1)..(406): unsure at all Xaa locations
  Clone ID: PAT_TA_28177.pep
MATTARPLVSVKALDGDMATDAAGVPMPHVMKAPIRPDVITFVHRLVSCNSRQPYAVSRKAGHQTSAESWGTGRAVSRIPRVGGGGTHRAGQGAFGNMCRGGXRMFAPTRIWRKWHRRVNVRLRRVAVASALAATAVPAIVTARGHRIESVPEFPLVVSDSAEGIEKTAQAIKVLKQLGAYADAEKAKQSVGIRPGKGKMRNRRYINRKGPLIVYGTEGSKIVKAFRNLPGVDVANVERLNLLDLAPGGHLGRFVIWTESAFKKLDEVYGSFEASSSKKKGFVLPRPKMTNADLGRLINSDEVQSVVKPINKEVKRREARKNPLKNAAAVLKLNPYFGTARMMAVLAEAARVKARKEKINSKRTKLSAEEASKIKAAGKAWXYQTMISDSDYTEFDVFSKWLGVSQ

SEQ ID NO: 133760 - protein, 370 aa, Triticum aestivum
  Clone ID: PAT_TA_28178.pep
PTRPREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRQAEPASFPVPTRPVVGKREKTRIKKENDFVQPGERYRSWAPDRQDRFVRRFADALAHPKVSHELRVIWIDFLSKCDKSCGMKVANRLNVKPSM

SEQ ID NO: 133761 - protein, 237 aa, Triticum aestivum
  Clone ID: PAT_TA_28179.pep
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQFNKELTLQEAETIALSILKQVMEEKVTPNNVDIARVAPNYHLYTPAEVEAVIARL

SEQ ID NO: 133762 - protein, 194 aa, Triticum aestivum
  Clone ID: PAT_TA_28180.pep
MPWQQQEVEVYTLLRQQAASGGRQQEQRQRQLLLVFPFPSPLLFGGGGFRKRGDRERGSPPPPPPSPRMTSMLSAFSSWFVNPRRNPLARIHMLTISNRLKNYGLRYDDLYDPYFDLDIKEALCRLPREVVDARHQRLKRAMDLSMKHQYLPDDVRALQTPFKSYLSDMLALVKKEAAERKALGALPLYERTLP

SEQ ID NO: 133763 - protein, 237 aa, Triticum aestivum
  Clone ID: PAT_TA_28181.pep
MFLTRTEYDRGVNTFSPEGRLFQVEYAIEAIKLGSTAIGLMTKDGVVLAVEKRVTSPLLEPSSVEKIMEIDEHVGCAMSGLIADARTLVEHARVETQNHRFSYGEPMTVESTTQAICDLALRFGEGDEESMSRPFGVSLLIAGHDENGPSMYYTDPSGTFWQCNAKAIGSGSEGADSSLQEQYNKELTIAEAETIALSILKQVMEEKVTPNNVDIAKVSPSYHLYTPAEVEAVIARL

SEQ ID NO: 133764 - protein, 445 aa, Triticum aestivum
  Clone ID: PAT_TA_28182.pep
MGNKSWSSTRGGGRSRTSGSPGLQEFGTRPHPSPYPAAAAAMATTARPLVSVKALDGDMATDAAGVPMPHVMKAPIRPDVITFVHRLVSCNSRQPYAVSRKAGHQTSAESWGTGRAVSRIPRVGGGGTHRAGQGAFGNMCRGGRMFAPTRIWRKWHRRVNVRLRRVAVASALAATAVPAIVTARGHRIESVPEFPLVVSDSAEGIEKTSQAIKVLKQLGAYADAEKAKDSVGIRPGKGKMRNRRYINRKGPLIVYGTEGSKIVKAFRNLPGVDVANVERLNLLDLAPGGHLGRFVIWTESAFKKLDEVYGSFEASSSKKKGFVLPRPKMTNADLGRLINSDEVQSVVKPINKEVKRREARKNPLKNAAAVLKLNPYFGTARRMAVLAEAARVKARKEKINSKRTKLSAEEASKIKAAGKAWYQTMISDSDYTEFDVFSKWLGVSQ

SEQ ID NO: 133765 - protein, 251 aa, Triticum aestivum
  Clone ID: PAT_TA_28183.pep
MTAPADKGKKAKTDTDVGEENEQIDGALVLSIERLQEIQDELEKVNEEASDKVLEVEQKYSEIRRPVYLRRCDIIKTIPDFWLTAFLSHPLLSELLTEEDQKMFKYLESVDVDDSKDVKSGYSITLNFSENPYFEDRKLTKSYAFADDGTTTINATSIKWKEGMEINGNAIKKKGSKRPLVEESFFTWFTDTEHKSLADGVQDEVAEIIKEDLWPNPLKYFNNEVEEFEGDDEDEEGSDGEDAEEDDDEEN

SEQ ID NO: 133766 - protein, 133 aa, Triticum aestivum
  Clone ID: PAT_TA_28184.pep
NFWFSTSELLLDNDADLPLLEHVIEGSGLPLLVPVMHLPHTTSNQPKGESNEDLLHHARPLEGRMCNSAACHLLAVGLKMPKCLAAAGGEGEKRLRRRERETHSSICYGGRRFCGNAHLRAEIRGRARSTRVV

SEQ ID NO: 133767 - protein, 311 aa, Triticum aestivum
  unsure (1)..(311): unsure at all Xaa locations
  Clone ID: PAT_TA_28185.pep
MDNLWHLGDEFRGQSKVVEDRQWSLMTSKLAEITKSKAERMNDFEYARMNTVPDVKQWDKLSYHQEDNKMDHLNLGLMNLDLKMNDLKMNEAAMKYPFRNMAYNMNPMYPKGNNGNVNSFKMNVGVNKYPNNQNGKETNGKHNGGNNNNGGNSNNNSVDKRFKTLPTSEMLPRNEVLGGYIFVCNNDTMQEDLKRQLFGLPARYRDSVRAITPGLPLFLYNYTTHQLHGVFEAASFGGSNIDPTAWEDKKCKGESRFPAQXVRIRIRRLCKALEEDAFRPVLHHYDGPKFRLELSIAETLSLLDLCKTEDA

SEQ ID NO: 133768 - protein, 367 aa, Triticum aestivum
  Clone ID: PAT_TA_28186.pep
TREGNWDLLGNNFPVFFIRDGIKFPDVIHAFKPNPKSHVQEYWRVFDFLSHHPESLHTFFFLFDDVGIPTDYRHMDGFGVNTYTFVSRAGKAHYVKFHWRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRHAEPASFPVPTRPVVGKREKTRIKKENDFVQPGERYRSWAPDRQDRFVRRFADALARPKVSHELRVIWIDFLSKCDKSCGMKVANRLNVKPSM

SEQ ID NO: 133769 - protein, 126 aa, Triticum aestivum
  Clone ID: PAT_TA_28187.pep
MTSMLSAFSSWFVNPRRNPLARIHMLTISNRLKNFGLRYDDLYDPYFDLDIKEALGRLPREVVDARHQRLKRAMDLSMKHQYLPDDVRALQTPFKSYLSDMLALVKKEAAERKVLGALPLYERTLP

SEQ ID NO: 133770 - protein, 255 aa, Triticum aestivum
  Clone ID: PAT_TA_28188.pep
MALVSSSSATAVAALPSNGLAGARSSFLGAAGKAAGSRASFAVRAAAPERPIWFPGSTPPPWLDGSLPGDFGFDPWGLGSDPESLRWNVQAELVHCRWAMLGAAGIFIPELLTKIGILNTPSWYTAGEQEYFTDTTTLFIVELILIGWAEGRRWADIIKPGCVNTDPIFPNNKLTGTDVGYPGGLWFDPLGYGTGSPEKLKELRTKEIKNGRLAMLAVMGAWFQAEYTGTGPIDNLFAHLADPGHATIFRAFAPK

SEQ ID NO: 133771 - protein, 148 aa, Triticum aestivum
  Clone ID: PAT_TA_28189.pep
MASTNMASATSRFMLAAGIPSGTNGGVSSRVSFVPSNRLGLKLVARAEEEPTAAAPAEPAPAAEEKPEGAVATKEPAKAKPPPRGPKRGTKVKILRRESYWYNGTGSVVTVDQDPNTRYPVVVRFAKVNYAGVSTNNYALDEIKEVAA

SEQ ID NO: 133772 - protein, 223 aa, Triticum aestivum
  Clone ID: PAT_TA_28190.pep
RMVNNTRLNFDALNGDKDHGGVHDGTTVVLWEWCKGDNQCWKIWPWAEAHAAVESGATMGNNAHAMGGGPPVHAVRIFCKAGEDYSLTARNGTVCLAPTNPRDDYQHWIKDMRHSNKIRDEEGYPAFAIVNKVTGECIKHSTGQGHPVKLVPYNPAYQDESVLWTESRDVGKGFRCVRMVNNIYLNFDAFHGDKAHGGVHDGTEVVLWKWCEGDNQRWKILPW

SEQ ID NO: 133773 - protein, 126 aa, Triticum aestivum
  Clone ID: PAT_TA_28191.pep
MTSMLSAFSSWFVNPRRNPLARIHMLTISNRLKNYGLRYDDLYDPYFDLDIKEALGRLPREVVDARHQRLKRAMDLSMKHQYLPDDVRALQTPFKSYLSDMLALVKKEAAERKALGALPLYERTLP

SEQ ID NO: 133774 - protein, 148 aa, Triticum aestivum
  Clone ID: PAT_TA_28192.pep
MASTNMASATSRFMLAAGIPSGTNGGVSSRVSFVPSNRLGLKLVARAEEEPTAAAPAEPAPAAEEKPDAAVATKEPAKAKPPPRGPKRGTKVKILRRESYWYNGTGSVVTVDQDPNTRYPVVVRFAKVNYAGVSTNNYALDEIKEVAA

SEQ ID NO: 133775 - protein, 211 aa, Triticum aestivum
  Clone ID: PAT_TA_28193.pep
AMVPVRVHTVLISTQHDETVTNDEIAADLKEHVIKPVIPEKYLDEKTIFHLNPSGRFVIGGPHGDAGLTGRKIIIDTYGGWGAHGGGAFSGKDPTKVDRSGAYIARQAAKSIIASGLARRCIVQISYAIGVPEPLSVFVDSYGTGKIPDKEILKIVKENFDFRPGMISINLDLKKGGNRFIKTAAYGHFGREDADFTWEVVKPLKFDKASA

SEQ ID NO: 133776 - protein, 164 aa, Triticum aestivum
  Clone ID: PAT_TA_28194.pep
MAFSKPVAALLLAVALAATAMSAAGQDPQNCKPSRKVTVQNLCGKDLYLGIEPLANSKLLYSPGHLLRHGTHVSYDVCSWTGRVKVQDAVVTEFHIGYDGGAWYQVSTDQSHMPIRVSITPHGHPLKDHCPTAGCNSGGHCFEHSVPGGKCHGVDEIKIVYYNP

SEQ ID NO: 133777 - protein, 455 aa, Triticum aestivum
  Clone ID: PAT_TA_28195.pep
MPTANVRAAQPSADRRLSTLVRHLLPSSPRTSAATATSADSSLQPFPTMASPSVFAGIAQGPEDPILGVTVAYNKDPSPVKVNLGVGAYRTEEGKPLVLNVVKRAEQMLIHNESRVKEYLPITGLADFNKLSAKLIFGADSPAIQENRVATVQCLSGTGSLRVGGEFLARHYHERTIYIPQPTWGNHPKVFTLAGLTARSYRYYDPATRGLDFQGLLEDLSSAPSGAIVLLHACAHNPTGVDPTLEQWEQIRQLMRSKALLPFFDSAYQGFASGSLDKDAQSVRMFVADGGELLMAQSYAKNMGLYGERVGALSIVCGSADIAVKVESQLKLVIRPMYSNPPLHGASIVATILKDSAMFDEWTVELKAMADRIISMREQLFDALKIRETPGDWSHIIKQIGMFTFTGLNSEQVAFMRQEYHIYMTSDGRISMAGLSSRTVPHLADAIHAAVTKLK

SEQ ID NO: 133778 - protein, 241 aa, Triticum aestivum
  Clone ID: PAT_TA_28196.pep
MGLGLRLPFFLLLLLLVSLGAAQGRSTVFLDIQEEARGSGQIIKDQLTLSKIPVRVERGSPLCPACEKFTEEALSYLSQKQSQDKMMEVLHEACSQTFSLEKKCVEFVDSYATLLFAKIAEIKPEEFCKRNGLCRDNALLSGVRSESTCVFCHHLMDEVLSKLKDPDAEFEIIQILLKECKKIEGHEQQCKRLVLQYIPLILVNGEKFLEKNDICTIVQACDAGKKTMVGPFSEEGLLRDA

SEQ ID NO: 133779 - protein, 63 aa, Triticum aestivum
  Clone ID: PAT_TA_28197.pep
MAGGRVAHATLKGPSVVKEIFIGLTLGLVAGGMWKMHHWNEQRKTRSFYDMLEKGQISVVVEE

SEQ ID NO: 133780 - protein, 209 aa, Triticum aestivum
  Clone ID: PAT_TA_28198.pep
MATAYAPPMASQVMKSGLVCSKPRGLSGASLTRRPRFVVKAVKSDKGTYQVVQPINGDPFIGSLETPVTSSPLVAWYLSNLPAYRTAVSPLLRGIEVGLAHGYLLVGPFALTGPLRNTPIHGQAGTLGAIGLVSILSVCLTMYGVASFNEGAPSTAPALTLTGRKKEADKLQTAEGWSQFTGGFFFGGVSGAIWAYFLLYVLDLPYFFK

SEQ ID NO: 133781 - protein, 170 aa, Triticum aestivum
  Clone ID: PAT_TA_28199.pep
MTPQALLLLLLLLAAAVAVAAASAAPENGAANDLLPKYGLPKGLIPDSVSSYTFDEATGDFEIHLAGTCYVRFGDHLVYYEKTLRGCLSKGRITGLAGIQAKKLFLWVSVSGIVAHPAEGTLEFQVGFVSEELSASLFDRVPACGASAGAQLRGVAGVIQELGLLPVAEA

SEQ ID NO: 133782 - protein, 348 aa, Triticum aestivum
  unsure (1)..(348): unsure at all Xaa locations
  Clone ID: PAT_TA_28200.pep
MFGFGHHHKDQAPAASGPNQIFKIYCRASEDYCLAVRDGEVVLAPVNPKDETQHWLKDMRFSTTVKDEEGMPAFALVNKATGLAVKHSIGQSHPVKLVPFNPAYEDASVLWTESKDVGKGFRCIRMVNNTRLNFDALNGDKDHGXGVHDGTTVVLWEWCKGDNQCWKIWPWAEAHAAVESGATMGNNAHAMGGGPPVHAVRVFCKAGEDYSLTARNGTVCLAPTNPRDDYQHWIKDMRHSNKIRDEEGYPAFALVNMVTGECIKHSTGQGHPVKLVPYNPAYQDESVLWTESRDVGKGFRCVRMVNNIYLNFDAFHGDKAHGGVHDGTEIVLWKWCEGDNQRWKILPW

SEQ ID NO: 133783 - protein, 248 aa, Triticum aestivum
  unsure (1)..(248): unsure at all Xaa locations
  Clone ID: PAT_TA_28201.pep
IRHEGLTEVRKNGTCAWLRPDGKTQVTVEYLNEGGATGXPVRVHTVLISTQHDETVTNDEIAADLKEHVIKPVIPEKYLDEKTIFHLNPSGRFVIGGPHGDAGLTGRKIIIDTYGGWGAHGGGAFSGKDPTKXVDRSGAYIARQAAKSIIASGLARRCIVQISYAIGVPEPLSVFVDSYGTGKIPDKEILKIVKENFDFRPGMISINLDLKKGGNRFIKTAAYGHFGREDADFTWEVVKPLKFDKASA

SEQ ID NO: 133784 - protein, 209 aa, Triticum aestivum
  Clone ID: PAT_TA_28202.pep
MATAYAPPMASQVMKSGLVSSKPRGLSGASLTRRPRFVVKAVKSDKGTYQVVQPINGDPFIGSLETPVTSSPLVAWYLSNLPAYRTAVSPLLRGIEVGLAHGYLLVGPFALTGPLRNTPIHGQAGTLGAIGLVSILSVCLTMYGVASFNEGAPSTAPALTLTGRKKEADKLQTAEGWSQFTGGFFFGGVSGAIWAYFLLYVLDLPYFFK

SEQ ID NO: 133785 - protein, 360 aa, Triticum aestivum
  unsure (1)..(360): unsure at all Xaa locations
  Clone ID: PAT_TA_28203.pep
CIQRVYSLGRQARVILGNFIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRHAEPASFPVPTRPVVGKREKTRIKKENDFVQPGXERYRSWAPDRQDRFVRRFADALAHPKVSHELRVIWIDFLSKCDKSCGMKVANRLNVKPSM

SEQ ID NO: 133786 - protein, 394 aa, Triticum aestivum
  Clone ID: PAT_TA_28204.pep
MAAETFLFTSESVNEGHPDKLCDQVSDAVLDACLAQDADSKVACETVTKTNMVMVLGEITTKATVDYEKIVRDTCRNIGFISDDVGLDADRCKVLVNIEQQSPDIAQGVHGHFTKRPEEVGAGDQGIMFGYATDETPELMPLSHVLATKLGARLTEVRKNGTCAWVRPDGKTQVTVEYLNEDGAMVPVRVHTVLISTQHDETVTNDEIAADLKEHVIKPVIPAKYLDENTIFHLNPSGRFVIGGPHGDAGLTGRKIIIDTYGGWGAHGGGAFSGKDPTKVDRSGAYIARQAAKSIIASGLARRCIVQISYAIGVPEPLSVFVDSYGTGKIPDREILKLVKENFDFRPGMISINLDLKKGGNRFIKTAAYGHFGRDDADFTWEVVKPLKFDKASA

SEQ ID NO: 133787 - protein, 336 aa, Triticum aestivum
  unsure (1)..(336): unsure at all Xaa locations
  Clone ID: PAT_TA_28205.pep
MDNLWHLGDEFRGQSKVVEDRQWSLMTSKLAEITKSKAERMNDFEYARMNTVPDVKQWDKLSYHQEDNKMDHLNLGLMNLDLKMNDLKMNEAAMKYPFRNMAYNMNPMYPKGNNGNINSFKMNVGVNKYPNNQNGKETDGKHNGVNNNNGGNSNNNSVDKRFKTLPTSEMLPRNEVLGGYIFVCNNDTMQEDLKRQLFGLPARYRDSVRAITPGLPLFLYNYTTHQLHGVFEAASFGGSNIDPTAWEDKKCKGESRFPAQVINFQGXHMFIIRLVFHDLTYSSSYQVRIRIRRLCKALEEDAFRPVLHHYDGPKFRLELSIAETLSLLDLCKTEDA

SEQ ID NO: 133788 - protein, 455 aa, Triticum aestivum
  Clone ID: PAT_TA_28206.pep
MPTVNVRAAQPGADRRLSTLVRHLLPSSPRTSAATATSADSSLQPFPTMASPSVFAGIAQGPEDPILGVTVAYNKDPSPVKVNLGVGAYRTEEGKPLVLNVVRRAEQMLIQNESRVKEYLPITGLADFNKLSAKLIFGADSPAIQENRVATVQCLSGTGSLRVGGEFLARHYHERTIYIPQPTWGNHPKVFTLAGLTARSYRYYDPATRGLDFQGLLEDISSAPSGAIVLLHACAHNPTGVDPTLEQWEQIRQLMRSKALLPFFDSAYQGFASGSLDKDAQSVRMFVADGGELLMAQSYAKNMGLYGERVGALSIVCGSADIAVKVESQLKLVIRPMYSNPPLHGASIVATILKDSAMFDEWTLELKAMADRIISMREQLFNALKIRETPGDWSHIIKQIGMFTFTGLNSDQVAFMRQEYHIYMTSDGRISMAGLSSRTVPHLADAIHAAVTKLK

SEQ ID NO: 133789 - protein, 395 aa, Triticum aestivum
  unsure (1)..(395): unsure at all Xaa locations
  Clone ID: PAT_TA_28207.pep
MAAETFLFTSESVNEGHPDKLCDQVSDAVLDACLAQDPDSKVACETCTKTNMVMVFGEITTKATVDYEKIVRDTCRNIGFISDDVGLDADHCKVLVNIEQQSPDIAQGVHGHFTKRPEEIGAGDQGIMFGYATDETPELMPLTHMLATKLGARLTEVRKNGTCAWLRPDGKTQVTIEYLNEGGAMVPVRVHTVLISTQHDETVTNDEIAADLKEHVIKPVIPGKYLDENTIFHLNPSGRFVIGGPHGDAGLTGRKIIIDTYGGWGAHGGGAFSGKDPTKVDRSGAYIARQAAKSIIASGLARRXCIVQISYAIGVPEPLSVFVDSYGTGKIPDREILKLVKENFDFRPGMISINLDLKKGGNRFIKTAAYGHFGRDDADFTWEVVKPLKFDKASA

SEQ ID NO: 133790 - protein, 195 aa, Triticum aestivum
  Clone ID: PAT_TA_28208.pep
MDYYRETYGGYGMATPGYAAPVPYGMSQVNIDGNYGGRPMPPQPTVKIYCRANPNYAMSVRNGKVVLAPANPKDDYQHWIKDMRWSTSIKDEEGYPAFAMVNKATGQAIKHSLGQSHPVRLVPYNPDYLDESVLWTESRDVGNGFRCVRMVNNIYLNFDALNGDKYHGGVRDGTEVVLWKWCEGDNQRWKLQPYY

SEQ ID NO: 133791 - protein, 251 aa, Triticum aestivum
  Clone ID: PAT_TA_28209.pep
MTAPADKGKKAKTDTDVGEENEQIDGALVLSIERLQEIQDELEKVNEEASDKVLEVEQKYSEIRRPVYLRRCDIIKTIPDFWLTAFLSHPLLSELLTEEDQKMFKYLESVDVDDSKDVKSGYSITLNFSENPYFEDRKLTKSYAFADDGTTTINATSIKWKEGMEINGNAIKKKGSKRPLVEESFFTWFTDTEHKSLADGVQDEVAEIIKEDLWPNPLKYFNNEVEEFEGDDEDEEGSDGEDAEEDEDEEN

SEQ ID NO: 133792 - protein, 455 aa, Triticum aestivum
  Clone ID: PAT_TA_28210.pep
MPTANVRAAQPGADRRLSTLVRHLLPSSPRTSAATATSADSSLQPFPTMASPSVFAGIAQGPEDPILGVTVAYNKDPSPVKVNLGVGAYRTEEGKPMVLNVVRRAEQMLIQNESRVKEYLPITGLADFNKLSAKLIFGADSPAIQENRVATVQCLSGTGSLRVGGEFLARHYHERTIYIPQPTWGNHPKVFTLAGLTARSYRYYDPATCGLDFQGLLEDLSSAPSGAIVLLHACAHNPTGVDPTLEQWEQIRQLMRSKALLPFFDSAYQGFASGSLDKDAQSVRMFVADGGELLMAQSYAKNMGLYGERVGALSIVCGSADIAVKVESQLKLVIRPMYSNPPLHGASIVATILKDSAMFDEWTLELKAMADRIISMREQLFNALKIRETPGDWSHIIKQIGMFTFTGLNSDQVAFMRQEYHIYMTSDGRISMAGLSSRTVPHLADAIHAAVTKLK

SEQ ID NO: 133793 - protein, 394 aa, Triticum aestivum
  unsure (1)..(394): unsure at all Xaa locations
  Clone ID: PAT_TA_28211.pep
MAAETFLFTSESVNEGHPDKLCDQVSDAVLDACLAQDADSKVACETVTKTNMVMVLGEITTKATVDYEKIVRDTCRNIGFISDDVGLDADRCKVLVNIEQQSPDIAQGVHGHFTKRPEEVGAGDQGIMFGYATDETPELMPLSHVLATKLGARLTEVRKNXTCAWVRPDGKTQVTVEYLNEDGAMVPVRVHTVLISTQHDETVTNDEIAADLKEHVIKPVIPAKYLDENTIFHLNPSGRFVIGGPHGDAGLTGREIIIDTYGGWGAHGGGAFSGKDPTKVDRSGAYIARQAAKSIIASGLARRCIVQISYAIGVPEPLSVFVDSYGTGKIPDREILKLVKENFDFRPGMISINLDLKKGGNRFIKTAAYGHFGRDDADFTWEVVKPLKFDKASA

SEQ ID NO: 133794 - protein, 259 aa, Triticum aestivum
  unsure (1)..(259): unsure at all Xaa locations
  Clone ID: PAT_TA_28212.pep
MSTAAANWCYATVVAPRARSSTIVASLGTPAPSNSSSFRPKLIRNTPVQAAPVAPAXMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVSNGTLKLVGGHYDFVSGKFETWEQ

SEQ ID NO: 133795 - protein, 310 aa, Triticum aestivum
  Clone ID: PAT_TA_28213.pep
MDNLWHLGDEFRGQSKVVEDRQWSLMTSKLAEITKSKAERMNDFEYARMNTVPDVKQWDKQSYHQEDNKMDHLNLGLMNLDLKMNDLKMNEAAMKYPFRNMAYNMNPMYPKGNNGNVNSFKMNVGVNKYPNNQNGKEANGKHNGGNNNNGGNSNNNSVDKRFKTLPTSEMLPRNEVLGGYIFVCNNDTMQEDLKRQLFGLPARYRDSVRAITPGLPLFLYNYTTHQLHGVFEAASFGGSNIDPTAWEDKKCKGESRFPAQVRIRIRRLCKALEEDAFRPVLHHYDGPKFRLELSIAETLSLLDLCKTEDA

SEQ ID NO: 133796 - protein, 396 aa, Triticum aestivum
  unsure (1)..(396): unsure at all Xaa locations
  Clone ID: PAT_TA_28214.pep
MATETFLFTSESVNEGHPDKLCDQVSDAVLDACLAQDADSKVACETCTKTNMVMVFGEITTKATVDYEKIVRDTCRNIGFISDDVGLDADRCKVLVNIEQQSPDIAQGVHGHFTKRPEDIGAGDQGIMFGYATDETPELMPLSHVLATKLGARLTEVRKNGTCAWLRPDGKTQVTVEYLNEGGAMVPVRVHTVLISTQHDETVTNDEIAADLKEHVIKPVIPEKYLDEKTIFHLNPSGRFVIGGPHGDAGLTGRKIIIDTYGGWGAHGGGAFSGKDPTKXVDRSGAYIARQAAKSIIASGLARRCIVQISYAIGVPEPLSVFVDSYGTGKIPDKEILKIVKENFDFRPGMIGINLDLKKGGNRFIKTAAYGHFGREDADFXTWEVVKPLKFDKASA

SEQ ID NO: 133797 - protein, 257 aa, Triticum aestivum
  unsure (1)..(257): unsure at all Xaa locations
  Clone ID: PAT_TA_28215.pep
IRHEANWCYATVAPRARSSTIVASLGTPAPSNSSSFRPKLIRNTPVQAAPVAPAXMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVSNGTLKLVGGHYDFVSGKFETWEQ

SEQ ID NO: 133798 - protein, 255 aa, Triticum aestivum
  Clone ID: PAT_TA_28216.pep
MALVSSSSATAVAALPSNGLAGARSSFLGAAGKAAASRASFAVRAAAPERPIWFPGSTPPPWLDGSLPGDFGFDPWGLGSDPESLRWNVQAELVHCRWAMLGAAGIFIPELLTKIGILNTPSWYTAGEQEYFTDTTTLFIVELILIGWAEGRRWADIIKPGCVNTDPIFPNNKLTGTDVGYPGGLWFDPLGYGTGSPEKLKELRTKEIKNGRLAMLAVMGAWFQAEYTGTGPIDNLFAHLADPGHATIFRAFAPK

SEQ ID NO: 133799 - protein, 56 aa, Triticum aestivum
  Clone ID: PAT_TA_28217.pep
MKKRDMFVAFEGVLVSAREPRGFGFVQYFNPGDAADRIYYKDGQVIHGKQVAVLFA

SEQ ID NO: 133800 - protein, 195 aa, Triticum aestivum
  Clone ID: PAT_TA_28218.pep
SRTTVVQVSSSALKCSNPHINAYSITDCGSCSFLLYIPCLSGKVVVVHKGAILAGGPRAGFFSAVCANKSVICVHHITSRSSYYLPCTISPEQQHWTNPGPRGTLAAPRPPSEAPHMPHTCPTSTRAPASQTKHEHKQQCRDNARQIRQTFCCLKIASQESNRVDPILDTCSRLPRTQAAQQKQQAFLTLIPSKA

SEQ ID NO: 133801 - protein, 325 aa, Triticum aestivum
  Clone ID: PAT_TA_28219.pep
MTKSGMYNKVPKKSSVVPVESKPMKKATGISQSVGSGAVKSKVPQLGDSSKGSGIVTRAEDKEQSPVTTEPTTKVPEADLAQPAHDVDENLEISIDNDLHVEKTENPGSSLSAAEMGPSDQVEPSVVEVKPLDEDMDISSAAWVEVDHQEVTDVGESVTGEDVTSPAIEPLPSSSPRIRHSLSQMLQADSNEPEIIEWGNAENPPAIVFHKDSPKGFKRLLKFARKNKGDNNTNGLASPSVVSDGEDEQEESGAGDGVNSSRRTFDGSKTNSVLSAQSTASSFNATGSDRLRDRPGAAPSTKAASRSFFSLSNFRSSKTNESKLR

SEQ ID NO: 133802 - protein, 300 aa, Triticum aestivum
  unsure (1)..(300): unsure at all Xaa locations
  Clone ID: PAT_TA_28220.pep
MVSTQEPISAAGLTGSVNQTTININREFHTEESSTYWLPKDDDEQKRLVGQHFGLKELCEGNVRSNVTKALDFEKGISILDVGCGSGVWIMDMINDYPNCTYHGCDIVNATSKFLNANQFTFSYGNVVKGLPYADNTFDXVHMRLLILALRKEEWPIAIKEVIRVVKPGGMLQLTEAHLKLPDDTSCAYYKLVSAFKTVAHSKGQDMDIAKELEDMLSVNRNVSVLQSECRWCRSNSGTLAAKKLIWDGIEIAKSTMSSIKPLLGVDSEESALKFLDDLNYCLTHTECYFRARSVTAQKF

SEQ ID NO: 133803 - protein, 43 aa, Triticum aestivum
  Clone ID: PAT_TA_28221.pep
KKPICIILFYWSHFPLGGPFNQRSNTLLQSNCFFPSFSFTTLC

SEQ ID NO: 133804 - protein, 71 aa, Triticum aestivum
  Clone ID: PAT_TA_28222.pep
ASPLSFKPVLKNQMILTRYFACEVAVFQSQIKRGTTQSSISSCIISLQSIQLVLQPQVYIEQKESVIVAGI

SEQ ID NO: 133805 - protein, 476 aa, Triticum aestivum
  Clone ID: PAT_TA_28223.pep
VKDEAAAQELWWGKGSPNIEMDEHTFLTNRERAVDYLNSLDKVYVNDQFLNWDPENRIKVRIISARAYHSLFMHNMCIRPTEEELESFGTPDFTIYNAGKFPCNRYTHYMTSSTSVDINLGRREMVILGTQYAGEMKKGLFGVMHYLMPKRRILSLHSGCNMGRDGDVALFFGLSGTGKTTLSTDHNRLLIGDDEHCWSDNGVSNIEGGCYAKCIDLSREKEPDIWNAIKFGTVLENVVFDEHTREVDYTDKSVTENTRAAYPIEYIPNAKIPCVGPHPKNVILLACDAFGVLPPVSKLNLAQTMYHFISGYTALVAGTEDGIKEPQATFSACFGAAFIMLHPTKYAAMLAEKMQTYGATGWLVNTGWSGGRYGVGKRIKLPYTRKIIDAIHSGELLTANYQKTEVFGLEIPTAIEGVPSEILDPINTWTDKAAYKETLLKLAGLFGKNFEVFASYKIGEDSTLTEEILAAWTPRS

SEQ ID NO: 133806 - protein, 230 aa, Triticum aestivum
  Clone ID: PAT_TA_28224.pep
RITYYDLELEDLGKVYWSPNTCKTRFALNLKNIPYDTEWLTFNEVAKVIPSKTKTGARPTVPIIEDKETQKVIQDSWEIVNYLEEAFPDSPSAFHGNQGIHKFFQSQCEKNIVFPIFKMVVLTIGNACGPFKQSFRETREGYFNMSLEKLAGQPEDHAPDLKKGLEPIHEVLKSYPFVTGNQAGWADVVLAAHLNFLEKLKPESFQAYVLDVFDDDILLNWWKRVEYIRK

SEQ ID NO: 133807 - protein, 132 aa, Triticum aestivum
  unsure (1)..(132): unsure at all Xaa locations
  Clone ID: PAT_TA_28225.pep
GSIVSLASVASVMEGWPHAYTASKXAVVGLTKSVALELGRHGIRVNCVSPYAVPALSMPHLPQGEQKGDAVRDFLAFVGSEANLKGVDLLPKDVAEAVLYLASDEARYISALNLVVDGGFTSVNGNLKAFED

SEQ ID NO: 133808 - protein, 215 aa, Triticum aestivum
  Clone ID: PAT_TA_28226.pep
NKHALELEQMVARFVGKEDAMCVSMGFATNSTTIPALVGKGCLVISDELNHSSIVFGVRLSGASVRVFKHNNMDDLRELLREVISQGQPRTHRPWRKILVIVEGLYSMEGTIVNLPELVELKKEFKFYLYVDEAHSIGALGENGGGVCDFYGIDPAEVDILMGTFTKSFGAAGGYIAGDKTIIDHLRLRNHAYNYAEPVSVAVTQQVITSMKIIW

SEQ ID NO: 133809 - protein, 218 aa, Triticum aestivum
  Clone ID: PAT_TA_28227.pep
MAILMSCVTSKTLAPCTPEVSRQQRHTCISVSAHRRQIRIGLTMKSWGTSCTVPPMWIRGATRITAVGSGPGELPEEKSPIPNKEAAISSDPGELPGKSPLPNKSSLVTVVVGGVFGAVSFYGQMRAMEEKVEKTAEVAIETIEKAADVVDKLADEVIAFPGNENLKKAAFRIKAIAEEIEKDAEEAEALIHKVEEIEKEVDAAVDTFMGKGMKKGSR

SEQ ID NO: 133810 - protein, 100 aa, Triticum aestivum
  Clone ID: PAT_TA_28228.pep
NNPQARLYSESNKIIKKQTHAPALSLLKMSYRSASADNAITSWAVVVDACSQWRETPQRWDEEVPLPPTAVQASVCPTPSDLNAGGATMAVWRCGPLGPP

SEQ ID NO: 133811 - protein, 202 aa, Triticum aestivum
  Clone ID: PAT_TA_28229.pep
GQGLAFLHEADTPVIYRDFKASNILLDSDYAAKLSDFGLAMEGPKGDDTHVTTRVMGTHGYAAPEYILTGHLTAKSDVYSFGVVLLELLTGRRSVDKRRRGREQNLVDWARPYLRRADDRLHRVMDPGMESQYSTRAARGAAAVAHSCLQSVPKARPRMRDVVDALEPLLALDDDVPMGPFVFTVCEPEAAAGKGDGAGDDE

SEQ ID NO: 133812 - protein, 321 aa, Triticum aestivum
  Clone ID: PAT_TA_28230.pep
VCHFIGEGGFGPVYKGFLDDKVVPGMQPQHVAVKYLDAEGPQGHREWLAEVVYLGMQLSHPHLVKLVGYCYQEHHRMLVYEYMARGSLEHHLFKNLLASLPWATRLKIAVGAAKGLAFLHEAETPVIYRDFKASNILLESDYTAKLSDFGLAKEGPSGDDTHVSTRVMGTHGYAAPEYILTGHLTARSDVYSFGVVLLELLTGRRSVDKRRRGREQNLVDWARPYLRRPDRLHRVMDPSLEGSYSAEAAAKAATVAYNCLHSVPKNRPTMREVVDSLEPLMRMSRDVPAGLFVYTAPSEPSPVAKAVADKADVAAEAVEET

SEQ ID NO: 133813 - protein, 59 aa, Triticum aestivum
  Clone ID: PAT_TA_28231.pep
TENAVVSTDFVGEEHSSVFDAKAGIQLSPTFVKLVAWYDNEKGYSCRVVDLVEHVSKSL

SEQ ID NO: 133814 - protein, 163 aa, Triticum aestivum
  unsure (1)..(163): unsure at all Xaa locations
  Clone ID: PAT_TA_28232.pep
AQASSIDPKKKPLACTIKYQSKGKRNPSIAARAMSGSSILLAAAVAAALLVASASAQSGCTAVLVGLYPCMNYIGGNDMAPTKSCCSQLGSVVQSQPQCLCSALGGDSSSXAATPTTPEVQTPAGSGSKTTPSAYLQENGGSSLHGPAGLVLALAAAAVYAVW

SEQ ID NO: 133815 - protein, 191 aa, Triticum aestivum
  Clone ID: PAT_TA_28233.pep
GQEAASSPKATKTLFHSLSNNRIHRRTTRAKSTSKGVLRATGGAHLPVPWGPPGPGGGAGVVGLRGCVADRRRVAADRPKSCCAQPSAGVQSPPPCPCSALGGSSSSPGGMTLEQTRARELPIACNVHTQPATRSNGGDRPPGADPPPTPVEQTGAGAGSQATRPARLQARGGSSRQGPAGRRLRRAAAAV

SEQ ID NO: 133816 - protein, 191 aa, Triticum aestivum
  Clone ID: PAT_TA_28234.pep
SMGSWKRTITTPFRKACTILSPQHGSGRSDDQHGGSGHDGKKSAAHAAPSEAVRSGGGGGGGDGAGRGGGEPVDDSAALRRRDGVRLRGRAGHVVHAGQQSQGPRQRRLVTTRSVITTDRSMGRGVSSSIQYILLAHRPLHPDFRPFGAQSADRPRRVLKLFRVLLFVEPDESPRLAWYLNNYTKVLASLE

SEQ ID NO: 133817 - protein, 144 aa, Triticum aestivum
  Clone ID: PAT_TA_28235.pep
DRLAAFSKGLATWARWVDDNVDASLTRVIYQGVSPSHYTSKEQESDGAAPASGGCFQQTRPRQVATDGDERVSPEQVVVRGLIASMSTPVSLLDITSLSQLRIDAHPSVYGGPGRDGMDCTHWCIAGLPDAWNHILNAMLLQHA

SEQ ID NO: 133818 - protein, 157 aa, Triticum aestivum
  Clone ID: PAT_TA_28236.pep
PATQAECTFEQAMIETENRVIFASGTAFPAYTIPSTNQVKYPGQGNNMYIFPGLGLGAILSRPNHITDRMIYATAKALADSLTTEEINQGWLYPSLKRIREVSATIAVAVYKEAVDAHLASLPKVDNIQDYVISNMWSPIDDHYGSLDTKSNIHANL

SEQ ID NO: 133819 - protein, 86 aa, Triticum aestivum
  Clone ID: PAT_TA_28237.pep
DAWGTALTDLAAGARLVPVPTTSCSSIEGERRARGREETDEERRRGIRRVREEVAGGGGSGDWPTGLLGKAKEYASLRFDRGVFDF

SEQ ID NO: 133820 - protein, 62 aa, Triticum aestivum
  Clone ID: PAT_TA_28238.pep
MESLWKLSYLLEPASLALIVTAVSVAYASASRALDHGKEMERNLDFSEAFITLDRSQAFMIP

SEQ ID NO: 133821 - protein, 182 aa, Triticum aestivum
  Clone ID: PAT_TA_28239.pep
LGPTAAGGSYFLVSVGPPTASPPGPPGRKGVSLPVFPLLPKKLELPAELDFPRNLLGGIVPGSTPRDYMMLGLGDMAIPGMLLALVLSFDHRKSKDVAVPSDLSPSSKRRKYVWFALTGYGVGLVTALAAGILSQSPQPALLYLVPSTLGPIVYLSWLRNDLWELWEGSGTIVNEKAHLLEV

SEQ ID NO: 133822 - protein, 165 aa, Triticum aestivum
  Clone ID: PAT_TA_28240.pep
HASGKVDPDVWEFAHESFLRGQAKLLPLIVRKKKRAGAGAAGRELCEEEEEVRGTIQAVQRLRDERRGMEEELQAMDRRLRAAENRPGQMMAFLGKLADDPGVVLRAMVAKKEELAAAGAGGKYSSPDKRRRIGADAGRGADAADQAAQSRAVPFPLSNLGQVFY

SEQ ID NO: 133823 - protein, 236 aa, Triticum aestivum
  unsure (1)..(236): unsure at all Xaa locations
  Clone ID: PAT_TA_28241.pep
MGSECKGHQPQDDGGVAPFVAKTFHMVSDPATDAVVCWGGASNTFLVLDPAAFSDFLLPSYFHHRTFPSFVRQLNTYGFRKVVPDVREFARVSFQGGPGRLRPLLARKKTXPGAGPARTAPGVGAEEVRGTIQAVQRLRDERRGMEEELQAMDRRLCAAENRPGQMMAFLXAKLADDPGVVLPAMVAKKEELAXAAGAGGKDSSPDKRRRIGADAGSGGXSRAVPFPFCNLGQVFY

SEQ ID NO: 133824 - protein, 328 aa, Triticum aestivum
  unsure (1)..(328): unsure at all Xaa locations
  Clone ID: PAT_TA_28242.pep
MAQVEPETKGSSINGPEGTAEALVATLPTREGWSTPLTLYPFGPLWAHMLRKFMVVLANPQPRRDDIILATHPKSGTTWLKALAFTISTRSRCDFTDSPLLTINPQRVVPFIXEPWAETFDILETLPCAEGDSLLHLPPSLLPADRXTVGCRVVXKWEDPKIAFVSRWYFRNKMGKGGTPITLDDAFSMFCEXVSPFGPFWDHYLQYWKESLARPHEVMFLKYEEIVSDPLTVVRKLASFLDVPFTEEEEKSGIVDQVVSFCSFESLRNLDVNKTGGAERAGGKIFIQHSSLFRKGKVGDWVNHMSKEMGEKMDRLVEEKFRGSGLEF

SEQ ID NO: 133825 - protein, 137 aa, Triticum aestivum
  Clone ID: PAT_TA_28243.pep
KPRTTISIEVNDNGLDHHRRLPPRTLLRVREHEQHDEKARGGDGYVQGGRAPAPDADPAQGPAVPIPARSTCPLAAQRPKAEVCRTFPAGRTCHPKPRSSQRSRQAHVPRQGPTASPRWTYHQRPRRCLPSPSSTSL

SEQ ID NO: 133826 - protein, 277 aa, Triticum aestivum
  unsure (1)..(277): unsure at all Xaa locations
  Clone ID: PAT_TA_28244.pep
CVARPRLPSPALGAAVCAAAVPAVRRCPPASARPCPPAPAPVSVSIPPSLAPAPAPAPRYVDLAALLDVAGPFHTFLAYLQKTNVIQTFQAQANKTDEGXITIFVPKDSAFAALKXPPSPTLTSPTSSTTLAPLPTPFPKYYPLAQVQESQARSIPVNXFAGSPYTLNLTDDMGSISVESMWSKPKISSSVYATKPIAVYSINKVLLPMQLFSKDPPLAPAPAPAPESGASDIAPSPDGGKVGARNGKADSTSAGHVGAANCFGLLAAAAGGLMLLW

SEQ ID NO: 133827 - protein, 211 aa, Triticum aestivum
  Clone ID: PAT_TA_28245.pep
RNSARGYSLAGLVCLLQSSRPTISRVEAMWCLLANDLRLEQAINMGASFTDKSPHSGFSTAESDAPSPAAPAPGQRGYCHFHATTATENHMFDPETFMRLAMRAHTDSTRPHTESTAGVVSCVKNTWSRSGGSAAPAPAAPDGQGQPKQSFAMKVSTDDLIESVVMELESLDIDKKDPPAEKPDPKNEMVRDLIKQTREMEEQLKERKEWA

SEQ ID NO: 133828 - protein, 305 aa, Triticum aestivum
  Clone ID: PAT_TA_28246.pep
IREPFLLVLTCKDIKNVTIIGAGLMGSGIVQVAAQGKYNVTMVDTSDAALENGKKIISSSLKRVARKKFADDETKQKDFINQTLGYIKTSKDANEASASSDLIVEAIVENIDIKQKLFKGLDQAAPADAIFCSNTSSLPVTLIAKATSEERQKRFAGLHFFNPVPAMKLVEIVRTENVTDEVINSLNQFSKNVGKVPVSCKDTPGFIVNRLLVPYLMESYRILDREEASIEDVDAAMKLGAGMPMGPFELSDFIGLDTMKFIVDGWHKEGKIDPAFTQPSKTLDKLISEGSLGRKTGKGFYDYSK

SEQ ID NO: 133829 - protein, 201 aa, Triticum aestivum
  Clone ID: PAT_TA_28247.pep
KVRQNLYFSSGLKGAVIGLGLGVAATAFTLRRSPEFRALSRPIQSIMAASTTTAGFLFASDSAVTEYENREMGYTDEDMIHSLLNSKHTDDTNLSTVDRSLQYLNKNRWSFIGLSWAASMAGALGYSFSNRYLTTQQKIVQARMYAQAVTIAVLMASAGISIYVGDDEKTRKELPDPQLRAVLELPHSNSPKPDLMKSTSA

SEQ ID NO: 133830 - protein, 262 aa, Triticum aestivum
  Clone ID: PAT_TA_28248.pep
EFGTRLQLPTACGAAAASSAPGPFSLSRPPPSRLRASHVLFAFPRLRKYGRRNREPVPTTLDDDEDEADEDDDDDVEEAVDEDIFLKNRPKPAGFGVGKTYTTDVEEQLLRGVGIGGAGRKSKSAAPKNLKANGSDTETGADRSNDGVHVRIWNLPKKKNIHKDLNLAFKGFPGLVTINPANSGTKKTRDPICKGFAFVKLESVDAATRFVELYSRKAVSFGKVEKPIKCCIVEGHVSTDPSGPASSSQPPGSNPQRLVAVR

SEQ ID NO: 133831 - protein, 189 aa, Triticum aestivum
  Clone ID: PAT_TA_28249.pep
MAGEGDLKLLGLLVSPFVTRVRLALHIKGLSYEYIETDVLDKGELLLRYNPVHKKVPVLIHNGVPLCESQIIVQYVDEVWAAAGAPILPADAYQRATARFWAAYVDDKLFPAWLGILLAPTEAARAEKVGETLAALAQLEVAAAECLDGGKRPFFAGDSIGFLDLAVGCNMFWMEALRRMFGVTFLDAG

SEQ ID NO: 133832 - protein, 195 aa, Triticum aestivum
  unsure (1)..(195): unsure at all Xaa locations
  Clone ID: PAT_TA_28250.pep
KGEAVVVVAARCPRKGAEIMRNGVRLCESQIMGQYVDEVGGGXGXTILPXDAYQRATARFWAAYVDDKLFPAWLGILLAPTEAARAEKVGETLAALAQLEVAAAECLDGGKRPFFAGDSIGFLDLAVGCNMFWMEALRRMFGVTFLDAGKTPLLVAWAERFAGTEAATAVVPDPDAAVAFARKLQAKYGSAPPAN

SEQ ID NO: 133833 - protein, 240 aa, Triticum aestivum
  unsure (1)..(240): unsure at all Xaa locations
  Clone ID: PAT_TA_28251.pep
MAGEGDLKLLGLLVSPFVTRVRLALHIKGLSYEYIETDVLDKGELLLRYNPVHKKVPVLIHNGLPLCXSHIIVQYVDDVWAPARTPILPADPXARATGRFWASLRRPPRLFPAMVWGLLLDGTEGAEDGRRSATPALAPLRSWRWPRPSAWTAGNNPFFAGDSIGFLGPRRSGSNMLRMEFRVRFFDRGYLDAGSSVGRAAWAGRFPGTGAATAVVPDPDDAVAFARKLQAKYGSAPPAN

SEQ ID NO: 133834 - protein, 242 aa, Triticum aestivum
  Clone ID: PAT_TA_28252.pep
KNIDSLHAKFEALEKKVEEGLPKKQLRMIIMGPPGAGKGTQAPAIKDKFCACHLATGDMLRAAVNAKTPLGLAAKKIMDEGGLVSDEIVVGMIEENLDKNPECKNGFILDGFPRTVVQAEKLDEMLDARKKPLNSVVELVIDDNLLVSRITGRLIHPSSGRTYHREFNPPKVPMKDDVTGEPLIQRSDDNVESLKKRLDAFHKQTVPVVEYYKKKGIWYGVDASQSPKSVWASLGAIFDKTL

SEQ ID NO: 133835 - protein, 184 aa, Triticum aestivum
  Clone ID: PAT_TA_28253.pep
HVVVIDRFDSGKSTTTDWLIYKCGGIDKRTIEKFEKEAAELGKGSFKYAWVLDKLKAERERGITIDIALWKFETPKYQITVIDAPGHRDFIKNMITGTSQADCAILIIAGGTGEFEAGISKDGQTREHALLAFTLGVRQLIVAVNKMDTTKWSEARFNEIVKEVSSFIKKIGYNPKSVPFVPIS

SEQ ID NO: 133836 - protein, 252 aa, Triticum aestivum
  Clone ID: PAT_TA_28254.pep
RHVGAVDAARLYCRSDGAYLCAGCDARAHGAGSRHARVWLCEVCEHAPAAVTCRADAAALCATCDADIHSANPLASRHERLPVTPFFGALADPPQPNPSPSSAAAMQEDADDDGSNEAEAASWLLPEPGDSPEDSAATFFADSDAYLDLDFVRSMDGIKAIGVPVAPSELDLAGGALFYPEHSMNQSMSMSEVAVVPDALSVGGALAPAPSVAVVASKGKERQARLMRYREKRKNRRFQKTIRYASRKAYAE

SEQ ID NO: 133837 - protein, 250 aa, Triticum aestivum
  Clone ID: PAT_TA_28255.pep
PHASADAWSLMATAGLDKKIKIWDLRKYEVVHTHAARAESLDFSQKGLLAASDGSLVEIYRDAGGHDYKVYLKHRMVKGYQVGKVLFRPYEDICSIGHSTGFSSILVPGSGEANFDTFVENPVETAKQRREREVHALLNKLQPETVMLNPNMIGNVRQPKKKEKKTKKEVEEEIEDAVEAAKSTKVKNKTKGRSKPSKRAKKKEEEVLRAKRPLLDQYKEIGGHPDKKQRVGDKAELPKALQRFAKNKQS

SEQ ID NO: 133838 - protein, 220 aa, Triticum aestivum
  unsure (1)..(220): unsure at all Xaa locations
  Clone ID: PAT_TA_28256.pep
MAVAAQPLLASALLALLLAAVSAADTKNNPADELVSLINSNRTASKASNLADNQGXLGCIALQYIKAYKGQCDQVGGNKKPVDSSFIDTFAPNCGVQAASLAKITGRLLACQPSYPPPAQAFDMLIADERSLQVLHSKNHTEVGAAVTGTSGGGPYFWCVLFSNGKANSSFTVEGGVPKTAHPGCFSGNNDECSGAISTGVGAWTLVSATLFALAGAFTL

SEQ ID NO: 133839 - protein, 242 aa, Triticum aestivum
  Clone ID: PAT_TA_28257.pep
MFLTRSEYDRGVNTFSPEGRLFQVEYAIEAIKLGTTAIGVQTSEGVVLAVEKRVSSTLLEPSSIEKIMEIDEHLGCAVSGMTADARTMIEHARVAAQNHRFTYEEKLKVESVTQSVCDLALRFGEGAEGEESIMSRPFGVALLIAGVDENGPQLFHADPSGTFMKYQAKAIGSGSEGAQTELQKEYHKSMTLKEAETLALSVLKSVMEEKLNKTNVQIAAITPESNFKIYSEEELQTVIERL

SEQ ID NO: 133840 - protein, 172 aa, Triticum aestivum
  Clone ID: PAT_TA_28258.pep
IIINIIETNINLRAAALHVIGDLLASIGVLISSIILIFRPDLTIVDPLCTFFFSILVLYTTYHLVKDSLAVLMEGVPGNIHPDLIEKSLMAVPGVIAVHDLHVWTLSPGKYSLTAHIKIDHAAEISYDEVLSKGQHIVCDVYGVHHSTLQIESDKTAFTSHCNPELCAPRNQ

SEQ ID NO: 133841 - protein, 111 aa, Triticum aestivum
  Clone ID: PAT_TA_28259.pep
GRVGGAGYAPVLDCHTAHIACKFAELIEKIDRRSGKSLEATPKFVKSGDSAIVKMIPSKPMCVEAYTDYPPLGRFAVRDMRQTVAVGVIKSVEKVDKAGKVTKAAAKAGKK

SEQ ID NO: 133842 - protein, 235 aa, Triticum aestivum
  Clone ID: PAT_TA_28260.pep
EEAVARVIKNSINGHLSNGASALMRHGMSDELCWACQTDDEFTLTHSILVWHVATGYCEIETIAGPNENDMHPNRGVATSLSKYVAYLVACAPTLLPGRLIVSECTLDELEAQAKKTLQGLVSPRERYEKLRELYNVVDEVPSSVADATAATEATSAHLLSKGVRLGKLLESMENHMIRWELLADFWAEMLVYIAPSDNVAGHIELLAEGGEFVTHIWVLLMHAGILERPATAIP

SEQ ID NO: 133843 - protein, 437 aa, Triticum aestivum
  unsure (1)..(437): unsure at all Xaa locations
  Clone ID: PAT_TA_28261.pep
MATMSRALGSAFVGFTRTPAVPATTPLPLPSSRASSALLLRWQRSRGVVGGGGGARRYSSGRNAKISMSLRAGIXGLPNVGKSTLFNAIVENGKAQAANFPFCTINPNTGVVAIPDPRLDVLSKLSQSKQTVPTSIHLVNITGLVKGASKGERLGNQFLSNIREVDSILQVVRCCEDDDIVHVNGKVDPKSDIDVINLELIFCDLEQIEKRLDXLKKSKTKDPQVKVKEGAERSGLEKILDALMDGKPARSVDLPDHEKEAIQHLYLLTMKPVIYVANVTESDLADPDKNPHVQEVAKLASELKSGMVTISAQVEAELSELPLEERVEYLNSLDVAESGLGNLVKATYNLLGLRTYFTTGEQETKAWTIIAGMTAPQAAGVIHSDFQKGFIRAETVSYDDFVAAGTLGAAREKGVMRLEGKEYIVQEGDVMLFRFNV

SEQ ID NO: 133844 - protein, 171 aa, Triticum aestivum
  Clone ID: PAT_TA_28262.pep
MGKSGSPSLVLLLVAAMAGATVFVASSPVAGLPEAEPPFPNPWLSLQNLSGCHMGDERDGLARLKDDLSHFGYLPGGPSSSPFSDAFSTNSPAATATYQRKRGSQGSRSILEPLVVPSLGPRPGLADVVHGTPTLGRPNPWTKHNFGLNASGFLDPSTVSQMVAPRCGVAD

SEQ ID NO: 133845 - protein, 350 aa, Triticum aestivum
  Clone ID: PAT_TA_28263.pep
MARVAEQKLQPSCLGDALTARNDADNLTELIPSLPVEKRLVPPPADMQRRQYRGYWFPEWHLSALAAVRDHFEPKPTDIFLVSCPKSGTTWLKSLAFATVHRHVHPPSSQEHPLLHQNPHGCVKFIHAIYRQPVDVVQGIIEAYPSPRIFGSHFPLSLLPERINDDDCGCRIVYICRDPKDVVVSWWWFMRTYLPNPEQVQFEEVFDLFCEGRTGAGPYWRHALEHWEESRRRPHKVLFLRYEEMLRDPQCNLRRLAEFLGCAFSEAEEKAGVLEAILELCSLGKLKKLEVNQSGNRINDEPMMNDSFFRKGVAGDWINHMTPEMAARLDAIVEQALQGTGFDFGISMPQ

SEQ ID NO: 133846 - protein, 156 aa, Triticum aestivum
  Clone ID: PAT_TA_28264.pep
PRVRLIKMGLNWSQINDNTYETEFPNEYQERQKLFNFWKNNKQELKNDGFLIKKDDEDKWKIIYNNNNDLNIEDICSKWKESFDGFNEDNIEIKTRYFQNQENQEKLEIMIKKIIQDEISDLKSSILNELNEIKELLKQKKEKTIVFILILILIVM

SEQ ID NO: 133847 - protein, 318 aa, Triticum aestivum
  Clone ID: PAT_TA_28265.pep
MGAFFSAQVNRRKLVTTQKLAMSERCTSCGDEFPGCAHRPADRQPWMAELGPDRLRVHQVVWPGTHDSATNKIGIPFITRPFAQCQSLSVYHQLALGCRLLDVRVQEERRVCHGVLATYSVDVVLDDVLRFLAETESEVLVLEIRTEFGREDPPDFAKYLVERLGEHLIPQDEAVFHKTVAELLPRRVICVWKPRKSPAPGRGEPLWSSGYLRDNWIDTDLPETKYESNLKFLGQQPPARDRRYLYRVENTVTPQADNPVVCVRPVTNRIRGYARSFIAEAFAKGLGDRLQVFSTDFIDGDFVDACAGVTKARVDGTA

SEQ ID NO: 133848 - protein, 149 aa, Triticum aestivum
  Clone ID: PAT_TA_28266.pep
RTRGRTRGRTRGRTRGIAGGRRRWALRWMHWSPRCTAVEQRRPGVLPNSCSRVAGLGEPGLRPGMREGQRVEPTVSRGIAACRGVAAEEQLGGGEARLRSAAKQGRRKMAAAGQVGGGASGTSSWLILRRLGHAVPVGNKGRRRLGRTD

SEQ ID NO: 133849 - protein, 119 aa, Triticum aestivum
  unsure (1)..(119): unsure at all Xaa locations
  Clone ID: PAT_TA_28267.pep
MAMVARAALLLAMVVVASATYCPPPPAPXPPRYGSCPQNALKLHVCANVLNLVKAKIGVPPTEPCCSLLDGLVNLDAAVCLCTAIKANVLGIHLNVPIDLSLILNNCGKICPADFQCIH

SEQ ID NO: 133850 - protein, 157 aa, Triticum aestivum
  unsure (1)..(157): unsure at all Xaa locations
  Clone ID: PAT_TA_28268.pep
VAQLLGSTAACFLLRFSTGGLPTGTFGLTGIGAWEAVVLEIVMTFGLVYTVYATAVDPKKGSLGTIAPIAIGFIXVGANILGPAAPSPGASMNPAVSFGPALXVSWEXWGYKWVYWVRPLIGRRLAGVIYECLHLPHQRQSPHRLLTTTCMRLASTV

SEQ ID NO: 133851 - protein, 96 aa, Triticum aestivum
  Clone ID: PAT_TA_28269.pep
VSKNRASLLQERIRAFIEDTTDKDVLVLNVQDPFQRLLLHGVCEFYNVTSTTTGTVQDGKPWKTTTIKKRSGTGVAPMITLVSFLRTKKNGSHVVS

SEQ ID NO: 133852 - protein, 101 aa, Triticum aestivum
  Clone ID: PAT_TA_28270.pep
AKPKETTLASPRSMTMGSWPHSIASAKEYGASGPHETTCDPFFFVLRKLTNVIMGATPVPERFLIVVVFHGFPSCTVPRKHHVIATSEMGPGHSTQAHLYQ

SEQ ID NO: 133853 - protein, 123 aa, Triticum aestivum
  Clone ID: PAT_TA_28271.pep
MARMALLAVFAVLAALAVAEMASGAVTCGDVTSAIAPCMSYATGQASSPSVGCCSGVRTLNGKASTSADRQAACRCLKNLAGSFKGISMGNAANIPGECGVSVSFPINNNVNCDTYVHPPLLT

SEQ ID NO: 133854 - protein, 117 aa, Triticum aestivum
  Clone ID: PAT_TA_28272.pep
MARMALLAVFAVLAALAVAEMASGAVTCGDVTSAIAPCMSYATGQASSPSVGCCSGVRTLNGKASTSADRQAACRCLKNLAGSFKGISMGNAANIPGECGVSVSFPINNNVNCDTLH

SEQ ID NO: 133855 - protein, 145 aa, Triticum aestivum
  unsure (1)..(145): unsure at all Xaa locations
  Clone ID: PAT_TA_28273.pep
DGAATPAGLISAAIAHAFALFVAVSVGANISGGHVNPAVTFGAFVGGNITLFRGLLYWIAQLLGSTAACFLLRFSTGGLPTGTFGLSGIGAWEAVVLEIVMTFGLVYTVYATAVDPKKGSLGTIAPIXIGFIVGANILVGAPLAS

SEQ ID NO: 133856 - protein, 88 aa, Triticum aestivum
  Clone ID: PAT_TA_28274.pep
WPPAVATSLTALDRIEPPLCDCPMESTARLRRGRRNWVWEKCCCRCRIWGRRRKGSVKQHLLWELLFDAFYVKFWICCLTMRAANQST

SEQ ID NO: 133857 - protein, 54 aa, Triticum aestivum
  Clone ID: PAT_TA_28275.pep
MPVNKIAVGSHREVYEVGALKAALAEFISTLIFVFAGQGSGMAFSDFFLFLLSD

SEQ ID NO: 133858 - protein, 230 aa, Triticum aestivum
  Clone ID: PAT_TA_28276.pep
SNFNNKYCMHKLPYMILVHIHSTYKEAEISSHGPWKPQRNSHRQRTRKRIQRTHTSNNPSTLGIDRRDHHGNILLFRRNTRGGCLDLLGDGVDGVDDPRDVPEEGEQEADPELVLQERNQETIISNQNSIHICHYLSIYLRIYQPVERARKGKTKEERKRKESGADAYPAAELEEDAEGREDDGEDDVDAVGRARHGRRCSGGRRAFHSIGGWRGSSRAEQSRGDLVRIP

SEQ ID NO: 133859 - protein, 263 aa, Triticum aestivum
  Clone ID: PAT_TA_28277.pep
AAARAGTHAGANAIHDECRKRKLKVSVVAVPKTIDNDIPLMDKTFGFDTAVEEAQRAINSAYIEARSAYHGIGLVKLMGRSSGFIAMHASLSSGQVDVCLIPEVSFALDGEYGVLQHLEQLIKNKGFCVVCVAEAAGQELLQNSGATDASGNTILSDIGVHMQQKIKTHFKGIGVHADIKYIDPTYMVRACRANASDAILCTVLGQNAVHGAFAGFSGITSCICNTHYVYLPVTQVITAPKRVNHKGRMWHRCLTSTGQPDFR

SEQ ID NO: 133860 - protein, 118 aa, Triticum aestivum
  unsure (1)..(118): unsure at all Xaa locations
  Clone ID: PAT_TA_28278.pep
MARVALLAVFAVLAALAVAEMASGAVTCGDVTSAVAPCMSYATGQASAPSAGCCSGVRTLRRXASTSADRQAACRCLKKLAGSGISMGNAANIPGKCGVSVSFPINTKVDCNTYILHP

SEQ ID NO: 133861 - protein, 117 aa, Triticum aestivum
  Clone ID: PAT_TA_28279.pep
MARVALLAVFTVLAALAVAEMASGAVTCSDVTSAIAPCMSYATGQASSPSAGCCSGVRTLNGKASTSADRQAACRCLKNLAGSFSGISMGNAANIPGKCGVSVSFPINNNVNCNNLH

SEQ ID NO: 133862 - protein, 120 aa, Triticum aestivum
  unsure (1)..(120): unsure at all Xaa locations
  Clone ID: PAT_TA_28280.pep
MARVALVAVFAVLAALAVAEMASGAVTCGDVTSAVAPCMSYATGKASGTXPGACCSGVRTLERXRRPPPADRKAACNCLKEPGXSGINMGNAANIPGKCXVSVSFPISTKTNCNKYILKS

SEQ ID NO: 133863 - protein, 117 aa, Triticum aestivum
  Clone ID: PAT_TA_28281.pep
MARVALLAVFTVLAALAVAEMASGAVTCSDVTSAIAPCMSYATGQASSPSAGCCSGVRTLNGKASTSADRQAACRCLKNLAGSFNGISMGNAANIPGKCGVSVSFPINNNVNCDNLH

SEQ ID NO: 133864 - protein, 129 aa, Triticum aestivum
  Clone ID: PAT_TA_28282.pep
MASSRILLLAAILLALASVQAHGQSMPPSPAMAPAPSAGGGKCNLNGAVSLGVCLNLQPGRTSPSDKNRCCHRIQGMGMQRAADCLCMTFMLAGGLLGADVANGVNSVLGVCGMARIRNLVCQMASVTV

SEQ ID NO: 133865 - protein, 268 aa, Triticum aestivum
  Clone ID: PAT_TA_28283.pep
IDMLFVLGGNGTHAGANAIHDECRKRKLKVSVVAVPKTIDNDIPLMDKTFGFDTAVEEAQRAINSAYIEARSAYHGIGLVKLMGRSSGFIAMHASLSSGQVDVCLIPEVSFALDGEYGVLQHLEQLIKNKGFCVVCVAEAAGQELLQNSGATDASGNAILSDIGVHMQQKIKTHFKGIGVHADIKYIDPTYMVRACRANASDAILCTVLGQNAVHGAFAGFSGITSCICNTHYVYLPVTQVITAPKRVNHKGRMWHRCLTSTGQPDFR

SEQ ID NO: 133866 - protein, 80 aa, Triticum aestivum
  Clone ID: PAT_TA_28284.pep
MGRKAGLYINSKKFGGVVKPCMLEMTAFLNCLALNKQIDEKCTRQKELLITCTQAQKGRPKNAAKTINYHLQRLGRDKFH

SEQ ID NO: 133867 - protein, 115 aa, Triticum aestivum
  Clone ID: PAT_TA_28285.pep
MARVALLAVFAVLAALAVAEMASGAVTCGDVTSAVAPCMSYATGQTSAPSAGCCSGVRTLNAKASTSADRQAACRCLKKLAGSGISMGNAANIPGKCGVSVSFPINTKVDCNTLH

SEQ ID NO: 133868 - protein, 55 aa, Triticum aestivum
  Clone ID: PAT_TA_28286.pep
MAGTANCIDIILAIILPPLGVFLKFGCGHEFWICLLLTFLGYIPGIIYAIYAITK

SEQ ID NO: 133869 - protein, 371 aa, Triticum aestivum
  Clone ID: PAT_TA_28287.pep
DAWGKDIYYEPNEVKAAIVTCGGLCPGLNDVIRQVVFTLETYGVKNIVGIPFGFRGFFEKGLKEMPLSRNLVENINLAGGSFLGVSRGGPKTSEIVDSIQARRIDMLFVLGGNGTHAGANAIHDECRKRKLKVSVVAVPKTIDNDIPLMDKTFGFDTAVEEAQRAINSAYIEARSAYHGIGLVKLMGRSSGFIAMHASLSSGQVDVCLIPEVSFALDGEYGVLQHLEQLIKNKGFCVVCVAEAAGQELLQNSGATDASGNAILSDIGVHMQQKIKTHFKGIGVHADIKYIDPTYMVRACRANASDAILCTVLGQNAVHGAFAGFSGITSCICNTHYVYLPVTQVITAPKRVNNKGRMWHRCLTSTGQPDFR

SEQ ID NO: 133870 - protein, 115 aa, Triticum aestivum
  Clone ID: PAT_TA_28288.pep
MVRVALVAVFAVLAALAVAEMASGAVTCGDVTSAVAPCMSYARGQASAPSGACCSGVRTLNAKASTPADRKAACNCLKNLAGSGISMGNAANIPGKCGVSVSFPINTKTNCNNLH

SEQ ID NO: 133871 - protein, 161 aa, Triticum aestivum
  unsure (1)..(161): unsure at all Xaa locations
  Clone ID: PAT_TA_28289.pep
SSSTPSLLTTPSNHPLIRPTDRWGRTGISISASGLPTGTFGLTGVSVWEALVLEIVMTFGLVYTVYATAVDPKKGSLGTIAPIAIGFIVGANILVGRAPSDGASMNPAVSFGPALVSWEWGYQWVYWVGPLIXGGGLAXGVIYELLFISHTHEXQLPSTDY

SEQ ID NO: 133872 - protein, 55 aa, Triticum aestivum; identical to SEQ ID NO: 133868
  Clone ID: PAT_TA_28290.pep

SEQ ID NO: 133873 - protein, 164 aa, Triticum aestivum
  Clone ID: PAT_TA_28291.pep
AQLWAHRRTTYWAWLSYRRERVQAALLSKSCLLNHLILNHKFLLWRSLTVMLLGLGSDHLFTTFPSSDDDAFAMDGPLFDVVDAPVSSEVDACASNKPLLDVVDLTNPSETYTPSVNEPFADVVDLPEPSSLYASAADELFASVDNLPKTSETFVGGSSGEHPG

SEQ ID NO: 133874 - protein, 119 aa, Triticum aestivum
  unsure (1)..(119): unsure at all Xaa locations
  Clone ID: PAT_TA_28292.pep
MARMALLAVFAVLAALAVAEMASGAVTCGDVTSAIAPCMSYATGKASAPFGGVAAAGLRTLNGKASNSGDRASXRCRCLKNLAGPFKXINMGNAANIPGKCGVSVXFPXNNNVNXNNNH

SEQ ID NO: 133875 - protein, 175 aa, Triticum aestivum
  Clone ID: PAT_TA_28293.pep
SNFNNKYCMHKLPYMILVHIHSTYKEAEISSHGPWKPQRNSHRQRTRKRIQRTHTSNNPSTLGIDRRDHHGNILLFRRNTRGGCLDLLGDGVDGVDDPRDVPEEGEQEADPELVPSNGSSLRDLDCTHSNYQTLMRPVLLFIVTTSPCQDWVICAPAAFLGCGSRFSGSLSGIEP

SEQ ID NO: 133876 - protein, 253 aa, Triticum aestivum
  Clone ID: PAT_TA_28294.pep
AQHIILLMIRSVICSICNKGKRWRSNTCGKQQRTYAEVATVDTPRRLAIHVEPGVMMLTDNLVNVVAVDVGVDRERNGDPALAGDGGGVAHADAPRAEFGTRCMFAQPQQPNISNDSQLATTNTKSMASSRILLLAAILLALASVQAHGQSMPPSPAMASATAARSGNCTLNGAVTLGVCLKLQPGRTSPSDKNRCCPRIQGMQSAADCLCFAFMLAGGLVASNAADGVNSVFGVCGMARIPNLVCLVASGTV

SEQ ID NO: 133877 - protein, 80 aa, Triticum aestivum; identical to SEQ ID NO: 133866
  Clone ID: PAT_TA_28295.pep

SEQ ID NO: 133878 - protein, 80 aa, Triticum aestivum
  Clone ID: PAT_TA_28296.pep
MGRKAGLYINPKKFGGIVKPCMMEMTAFLNCLALNKQIDEKCTRQKELLITCTQAQKGRPKNAAKTINYHLQRLGRDKFH

SEQ ID NO: 133879 - protein, 123 aa, Triticum aestivum
  unsure (1)..(123): unsure at all Xaa locations
  Clone ID: PAT_TA_28297.pep
MQIFVKTLTGKTITLEVESSDTIDNVKAKIQDKEGIPPDQQRLIFAGKQLEDGRTLADYNIQKESTLHLVLRLRGGQXFLWKIVSRVLVVVSCKQLEDGRTLAVYNIQKESTLHLVLRLRGGQ

SEQ ID NO: 133880 - protein, 117 aa, Triticum aestivum
  unsure (1)..(117): unsure at all Xaa locations
  Clone ID: PAT_TA_28298.pep
MARVALLAVFSVLAALAVAEMASGAVTCSDVTSAIAPCMSYATGQASSPSAGCCSGVRTLNGKASTSADRQAACRCLKNLAGSFNXISMGNAANIPGKCGVSVSFPINNNVNCNNLH

SEQ ID NO: 133881 - protein, 117 aa, Triticum aestivum
  Clone ID: PAT_TA_28299.pep
MARVALLAVFTVLAALAVAEMASGAVTCSDVTSAIAPCMSYATGQASSPSAGCCSGVRTLNGKASTSADRQAACRCLKNLAGSFNGISMGNAANIPGKCGVSVSFPINNSVNCNNLH

SEQ ID NO: 133882 - protein, 166 aa, Triticum aestivum
  unsure (1)..(166): unsure at all Xaa locations
  Clone ID: PAT_TA_28300.pep
VPTIVHRDLKSPNLLVDDNWTVKVCDFGLSRLKHSTFLSSKSTAGTPEWMAPEVLRNEQSNEKCDIYSFGVILWELATLRKPWHGMNQXMQVVGAVGFQDRRLDIPKEVDPIVASIIRDCWXQKDPNLRPSFIQLTSYLKTLQRLVIPSHQETASNHVPYEISLYR

SEQ ID NO: 133883 - protein, 216 aa, Triticum aestivum
  unsure (1)..(216): unsure at all Xaa locations
  Clone ID: PAT_TA_28301.pep
HASADAWAAGKLSPDGAATPAGLISAAIAHAFALFVAVSVGANISGGHVNPAVTFGAFVGGNITLFRGLLYWIAQLLGSTAACFLLRFSTGGLPTGTFGLSGIGAWEAVVLEIVMTFGLVYTVYATAVDPKKGSLGTIAPIAIGFIVGANILVGGAFSGASMNPAVSFGPALVSWEWGYXWVYWVGPLIGGGLAXGVIYELLFISRTHEQLPTTDY

SEQ ID NO: 133884 - protein, 251 aa, Triticum aestivum
  Clone ID: PAT_TA_28302.pep
MASADLLRREEEFYESLFDSAKGDAAAAKTRGQMIERKIEALEDMATKVSNRRSRRWLNDRLLIELVPRLHVEEIKGLFAPPPFGEEAPLSAFCRTSVGEWDAFRSIDMDVEERFMQRMKQSSTKQKNLVNEDESIVLNAWRRIDCQTREAMKRNFLPELLEIYEERIRAFIEDTTDKDVLVLNVQDPFQRLLLHGVCEFYNVTSTTTGTLQDGKPWKTTTIKKRSGTGVAPMITLVSFLRTKKNGPHVAS

SEQ ID NO: 133885 - protein, 66 aa, Triticum aestivum
  Clone ID: PAT_TA_28303.pep
SGACCSGVRTLNAKASTPADRKAACNCLKNLAGSGISMGNAANIPGKCGVSVSFPINTKTNCNNLH

SEQ ID NO: 133886 - protein, 84 aa, Triticum aestivum
  unsure (1)..(84): unsure at all Xaa locations
  Clone ID: PAT_TA_28304.pep
MGRKAGLYINPKKFGXASVKPCMLEMTAFLNCLAXLNKQIDEKCTRQKELLITCTQAQEGAGPKNAAKTINYHLQRLGRRQVST

SEQ ID NO: 133887 - protein, 115 aa, Triticum aestivum
  Clone ID: PAT_TA_28305.pep
MARVALVAVFAVLAALAVADMASGAVTCGDVTSAVAPCMSYASGKASAPSGACCSGVRTLNAKASTPADRKAACNCLKNLAGSGISMGNAASIPGKCGVSVSIPISTKTNCNNLH

SEQ ID NO: 133888 - protein, 251 aa, Triticum aestivum
  Clone ID: PAT_TA_28306.pep
MASADLLRREEEFYESLFDSAKGDAAAAKTRGQMIERKIEALEDMATKVSNRRSRRWLNDRLLIELVPRLHVEEIKGLFAPPPFGEEAPLSAFCRTSVGEWDAFRSIDMDVEARFMQRMKQSSAKQKNLVNEDESIVLNAWRRIDCQTREAMKRNFLPELLEIYEERIRAFIEDTTDKDVLVLNVQDPFQRLLLHGVCEFYNVTSTTTGTVQDGKPWKTTTIKKRSGTGVAPMITLVSFLRTKKNGSHVAS

SEQ ID NO: 133889 - protein, 117 aa, Triticum aestivum
  Clone ID: PAT_TA_28307.pep
MARVALLAVFAVLAALAVAEMASGAVTCGDVTSAIAPCMSYATGKASAPSAGCCSGVRTLNGKASTSADRQAACRCLKNLAGSFKGISMGNAATIPGKCGVSVSFPINTNVNCNNIH

SEQ ID NO: 133890 - protein, 163 aa, Triticum aestivum
  Clone ID: PAT_TA_28308.pep
DCEPVGLGALAMVVHGRGHLLLELLPEEVGRRRSRGTDGGGEGSSHLGAAWSTLLATVDARLCWCPLSSSVFSPSTDRVKLSVRRTKDRRPWRARPTASTSSSPSSSRPSASSSSSAAGTSSGSASCSPSSGTSRGSSTPSTPSPSKLASKPSQVFGDTIFSG

SEQ ID NO: 133891 - protein, 139 aa, Triticum aestivum
  Clone ID: PAT_TA_28309.pep
MLIKLSAPSQLHGFQQASRSTRSSMARVALVAVFAVLAALAVAEMASGAVTCGDVTSAVAPCMSYATGKASAPSGACCSGVRTLNAKASTPADRKAACNCLKNLAGSGISMGNAANIPGKCGVSVSFPISTKTNCNNLH

SEQ ID NO: 133892 - protein, 249 aa, Triticum aestivum
  unsure (1)..(249): unsure at all Xaa locations
  Clone ID: PAT_TA_28310.pep
MPVSRIAVGSHREVYEVGALKAALAEFISTLIFVFAGQGSGMAFSKLSPDGAATPAGLISAAIAHAFALFVAVSVGANISGGHVNPAVTFGAFVGGNITLFRGLLYWIAQLLGSTAACFLLRFSTGGLPTGTFGLTGIGAWEAVVLEIVMTFGLVYTVYATAVDPKKGSLGTIAPIAIGFIVGANILVGGAFFRRVHEPPAVSFGPALVSXWEWGYPRGXWGGPLIGGGLXAGVIYKLVFISRHPRTSS

SEQ ID NO: 133893 - protein, 55 aa, Triticum aestivum; identical to SEQ ID NO: 133868
  Clone ID: PAT_TA_28311.pep

SEQ ID NO: 133894 - protein, 117 aa, Triticum aestivum; identical to SEQ ID NO: 133889
  Clone ID: PAT_TA_28312.pep

SEQ ID NO: 133895 - protein, 187 aa, Triticum aestivum
  Clone ID: PAT_TA_28313.pep
SNFNNKYCMHKLPYMILVHIHSTYKEAEISSHGPWKPQRNSHRQRTRKRIQRTHTSNNPSTLGIDRRDHHGNILLFRRNTRGGCLDLLGDGVDGVDDPRDVPEEGEQEADPELVPAAELEEDAEGREDDGEDDVDAVGRARHGRRCSGGRRAFHSIGGWRGSSRAEQSRGGWEGRGGETRIRRALVI

SEQ ID NO: 133896 - protein, 115 aa, Triticum aestivum
  Clone ID: PAT_TA_28314.pep
MARVALVAVFAVLAALAVAEMASGAVTCGDVTSAVAPCMSYARGQASAPSGACCSGVRTLNAKASTPADRKAACNCLKNLAGSGISMGNAANIPGKCGVSVSFPINTKTNCNNLH

SEQ ID NO: 133897 - protein, 211 aa, Triticum aestivum
  Clone ID: PAT_TA_28315.pep
ARGAFSKLSPDGAATPAGLISAAIAHAFALFVAVSVGANISGGHVNPAVTFGAFVGGNITLFRGLLYWIAQLLGSTAACFLLRFSTGGLPTGTFGLTGIGAWEAVVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPTTDY

SEQ ID NO: 133898 - protein, 252 aa, Triticum aestivum
  unsure (1)..(252): unsure at all Xaa locations
  Clone ID: PAT_TA_28316.pep
MPVSRIAVGSHREVYEVGALKAALAEFISTLIFVFAGQGSGMAFSKLSPDGAATPAGLISAAIAHAFALFVAVSVGANISGGHVNPAVTFGAFVGGNITLFRGLLYWVAQLLGSTAACFLLRFSTGGLPTGTFGLTGIGAWEAVVLEIVMTFGLVYTVYATAXVDPKKGSLGTIAPIAIGFIVGANILVGGAFSGASMNPAVSFGPALVSWEWGYXQWVYWVGPLIGGGLAGVIYELLFISRTHEQLPTTDY

SEQ ID NO: 133899 - protein, 514 aa, Triticum aestivum
  Clone ID: PAT_TA_28317.pep
ISKDLNHVDVFTKSCSLSLTKSFERAAANKAKSIIILPSKNERYEVDTDAFLSLLALQSLPRIALVPTIVEASNSTTIELLKSITGLNVQPVEMVASKLFVQCSRQKGLLKIYRHLLNSRKNVFNIFSIPEVGGMKFKDVRRKVQDAVVCGIFRSGGIHFHPGDDEVLKETDKLLLISPVCGKRKSQYSVLNISERTDNSVNYSEPKEGQRSSSVVTELKETRLKNIVERPSKSLSKSSECTLGPRECILIVGWRPKITDMIREYDNYLGPGSVLEILSETPITERTSVVNPLMQSQLKNIKVTHKVGCPMNYDTLKEAIINIRKSAKCDKNVPLSVVVISDRDWLIGDTVQADKQLAYTLLLAENICQKNDIKVQHLVSEIVDTGLGKQITRIRPSLSFIGAEDVMSLVTAQVAECSELNEVWKDILDAEGDEIYIKEVGLYMKEGEKISFTELSERAVLRREVAIGYVKDQKQHINLTNKLQPLSLEMTDSLIVISEFEGEQPIVRGSKTSA

SEQ ID NO: 133900 - protein, 137 aa, Triticum aestivum
  Clone ID: PAT_TA_28318.pep
DAWGLSDSQKIGVGLTAFGVFFMMMGVLLLFDAGLMAIGNVLFLGGITAIIGPRSTFTFFSRKEKIKGTICFLGGIFLVLSKYPFIGFAVEIFGFLNLFGDFFPVVFGFLKRLPIIGPILSHPALSRVVPRESRTRV

SEQ ID NO: 133901 - protein, 221 aa, Triticum aestivum
  Clone ID: PAT_TA_28319.pep
GDRSINNSVLELINRRLPRPPSYRQARGPTEGMAGTVEDSGKTAPSSPAGLRGADLGLRVLLFAVSLSGLVVLVTAKQTEMVPLVLTPPFRFGPVPAQFKDSPALIYLLVALCMTSLYSLVTAASSVKSMSSSASCAKGIFVLILLDVVYAGIMASATGTAGAVAWVGLKGNSHTRWNKICNIYDKFCRHIGSATCLGLIASILLVLLVVLNAYSLYRRSR

SEQ ID NO: 133902 - protein, 237 aa, Triticum aestivum
  Clone ID: PAT_TA_28320.pep
MEQPIAEPDRTNRIQNIFRLCGNYRELVKKQNADESPAKQQVFGDENKQPGQQHLLGDENNQQGKQVFGDENQDPSAAWAAIENPMCDVKVADSPVSSQLSPIVCHVVDDTELTMPEELKSCTTDGEANEQSKKEREGLLDVYIKWESGSLIKGLKLLPTACLSDLRKLIEAHFEEAGSKQPQHQFTFLLLGDPSGAPVSREKEPTVQISRLPNWNNQTNSYLACLRVAKKPATTEQ

SEQ ID NO: 133903 - protein, 221 aa, Triticum aestivum
  unsure (1)..(221): unsure at all Xaa locations
  Clone ID: PAT_TA_28321.pep
FGTRQRPGPLHSLAPPLIHKGFKTSNVLVDENFIAKVSDAGVDRLLRGLEDPGSPLNGFRSGIYQDPEAHSLAQLSASSDVYSFGVFLLELITGREAATLVSPESTEXLAHWLETSXDEVADPXRLGGSFTSEGMKELVGLTMQCLSPSAVRRRPKMRLVAAELDRILEKEMTLTTVMGDGTAIITLGSQLFTSMIIQYLLPQNGYFCVSRLLNFSCLKIN

SEQ ID NO: 133904 - protein, 199 aa, Triticum aestivum
  Clone ID: PAT_TA_28322.pep
MDHSMGHSMDHSNNSMDHSGHNMSNMTTGNSGSHMHHMMMGAMGTFHWSTTGDGIWINTWVPSSKGAYAGACFGMLFMTILYKGIPTLDAYLVAWRKTRESNICTIQSNIEQQTVNHGIEKTPGSLTYSPPISPMPSWTCHTIRSFLAAFSSFISYLLMMVVMTGNAGFFFVIIGGVFIGEMIFGRHRAPGGLANDHEH

SEQ ID NO: 133905 - protein, 215 aa, Triticum aestivum
  Clone ID: PAT_TA_28323.pep
PTRPMRSMGSSQEMPVVKAPKTDPKSFVLRFNSSDLNSNQKRLKKSTKRVMEEMMEPETIKKRKSVDVQEEDFYDKKDVIQNEILQDFWMHEPDQSQELLLTTEYNPFCFDPEAQNILEGLQAPAPHVISSHPDMKTIDLQLDSFEKSIHYPQSFSLDQINNPSFMDDLNNYSIDQYIDFDILDDKLPSDLLKDTNESFTTIMNSYWPDQTNPLF

SEQ ID NO: 133906 - protein, 204 aa, Triticum aestivum
  Clone ID: PAT_TA_28324.pep
MKTMKRCIIPSILLMLSLEAVLLVAAGRPSTATGADDVGTILLPSQGKGEAGVVAAAKKKGEEEERPWKCCDFALCTRSFPPLCRCMDKVEQCAATCEKCEPATSDSSRRVCNDWYHGFPGPMCTEAVATAKKEKAEEEERPWKCCDLALCTRSFPPMCRCLDKVEQCAANCKSCDPAASDSSRRVCNDWYHGFPGAKCTADGN

SEQ ID NO: 133907 - protein, 192 aa, Triticum aestivum
  unsure (1)..(192): unsure at all Xaa locations
  Clone ID: PAT_TA_28325.pep
MAAMAGPAERKMKVWELVLRCLVGGFGAVAAALVVTDSQTRTFFSLERRAKYTDMKALVLLVAANGAAVGYSLLQAARCAVAMARGGGALVMSSRALAWSVFSGDQLLAYAMLAATAAALQSSLLGKLGQPELQWMGICGLYGAFCRQVGAGIACAVVAGLAAVLLASFXAFNLFRLYGGNKGSXXTRNGST

SEQ ID NO: 133908 - protein, 220 aa, Triticum aestivum
  Clone ID: PAT_TA_28326.pep
MNNNINVPLENVAVKLNTDKTRRKRLKVISACCECRRKKTKCNGEKPCIGCIKTNVECKYANSNHTQQQQHQHQHQHQQQQQQHQQQQHIIKTTTSQTSTKNVDISKLTLQSIEQRLGAIEDILQLLLQQQSESRNSGYLYHSGIYDGGKRKHEEMDDYYVRLPPPLNYPESSSSSSVSSSPKLNTIQNLLNEEKRPPSAFYRLTAGSDLRSSNNSSFYY

SEQ ID NO: 133909 - protein, 250 aa, Triticum aestivum
  Clone ID: PAT_TA_28327.pep
PRVRTHWYPSSILSKKIGNKFCLIILNQPITRMDIFHKLWDNACIKLVADGGSNRLYDAFKHDKALLEKFIPDEIRGDLDSIRPDVWEYYESKNVKITKVDEQDSNDFMKCVYLLNEKEKENNETYDIVATPALGGRFDQTMSSIHVLYTLKDQVQKKVILVSSENLTMLLDKGKHHIHCQLDLEGPTCGVIPVSAPAVISSHGLKWDMDNLQCQFGGRISTCNVLNNELIEITTDSPVVWTVEIKLSVQ

SEQ ID NO: 133910 - protein, 185 aa, Triticum aestivum
  unsure (1)..(185): unsure at all Xaa locations
  Clone ID: PAT_TA_28328.pep
MQKTRRGHVVAATSARRRPGDKFARGVREHVTLGPKLYETVRGKLSLGARILQAGGXWQKVFRRWFGRWSKGDEASSNASQCYLSTTAGPIAGMLFVSSETVAFRSDRSLALTSPKGDTVQGCXYKVAVPLRRVKAATPSENQHRPEQKYVQLVTDDGFEFWFMGFVSYQASLQHLEQAIAESHL

SEQ ID NO: 133911 - protein, 192 aa, Triticum aestivum
  unsure (1)..(192): unsure at all Xaa locations
  Clone ID: PAT_TA_28329.pep
MAGNQQPASVVLDYAAVLDAKPLRTLTPMFPAPLGMHTFTPKSSSSVVCVTPFGPYAGGTELGMPGGVPPMLTSLSAPADPNQVQPYTAHMNGTSNANGTTNNTMVTPVLQTPPAVTTQESGFKMWGRPWRVQDTTTVPSVPPVQPVPTVPTXHLVPSAXPEVNNIGXQTPXSAVTQESGKRKRGRPKRVPD

SEQ ID NO: 133912 - protein, 227 aa, Triticum aestivum
  Clone ID: PAT_TA_28330.pep
METSASGAEPANAGIEVSADPCSSAGGGHRLSVHQIVGGGKAADIILWKCKRATVGVIFGATIAWWLFEKSELSFLTICCDVLLILIVVQLIWVKISGLLNKQPRQLPELVLSEEMVNNAAASFRVKVNNMLMIAHDITLGKDFRLFFQVVSVLWLLSVIGNFYSSVTLAYIGTIALVTVPVLYHRHQEHVDRYAGMVHRNISRHYKIVDENVISRLPRSFIRDKDD

SEQ ID NO: 133913 - protein, 161 aa, Triticum aestivum
  Clone ID: PAT_TA_28331.pep
MGVYFDISIDGQPAGRIEFKLYDDVVPKTTENFRALCTGEKGFGYKGSAFHRVIPQFMLQGGDFTHGDGTGGKSIYGTKFADENFKLKHDKPGLLSMANAGPNTNGSQFFITTVPCSWLDGAHVVFGEVTKNMDLVKTIESLGSANGKVKKKVVITDSGEL

SEQ ID NO: 133914 - protein, 143 aa, Triticum aestivum
  Clone ID: PAT_TA_28332.pep
VRPRVRPRVRGRVGLDAAYQAAKDKSSNSPVFLLFSVNTSGQFIGLAEMVGQVDFNKTVEYWQQDKWTGCFPVKWHIVKDIPNTLLKHIILEYNENKPVTNSRDTQEVRLEQGLQVLKIFKDHVCKTSMLDDFGFYDNREKIM

SEQ ID NO: 133915 - protein, 317 aa, Triticum aestivum
  unsure (1)..(317): unsure at all Xaa locations
  Clone ID: PAT_TA_28333.pep
NYKPRQRTAYGSYGFPNENLDGLNELKRGPXSGLYNNQQGFGPAAATAVKAQDVSATDGSNAVGQDQYNGSDLGDTYENELYFIIKSYSEDDVHKSIKYNVWASTPNGNKKLDSTYLEAKSVNSPVFLLFSVNTSGQFVGLAEMVGQVDFDKTVEHWQQDKWTGCFPVKWHIVKDIPNNLLKHIILEYNENKPVTNSRDTQEVKLEQGLQVLKIFKDHVSKTSILDDFSFYDNREKIMQERKSQRQLQLKKITSPKLLPTVDNTENDSGNVQESQKPEVTGENKSAVEDNVEAAAVSGVAPKDANPTAASLAVANGC

SEQ ID NO: 133916 - protein, 155 aa, Triticum aestivum
  Clone ID: PAT_TA_28334.pep
RHEVVEIDGPSTIATKFPEQEPNFIRSPSPHGPSATTRIRASRGESRSSLLSGAARVLDAVRVQRPKCRTGRRQFLRMLLPFWSSALPTFPVTAPPKKENDAPQRRPRHQRTSRIDPTKILLAMAIMACIATMGILYYRLSQRSLSENFAHDEAQ

SEQ ID NO: 133917 - protein, 246 aa, Triticum aestivum
  Clone ID: PAT_TA_28335.pep
DAWADAWVEVKTLTAESLAKVFDHAILRPDQTTEDVVQGCQVAREYNVASVCVKPCDVKQASELLQGSSVMVGTVISFPHGNSPTSAKVAEALQTVEDGAIELDIVINIGHLRSGLYAEVQQELEEIMKACRAKNKDVSFKIIFETAYLTNEQIVKACEISHAAGAEFVKTSTGFASAGATVEHIKLMKASVPESMEVKASGGIKTLDQVLEFLSLGATRIGSSSSDKIVEEFKKRQILIINFFIF

SEQ ID NO: 133918 - protein, 147 aa, Triticum aestivum
  Clone ID: PAT_TA_28336.pep
VKCDPRRGKYMACCLLYRGDVVPKDTNAAISVIKTKRTIQFVDWCPTGFKVGINHQPPITVPGGDVAKVQRALCMLSNTTAIAEAWSRLDHKFDLMYAKRAFVHWYVGEGMEEGEFSEAREDLAALEKDYEEVGADSLGDSEMEEEY

SEQ ID NO: 133919 - protein, 80 aa, Triticum aestivum
  Clone ID: PAT_TA_28337.pep
ALKLGVCANVLGLLNLTLGSPPVQPCCSLIQGLADLEAALCLCTTLNLNLLGINLTLPIALSLVLDNCGKNVPSGFQCPN

SEQ ID NO: 133920 - protein, 91 aa, Triticum aestivum
  Clone ID: PAT_TA_28338.pep
HALPFSLLPLGVFIRQHLQESFFVMIWITAVMFKSNDILRKQTALKQATRLGERPCHCHDGCSFWPDRGMKTCGIPSFGRTSSSGGLHVMS

SEQ ID NO: 133921 - protein, 123 aa, Triticum aestivum
  Clone ID: PAT_TA_28339.pep
VQSKSLNEEVKGIPAPQLKTIDQIDAAYRTAATAADAAPVNDKFTVFESAFNKAIKETTGGAYDNYKFVPALESAVKQAYAATVASAPEVKYAVFQAALSKAINAMVEAEKDTGAATAGGYKA

SEQ ID NO: 133922 - protein, 169 aa, Triticum aestivum
  Clone ID: PAT_TA_28340.pep
MAAAGDAGEKKMVTLKSSDGEEFEVEEAVAMESQTIRHMIEDDCADNGIPLPNVTSKILSKVIEYCNKHVQAKPADAAAAAPDAAAPPAEDLKNWDAEFVKVDQATLFDLILAANFLNIKGLLDLTCQTVADMIKGKTPEEIRKTFNIKNDFTPEEEEEIRRENQWAFE

SEQ ID NO: 133923 - protein, 141 aa, Triticum aestivum
  Clone ID: PAT_TA_28341.pep
MADYGGEYGHPYPRVDEYGNPVPPVDQYGNPIPREPGQVPAYTSGGAAPPYSSDGAGAVTSADYGAGVTPGYGLSGAVHPQESVVGGAVFPSGTAHTHEGALSGSLAPGETTAYAYEGMVGSGIGTGDQIQPTKEGHTTLG

SEQ ID NO: 133924 - protein, 94 aa, Triticum aestivum
  Clone ID: PAT_TA_28342.pep
VKSVNIVHCLGVWCVYCIILFFFASLSKARTRLGTYVYNEVLSLQLHSFLARYLCASVVCLQVGHVFEYNPFLASLFKARTSLRTYVYNEVISL

SEQ ID NO: 133925 - protein, 170 aa, Triticum aestivum
  unsure (1)..(170): unsure at all Xaa locations
  Clone ID: PAT_TA_28343.pep
MAAEEGEKKMITLKSSDGEEFQVEEAVAMXSQTIRHMIEDDCADNGIPLPNVDSKILSKVIEYCKKHVQASPKPADSGAAVDASSSTSTAAAAPTEDLKSFDAEFIKVDQNTLFDLILAANYLNIKGLLDLTCQTVADMIKGKTPEEIRKTFNIKNDFTPEEEAEIRKEN

SEQ ID NO: 133926 - protein, 134 aa, Triticum aestivum
  Clone ID: PAT_TA_28344.pep
MAKSSFKLEHPLERRQAEANRIREKYSDRIPVIVEKAGKSDIPDIDKKKYLVLADLTVGQFVYDVRKRIKLSAEKAIFIFVKNTLPPTAALMSAIYEENKDEDGFLYMTYSGREPPWDGFRWRWLPGNRSECHL

SEQ ID NO: 133927 - protein, 94 aa, Triticum aestivum
  unsure (1)..(94): unsure at all Xaa locations
  Clone ID: PAT_TA_28345.pep
MGSAGGAGAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 133928 - protein, 102 aa, Triticum aestivum
  Clone ID: PAT_TA_28346.pep
FGTRDMSGMTAHLPAKKGLSAYYQGKSQSFACMAEVRCLEDLQKKEKPRGRGHKMKPCKSYAALGGMAMARKPPGSSCANLGLMDAGSGFMNIPVNEDCYRQ

SEQ ID NO: 133929 - protein, 165 aa, Triticum aestivum
  Clone ID: PAT_TA_28347.pep
EEITLKSSDGEEFEVEEAVAMESQTIRHMIEDDCADNGIPLPNVNSKILSKVIEYCNKHVQAKPADGAAAGAGAGASDAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 133930 - protein, 106 aa, Triticum aestivum
  unsure (1)..(106): unsure at all Xaa locations
  Clone ID: PAT_TA_28348.pep
GNNRSVMPLDVLGRTRATLMYSTSIXPWPTGPGNLGKFHRDGDRSLQLLVFNEECLVSASHQLALTTSLPFVHTARRSYRLNGPVKCSDRGDGGGDVARSPLNLII

SEQ ID NO: 133931 - protein, 112 aa, Triticum aestivum
  Clone ID: PAT_TA_28349.pep
DISCFAACHFLFLHACIVSSSTLWYHQKRLKIMVAAQLIFHQELISLETISFPVLFGQHNLLAIDARIFFTHAALATNCTYNLYNLKASRSSFCCSNLLPPFHNIRTFFTLV

SEQ ID NO: 133932 - protein, 150 aa, Triticum aestivum
  Clone ID: PAT_TA_28350.pep
TRAGCDAIRKAFAMGNGKGKAKELSPQDAVLLIQMNYRAHLAHRSQVLSSLRDLAVAKAKLKELQSLFYNLSYRRRLSHDHEERQRFSEKIIVLLLTVDALESMCEKNGQTPPPMPVIAPAGTRNSRQASTGPSPSATGATGSTPTPTPS

SEQ ID NO: 133933 - protein, 106 aa, Triticum aestivum
  Clone ID: PAT_TA_28351.pep
MKNVAKCDTWCELQNPANHRVFERKLRPRPLGRGHACLGVTHKETLLDAVKETNEWLDGHGADATAEDFEEQKEKLSNVAYPITSKMYQGAGGAGGEQDDNIHDEL

SEQ ID NO: 133934 - protein, 98 aa, Triticum aestivum
  Clone ID: PAT_TA_28352.pep
LQLASLCHSGHFLASTTAMATADVQNPSAALTEEAPAVEKPVAAEEVAKTEELAGSASTAAAVCSYVARRDAESASGVVLLFTRCGVGVLCAGSRDVG

SEQ ID NO: 133935 - protein, 96 aa, Triticum aestivum
  Clone ID: PAT_TA_28353.pep
GRNLNDASPARRPCDPSSYHESSDQRAEPASAFYLINAPLPEVGGLLHVLALELLRLFRVARTIKQTITDLMSHSQFHSSNWFILAHAGLIFETSI

SEQ ID NO: 133936 - protein, 138 aa, Triticum aestivum
  unsure (1)..(138): unsure at all Xaa locations
  Clone ID: PAT_TA_28354.pep
MAAAGDAGEKKMITLKSSDGEXEFEVEEAVAMESQTIRHMIEDDCADNGXIPLPNVNSKILKNWDAEFVKVDQATLFDLILAANYLNIKGLLDLTCQTVADMIKGKTPEEIRKTFNIKNDFTPEEEEEIRRENQWAFE

SEQ ID NO: 133937 - protein, 177 aa, Triticum aestivum
  unsure (1)..(177): unsure at all Xaa locations
  Clone ID: PAT_TA_28355.pep
LGFRFASQYSDLSMAAEEGEKKMITLKSSDGEEFQVEEAVAMESQTIRHMIEDDCADNGIPLPNVDSKILSKIIEYCKKHVQANASSSTSTAAAAPTEDLKSFDADFVKVDQATLFDLILAANYLNXKGLLDLTCQTVADMIKGKTPEEIRKTFNIKNDFTPEEEEEIRRENQWAFE

SEQ ID NO: 133938 - protein, 222 aa, Triticum aestivum
  Clone ID: PAT_TA_28356.pep
GNARTTTNVPQPKASRTKQKGNNGGAPTAATGRSARTGALYMTNNTTDILGALRPIEKLRQRWGNGDARHIYPKSILRALGPSWPSSRLSSSLAWANASSLVPSSAPLSSTVLTALKMGFHRWASRFTTPSAHLSFSPVFSLGRSLPPDLGCIPKQPDSLTAPRGATGSGPDGALTLPGAPFQGTWARSVAEDASPDYNSDGTAARFSSWAAPGSLAVTRGI

SEQ ID NO: 133939 - protein, 78 aa, Triticum aestivum
  Clone ID: PAT_TA_28357.pep
NIQGITKPAIRRLARRGGVKRISGLIYEETRGVLKIFLENVIRDAVTYTEHARRKTVTAMDVVYALKRQGRTLYGFGG

SEQ ID NO: 133940 - protein, 93 aa, Triticum aestivum
  Clone ID: PAT_TA_28358.pep
RTSVAKCIEIGLPEIILLVALSQYIPHLVPLLGTAFERFAVIMSVAIVWLYAFFLTVGGAYKNAAPKTQFHCRTDRSGLVGGAPWITVPYPFQ

SEQ ID NO: 133941 - protein, 161 aa, Triticum aestivum
  Clone ID: PAT_TA_28359.pep
TKYDAYVATLTESLRVISGTLEVHSVKPAEEEVKGVPTGELKAIDQVDAAFRTAATAADAAPVNDKFTVFESSFNKAIKETTGGTYESYKFIPALEAAVKQAYAATVAAAPEVKFTVFQTALSKAINAMTQAEKDAKPAAAATATATPGASAGATAGGYKA

SEQ ID NO: 133942 - protein, 113 aa, Triticum aestivum
  Clone ID: PAT_TA_28360.pep
MSKMADEKVISAPATGGGEDGLIAGDLSAAEARVRPLETLLRAAGVGLCVAAMAVMLRDAGTNEYGTVSYSDLGGFKYLVYANGLCAAYSLVSAFYTAVPRPATLSRSWIVFL

SEQ ID NO: 133943 - protein, 76 aa, Triticum aestivum
  Clone ID: PAT_TA_28361.pep
DLLAHKSISTCILLFRARHGHLTSVILKLANCGSYCFPQVAHGESCVSRLDPFAMLLYFSHEGFTACQFVVVPAVC

SEQ ID NO: 133944 - protein, 145 aa, Triticum aestivum
  unsure (1)..(145): unsure at all Xaa locations
  Clone ID: PAT_TA_28362.pep
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPSQRFRRXDDGPRPGQGGPPRAGGPGGPGWCSCRAGAVPGAPAPVWGLI

SEQ ID NO: 133945 - protein, 41 aa, Triticum aestivum
  Clone ID: PAT_TA_28363.pep
FARLLPSLDVVAVSQAPSPESNPNSPSPVTTMVGPYPTIES

SEQ ID NO: 133946 - protein, 298 aa, Triticum aestivum
  unsure (1)..(298): unsure at all Xaa locations
  Clone ID: PAT_TA_28364.pep
MSSPGSSDDPRSQVSSLYKRHSFQSVVLGALQVQKIHNVWIFDEKSLIVRGDLSYSMALYKIFDQILLLVADNKNRGMTRLTVDVDQNKGRIKFTCTGTNIPMGPEAVLQFTEYSPTMEFNGVFANVLSNRFTVSTTNGKQLLKQTYRKRMLKVQPQVTKNRIVPEESTHLEEWTSVSFIPDLAMFRMTKLEGDIICMMRKRVIEMTCTIGKSIDVYFNDELIPEMTFLKYVEHYIGAGAEAEEKHPRVXRVGEWEICLTLSDGEFNQVSFTNGHSTLGGSHVDCVADQVIAYVMRNI

SEQ ID NO: 133947 - protein, 66 aa, Triticum aestivum
  Clone ID: PAT_TA_28365.pep
KKELNIYNLWNLLILQPAKKKKLQSQILHYGALIYATTPLKSDTSIPITMKFPKITRACRPRLYTP

SEQ ID NO: 133948 - protein, 75 aa, Triticum aestivum
  Clone ID: PAT_TA_28366.pep
LDHSVVVTHMMAICSGHSSFDDGGGGAPMMVDSSDFPSRIHGDEAQPRLEPPPICLRSRKLGLMECLYLVFVLTL

SEQ ID NO: 133949 - protein, 193 aa, Triticum aestivum
  unsure (1)..(193): unsure at all Xaa locations
  Clone ID: PAT_TA_28367.pep
SARGAHRLSSPSSLLPPSASGRGRERGRERGRAGATRGSIVPSRSALYSLTGYGFYQFKVRFISSLLSKTELRQLWHSELLIKMPALRMKRKFDDDIFGNEFDTKSMKSMKISNFQVDEFEQAFVLNSSYKDPQDEPESTTQLAGQHSRVTEFSGLHAVLGVTSVALLKDLISETVVXTNLEPDSLSNNDDGK

SEQ ID NO: 133950 - protein, 166 aa, Triticum aestivum
  Clone ID: PAT_TA_28368.pep
ARGTSLCADATVKVSTRAEDLESEVERIQAAMGSEIDVSLDCAGFSKTMSTALEATRPGGKVCLVGMGHNEMTLPMTSAAAREVDVVGVFRYKDTWPLCIDFLRTGKVDVKPLITHRFGFSQRDVEEAFEVSARGRDAIKVMFNLLGGWLELDHRRRLDLSVQPAG

SEQ ID NO: 133951 - protein, 170 aa, Triticum aestivum
  Clone ID: PAT_TA_28369.pep
CAALVSDARSLSRMSASSALLSGASSLSCFCRSELVFRVHHLSFLRHLACLVTASSVHHDCAPFSLYLIFLNPLRPQSSMVNLVTNFLPPFDPFSQYQNLYEFTANQLIRIFSLVEPATARGAGDGPPTRLASRATTGGGDRRCAGRAVPTRGRPDRRNSRRIWRCAAVR

SEQ ID NO: 133952 - protein, 175 aa, Triticum aestivum
  Clone ID: PAT_TA_28370.pep
AQQPGYGSQQAQQPGYGSQQAQQPGYGSHQTQQFGYGSQQAQQPGYGSHQEQQPRYGSQQGQQPGYGSQQVQQPGYVSHQTQQPRYGSQQAQQPGYGSQQAQQPGYGSQQAQQPGYGSHQAQQTGYGLHQAQQPGYSYQAQQPKYGAHQAEQPGYGAYQAQQPGYGAHQARQPGY

SEQ ID NO: 133953 - protein, 86 aa, Triticum aestivum
  Clone ID: PAT_TA_28371.pep
MSAGSERSNAAYATPAAVLAGFSRGSGPSVSGAGSGSGRSQAEGGARKKPPFRLAADDTKPILRDPISRSDPMETEQAVLRLPPFP

SEQ ID NO: 133954 - protein, 138 aa, Triticum aestivum
  Clone ID: PAT_TA_28372.pep
ITIPGALVSGNWNEYNLNPDSVSKAFVQHYYHTFDSNRAALVGLYQDGSMLTFEGEKFGGPAAIAGKLGSLPFQQCQHKIDTVDCQPSGPQGGVLVFVSGTITTGPGEHPLKFSQMFHLLPAGGSFYVQNDMFRLNYG

SEQ ID NO: 133955 - protein, 153 aa, Triticum aestivum
  Clone ID: PAT_TA_28373.pep
MGRTKHAVAATATTTTTETKKRLRFELSPRWRPPPPMRQVPPEPQPEKKKKRAYRFRPGTVALREVRKYQKSTGPLIPFAPFVRLVKEITNDLTKGELNHWTPQALFALQEAAEYHIVDVFEKANLCAIHAKRVTIMQKDIQLARRIGGRWLW

SEQ ID NO: 133956 - protein, 326 aa, Triticum aestivum
  Clone ID: PAT_TA_28374.pep
HSQGTVEPGFDHIKGPAVNLFVAAPELPMELSIAVNTSLIALVRRGIFCTEPFRIPFAGKVDICCFDKTGTLTSDDMEFQGVVTLESDAELISDANKLPLRIQEVLSSCHALVFVDNKLVGDPLEKAAIKGIDWIYTSDEKAMSRSLRCRPGGQPVQIVHRYHFASHLKRMSVIVRIQEKFYAFIKGAPETIQERLVDLPAAYVETYKKYTRQGSRVLSLAYKLLPEMPVSEARSLERDQVESDLIFAGFAVFNCPIRSDSAAVLLELEQSSHDLVMITGDQALTACHVASQVNICSKPVLILTRMKTSGFEWVSPDETDRVPYRA

SEQ ID NO: 133957 - protein, 129 aa, Triticum aestivum
  Clone ID: PAT_TA_28375.pep
KVIWEAGILTIVVVLSLTAYTFWAARRGKDFSFLGPFLFASLVILLVFGFIQIFFPLGKLSHMINGALAALIFSGYIVYDTGNIIKRYTYDEYVWAAVTLYLDIMIPAVPATLHWVDDSQARHPAPALS

SEQ ID NO: 133958 - protein, 137 aa, Triticum aestivum
  Clone ID: PAT_TA_28376.pep
AGRVRSITITNDKGRLTPEEIERMVAEAEKYAEEDKATRERIEARNGLENYAFSLKNQVNDEEGLGGKIDEEDKETLLDAVKETNEWLDEHGADATAEDFEEQKEKLSNVAYPITSKMYQGAGGAGGEQDDNIHDEL

SEQ ID NO: 133959 - protein, 109 aa, Triticum aestivum
  unsure (1)..(109): unsure at all Xaa locations
  Clone ID: PAT_TA_28377.pep
MAPKKDKAPPPSSKPAKSGGGKQKKKKWSKGKQKEKVNNAVLFXDQATYDKLLSEVPKYKQITPSVLSERLRINGSLARRAIKDLMARGFIRMISVHSSQQIYTKATNT

SEQ ID NO: 133960 - protein, 114 aa, Triticum aestivum
  Clone ID: PAT_TA_28378.pep
SSIRRQHRQGKYTPENPPTGPRGNTYTPEFLAKLQPLMNRIKEIGVSYGKKPTQVSLNWLTCQGNVVPIPGAKNAGQAMEFAGALGWSLTADEVEELRTLAREIKGIKMPIEES

SEQ ID NO: 133961 - protein, 130 aa, Triticum aestivum
  unsure (1)..(130): unsure at all Xaa locations
  Clone ID: PAT_TA_28379.pep
MGRMHSRGKGISSSALPYKRTPPTWLKTAASDVEEMITKAAKKGQMPSQIGVLLRDQHGIPLVKSVTGSKILRILKAHGLAPEIPEDXYFXIKKAVAIRNTLEEQEGQRKSSSQNRFNALPVNAQELHLN

SEQ ID NO: 133962 - protein, 95 aa, Triticum aestivum
  Clone ID: PAT_TA_28380.pep
EKNPNCIILLRYIVRSYSFQSVCTSCTPHVLCTGSFVIPCSLRSQARPLSGFISLYCAAKLKSRRRVHARRCWLYIFGLLENVNNIDLFFVKDSK

SEQ ID NO: 133963 - protein, 114 aa, Triticum aestivum
  Clone ID: PAT_TA_28381.pep
MAPRDSKEMLQRAAESAIRSIGLGYDVAADVRLKFCKQRGSPDPSLIELDRDGTQDIVLPGSLTTVAGVPKSIKCDKGERMRFRSDVLSFQQICFRSRKLGLMECLSLVFVLTL

SEQ ID NO: 133964 - protein, 131 aa, Triticum aestivum
  Clone ID: PAT_TA_28382.pep
MSMAAAARAAARAPGRAAARFVQSRLRSSGKVLSEEERAAENVYIKKMEQEKREKLARKGPSTGEQAPSTPSAAAGDANTAGAGSTASASAAGTSTDKNRNYAVLAGTLAGLSALGWYLLSKPKKTEEVVD

SEQ ID NO: 133965 - protein, 111 aa, Triticum aestivum
  Clone ID: PAT_TA_28383.pep
PISPEKEASTMSGRGKGGKGLGKGGAKRHRKVLRDNIQGITKPAIRRLARRGGVKRISGLIYEETRGVLKIFLENVIRDAVTYTEHARAAPSTDSAARPRESIPPPPYLCS

SEQ ID NO: 133966 - protein, 145 aa, Triticum aestivum
  Clone ID: PAT_TA_28384.pep
RPEEIEKRERERGWGRRRRRPSRLDRARGTRGERACDPRGAGSRFRRRDSLALAGPAVSSTLSPRIWWDPAKSWLVEGRGGARRGGAEKLKWALGVVNLEAQWWKPIFRADSTVLERGAYEGTKEELNSELWPEGPNRPQDRTLV

SEQ ID NO: 133967 - protein, 52 aa, Triticum aestivum
  Clone ID: PAT_TA_28385.pep
TALSLARAGLVKYTADEDFVIADAVFDCIGDPPEGRFDLEFCANLLQKQFVS

SEQ ID NO: 133968 - protein, 40 aa, Triticum aestivum
  Clone ID: PAT_TA_28386.pep
ECSDLYISSKTLKFCNFYCSCVHACRCGYWLFTAADVKKK

SEQ ID NO: 133969 - protein, 61 aa, Triticum aestivum
  Clone ID: PAT_TA_28387.pep
AWSRRGTRSNTTNPAITSTIHRTDCTVVSSLLGINSTKLSNIFTVPAIPAYTILHLPGRPL

SEQ ID NO: 133970 - protein, 95 aa, Triticum aestivum
  Clone ID: PAT_TA_28388.pep
MAQGSGSATAVLALVLLCLLLHGDFAESKVYTVGDRNGWALSSGGWPRGKRFRAGDVLRECSPSLPPMRATLITFFFQLHSRLVLRYKLDHGKHS

SEQ ID NO: 133971 - protein, 134 aa, Triticum aestivum
  Clone ID: PAT_TA_28389.pep
MTDRYLPMRCVLKKKKKRATASASTGASSAAAGSAGSASAAGAASSFTSPAAAGSASATASLVSVSTTAGASVSLGASASGSAAAAGSASLASSVSAAAGASSLVRRDAESASGVECYCFLLGVEWERYARGRA

SEQ ID NO: 133972 - protein, 90 aa, Triticum aestivum
  unsure (1)..(90): unsure at all Xaa locations
  Clone ID: PAT_TA_28390.pep
FYSTSTHTRLALQWILVKXLDCTHSNYQTLMRPXIVIYCHYLPVSGLGNLRACCLXLDVVAVSQAPSPESNPNSPSPVTTMVGPYPTIES

SEQ ID NO: 133973 - protein, 99 aa, Triticum aestivum
  unsure (1)..(99): unsure at all Xaa locations
  Clone ID: PAT_TA_28391.pep
MDPDSVSKAFVQHYYQTFDSNRAALXGKLGSLPFQQCQHKIDTVDCQPSGPQGGVLVFVSGTITTGPGEHPLKFSQMFHLLPAGGSFYVQNDMFRLNYG

SEQ ID NO: 133974 - protein, 94 aa, Triticum aestivum
  unsure (1)..(94): unsure at all Xaa locations
  Clone ID: PAT_TA_28392.pep
MAFAFSIIGAGITAAAGTRLALQWILVKXLDCTHSNYQTLMRPXIVIYCHYLPVSGLGNLRACCLXLDVVAVSXAPSPESNPNSPSPVTTMVGP

SEQ ID NO: 133975 - protein, 81 aa, Triticum aestivum
  Clone ID: PAT_TA_28393.pep
VPSRCKRRIEVMHTSYPVTIRCKWTISLSSLEPTERRAFFPDYTSFKIAKWTKDKIIHTLDKVAKDSNDVNRHGASQIYIG

SEQ ID NO: 133976 - protein, 105 aa, Triticum aestivum
  unsure (1)..(105): unsure at all Xaa locations
  Clone ID: PAT_TA_28394.pep
SAQRPPSVRHPLERRQAXANRIREKYSDIIPVIVEKAGKSDIPDIDKKKYLVPADLTVGQFVYVVRKRIKLSAEKAIFIFVKNTLPPTVFLLCRLEEKKKIQRRS

SEQ ID NO: 133977 - protein, 69 aa, Triticum aestivum
  Clone ID: PAT_TA_28395.pep
MTLEEAPFYPRKKLVQKQQYFQKLSKHIHLKGRYDVVTSVAIPLALAGTSLFMIGRGIHNMSNGIGKKE

SEQ ID NO: 133978 - protein, 152 aa, Triticum aestivum
  Clone ID: PAT_TA_28396.pep
DVGIGGTTISQLPLGGAGAGAGLLLELAHVGGEHGDDVPGWRLQRGDEGGGRPIKGAEQLGVDLGAAGHGLSPVFSLGRSLPPDLGCIPKQPDSLTAPRGATGSGPDGALTLPGAPFQGTWARSVAEDASPDYNSDGTAARFSSWAAPGSLA

SEQ ID NO: 133979 - protein, 103 aa, Triticum aestivum; identical to SEQ ID NO: 107316
  Clone ID: PAT_TA_28397.pep

SEQ ID NO: 133980 - protein, 337 aa, Triticum aestivum
  Clone ID: PAT_TA_28398.pep
MARSIALVCFLVVGLGLLGAMCASAAAAGGENGGRLVNAVYVFGDSLVDVGNNDYLPAPAPRANRPYGMDLPGKPTGRFTNGYNLADVISQRVGFEMSPKPYLSMLPHDKILLGLCKIGANYASGGSGILDTTGKGTLTMRTQVEYFKKAADNMICYPSKEEHLARSLFLLSGGGNDFSAFDPSTASPQAYVVKMVTTYIKHIQALYDMGARMVGILDVPPIGCTPGQRVGMPNGECNEQANSLAQAFNGLLRAKLAEASATTMKELKYSIAANYNILNDMMDNSLVAGLRHVKTACCGSGKLNAEVMCSHPGTTACPAGEHDDYMCLDMLHPTHAT

SEQ ID NO: 133981 - protein, 51 aa, Triticum aestivum
  Clone ID: PAT_TA_28399.pep
RPRCFWRGFVCVRGFDRTSRAPRPLYARLHFPASKITRNKKGAASAGTDDA

SEQ ID NO: 133982 - protein, 99 aa, Triticum aestivum
  unsure (1)..(99): unsure at all Xaa locations
  Clone ID: PAT_TA_28400.pep
MTLEEAPFYPREKLVQKQQYFQKLSKHIHLKGRYDVVTSVAIPLALAGXSLFMIGRGXYNMSNGIRGKRSEFLWLLLVSQLSGMGSDTAPSMMSSSVCK

SEQ ID NO: 133983 - protein, 143 aa, Triticum aestivum
  Clone ID: PAT_TA_28401.pep
MATVSDSLVWELVRKNNCFLIKQFGNSNAKVQFSKEPNNLYNVHSYKYSGLANKKTVTVQPAAEKEMTVVLSTTKSKKQNKPAAFTHKTVMRKEFRKMAKAVKNQVSDNYYRPDLTKPALARLSAVYRSLQVAKSGVKKKNRQ

SEQ ID NO: 133984 - protein, 127 aa, Triticum aestivum
  Clone ID: PAT_TA_28402.pep
MSMAAATRAPGRAAARFVQTRLRSSGKVLSEEERAAENVYIKKMEQEKREKLARKGPSTGEQAPSTPSAAAGDVNTGGAASTASASAAGTSTDKNRNYAVLAGTLAGLSALGWYLLSKPKKTEEVVD

SEQ ID NO: 133985 - protein, 84 aa, Triticum aestivum
  Clone ID: PAT_TA_28403.pep
MGQQLGRDKIGSNLTADDIASAFYFSLLLSPVVSYWDCIFRKIRYSFRPEWQAVTVVMEKAAGNQAGKVLKKGKKKQAKDELDR

SEQ ID NO: 133986 - protein, 125 aa, Triticum aestivum
  unsure (1)..(125): unsure at all Xaa locations
  Clone ID: PAT_TA_28404.pep
MATVSDSLVWELVRKNNCFLIKQFGNSNAKVQFXSKEPNNLYNVHSYKYSGXWANKKTVTVQPAADKEMTVGLSTTKXKKQNKPAAFTHKTVMRKEFXKMAKXAIKEQVNDNYYRLTFTNLSCKN

SEQ ID NO: 133987 - protein, 55 aa, Triticum aestivum
  Clone ID: PAT_TA_28405.pep
RPGRRALGRVASGATCVQRLDGSRDSAIHTRYRISLRSSSMREPRYPLPRVVWIK

SEQ ID NO: 133988 - protein, 182 aa, Triticum aestivum
  unsure (1)..(182): unsure at all Xaa locations
  Clone ID: PAT_TA_28406.pep
HQGCQQHHPITLWKAEVEIQKYKVGVKQLSAPSIDSNHGGKQNTLETKTHNIFRELPSFSTTHISSYGESFSSFPRGTCSLSVSRLYLALDGVYRPIWAAFPNNPTRXRRLVGRQGPGRTGLSPSQAPLSRGLGPGPSLRTPXPDYNSDGTAARFSSWAAPGSLAVTRGILVSFFSSAYLYA

SEQ ID NO: 133989 - protein, 89 aa, Triticum aestivum
  unsure (1)..(89): unsure at all Xaa locations
  Clone ID: PAT_TA_28407.pep
ITIPGALVSGNWNEYNLNPSDPLNGEAAALMMRDRPAYEQKVKEFCEKYAKXPEDAGITPEDKSXSDEEELSEDEDDSGDEDIVGKPDP

SEQ ID NO: 133990 - protein, 89 aa, Triticum aestivum
  unsure (1)..(89): unsure at all Xaa locations
  Clone ID: PAT_TA_28408.pep
LEGVAVARLALQWILVKXLDCTHSNYQTLMRPXIVIYCHYLPVSGLGNLRACCLXLDVVAVSQAPSPESNPNSPSPVTTMVGPYPTIES

SEQ ID NO: 133991 - protein, 117 aa, Triticum aestivum
  Clone ID: PAT_TA_28409.pep
ATTTTTSSTHSEAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 133992 - protein, 42 aa, Triticum aestivum
  unsure (1)..(42): unsure at all Xaa locations
  Clone ID: PAT_TA_28410.pep
QAEVSFVNGINQTNRSTNXERPCTTTHRIKKELSVCQSLLCL

SEQ ID NO: 133993 - protein, 122 aa, Triticum aestivum
  Clone ID: PAT_TA_28411.pep
LQIRHEGYFHVVNNDYTHWEMYAIGGSAEPTINSQGNRYLAPTNPFAKEVTKRVETAQTTWKAWNWRSEGDMLLNGAFFTPSGAGASASYSRASSLGAKSSSMVATITSGAGALSCHKGSSC

SEQ ID NO: 133994 - protein, 86 aa, Triticum aestivum
  Clone ID: PAT_TA_28412.pep
MVVTGDGELGFDSGKLGSLPFQQCQHKIDTVDCQPSGPQGGVLVFVSGTITTGPGEHPLKFSQMFHLLPAGGSFYVQNDMFRLNYG

SEQ ID NO: 133995 - protein, 129 aa, Triticum aestivum
  unsure (1)..(129): unsure at all Xaa locations
  Clone ID: PAT_TA_28413.pep
MGAICIIPSPERSALVRQQHTPEEDQRRRTWLFLACSHNSSRPHSGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 133996 - protein, 103 aa, Triticum aestivum; identical to SEQ ID NO: 107316
  Clone ID: PAT_TA_28414.pep

SEQ ID NO: 133997 - protein, 164 aa, Triticum aestivum
  Clone ID: PAT_TA_28415.pep
MGSGGRTDLDGGAVAPLTICVIGTGGFIGSHLCEKLMAETQQTVLAVDVYCDKIRHLVDPPPPHLAGRISFHRLNIKNDSRLEGLIKMADLTINLAAICMPADYNTRPLDTIYSNFIDALPVVKYWIRKSKRLIHFSTCEVYGKTIGSFLPKDHPLRKVILHLD

SEQ ID NO: 133998 - protein, 116 aa, Triticum aestivum
  Clone ID: PAT_TA_28416.pep
PVKAAFDQTAWSGLWNTNLFVALGFLRWESPSTIFSELKSTFFPMLTAGWKLWPFAHLITYGVVPVEHRLLWVDCVEIIWVTILSTYSNEKSEARILDDSSTTDTRVYYIGTTKYM

SEQ ID NO: 133999 - protein, 150 aa, Triticum aestivum
  Clone ID: PAT_TA_28417.pep
SSSSSRVPWWIQQQQQKEDTMVGTAAAAGFLGGYSSNSRKRTPWWVQQQQQGCIFKVSISRRSMDRDPFSTSRFICKQARFHPYSRGQGPHLIMPASQGRNPRRGDALLFGIGCANRHGRHPLWTGMTMMQGRMRTDTLSSTTTGHRTRA

SEQ ID NO: 134000 - protein, 65 aa, Triticum aestivum
  Clone ID: PAT_TA_28418.pep
KQRTAVLPLEINTMAHRQNTGSNNQINYTRSCFDSTTRIKTCTTMSYVATEQHILQPSKPSRLTG

SEQ ID NO: 134001 - protein, 257 aa, Triticum aestivum
  unsure (1)..(257): unsure at all Xaa locations
  Clone ID: PAT_TA_28419.pep
PRVRAFWTLAGIIDDYFDGYFSEEMMESQVDQLVLEELVREKFPKLANHLDYLGVEVAWVTGPWFLSIFTNVLPWESVLRVWDVLLFDGNRVMLFRTALALLEFYGPALVTTKDAGDAVTLLQSLAGSTFDSSQLVLTARMGYQSVNETGLQDLRNKHRPSVMLSMEERAKGLGVCKESGLASKLYNFKREPEQLVSINDSADQMSDVADGDVDQEGDSGXVDDMYGXLTVNSEIDSXLPDPKDQVTWLKLKLCRLL

SEQ ID NO: 134002 - protein, 99 aa, Triticum aestivum
  Clone ID: PAT_TA_28420.pep
RTRPLYSGSDRSGGTPQSTHHCFPAGRAVYSGRKEDGSTIYTCVCACVRATYVNTCPKITRRRFGRVREPLYRRLLPVAISQARSTWSRTRGSTRDSGP

SEQ ID NO: 134003 - protein, 240 aa, Triticum aestivum
  unsure (1)..(240): unsure at all Xaa locations
  Clone ID: PAT_TA_28421.pep
KAIGSGGEWWWNLPSLRRKNDSRRRGRRNQDARGRRRGPPREPLSSSSSSDSVGQSRGWPLDFPFQQAVTAACLTLTGDTMAQVHRRIVDRRKRGPEPDSKALVPDLLLNHDWLRGLRIASYGFLXLYGPGSYAWYQFLDKSMPKQTLATLSAKVLLNQIVLGPCVISVIFAWNNLWLGKLSELPSKYQNDALPTLLDRFKFWIPVSIVHFGMIPLPARVAFMSSCSIFWNFYLSTTMNK

SEQ ID NO: 134004 - protein, 220 aa, Triticum aestivum
  Clone ID: PAT_TA_28422.pep
SAAKYHHNQKAKRSQPNGEDPPGLPEPEPTYIFPTIVVSEPQKRLTLLPGIRRSHVSFHAGYSCHGLGPSLKGPLVLPPHFLLLLRGEVVGDVEGLADLLRSLALDHVGDGLAGQVQEPLNVQVVRSQDEVEESRLLDLDELDVVGLELLLVGLLAPDLPSNGSSLRDLDCTHSNYQTLMRPVLLFIVTTSPCQDWVICAPAAFLGCGSRFSGSLSGIEP

SEQ ID NO: 134005 - protein, 229 aa, Triticum aestivum
  Clone ID: PAT_TA_28423.pep
GNASTITNVPQPKASRTKLKGNNGGAPTAATGRSARTGALYMTNNTTDILGALRPIEKLRQRWGTGDACHIYPKSILRSLGPSWPSSRLSSSLAWAKASSLVPSSAPLSSTVLTALKMGFHRWASRFTTPSAHLSFSASLVSGLWREITVMACAMASCRSCRSSSPAATGLLLAGRTNLTSMVRASCLKITLALALYIALAAPMLLHLAEKASRRKRRRGRVGGRVGGR

SEQ ID NO: 134006 - protein, 131 aa, Triticum aestivum
  unsure (1)..(131): unsure at all Xaa locations
  Clone ID: PAT_TA_28424.pep
SSYIKNSPQGIRVQFLAAVRCQAHNAIFQRAVLHDAWFIHGEKKPAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 134007 - protein, 98 aa, Triticum aestivum
  unsure (1)..(98): unsure at all Xaa locations
  Clone ID: PAT_TA_28425.pep
NFDHAVGAGITAAAGTRLALQWILVKXLDCTHSNYQTLMRPXIVIYCHYLPVSGLGNLRACCLXLDVVAVSQAPSPESNPNSPSPVTTMVGPYPTIES

SEQ ID NO: 134008 - protein, 120 aa, Triticum aestivum
  Clone ID: PAT_TA_28426.pep
TAVPRFPTSARSLRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134009 - protein, 127 aa, Triticum aestivum
  Clone ID: PAT_TA_28427.pep
PWSLSFPHLSTSCPSCFIAVRVWCSTTSPCVRRAPPLRSWAAIEAERAKTQAAFEERDRQLAERDRQAAERDRENEERTARLLEEERNRNDSADRAMYDLFVSMCEKNGQTPPPMPVIAPAGTVSFI

SEQ ID NO: 134010 - protein, 188 aa, Triticum aestivum
  Clone ID: PAT_TA_28428.pep
MLLYHRILPRLLSLSLPSSPTSKLLIRPSRLPPRGPFLPRCAALSQLAAPQTVDHSDAEESADHLDAEEPQEPQEPQEVLVKLPLDRLFLPPGASVTPGDEEVVTARVLKGSNIVLGTYARGDAQVVNADFIKSSVRPDDCPRDGLPEFALVGRSNVGKSSLLNSLVRRKRLALTSKKPGKTQCINHF

SEQ ID NO: 134011 - protein, 239 aa, Triticum aestivum
  Clone ID: PAT_TA_28429.pep
GENLEEFDEQENKSSMAIQEETEESSIDQLSGIGNKSATGGWFVSEGEAVLLAHGDGTCSYYDIANHEFKSEYKPPSVVSHNTWGDCWLIRAPGVDGCSGRYVVAASAGNALEPGFCSWDYYNREVQAFHVEEEASLAPVPSARTVLGPLPNIGSSRSSSAISTIERPQWWYRPCGPLLLSTASKQKMVTAYDIRDGDVVMKWEVSSPVLGMEYSSPLQWRSRGKVVIAGTESIGLWDV

SEQ ID NO: 134012 - protein, 184 aa, Triticum aestivum
  Clone ID: PAT_TA_28430.pep
PTRPGKSPPHHQQPPPFLRFHICSQLEEDRQPCPPLSLAASPRRTRSPPSSPSAPSAQPPSQPHPAPSPSSPPPPAPATPICSGSPAARPMATPPPSPASSSASAASRRTSQTTSLAWRLIWQTTPPASRSMWTTRLSRSRSRSRRCAWAGTRRPMLGTPPTPRSSPTSAPAFSPSRQQRMWPR

SEQ ID NO: 134013 - protein, 128 aa, Triticum aestivum
  Clone ID: PAT_TA_28431.pep
PPPPAPPSPPTRSDARVGSDVASGSSGRAGGPDRPQDPRRAARPPPRARQDWEADPARLVVRGFVARGTFDTVHRGIFDGLDVAGFFVMIWIAAVMFKSNDILRKQTALKIQRSCMLLWWSSVCCLGK

SEQ ID NO: 134014 - protein, 166 aa, Triticum aestivum
  Clone ID: PAT_TA_28432.pep
MTPAISRLHINGRLYLDDMAPGTSDADLRRHFGRYGDVADIFIPTYSLTGQPCCCAFVQFSSPDDAGRALADPHHVINGREVYIGRAEPRHLEESSVCQYKPLCKRQIRDGQWRGYRVGDIGKTSFGPIVYDSIITYISEDGVDCWCLPVTMHTESKSTGYGPRKH

SEQ ID NO: 134015 - protein, 250 aa, Triticum aestivum
  Clone ID: PAT_TA_28433.pep
DVQRLARWVEHALPFSLLLLGVFIRQHLQGFFVMIWIAAVMFKSNDILRKQTALKGERKMPMLIGIIIVFTIHVFGVYWWYRNDDLVRPLVMLPPKEIPPFWHAIFFIAVNDTMVRQAAMVVKCVLLMYYKNSKGRHYRRQGQMLTVVEYSLLLYRALLPAPVWYRFFLNKEYGSLFSSLTTGLYLTFKVASMVEKVRSLLASVNALSHKDLHYGSHATTEQVLAAGDLCAICQEKMHTPILLQCKHIFC

SEQ ID NO: 134016 - protein, 60 aa, Triticum aestivum
  Clone ID: PAT_TA_28434.pep
LLRNITGNPEVRVNKMGRAAGVLENHEEGRRYAEHGLRAYVQDKTPEIMPGINKFFTSPK

SEQ ID NO: 134017 - protein, 60 aa, Triticum aestivum
  Clone ID: PAT_TA_28435.pep
SFLAGGRAGRACHVPGLLPTSKSSLFRPGKVGSWPCGLIVATCMHGNLVCSSVRPRDRAF

SEQ ID NO: 134018 - protein, 100 aa, Triticum aestivum
  unsure (1)..(100): unsure at all Xaa locations
  Clone ID: PAT_TA_28436.pep
AXGGSAEPTXNSQGNRHPAPTNPXAKEGTKRVETAQTTWKAWNWRSEGDMLLNGAFFTPSGAGASASYSRASSLGAKSSSMVATITSGAGALSCHKGSSC

SEQ ID NO: 134019 - protein, 126 aa, Triticum aestivum
  Clone ID: PAT_TA_28437.pep
FFFYTNRIGYRSIIGGTDTVTHTATKLQLSRRRHTGAGEWRCVARSLAADPTLGVDWPRQHFYLAHVTRPPRRRPASPPRAPPPSARPMGSGHQRWPLPSWMQENDRSGRGWLAEASATLIRECEA

SEQ ID NO: 134020 - protein, 371 aa, Triticum aestivum
  unsure (1)..(371): unsure at all Xaa locations
  Clone ID: PAT_TA_28438.pep
MGGLCSKVSAVDKSPSDTALGRNQVFDHEPVAALKEEEKKSVPEEAAAKRVEEQQAFSFLESVVPGLAVHNGADAEHTGSRTPQLARTLSQRAGLGXAKVSEMSTILGRASTVGLGKAVEVLDTLGSSMASLNASSGFVSSSGAKGNKISILAFEVANTIVKGSNLMHSLSNSNIKHIKEVVLHSEGVQHLISKDMDELLEIAAADKREELDVFSKEIIRFGNRCKDPQWHNLDRYFEKLVSERTSQHSLKRDAETVMQQLIICVQYTAELYHELHALDRFEQDYRRKHQEHDDLNLTGDNLHILKQEVKSQSKHVKSLKRKSLWSKNLEEVIEKLVDIVHFLDLEIYDAFGHAESEEPQEPVKRQVDAAA

SEQ ID NO: 134021 - protein, 90 aa, Triticum aestivum
  Clone ID: PAT_TA_28439.pep
MSAGSERSNAAYATPAAVLADFSRGSGPSVSGGAAGSVSGSGTSQAEGGARRKPSFRLAADDTKPILRDPISRSDPVETEQAVLRLPPFP

SEQ ID NO: 134022 - protein, 91 aa, Triticum aestivum
  Clone ID: PAT_TA_28440.pep
ITIPGALVSGNWNEYNLNPLTRIHWLARRGGVKRISGLIYEETRGVLKIFLENVIRDAVTYTEHARRKTVTAMDVVYALKRQGRTLYGFGG

SEQ ID NO: 134023 - protein, 284 aa, Triticum aestivum
  Clone ID: PAT_TA_28441.pep
IRTRAGDSAREPYIVTHNILLAHAAAVQLYRRKYQKAQGGEIGITLVCHWYLPYSNSTADKDAAKRRVEFMLGWFMDPIVHGDYPASMKSWLGARLPSFTREQKAMLKGSHDFFGLNYYTTYYAIATPAPANALLRGSYDADNRSNVTGFRNGRALGPQAYTEFLFVYPPGIHELMLYAKRRYGNPPVYVMENGIDEGNNSSLPIREALKDPARINYHYKHLLFLNLAIKQKVNIKGYFSWTFMDCFEWGDGFKDRFGLIYVDRNTLKRYPKESSKWMGRFLKK

SEQ ID NO: 134024 - protein, 78 aa, Triticum aestivum
  Clone ID: PAT_TA_28442.pep
RRIRVRFRRGSLRNGYHILKEQWSPALTISKVLLSICSLLTDPNPDDPLVPEIAHMYKTDRAKYESTARSWTQKYAMG

SEQ ID NO: 134025 - protein, 109 aa, Triticum aestivum
  unsure (1)..(109): unsure at all Xaa locations
  Clone ID: PAT_TA_28443.pep
VSARARSAVIGHRPHASEYLDSSGRLWGGLVVGSSLRDLDCTHSNYQTLMRPXIVIYCHYLPVSGLGNLRACCLPLDVVAVSQAPSPESNPNSPSPVTTMVGPYPTIES

SEQ ID NO: 134026 - protein, 103 aa, Triticum aestivum; identical to SEQ ID NO: 107316
  Clone ID: PAT_TA_28444.pep

SEQ ID NO: 134027 - protein, 166 aa, Triticum aestivum
  Clone ID: PAT_TA_28445.pep
MAADGERWVGLAVDFSEGSRAALQWAADNLLRAGDNLLLLHVLKDPDYEQGETLLWEASGSPLIPLSEFSHPSIAKKYGVKPDAETLDMLNTIAKQKEVAVVSKVLFGDPREKLCQAIHDMPISSLVIGSRGLGKLKRVLLGSVSDYVVNNAACPVTVVKPASTHA

SEQ ID NO: 134028 - protein, 253 aa, Triticum aestivum
  Clone ID: PAT_TA_28446.pep
FSCTGLLIKISHLRRMKKVRQHDGDVRSFSCTGLLIKWHKTGTPVILTSASLVRSRVDENEIDEKLKIKVLLPPKQVVDGTLELYHSDYNIAVISLQKPLYGIRPEYIFRTAKRPPRVVAIGRGAQDGLLMGTIGKAVKKLAGDKLPCEDLKLSTCKITKVGIGGPLVNIVNGLFAGMNFYGETDVTPYLPRAIIVEVLSGTDLPSHKGMDHATDIMGAATVKKNRWRVPKPYWYHPLFEDRRPLHFYGRQLQ

SEQ ID NO: 134029 - protein, 123 aa, Triticum aestivum
  Clone ID: PAT_TA_28447.pep
PLAAATTAPPPFPSQSTPSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134030 - protein, 158 aa, Triticum aestivum
  Clone ID: PAT_TA_28448.pep
MSYRMMGEEEEDAFEASSCASSGGESGDEGDRFPASGGARRQSAPPQAPLRRMNSDSIYDMSGMTAHLPAKKGLSAYYQGKSQSFACMAEVRCLEDLQKKEKPRGHKMKPCKSYAALGGVAMARKPPGSSCANLGLMDAGNGFMAPRNIPVNDDCYHQ

SEQ ID NO: 134031 - protein, 144 aa, Triticum aestivum
  unsure (1)..(144): unsure at all Xaa locations
  Clone ID: PAT_TA_28449.pep
AMESQTIRHMIEDDCADNGIPLPNVTSKILSKVIEYCNKHVQAKPADAAAAAGAAAPDAAAXPAEDLKNWDAEFVKVDQATLFDLILAANFLNIKGLLDLTCQTVADMIKGKTPEEIRKTFNIKNDFTPEEEEEIRRENQWAFE

SEQ ID NO: 134032 - protein, 176 aa, Triticum aestivum
  Clone ID: PAT_TA_28450.pep
MAAAGDAGEKKMITLKSSDGEEFEVEEAVAMESQTIRHMIEDDCADNGIPLPNVNSKILSKVIEYCNKHVQAKPADGAAAGAGASDASAAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 134033 - protein, 225 aa, Triticum aestivum
  Clone ID: PAT_TA_28451.pep
MDSEHWISRLAAAKRFYAAQLGHSDRAGMEELDMDEEVRPEFACPYCYEDHDVGSLCAHLEEEHPFEPQAAACPVCSEMVTKDMVNHITMQHGYLFKNRRRLRRFIIPGSQALSLLSRDLREAHLQVLLGGGHRSSNNNSTTNISADPLLSSFGLSFPTSDAEQTSKSTLSIPDDATMIKETPAQARKLSIDSSLTSEEREQKRKQASVRATFVQDLLLSTLFGD

SEQ ID NO: 134034 - protein, 122 aa, Triticum aestivum
  Clone ID: PAT_TA_28452.pep
PRVRLSPPNSICSELQAAIMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134035 - protein, 49 aa, Triticum aestivum
  unsure (1)..(49): unsure at all Xaa locations
  Clone ID: PAT_TA_28453.pep
RSNRRIQPTSRLLEGXLQSSLIASKITGEKVPRTNFRSATSASRGKAHG

SEQ ID NO: 134036 - protein, 119 aa, Triticum aestivum
  Clone ID: PAT_TA_28454.pep
TPSKAKYRRETDSEQVPRGKDEKDFEKRVKECLKLPGGKRMGHNEMTVPLTSAAIREVDVVGIFRYKDTWPLCLEFLRSGKIDVKPLITHRFGFSQGEVEEAFEVSARGRDAIKVMFNL

SEQ ID NO: 134037 - protein, 104 aa, Triticum aestivum
  unsure (1)..(104): unsure at all Xaa locations
  Clone ID: PAT_TA_28455.pep
WELVKKNTXFLIKQFGNSNAKVQFSKEPNNLYNVHSYKFSGLANSKTVAVQPSAGEDKAVVLSTTKTKKQNTPAKLQHKTLMRKEFRKMAKSVKNQVLTPEFCT

SEQ ID NO: 134038 - protein, 140 aa, Triticum aestivum
  Clone ID: PAT_TA_28456.pep
RPASNIHQEVPCILPPSSHRDLHDVGCFSLYSFLKVPLRRRRRRSGGAWACWGPCRPCSSSPRALAFIQPPAARESPVREPALAFILPPAARESPVREPVLAFILPLAAYRVCMRNPGPDRRGHGRRRTGSAFAIWGRTR

SEQ ID NO: 134039 - protein, 102 aa, Triticum aestivum
  Clone ID: PAT_TA_28457.pep
SRRKEASTMSGRGKGGKGLGKGGAKRHRKVLRDNIQGITKPAIRRLARRGGVKRISGLIYEETRGVLKIFLENVIRDAVTYTEHARRKTVTAMDVVYARFTS

SEQ ID NO: 134040 - protein, 214 aa, Triticum aestivum
  Clone ID: PAT_TA_28458.pep
KLRQRWRIGDACHRKRKSSLRALGPSWPRSRLSCTLAWVNASSLVRSSAPLSSTLLTALKMGFHRWASRFTTPIARLSVLASVVSGLWRESTVMACAMASCLSCRSSSPTATSLLLAGRTKSTWMLRPSCLKNAPTFSLYIKLASSLSALASTVASGHEEEVDAMQASCCGSGWLSTVAATALLQLKAKASTRKRRRKAAMANRDDCGRVGRPG

SEQ ID NO: 134041 - protein, 62 aa, Triticum aestivum
  Clone ID: PAT_TA_28459.pep
ITIPGALVSGNWNEYKSCSAARGGRTYNSGSDRVTLARGTNYFICSVPGHCQAGMKMAVTAA

SEQ ID NO: 134042 - protein, 90 aa, Triticum aestivum
  Clone ID: PAT_TA_28460.pep
MSAGSERSNAAYATPAAVLADFSRGSGPSVSGGAAGTGTGSGRSQAEGGARKKPPLRLAADDTKPVLRDPISRSDPMETEQAVLRLPPFP

SEQ ID NO: 134043 - protein, 126 aa, Triticum aestivum
  unsure (1)..(126): unsure at all Xaa locations
  Clone ID: PAT_TA_28461.pep
DPKRGDLGVIAPIAIGFIVGANILAGGAFDGASMNPAVSFGPAVVTGVWENHWVYWXGPFAGAAIAALXVYDICFIXGQRPHEQSPPPTTENSLSISSIHHRHERLKSDSKKSSKCTPSVSSSISI

SEQ ID NO: 134044 - protein, 164 aa, Triticum aestivum
  unsure (1)..(164): unsure at all Xaa locations
  Clone ID: PAT_TA_28462.pep
MGSGGRTDLDGGAVAPLTICVIGTGGFIGSHLCEKLMAETQQTVLAVDVYCDKIRHLVDPPPPHLAGRISFHRLNIKNDSRLEGLIKMADLTINLAAICMPADYNTRPLDTIYSNFIDALPVVRXENSKRLIHFSTCEVYGKTIGSFLPKDHPLRKVICILIRR

SEQ ID NO: 134045 - protein, 286 aa, Triticum aestivum
  Clone ID: PAT_TA_28463.pep
MAAVQKYTVALLLAVALVAGPAVSYADYAPGAPATPAAPGTQPKATTPEQKLMEDINNGFKAAVAAAAGVPAADKYKTFEASFSAASNKAFADVLKAAASGQMAAQSASMASLSKSLEASYKLAYDKAQGATPETKYDTYVASLTESLRVISGAFEIHSVKPAAEEVKGIPAPQLKTIDQIDAAYRSAATAADAAPVNDKFTVFESTFNKAIKETTGGAYDNYTFVPALESAVKQAYAATVASAPEVKYAVFQAALSKAINAMVEAEKDAKPAAAGAGAAAGGYKA

SEQ ID NO: 134046 - protein, 121 aa, Triticum aestivum
  Clone ID: PAT_TA_28464.pep
TIPQSPPIPPSEQLASPAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134047 - protein, 108 aa, Triticum aestivum
  Clone ID: PAT_TA_28465.pep
MAPKKEKAPAASSKPSKSGGGKQKKKKWSKGKQKEKVNNAVLFDQATYDKLLTEVPKYKQITPSVLSERLRINGSLARRAIKDLMERGLIRMVSIHSSQQIFTRATNT

SEQ ID NO: 134048 - protein, 114 aa, Triticum aestivum
  unsure (1)..(114): unsure at all Xaa locations
  Clone ID: PAT_TA_28466.pep
MAADAASAAVKKLTLKSSDGEDFEVEVAVAMASQTIKHMVEDGCADNIIPLPNVTAKILSKVIEYCTQHAPKADDAARRRLRHRPSSXDEEKLKAYDVEFVKVEQATLFDLILA

SEQ ID NO: 134049 - protein, 198 aa, Triticum aestivum
  unsure (1)..(198): unsure at all Xaa locations
  Clone ID: PAT_TA_28467.pep
LSIHIRAHHGFGWVGEWANTGSELSCKLSGQMDLTRIETLYHAEKDKTEAHILELVVWLHHLISKSRTANGDIRSPIKSPVRSPTQKGHTIRLQLDPANNSSPILTXQEDQDMLRCVKYRKFVPGISKSQEFDTKSRHDKHSRLCKSNSHSPTSGNRKDLLSFRRFSMLPVIDFEIDRTKALDLIDRLDGLEIQSGIN

SEQ ID NO: 134050 - protein, 69 aa, Triticum aestivum
  Clone ID: PAT_TA_28468.pep
ASRDHCTCTEPPLSLGPPLISYGRRILATTRRDQSSSSPKKVSKIAILPSGRAGMSCAWPASKFKELSL

SEQ ID NO: 134051 - protein, 127 aa, Triticum aestivum
  Clone ID: PAT_TA_28469.pep
PHQPPPPQLLHLHLSQLQGRKRSAISGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134052 - protein, 153 aa, Triticum aestivum
  Clone ID: PAT_TA_28470.pep
EHTAAAVDADTASSSSARAGASHADAGHRGGPAPLPRPAGCLLRQQPVLPRATAATSGSAAGAASSFTSSTTAGSASAHGPPWSLVSTTAGASASGSAAAAGSGSLVSSVSAAAGASSLVSSTSTGAAGASTSAIAFVDARKCPEWQKVASSS

SEQ ID NO: 134053 - protein, 246 aa, Triticum aestivum
  Clone ID: PAT_TA_28471.pep
MKGGDIEAGTSGGTAAAPAGALYPGMAESPELRWALIRKIYVIVSLQLLLTAVVAAVVVKVPAIPHFFASSYAGLGLYIFLLILPFIVLCPLYIYRQKHPVNLLLLGVFTVAISFAVGMTCAFTSGKVILEAAILTTVVVFSLTAYTFWAVKRGKDFSFLGPFLFASLIMLLVFGFIQILFPLGKLSHMIYGALAALIFSGYIVYDTDNIIKRYTYDEYVWAAVSLYLDIINLFMALLTLFSAGDS

SEQ ID NO: 134054 - protein, 342 aa, Triticum aestivum
  unsure (1)..(342): unsure at all Xaa locations
  Clone ID: PAT_TA_28472.pep
SFPGLKLTEPQVKCYMQQLLRGLEHCHSRHILHRDIKGSNLLIDNRGILKIADFGLASFFDPEQRHPLTSRVVTLWYRPPELLLGATNYGVAVDLWSTGCILAELYAGKPIMPGRTEXEQLHKIFKLCGSPSEDYWRKSKLPHATIFKPQHPYARRVTDTFKDFPSPALALVDVLLSVDPADRRTASSALQSEFFTTKPYACNPSSLPRYPPSKEYDAKRRDEEGRRQGTAGGKQHPERRTRESKAVPAPDANAELVSSLQKRQAQANTKSRSEMFNPCKEDSASGFPIEPPSSTHIIELPGDSKHVYXRRTFHSGPLVYPSKTGNKQTWRTSCTCRFRNPD

SEQ ID NO: 134055 - protein, 123 aa, Triticum aestivum
  Clone ID: PAT_TA_28473.pep
TIVDAVAAHDRSTMRKVSELAPATDKPNTNDKNLWLEQIRNKVGELAPTADKPNTNDKNLWLEQIRNKTFDLKPVGSAKPTSMIAPARASSGNLRVAAIIEKANAIRQAVGSDDEDDDNWSDT

SEQ ID NO: 134056 - protein, 144 aa, Triticum aestivum
  Clone ID: PAT_TA_28474.pep
GPPPLQPVFPRRRPPLLARQQAPPPPSPPRPQPALPLPQPPWSRPRLAPLALWALRPPARRQLLARAPWSPPSQRLPVPPPWSPQPRRGQAPRLRPPPARGPPPSSRPPRRPLASPPRAPPPSARPMGSGPGRSSDHTHKQIKR

SEQ ID NO: 134057 - protein, 162 aa, Triticum aestivum
  Clone ID: PAT_TA_28475.pep
AGRVGKKTRLSATDISALASMKNVARCDTWCELQNPANHRVFERKLRPRPLGRGHACLGVTQRHPPPPLSLSLSLSVLYPSRDHCTCKSLSLSRPSPCVIRPAHPSLGLPPLATTRRDQSSSSPKKVSKIVILPSGRAGGRACHVPGLLPTSKSSLFRPASN

SEQ ID NO: 134058 - protein, 122 aa, Triticum aestivum
  Clone ID: PAT_TA_28476.pep
PRVRRPSDSTSARSSRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134059 - protein, 103 aa, Triticum aestivum
  Clone ID: PAT_TA_28477.pep
MSGRGKGGKGLGKGGAKRHRKVLRDNIQGITKPAIRRLARRGGVKRISGLIYEETRGVLKIFLETVIRDAVTYTEHARRKTVTAMDVVYALKRQGRTLYGFGG

SEQ ID NO: 134060 - protein, 96 aa, Triticum aestivum
  Clone ID: PAT_TA_28478.pep
KSIFFMMNSLNKRRIPNLYHFATLYSQILFFPSLYAQVVPHMSCALGSFVIPCSFHSQARPLSGFISLYCAAKLKSRLGAYMPEDVSYIFLDLWKM

SEQ ID NO: 134061 - protein, 203 aa, Triticum aestivum
  Clone ID: PAT_TA_28479.pep
MKNVAKCDTWCELQNPANHRVFERKLRPRPLGRGHACLGINTRQIWRKTLSILHPLRSADPSLHADADLSGPFLFLLSFGLFQLLAGKFHFGIVLGWVTVASLFLYFVFSMLSGGRRGDLDLYRCVSLVGYCMLPMVIFSAVSLFLPRGGGLIFGMGMGFVLWSTRVCTRLLAELASSGDEHRGLIAYACWLVYMLFSLLVIF

SEQ ID NO: 134062 - protein, 409 aa, Triticum aestivum
  unsure (1)..(409): unsure at all Xaa locations
  Clone ID: PAT_TA_28480.pep
MCSHAEPTTTCVTCPPPSQGXLITVLSIRXGGIRGLIPFNNLXFLESKLQELDGPDARIADYFDVIAGTSTGALVTSMLAAPGENKRPLFAAKEINKFYLDNGPKIFPQRSWGLLTPIGNMFGAVMGPKYDGKFLHDKIKSLTNDVTVADTVTNIIVPTFDIKYLQPIIFNTYEAKVDPLKNAHLSDICISTSAAPTYFPAHYFTTRDPTGKQPDREYHLIDGGVAANNPTMAAMSMITQEVMRRNPDFTHGKPAEYSNYLIISIGTGTAKQAEKYTAPDCAKWGVLRWLKDGRFTPLLDIFSHASADMVDIHAAVLFQSLRVEKNYLRIQDDSLTGHTSSVDISTKENMEALIGIGNKLLKMNVARVNIDTGMYEPVDDEGTNEEALARFAKKLSNERKLRQANLNSQ

SEQ ID NO: 134063 - protein, 283 aa, Triticum aestivum
  unsure (1)..(283): unsure at all Xaa locations
  Clone ID: PAT_TA_28481.pep
MASQDHHHHHGGHSHDDDHHHRHHHGDAAGKGAGAGSWVGEDGRVWHSHDGLAPHSHEPIYSAGDFSKRAPPLDSRSFADRAFTVGIGGPVGTGKTALMLALCTCLRDKYSLAAVTNDIFTKEDGEFLVKHGALPEERIRAVETGGCPHAAIREDISINLGPLEELSNLYKADLLLCESGGDNLAANFSRELADYIIYIIDVSGGDKIPRTGGPGITQADLLVINKTDLASAVGADLAVMERDALRMRXGGPFLFAQVKHGVGVXEHLWNHVLAGPGKPPATG

SEQ ID NO: 134064 - protein, 202 aa, Triticum aestivum
  unsure (1)..(202): unsure at all Xaa locations
  Clone ID: PAT_TA_28482.pep
FVLNEKSGKLGYTKKQEERHFRGVITLEECNLEEVDEEEPSKSLKDSKKANGPEKGPSLVFKITNRVAYKTVLKAHSAVVLKAEEXADKXEWVNKIKAVIQSKVVFQGCNSXGGPLKQSQPDSSTDAMIRRXTVPEEXLRWMSQEVRGYVEAVLNSLAANGPAPNIESRSRSADGRRRSENGDPNSSSRRTPNRMPPAPPRY

SEQ ID NO: 134065 - protein, 119 aa, Triticum aestivum
  Clone ID: PAT_TA_28483.pep
MAKSSFKLEHPLERRQAEANRIREKYSDRIPVIVEKAGKSDIPDIDKKKYLVPADLTVGQFVYVVRKRIKLSAEKAIFIFVKNTLPPTAALMSAIYEENKDEDGFLYMTYSGENTFGLL

SEQ ID NO: 134066 - protein, 359 aa, Triticum aestivum
  unsure (1)..(359): unsure at all Xaa locations
  Clone ID: PAT_TA_28484.pep
MMNHATFAAEEAVTAVAAPAQPGRHFVSLPPRRARDCRKASLGRMDLATSAVLMGGSLLDSMKASSPRHPMSPAGADNEEWIEKHPSALEWFEGVLAAAEGKQIVMFLDYDGTLSPIVQDPDRAVMTEEMRDAVRGVAQHFPTAIVSGRCRDKVFNFVKLEELYYAGSHGMDIKGPTKVSNHKAKADEVLCQPATKFLPVIQKVYKTLTAKMESIPGAMVENNKFCLSVHFRCVEEAEWDALGREVKAVLDVYEDLEITEGRKVLEIRXPTIEWHKGKALLFLLECLGFAGRGDVFPIYIGDDRTDEDAFEVLRNMGQGIGILVTKFPKETSASYSLREPAEVKEFLHKLVKSNETKKG

SEQ ID NO: 134067 - protein, 124 aa, Triticum aestivum
  Clone ID: PAT_TA_28485.pep
MAQGSGGATAVLALLLLCVLLHGDFAESKVYTVGDRAGWALSSGGWPRGKRFRAGDVLLFKYGRGAHNVVAVNAAGYKSCSAARGGRTYNSGSDRVTLARGTNYFICSVPGHCQAGMKMAVTAA

SEQ ID NO: 134068 - protein, 191 aa, Triticum aestivum
  unsure (1)..(191): unsure at all Xaa locations
  Clone ID: PAT_TA_28486.pep
HEKELRSQIILEAEEFKKGFVEKRKXTYETSKDHNREREKLFLSNQEKFHKGADKQYWKAISEXLIPQEIAHIEKRTGKKDKDKKPGIIVVQGPKPGKATDMARMRQILSKLKHTPPPHMKPPPPPAAAPAGKDGAPAAAGKDGAKAAATPAAKDAPANGTVPEKENAAPAAAAAPAAAAPAPPAEPIAAA

SEQ ID NO: 134069 - protein, 59 aa, Triticum aestivum
  Clone ID: PAT_TA_28487.pep
MKFFSAFDPWPVFFRREWGRNWPFIAGFAVTGALITKMTAGFTEEDLKNSKFVQAHKKK

SEQ ID NO: 134070 - protein, 124 aa, Triticum aestivum
  Clone ID: PAT_TA_28488.pep
MAQGSGSATAVLVLVLLCVLLHGDFAESKVYTVGDRAGWALSSGGWPRGKRFRAGDVLLFRYGRGAHNVVAVSAAAYKSCSAARGGRTYNSGSDRVTLSRGTNYFICSVPGHCQAGMKMAVTAA

SEQ ID NO: 134071 - protein, 61 aa, Triticum aestivum
  Clone ID: PAT_TA_28489.pep
FFFFFFFYSELQPGNCMKLLHTTQIMNSHKARRYATNGHARRMHRSKKIKRRAEIMQSGRC

SEQ ID NO: 134072 - protein, 206 aa, Triticum aestivum
  Clone ID: PAT_TA_28490.pep
MEKAAGNQAGKVLKKGKKKQAKDELDRQKQAEKKRRRLEKALANSAAIISELEKKKQKKKEEQERLDEEGASIAEAVALHVLVGEDSDESRHLVLNKHRRCNDWDPSAGLDFTLDTQGAADIYSPGGLMCGNQAYASRGRWIDWGNAHPLPTWGEVRDLKASYYQGTCHQSTVACPGFMAAQAVSSLQIREDSSSPRPGSRRRDRR

SEQ ID NO: 134073 - protein, 132 aa, Triticum aestivum
  Clone ID: PAT_TA_28491.pep
MSMAAAARAATRAPGRAAARFVQARLRSSGKVLSEEERAAENVYIKKMEQEKREKLARKQGPSTGEQAPSTPSAAAGDVNTGGAASTVSASAAGTSTDKNRNYAVLAGTLAGLSALGWYLLSKPKKTEEVVD

SEQ ID NO: 134074 - protein, 82 aa, Triticum aestivum
  Clone ID: PAT_TA_28492.pep
RRRRPRWRSRSPPRRSRRRRKPPRRWRPKSRRLPPSRLRRPRRRRRQQLRQRRRRSPSQQLRPNREARGARRGRDRDQGGRG

SEQ ID NO: 134075 - protein, 315 aa, Triticum aestivum
  Clone ID: PAT_TA_28493.pep
MRRRSHALRAQLVARDSYQSCRAGTAAAGAALAPCGGPAPALIQISNPKMRSVWLTVSLNAMMIMQGCDASILLDNAQSEKTAPPNGSLGGYPVIDAIKAQLEKACPGVVSCADIVALAARDAVSYQFKASLWQVETGRRDGPVSLASNTGALPSPSAGFNGLLQSFAAKGLDVNDLVALSGAHTIGKASCSSVTPRLYQGNATSIDPLLDSTYAKTLMNACPNNPASTSTVDLDGATPFKFDGSYYTNLQNKRGVLASDAALTQNAAAATIVNDLTNPIKFYAAFSMSMKKMGRVDVLTLKNGQGKIRTKCNVP

SEQ ID NO: 134076 - protein, 67 aa, Triticum aestivum
  Clone ID: PAT_TA_28494.pep
FHQYYTVSSILHSFIMGSKFHKVKTKTKDKHSINPSFRDLKQIYKMGKKKVRRRRLEEEDYYDATKM

SEQ ID NO: 134077 - protein, 183 aa, Triticum aestivum
  Clone ID: PAT_TA_28495.pep
MSSPSKRREMDLMKLMMSDYKVEMVNDGMQEFFVEFKGPTESIYQGGVWKVRVELPDAYPYKSPSIGFINKIYHPNVDEMSGSVCLDVINQTWSPMFDLVNVFEVFLPQLLLYPNPSDPLNGEAAALMMRDRPAYEQKVKEYCEKYAKPEDAGITPEDKSSDEELSEEEDDSGDEAILGNPDP

SEQ ID NO: 134078 - protein, 278 aa, Triticum aestivum
  Clone ID: PAT_TA_28496.pep
AMGVNMETAQFFKRDFEENGSMERVTLFLNLANDPTIERIITPRIALTTAEYLAYECGKHVLVILTDMSSYADALREVSAAREEVPGRRGYPGYMYTDLATIYDRAGRIEGRTGSITQIPILTMPNDDITHPTPDLTGFISEGQIYIDRQLHNRQIYPPINDLPSLSRLMKSAIGEGMTRRDHSDVSNQLYANYAIGKDVQAMKAVVGEEALSSEDLLYLEFLDKFERKFVTQGAYDTRNIFQSLDLAWTLLRIFPRELLHRIPAKTLDQYYSRDASH

SEQ ID NO: 134079 - protein, 249 aa, Triticum aestivum
  Clone ID: PAT_TA_28497.pep
MAEHKEESVMDKITEKFHGGSSSSSSSDDDERKSGSSSSVKAKIYRLFGREKPVHSVLGGGKPADLFLWRNKKISGGVLAGATAIWLLFEVLEYHLLTLLCHGFILTLGILFLWSNASAFVNKCPPNIPEAKIPEDLAVNVARSLRYEINRGFASLRAIGQGRDLKKFLIVVAGLWILSFLGSCCNFLTLFYIVFMVLYTVPVLYEKYEDKIDAFGEKAMVELKKYYAIFDEKCLSKIPKGPSKDKKQH

SEQ ID NO: 134080 - protein, 103 aa, Triticum aestivum; identical to SEQ ID NO: 107316
  Clone ID: PAT_TA_28498.pep

SEQ ID NO: 134081 - protein, 156 aa, Triticum aestivum
  unsure (1)..(156): unsure at all Xaa locations
  Clone ID: PAT_TA_28499.pep
LACFSNNLLRREPLKLVDGGESQRTFVYIKDAIEAVLLMIENPARANGHIFNVGNPDNEVTVRELAEMMTEVYAKVSGEPPLEEPVVDVSAKEFYGEGYDDSDKRIPDMTLINKQLGWNPKTPLKDLLETTLTYQHKTYKEXVKTQMCLATATPSS

SEQ ID NO: 134082 - protein, 103 aa, Triticum aestivum; identical to SEQ ID NO: 107316
  Clone ID: PAT_TA_28500.pep

SEQ ID NO: 134083 - protein, 90 aa, Triticum aestivum
  unsure (1)..(90): unsure at all Xaa locations
  Clone ID: PAT_TA_28501.pep
MIMIMTELELDRFVYVFDMCVALMILSVQTCRSRTRRSRXRRRRPRWRHPWSPRRSRRRRRPPRRRWPKSKRLLPPSRLRRLRRRRRPPL

SEQ ID NO: 134084 - protein, 99 aa, Triticum aestivum
  unsure (1)..(99): unsure at all Xaa locations
  Clone ID: PAT_TA_28502.pep
MGAGAEPREEEPLEAEEGSGGKEEKAAVSCSICLDAVVAASAGKXPCVRLQXGHVLHLDXFGSPFNAQGVIQCPNWPQIEXGNWLYANGFRPFNYIYMG

SEQ ID NO: 134085 - protein, 246 aa, Triticum aestivum
  Clone ID: PAT_TA_28503.pep
KAATLRRAATYEAGTAAPKGAPYPGTTESPELRWALIRKVYVVLCLQLLLTAVVAVVFVKVRSIPHFFASSYVGLGLYIFILIFPFIVMCPLHFYRQKHPVNLLLLGVFTVAISFSVGLTCAFTSGKVILEAGILTIVVVLSLTAYTFWAARRGKDFSFLGPFLFACLMILLVFGFIQIFFPLGKLSHMIYGALAALIFIGYIVYDTGNIIKRYKYDEYVWAAVTLYLDIINLFLGLMTLFRAGDS

SEQ ID NO: 134086 - protein, 245 aa, Triticum aestivum
  Clone ID: PAT_TA_28504.pep
WARGSRRCGQLEVSIRAKGNVTQTEDALLRACMLFSNLSYTATSAVVCLVGAFASGQVHKIVGGQPMPRLFRLAVSAGVGLTAGKMMYYESLHASSLYILGRGEEPFERLKMELANIILTKHSDEKLSVEAVKKHFFAENLYTDQYQDKLLFRWRQRYSYVDSTYLERVKEIEANNSVDKDKTMSAQTTGSFGNLMEDPLACILGSPNSDMETDKPPERTATVLRKRDLRAQRRSQRHHRRHAAL

SEQ ID NO: 134087 - protein, 176 aa, Triticum aestivum
  Clone ID: PAT_TA_28505.pep
MASTTFSSAFSILSLPSSSPSPSASAPRTLPVANRRRRAVAVASTATESPKVLELGDAIAGLTLEEARNLVDHLQERLGVSAASFAPAAAVAAPAAAAAEEAPVEKTEFDVVIEEVPSSARIATIKVVRALTNLALKEAKDLIEGLPKKLKEAVSKDEAEEAKKQLEGVGAKVSIA

SEQ ID NO: 134088 - protein, 199 aa, Triticum aestivum
  Clone ID: PAT_TA_28506.pep
VQSKSLNEDPLEGKSGASSRGNSSSNVGKSSLLNSLVRRKRLALTSKKPGKTQCINHFKINDSWYLVDLPGYGYASAPQVARKDWDEFTRNYFLSRDNLVSVFLLIDASIPAKKIDLDYASWLGQNKVPMTLVFTKCDKRKKKKNGGKRPEENVECFQNLIREYFEAAPPWIMTSSVTNQGRDEILLHMSQLRNYWRKH

SEQ ID NO: 134089 - protein, 127 aa, Triticum aestivum
  Clone ID: PAT_TA_28507.pep
MATELAYAPPMKSGKAGFEGPQEAQHRIRITLSSKSVKNLEKVCSDLVRGAKDKLLRVKGPVRMPTKVLNITTRKSPCGEGTNTWDRFEMRVHKRVIDLVSSPDVVKQITSITIEPGVEVEVTISDQ

SEQ ID NO: 134090 - protein, 329 aa, Triticum aestivum
  unsure (1)..(329): unsure at all Xaa locations
  Clone ID: PAT_TA_28508.pep
MAAPPPKQEELQPHAVRDQLPAVSYCLTSPPPWPEAILLGFQHYLVMLGTTVIIPTALVPQMGGGNEEKARVVQTLLFVAGINTLLQSFLGTRLPAVIGGSYTFVAPTISIVLAARYSGIADPHEKFLRTMRGTQGALIVASTLQIIMGFSGLWRIVVRLLSPLSAAPLVALVGFGLYELGFPSVAKCIEIGLPEIILLVALSQYIPHLVPLLGTAFERFAVIMSVAIVWLYAFFLTVGGAYKNAAPKTQFHCRTDRSGLVGGXLPWITVPYPFQWGAPTFDAGECFAMMAAAFVALVESTGAFIAVSRYASATPCPPSVMSRGIXLXG

SEQ ID NO: 134091 - protein, 237 aa, Triticum aestivum
  unsure (1)..(237): unsure at all Xaa locations
  Clone ID: PAT_TA_28509.pep
KRTPPXWVKTAVADVDELITKAAKKGQMPSQIGVLLRDQHGIPLVKSVTGSKILRILKAHGLAPXIPEDLYFLIKKAVAIRKHLERNRRDKDSKFRLILVESRIHRLARYYKRTKKLPPTWKWEVKAVLDDYPKLCLTKGRKVLEIRPSIEWNKGHALKFLLKSLGYAGRSDVFPIYIGDDRTDEDAFKVLQNMGQGIGILVTKFPKDTSASYSLREPAEVKEFMRKLVKSNGIKKG

SEQ ID NO: 134092 - protein, 73 aa, Triticum aestivum
  Clone ID: PAT_TA_28510.pep
MQPKSGGRLRPRLNTGEMNHWTPQALFSLQEAAEYHIVDVFEKANLCAIHAKRVTIMQKDIQLARRIGGRRPW

SEQ ID NO: 134093 - protein, 78 aa, Triticum aestivum
  Clone ID: PAT_TA_28511.pep
PIMHACMHEVWRMQHARSGRAQLGHWKPEGTFLPQLLRTRLRAMDKVRLYSFQLPDTNAPGIVIYCHYLPVSGLGNLR

SEQ ID NO: 134094 - protein, 163 aa, Triticum aestivum
  unsure (1)..(163): unsure at all Xaa locations
  Clone ID: PAT_TA_28512.pep
LLMRRDVATHKGLPILGIYRSFAXPVGVXSQLVMGVGPAVAIPAAVKAAGLQINDIDLFEINEAFASQYVYCSKKLDLDPAKVNVNGGAIALGHPLGATGARCVSTLLNEMKRRGKDCRFGVISMCIGSGMGAAAVFERGDAVDELTNARGGPSLNWLSKDTV

SEQ ID NO: 134095 - protein, 201 aa, Triticum aestivum
  unsure (1)..(201): unsure at all Xaa locations
  Clone ID: PAT_TA_28513.pep
KTKTKWGTEIXGKGSLQPWSHAYTWEEDFAASDDDDDVLEIEERKPEKKKKEDKPKKIKAAAKEEKKATKCVQIEEIPEDNTAGCDAIRKAFAMGNGKGKAKELSPQDAALLIQMNYRPHLAHRSQVLRCLRDLAVAKAKLKELRSLFYNLSYRRRLSHDHEECQRFSEKIIVLLLTVDALEVSSVMTCLRLLIAIAVFWI

SEQ ID NO: 134096 - protein, 207 aa, Triticum aestivum
  unsure (1)..(207): unsure at all Xaa locations
  Clone ID: PAT_TA_28514.pep
TFSNPGVQEDAACGPLIDAVAIKELPTPYPTKDNLIKNDGFQIGPQVFKNSSVGVLLPPKQXKDVTSPLPGWIIESLKAVRYIDAAHFSVPAGQYAVELVAGRESAIAQVIRTVPNRAYNLSYVVGDAKNGCHGSMLVEAFAANVTQKVPFQSTGKGGFKAASLRFVAAGVRTRVTFYSSYYHTKVTDGVSLCGPVLDQVKIMPLKL

SEQ ID NO: 134097 - protein, 237 aa, Triticum aestivum
  unsure (1)..(237): unsure at all Xaa locations
  Clone ID: PAT_TA_28515.pep
VLTLWDHRFLLPVNSWNYSTVSPIEKLCLLIPPHNSISSTXRPLVFVAAGCNEVSLWNAENGSCHQMFRTAGTENDAVTPKTPSKPLNKTTAKDVRRAGNYKYRIEELADPPPRLPGIRCLLPLPGGDLLTGGTDLKIRYWDQARPEQSFCIAGPSAKGVGNDEFYDIRSSYGVQVVQESCKPPTPASRLTHKTQLAMAAADSAGCHRDAILALASVNLSSQRLISASRDGAVKVWK

SEQ ID NO: 134098 - protein, 98 aa, Triticum aestivum
  Clone ID: PAT_TA_28516.pep
RRLSHDHEERQRFSEKIIVLLLTVDALEGPDFMVRTAKKSMLEELESMLEIVDPQPPGKQRSFNRRKFDLPEGGAIPNEKTAGVNNAVRVINTGKGKQ

SEQ ID NO: 134099 - protein, 74 aa, Triticum aestivum
  Clone ID: PAT_TA_28517.pep
MGVMGRLKIFVVKEPVVAASCLIAGFGLFLPAVVRPMLDSWETEKNAKTPVELKDVVAGVTGQESLVINVSSLC

SEQ ID NO: 134100 - protein, 369 aa, Triticum aestivum
  unsure (1)..(369): unsure at all Xaa locations
  Clone ID: PAT_TA_28518.pep
MAASVATSPACTRLIPSSPLSASAYTAAPSLVRLAGSSRRLRRALRVSAAAEPADALPGPGAGDLDGVVPAGLLEELPEGLAFQGDMGGGFAPGGSGGGGDDGNKMLDRGINAAIVLGASTYALTKLLTVDQDYWHGWTIFEILRYMPEHNWSAYEEALKANPVLAKMMISGVVYSLGDWXIAQCYEGKPIFEFDRTRMFRSGLVGFTLHGSLSHYYYHFCESLFPFKDWWAVPVKVAFDQTAWSALWNSIYFVALGFLRWESPSTIYKELKATFFPMLTAGWETVGHLAHLITYGVGPXEQRLLWVDCVELIWVTILSTYSNEKSEARILRRSSHNRYAGQLQIAHTSCFVVFYFLRPKKFVPSLSLK

SEQ ID NO: 134101 - protein, 212 aa, Triticum aestivum
  unsure (1)..(212): unsure at all Xaa locations
  Clone ID: PAT_TA_28519.pep
METSFLPTARPLPAFQTLAAAPRCPRPLRRSTIRAAISRGRKEDTVAVVREQLEGCYLLAGIRYEGLTVKQFQGIRDALPESCHLLXVAKNTLVGKXAIEGTPWEALKPCMKGMNAWLFXVHTEEVPVALKPYRAFQKEERVXETNDFIRGGVXEGKXLRPGDSIARDHPTRARVYPTLGPLMGGTPSSHLQGTKDSPCLANQLQKIPRAGP

SEQ ID NO: 134102 - protein, 223 aa, Triticum aestivum
  unsure (1)..(223): unsure at all Xaa locations
  Clone ID: PAT_TA_28520.pep
MEKAAGNQAGKVLKKGKKKQAKDELDRQXKQAEKKRRRLEKALANSAAIISELEKKKQKKKEEQERLDEEGASIAEAVALHVLIGEDSDESRHLVLNKHRRCNDWDPSAGLDFTLDTQGAADIYSPGGLMCGNQAYASSGRWIDWGNAHPLPTWGEVRDLKASYYQGTFHQSTVACPGYMAAQAVSSLQIQEDSSSPGQGVATATVVNRMLGGTNRLNLYREI

SEQ ID NO: 134103 - protein, 322 aa, Triticum aestivum
  unsure (1)..(322): unsure at all Xaa locations
  Clone ID: PAT_TA_28521.pep
MCSQADPTLTCPPPSQGRLITVLSIDGGGIRGLIPSTILACLESKLQELDGPDARIADYFDVIAGTSTGALVTSMLAAPGENKRPLFEAKDINTFYLENGPKIFPQRRLGFLTPMANLFGAVKGPKYDGKFLHDKIKSLTNDVTVADTVTNIIVPTFDIKYLQPVIFNTYEAKVDPLKNAHLSDICISTSAAPTYFPAHYFTTHDPAGKLPDREYHLIDGGVAXANNPTMAAMSMITKEVLRXGNPDFTHGKPAEYHRYLIISIGTGTAKQAEKYTAPXCAKWGVLRWLYDGGSTQLSTXFSNANADMSTSPAIIIKALTLR

SEQ ID NO: 134104 - protein, 289 aa, Triticum aestivum
  Clone ID: PAT_TA_28522.pep
SAPDHHHHHHHGGRSHDDDHHHGDAAAATAGKGAGAGAGAGLWVGEDGRVWHSHDGLAPHSHEPIYSAGDFSKRAPPLDSRSFADRAFTVGIGGPVGTGKTALMLALCTSLRDKYSLAAVTNDIFTKEDGEFLVKHGALPEERIRAVETGGCPHAAIREDISINLGPLEELSNLYKADLLLCESGGDNLAANFSRELADYIIYIIDVSGGDKIPRKGGPGITQADLLVINKTDLASAVGADLAVMERDALRMREGGPFVFAQVKHGVGVEEIVDHVLRAWEIATGNRRR

SEQ ID NO: 134105 - protein, 184 aa, Triticum aestivum
  Clone ID: PAT_TA_28523.pep
MSSPSKRREMDLMKLMMSDYKVEMVNDGMQEFFVEFRGPTESIYQGGVWKVRVELPDAYPYKSPSIGFINKIYHPNVDEMSGSVCLDVINQTWSPMFDLVNVFEVFLPQLLLYPNPSDPLNGEAAALMMRDHPAYEQKVKEFCEKYAKPEDAGITPEDKSSDEEELSEDEDDSGDEDIVGKPDP

SEQ ID NO: 134106 - protein, 140 aa, Triticum aestivum
  unsure (1)..(140): unsure at all Xaa locations
  Clone ID: PAT_TA_28524.pep
ESGGCAVRIVVWRGVLRWLYDGGXFTPLIDIFSHASADMVDIHAAVLFQALRIEKNYLRIQDDSLTGHTSSVDIATKENMEALIXGIGKNLLKKNVSRVNIDTGMYESVEGEGTQXEALTRFARKLSEERKLRQTNLNSK

SEQ ID NO: 134107 - protein, 118 aa, Triticum aestivum
  Clone ID: PAT_TA_28525.pep
SLRFTTSARSLRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134108 - protein, 287 aa, Triticum aestivum
  unsure (1)..(287): unsure at all Xaa locations
  Clone ID: PAT_TA_28526.pep
MAAVQQYTGALFLAVALVAGPAVSYAAYAPGAPATPAAPGTQPKATTPEQKLFEDINNGFKAAVAAAAAVPAADKYKAFQTTFIASSNKAFADALKAAASGQTPAKSDSMSRLSTSLESSFKLAYDFAEGATPETKYDTYVASLTESLRVISGAFEVHAVKPAEEEVKGVPAPQLKTIDQIDAAYRTAATAXANAVSADKKFTIFESFFNRAIKENTGGKYDNYKFVPALESAVKQAYAATVASAPEVKYAVFQAALSKAISAMVEAEKDAKPAGAGAGATAGGYKA

SEQ ID NO: 134109 - protein, 93 aa, Triticum aestivum
  Clone ID: PAT_TA_28527.pep
PQTCPAASRRGRWTCPASAACSPPPTSGSSAPRSSYAAPAKPASPSPSGANAGPTQSWRQRRHARMREEFRSRDRARGRRGKGRRRCQGRITE

SEQ ID NO: 134110 - protein, 158 aa, Triticum aestivum
  unsure (1)..(158): unsure at all Xaa locations
  Clone ID: PAT_TA_28528.pep
AGIRHEVGPQDPPRRHRRRRAVAVASTVTESPKVLELGDAIAGLTLEEARNLVDHLQXRLGVSAASFAPAAAVAAPAAAAAEEAPVEKTEFDVVIEEVPSSARIATIKVVRALTNLALKEAKDLIEGLPKKLKEAVSKDEAEEAKKQLEGVGAKVSIA

SEQ ID NO: 134111 - protein, 120 aa, Triticum aestivum
  Clone ID: PAT_TA_28529.pep
HHRSSSVSISVSSKPSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134112 - protein, 82 aa, Triticum aestivum
  Clone ID: PAT_TA_28530.pep
RPPGQVQPGFKQMKVLRQDRNTVCFIEFDDVSTASAVHHTLQGAVVPSSGRGGMRIQFSKNPFGRRKDLVGGMVGTLNGAPV

SEQ ID NO: 134113 - protein, 106 aa, Triticum aestivum
  Clone ID: PAT_TA_28531.pep
LESRLQATPTIPAVKKNPIAANRAKRKFVPSADSNVNRRVLKTPDVSAKTSSDSAEPRRSNRRIQPTSRLLEGLQSSLIASKITGEKLPRTNFRSATSASRGKAHG

SEQ ID NO: 134114 - protein, 153 aa, Triticum aestivum
  Clone ID: PAT_TA_28532.pep
GRVGTHPTPDLTGYITEGQIYIDRQLHNRQIYPPINVLPSLSRLMKSAIGEGMTRRDHSDVSNQLYANYAIGKDVQAMKAVVGEEALSSEDLLYLEFLDKFERKFVAQGAYDTRNIFQSLDLAWTLLRIFPRELLHRIPAKTLDAFYSRDAAH

SEQ ID NO: 134115 - protein, 282 aa, Triticum aestivum
  Clone ID: PAT_TA_28533.pep
MAAVQQYTGALFLAVAVALVAGPAVSYAAYAPGAPATPAAPGTQPKATTPEQKLMEDINNGFKAAVAAAAAVPPADKYKTFEATFSAASNKAFADVLKAAASGQMPAQSASMASLSKSLEASYKLAYDKAQGATPETKYDTYVASLTESLRVISGAFEVHSVKPAAEEVKGIPAPQLKTIDQIDAAYRTAATAADAAPVNDKFTVFESAFNKAIKETTGGAYDNYKFVPALESAVKQAYAATVASAPEVKYAVFQAALSKAINAMVEAEKDTGAATAGGYKA

SEQ ID NO: 134116 - protein, 58 aa, Triticum aestivum
  Clone ID: PAT_TA_28534.pep
RPGRRALGRVASGATCVQRLDGSRDSAIHTRYRISLRSSSMREPRYPLPRVVWPDPAG

SEQ ID NO: 134117 - protein, 135 aa, Triticum aestivum
  Clone ID: PAT_TA_28535.pep
YSSISSQSNARIEELLQEDHNAKRRREKAQKQSTLLSKLTRQLSVHDNRAAAASYSDDTSGPESGPQSPGQSGEDWRSAFSAAANGSADRSSSQNESRSRSADSRGRRYENGDANGANSGSRRTPNRLPPAPPKY

SEQ ID NO: 134118 - protein, 147 aa, Triticum aestivum
  unsure (1)..(147): unsure at all Xaa locations
  Clone ID: PAT_TA_28536.pep
LLPLRPGVQRLIDEALXKGVKVAVCSTSNEKAVSAIVSCLLGPDRAEKITIFAGDVVPRKKPDPAIYLLAATTLEVDPSSCVVVEDSNIGLSAAKAAGMKCIVTKSGYTADEDFVIADAVFDCIGDPPEGRFDLEFCANLLQKQFVS

SEQ ID NO: 134119 - protein, 186 aa, Triticum aestivum
  Clone ID: PAT_TA_28537.pep
TRDAMIRRPADPEEELRWMSQEVRGYVEAVLNSLAANVPKAIVLCQVEKAKEDMLNQLYSSISGQSNAKIEELLQEDHNAKRRREKYQKQSSLLSKLTRQLSIHDNRAAASSYSNDSPETESPRTPGRPGEDWRSAFDSAANGPAPKHRIKIEKRLTVADALENGDPNSSSRRTPKPDAAQRPPRY

SEQ ID NO: 134120 - protein, 261 aa, Triticum aestivum
  Clone ID: PAT_TA_28538.pep
SVHASGANVHIANGACITIQYVTNVMIHGLHIHDCRPTGNAMVRSSPSHYGWRTMADGDAVSIFGASHVWVDHCSLSNCADGLVDAIMGSTAITVSNNYFTHHNEVMLLGHSDSYLKDKAMQVTIAFNHFGEGLIQRMPRCRHGYFHVVNNDYTHWEMYAIGGSAEPTINSQGNRYLAPTNPFAKEVTKRVETAQTTWKAWNWRSEGDMLLNGAFFTPSGAGASASYSRASSLGGSRRSSSMVATITSGAGALSCHKGSSC

SEQ ID NO: 134121 - protein, 103 aa, Triticum aestivum
  Clone ID: PAT_TA_28539.pep
MSGRGKGGKGLGKGGAKRHRKVLRDNIQGITKPAIRRLARRGGVKRISGLIYEETRGVLKIFLENVIRDAVTYTEHARRKAVTAMDVVYALKRQGRTLYGFGG

SEQ ID NO: 134122 - protein, 216 aa, Triticum aestivum
  unsure (1)..(216): unsure at all Xaa locations
  Clone ID: PAT_TA_28540.pep
LALAAARADAAAPSPLAAAWGTRALSTLPRDPAAASPASSPRQPAAXRPLGLSKILGYEQASRLGGTHVLPRWFSTGASNGSSDQQTSKTIAGMVQSDALKSQEGASAKVAAFSPIEATISKPRSSPLTLESLKVRRTEMMTKVTFYMIPTLLLVSKNSISTSLLIASVYHQVYMFHKEILLDYVHHDITRKWALIYFKLLLLVMAKDTMVYFDLF

SEQ ID NO: 134123 - protein, 103 aa, Triticum aestivum; identical to SEQ ID NO: 107316
  Clone ID: PAT_TA_28541.pep

SEQ ID NO: 134124 - protein, 456 aa, Triticum aestivum
  unsure (1)..(456): unsure at all Xaa locations
  Clone ID: PAT_TA_28542.pep
MEKALDRQRILLRHLEPAAGASPAASAISASACAAGESAAYHRGPCFADDVVIVAAYRTAICKAKRGSFKDTLPEDLLVPVFKALVDKTKLNPSEVGDIVVGTVLAPGSQRAIECRMAALYAGFPDTVPLKTVNRQCSSGLQAVADVAAAIKAGMYDIGIAAGVESMTVNKVDLIGKVNPKVELFAQARDCLLPMGLTSENVAQQFGITRMEQDQAAVESHRKXAAAAVAAGKFKEEIVPVHTKIVDPKTGEEKEIVVSADDGIRSNTTLAVLSKLKPAFSKDGTTTAGNASQVSDGAGAVLLMRRDVATQKGLPILGIYRSFAAVGVDPAVMGVGPAVAIPAAVKAAGLQINDVDLFEINEAFASQYVYCSKKLDLDPAKVNVNGGAIALGHPLGATGICFXSMLCAPGAHHLLDSWTGARCVSTLLNEMKRRGKDCRFGVISMCIGSGMGAAAL

SEQ ID NO: 134125 - protein, 102 aa, Triticum aestivum
  Clone ID: PAT_TA_28543.pep
PAYKPAPKVSPPAYKPAPKVSPPAYKPAPKVSPPAYKPVPKPSPPAPKPTPPPYKPPTPTPPAYKPSPPAPKPTPPPYKPPTPTPPAYKPPTPSPPPPPYHH

SEQ ID NO: 134126 - protein, 104 aa, Triticum aestivum
  unsure (1)..(104): unsure at all Xaa locations
  Clone ID: PAT_TA_28544.pep
MSGRGKGGKGLGKGGAKRHRKVLRDNIQGITKPAIRRLARRGGVKRISGLIYEETRGVLKIFLENVIRDAXVTYTEHARRKTVTAMDVVYALKRQGRTLYGFGG

SEQ ID NO: 134127 - protein, 133 aa, Triticum aestivum
  unsure (1)..(133): unsure at all Xaa locations
  Clone ID: PAT_TA_28545.pep
YIDRQLHXRQIYPPINVLPSLSRLMKSAIGEGMTRRDHSDVSNQLYANYAIGKDVQAMKAVVGEEALSSEDLLYLEFLDKFERKFVAQGAYDTRNIFQSLDLAWTLLRIFPRELLHRIPAKTLDAFYSRDAAH

SEQ ID NO: 134128 - protein, 137 aa, Triticum aestivum
  unsure (1)..(137): unsure at all Xaa locations
  Clone ID: PAT_TA_28546.pep
MATELAYAPPMKSGKLGFEGTQEVQHRIRITLSSKSVKNLEKVCSDLXVKGAKEKQLKVKGPXSRMPTKVLNITTXRKSPCGEGTNTWDRFEMRVHKRVIRLVSPPDXVKQLTLSHQPGVQVQMTINDNYYLPQILS

SEQ ID NO: 134129 - protein, 135 aa, Triticum aestivum
  Clone ID: PAT_TA_28547.pep
NARVRCTITAFSKMVGYALQAAEILSKEGISAEVINLRSIRPLDRAAINASVRKTNRLVTLEEGFPQHGVGAEICMSVVEESFEYLDAPIERIAGADVPMPYAANLERLAVPQIEDIVRAARRACYRALPMAATA

SEQ ID NO: 134130 - protein, 247 aa, Triticum aestivum
  Clone ID: PAT_TA_28548.pep
MEGDGETSAAEAALGLSPQTFINEVLNFVDDVCFQAFDYCLQEGAPTAVGAATATNKAEELKRGVNEIHHLVKDVLDKRMNNWEMYCLRKCLTVPEGFVAPEDDNSSAMVLHKDGNSDSELDAELNSLRKKLADANKESEELQREISSLERQTTYKSNLNSSIAEVLKLFEDKSVQENIQAIANTIPKLHQKMKVMKRKKVELEAMVGQNVWNVNCLRDQKRLAPGSAPSTEDIQEVNAAVNGSREE

SEQ ID NO: 134131 - protein, 296 aa, Triticum aestivum
  unsure (1)..(296): unsure at all Xaa locations
  Clone ID: PAT_TA_28549.pep
GIRRRLKEAKXAFDAXIDNGMTFFDTAEVYGTALMGAVNSESLXGRFIRERQQKGAVDVTVATKFAALPWRFGRGSVLSALKKSLERLGLPSVELYQLHWPGLWGNEGYLDGLADAYEQGLVKAVGVSNYNEKRLRDAHGRLKKRGVPLAVNQVNYSLIYRTPEENGVKAACDELGVTLIAYSPIAQGVLSGKYTPENPPTGPRGNTYTPEFLTKLQPLMNRIKEIGVSYGKNPTQVSLNWLTCQGNVVPIPGAKNAGQAMEFAGALGWSLTFDEVEELRXLAREIKGIKMPIEES

SEQ ID NO: 134132 - protein, 103 aa, Triticum aestivum; identical to SEQ ID NO: 107316
  Clone ID: PAT_TA_28550.pep

SEQ ID NO: 134133 - protein, 172 aa, Triticum aestivum
  Clone ID: PAT_TA_28551.pep
MAAAGDAGEKKMVTLKSSDGEEFEVEEAVAMESQTIRHMIEDDCADNGIPLPNVTSKILSKVIEYCNKHVQAKPADAAAAGAAAPDAAAPPAEDLKNWDAEFVKVDQATLFDLILAANFLNIKGLLDLTCQTVADMIKGKTPEEIRKTFNIKNDFTPEEEEEIRRENQWAFE

SEQ ID NO: 134134 - protein, 141 aa, Triticum aestivum
  Clone ID: PAT_TA_28552.pep
MASGGRTDLDGAAVAPLTICVIGAGGFIGSHLCEKLMAETQHTVLAVDVYCDKIRHLVDPPPPHLAGRISFHRLNIKNDSRLEGLIKMADLTINLAAICTPADYNTRPLDTIYSNFIDALPVVKYCSENSKRLIHFSTCEV

SEQ ID NO: 134135 - protein, 227 aa, Triticum aestivum
  unsure (1)..(227): unsure at all Xaa locations
  Clone ID: PAT_TA_28553.pep
MPVSRIAIGAPGELSHPDTFRAXVAEFISMLIFVFAGSGSGMAFGKLTDGGATTPAGLIAAALAHAFAXFVAVSVGANISGGXHVKPGVTFGAFVGGNISLXKAVVYWVAQLLGSVXVACLLLKIATGGEAVGAFSLSAGVGVWNAVVFEIVMTFGLVYTVYATAVDPKRGDLGVIAPIAIGFIVGANILAGGAFDGASMNPAIAALVYDICFIGQRPHEQLPTADY

SEQ ID NO: 134136 - protein, 168 aa, Triticum aestivum
  Clone ID: PAT_TA_28554.pep
QLEEARWPEVACPYCYEDYDLGSLCVHLEEDHPYEPHPAPCPICSEKITRDMLNHITMHHGYLFKALLGGGHSHRSRNTTTATTNIYADPLLSSFGLGFATSDAEEPSKSSVPVLDDTSILKEAPPQPWESSIDSSLTSEEREQKRKQATSRATFVQDLVLSTLFGDD

SEQ ID NO: 134137 - protein, 83 aa, Triticum aestivum
  Clone ID: PAT_TA_28555.pep
TSRPSGGSPSSEPSARCWRAAPTTAPRRTRSPRPRRSSTASSARKVPTPSRSTSGICDVHRHFPTSALVSLSALARPRYLWCC

SEQ ID NO: 134138 - protein, 167 aa, Triticum aestivum
  Clone ID: PAT_TA_28556.pep
MAASAAAKKLTLKSSDGEDFEVEVAVAMASQTIKHMVEDGCADNIIPLPNVTAKILSKVIEYCTQHAPKADDAAAAADSATAVKPDEEKLKAFDAEFVKVEQATLFDLILAANYLDIKGLLDLTCQTVADMIKGKTPEEIRKTFNITNDFTPEEEEEVRKENQWAFE

SEQ ID NO: 134139 - protein, 128 aa, Triticum aestivum
  unsure (1)..(128): unsure at all Xaa locations
  Clone ID: PAT_TA_28557.pep
NSLVISVVAAEVPTGRREGRKEKASCLCLWAMAEFKHLCMAKFKEGVVVEDIIQELTKLAAELDTVKYFGWGKDVLNQEALTQGFTHVFVMTFASARGPGGVXGHEKHTAFAATFMAALDKXVVTDFP

SEQ ID NO: 134140 - protein, 153 aa, Triticum aestivum
  unsure (1)..(153): unsure at all Xaa locations
  Clone ID: PAT_TA_28558.pep
MAADGERWVGLAVDFSEGSRAALQWAADNLLRSGDNLLLLHVLKDPRLRAGARPSSGRPSGSPLIPLSGVLXTLQLQRNMGLKPDAETLDMLNTIAKQEGGSVVSKVLFGRXREKLCQAIHDMPINSLXVIGNKGLGKLKRLRPPAKRPPSCS

SEQ ID NO: 134141 - protein, 118 aa, Triticum aestivum
  unsure (1)..(118): unsure at all Xaa locations
  Clone ID: PAT_TA_28559.pep
MARAQVMLMAVALVLMLAAVPRAAVAIDCGHVDSLVRPCLSYVQGGPSPSGQCCGGVQSLHNQAQSKSDRQAACNCLKGIAXRGIHNLXNEDNARSLAPKCGVNLPYHISLDIDCNSV

SEQ ID NO: 134142 - protein, 132 aa, Triticum aestivum
  Clone ID: PAT_TA_28560.pep
RHEDAEDLAGEIERIQAAMGGDIDVSLDCAGFSKTMSTALEATRPGGRVCLVGMGHNEMTVPLTSAAIREVDVVGIFRYKDTWPLCLEFLRSGKIDVKPLITHRFGFSQGEVEEAFEVSARGRDAIKVMFNL

SEQ ID NO: 134143 - protein, 320 aa, Triticum aestivum
  Clone ID: PAT_TA_28561.pep
MAASVAFSPACRRLPCNPLSAYTAAPSLVRLAGTSRRLRRACASAEPAGELDGLVPAGLLEELPEGLAFQGAPGGSGGGGGHTMLDRGINAAIVLGAITFALTKLLTVDQDYWHGWTILEILRYMPQHNWSAYEEALKANPLLVKMMISGIVYSLGDWIAQCCEGKPIFEFDRARMFRSGLIGFTLQGSLSHYYYNLCESVFPCKDWWAVPVKAAFDQTAWSGLWNTIYFVALGFLRWESPSTIFSELKSTFFPMLTAGWKLWPFAHLITYGVVPVEHRLLWVDCVEIIWVTILSTYSNEKSEARILDDSSTTDTRDNSR

SEQ ID NO: 134144 - protein, 124 aa, Triticum aestivum
  Clone ID: PAT_TA_28562.pep
MAQGSGSATAVLALVLLCLLLHGDFAESKVYTVGDRNGWALSSGGWPRGKRFRAGDVLLFRYGRGAHNVVAVSAAGYRSCSAARGGRTYNSGSDRVTLARGTNYFICSVPGHCQAGMKMAVTAA

SEQ ID NO: 134145 - protein, 131 aa, Triticum aestivum
  Clone ID: PAT_TA_28563.pep
MNALTFLHQSLFPFKDWWAVPVKVAFDQTAWSALWNSIYFVALGFLRWESPSTIYKELKATFFPMLTAGWKLWPFAHLITYGVVPIEQRLLWVDCVELIWVTILSTYSNEKSEARILDDSSTTDTQDNNFR

SEQ ID NO: 134146 - protein, 119 aa, Triticum aestivum; identical to SEQ ID NO: 134065
  Clone ID: PAT_TA_28564.pep

SEQ ID NO: 134147 - protein, 225 aa, Triticum aestivum
  Clone ID: PAT_TA_28565.pep
SLPSQLASKGIISNIFGHCITRETNGGGYMFLGDDYVPRWGMTWAPIRGGPDNLYHTEAQKVNYGDQELSMHGHAGNSVQVIFDSGSSYTYLPEEMYKNLIDAIKDDSPSFVQDSSDTTLPLCWKADFSVRSFFKPLNLHFGRRWFVVPKTFTIVPDDYLIISEKGNVCLGLLNGTEINHGSTIIVGDVSLRGKLVVYDNERRQIGWANSECTKPQSQKGFPFFL

SEQ ID NO: 134148 - protein, 320 aa, Triticum aestivum
  Clone ID: PAT_TA_28566.pep
MNAMAATATASTSLPARTFSSARPVAWIAARCLPRRAGGESMLSPSPLRLSAVRTRRAEAARASAAGAGGAPAAALPAALLFDCDGVLVDTEKDGHRISFNETFAERELGVSWDVELYGELLKIGGGKERMTAHFNKTVWPAKALKTDEERKEFIASLHKRKTELFMALIEKKLLPLRPGVQRLIDEALGKGVKVAVCSTSNEKAVSAIVSCLLGPDRAEKITIFAGDVVPRKKPDPAIYLLAATTLEVDPSSCVVVEDSNIGLSAAKAAGMKCIVTKSGYTADEDFVIADAVFDCIGDPPEGRFDLEFCANLLQKQFVS

SEQ ID NO: 134149 - protein, 171 aa, Triticum aestivum
  unsure (1)..(171): unsure at all Xaa locations
  Clone ID: PAT_TA_28567.pep
MTFKRRNGGRNKHGRGHVKYIRCSNCAKCCPKDKAIKRFLVRNIVEQAAVRDVQEACVHDGYVLPKLYAKVHHCVSCAIHAHIVRXVRSRENRRNRXSPPQRFRRRDDGPRPGQGGPAPCRRPWCPWWCACWRRCRSWCPWWCACWRRCRSWCPCSPCLVWECFVRDMRQP

SEQ ID NO: 134150 - protein, 300 aa, Triticum aestivum
  unsure (1)..(300): unsure at all Xaa locations
  Clone ID: PAT_TA_28568.pep
RGDSPYQGYDVQRLARWVEHALPFSLLLLGVFIRQHLQGFFVMIWIAAVMFKSNDILRKQTALXGERKMPMLIGIVTVFTIHVFGVYWWYRNDDLVRPLVMLPPKEIPPFWHAIFFIAVNDTMVRQAAMVVKCVLLIYYKNSKGRHYRRQGQMLTVVEYSLLLYRALLPAPVWYRFFLNKEYGSLFSSLTTGLYLTFKVASMVEKVRSLLASVNALSHKDLHYGSHATTEQVLAAGDLCAICQEKMHTPILLQCKHIFCEDCASEWLERERTCPLCRALVKPGDIRSFSDGSTTLFFQLF

SEQ ID NO: 134151 - protein, 412 aa, Triticum aestivum
  unsure (1)..(412): unsure at all Xaa locations
  Clone ID: PAT_TA_28569.pep
MCSHGHAEPATTCVTCPPPSQGRLITVLSIDGGGIRGLIPSTILACLESKLQELDGPDARIADYFDVIAGTSTGALVTSMLAAPGENKRPLFEAKEINNFYLENGPKIFPQKSWGFLTPMANMFGAVMGPKYDGKFLHDKIKNLTNDVTVADTVTNIIVPTFDVKYLQPIIFNTYEAKVDPLKNAHLSDICISTSAAPTYFPAHYFTTGDPAGKLPDREYHLIDGGVAANNPTMAAMSMITKEVLRRNPDFTHGKPAEYGNYLIISIGTGSAKMAEKYTAPDCAKWGVLRWLYDGGFTPLIDIFSHASADMVDIHAAVLFQALRIEKNYLRIQDDSLTGHTSSVDIATKENMEALIGIGKNLLKKNVSRVNIDTGMYESVEGEGTNEEALXRRFARKLSEERKLRQTNLNSK

SEQ ID NO: 134152 - protein, 106 aa, Triticum aestivum
  Clone ID: PAT_TA_28570.pep
MVNIPKTRNTYCKGKECRKHTQHKVTQYKAGKASLFAQGKRRYDRKQSGYGGQTKPVFHKKAKTTKKVVLRLECVKCKTKLQLALKRCKHFELGGDKKTKGAALVF

SEQ ID NO: 134153 - protein, 266 aa, Triticum aestivum
  Clone ID: PAT_TA_28571.pep
SKKAPRGAEMATTLKGMWGQVMGKKGEAMRELEVSIRAKGNVTQTEDALLRACMLFSNLSYTATSAVVSLVGAFASGQVHKIVGGQPMPRLFRLGFSAGVGLTAGKMMYYESLHATSLYILGREEEPFERLKMELANIILTKHSDEKLSVEAVKKHFFAENLYTDQYQDKLLFRWRQRYSYVDSTYLERMKEIEANNSVDKDKTMSVQTTGSFGNLMEDPLACILGSPDSDMENDKPPERTATILRKRDLRARRRSQRHHRRHAAL

SEQ ID NO: 134154 - protein, 147 aa, Triticum aestivum
  Clone ID: PAT_TA_28572.pep
SPTSVLHIFTRNLAGEKVVGDDGIEPPTTTATTKPISPEKEASTMSGRGKGGKGLGKGGAKCHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134155 - protein, 403 aa, Triticum aestivum
  Clone ID: PAT_TA_28573.pep
SDVRGDPASALLEVLDPEQNKTFNDHYLNVPFDLSKVVFVATANRMQPIPPALLDRMEVIELPGYTPEEKLKIAMKHLLPRVLEQHGLSSAYLQIPEAVVKLIIERYTREAGVRNLERNLAALARAAAVKVAELDSTLRLGKEMQPITTTLLDSRLADGGEVEMEVIPMGQDISNTYENPSPMIVDEAMLEKVLGPPRFDDREAADRVSSPGVSVGLVWTSFGGEVQFVEATAMVGKGDLHLTGQLGDVIKESAQLALTWVRARSADLNLSPTSDINILESRDIHIHFPAGAVPKDGPSAGVTLVTSLVSLFSNRKVRADTAMTGEMTLRGLVLPVGGVKDKVLAAHRYGIKRVILPERNLKDLAEIPAPILAGIEILLVKRIEEVLGHAFENGFPLRLHSSL

SEQ ID NO: 134156 - protein, 150 aa, Triticum aestivum
  unsure (1)..(150): unsure at all Xaa locations
  Clone ID: PAT_TA_28574.pep
MATADVQNPSAALTEEAPAAGDASGRRGGREDGGGPRAGREGRSRGACPRRGLRRPRRRHRQPLRRRRPRSPEPAAAARAGGPKRPKEPEAPAVGRDQGGCGKSKAGCGPRGEGRSGACCRARSGGRRRXNTGCNGXGPTAAAKEPAPPQ

SEQ ID NO: 134157 - protein, 173 aa, Triticum aestivum
  Clone ID: PAT_TA_28575.pep
NLIKNDGFEIGPQVFKNSSVGVLLPPKQKDVTSPLPGWIIESLKAVRYIDAAHFSVPAGQYAVELVAGRESAIAQVIRTVPNRAYNLSYVVGDAKNGCHGSMLVEAFAANVTQKVPFESTGKGRFKAASLRFVAAGVRTRVTFYSSYYHTKVTDGVSLCGPVLDQVKILPLKL

SEQ ID NO: 134158 - protein, 124 aa, Triticum aestivum
  unsure (1)..(124): unsure at all Xaa locations
  Clone ID: PAT_TA_28576.pep
CRNSARATAPPPFPSQSNSKMSGRGKGGKGLGKGGAKRHRKVLRDNIQGITKPAIRRLARRGGVKRISGLIYEETRGVLKIFLENVIRDAVTYTEHARRKTVTAMDVVXYALKRQGRTLYGFGG

SEQ ID NO: 134159 - protein, 220 aa, Triticum aestivum
  Clone ID: PAT_TA_28577.pep
METSFLPTARPLPAFQTLAAAPRCPRPLRRSTIRAAISRGRKEDTVAVVREQLEGCYLLAGIRYEGLTVKQFQGIRDALPESCHLLVAKNTLVGKAIEGTPWEALKPCMKGMNAWLFVHTEEVPVALKPYRAFQKEERVEETNDFIGAVFEGKYYAPAEFKSLETMPSRAEVYSKLLGALNGPATSLVTTLQAPARDVVAVLSAYVRKLEEESGAGDGTA

SEQ ID NO: 134160 - protein, 194 aa, Triticum aestivum
  Clone ID: PAT_TA_28578.pep
EDDKKKKKPARTCVQIEEIPEDNTAGCDAIRKAFAMGNGKGKAKELSPQDAALLIQMNYRAHLAHRSQVLRCLRDLAVAKAKLKELRSLFYNLSYRRRLSHDHEERQRFSEKIIVLLLTVDALEGPDFMVRTAKKSMLEELESMLEIVDPQPPGKQRSFSRRKFDLPEGGAIPNEKTAGVNNAVRVINTGKGKQ

SEQ ID NO: 134161 - protein, 131 aa, Triticum aestivum
  Clone ID: PAT_TA_28579.pep
MSMAAAARAATRAPGRAAARFVQTRLRSSGKVLSEEERAAENVYIKKMEQEKREKLARKGPSTGEQAPSTPSAAAGDVNTGGAASTASASAAGTSTDKNRNYAVLAGTLAGLSALGWYLLSKPKKTEEVVD

SEQ ID NO: 134162 - protein, 227 aa, Triticum aestivum
  Clone ID: PAT_TA_28580.pep
MASRLLTRSKALALAAARADAAAPSPLAGAWGARALSTLPRDPAAASPAPSPRQPAAVSPLGLSKILGYEQASRLGGTHMLPRWFSTGASNGSSDQQTSKTIAGMVQSDALKSQEGASAKVAAFSPMEATISKPRSSPLTLESLKVRRTEMMTKVTFYMIPTLLLVSKNSISTSLLIASVYHQVYMFHKEILLDYVHHDITRKWALIYFKLLLLVMAKDTMVYFDLF

SEQ ID NO: 134163 - protein, 252 aa, Triticum aestivum
  Clone ID: PAT_TA_28581.pep
MMGYQKGVDIEAGTSGGGTGTTAPTRGLYPGMTESPELRWALIRKIYVILSLQLLLTAVVAAVVVKVRAIPHFFVSSSAGLGLYIFLIIFPFIVLCPLYFYRQKHPVNLLLLGVFTVAISFAVGMTCAFTSGKVILEAAILTTVVVFSLTAYTFWAAKRGQDFSFLGPFLFASLIMLLVFGFIQILFPMGKLSHMIYGALAALIFSGYIVYDTDNIIKRYTYDEYVWAAVSLYLDVINLFLALLTLFRAGDS

SEQ ID NO: 134164 - protein, 265 aa, Triticum aestivum
  Clone ID: PAT_TA_28582.pep
LCKIGANYASGGSGILDTTGKGTLTMRTQVEYFKKAADNMICYPSKEEHLARSLFLLSGGGNDFSAFDPSTASPQAYVVKMVTTYIEHIQALYDMGARMVGILDVPPIGCTPGQRVGMPNGECNEQANSLAQAFNGLLRAKLAEAAEATMKELKYSIAANYNILNNMMDNSLVAGLRHVKTACCGSGKLNAEVMCSHPGTTACPAAEHDDYMFWDMLHPTHATIERGVVALFYGNGPKYGEPVNFGTLVAGKNVSPAIKMVVDEQ

SEQ ID NO: 134165 - protein, 182 aa, Triticum aestivum
  Clone ID: PAT_TA_28583.pep
MARSGGLLVPTPCSASASSSHFQREGERGFESLPESGSIQRVLGFSLRAAAMSMAAAARAAARAPGRAAARFVQTRLRSSGKVLSEEERAAENVYIKKMEQEKREKLARKGPSTGEQAPSTPSAGAGDVNTAGAGSTTSASAAGTSTDKNRNYAVLAGTLAGLSALGWYLLSKPKKTEEVVD

SEQ ID NO: 134166 - protein, 411 aa, Triticum aestivum
  unsure (1)..(411): unsure at all Xaa locations
  Clone ID: PAT_TA_28584.pep
MCSHGHAEPATACVTCPPPSQGRLITVLSIDGGGIRGLIPSTILACLESKLQELDGPDARIADYFDVIAGTSTGALVTSMLAAPGENKRPLFEAKEINKFYLDNGPKIFPQRSWGLLTPIGNMFGAVMGPKYDGKFLHDKIKSLTNDVTVADTVTNIIVPTFDVKYLQPIIFNTYEAKVDPLKNAHLSDICISTSAAPTYFPAHYFTTRDPAGKLPDREYHLIDGGVAANNPTMAAMSMITKEVLRRNPDFTHGKPAEYGNYLIISIGTGSAKMAEKYTAPDCAKWGVLRWLYXGGFTPLIDIFSHASADMVDIHAAVLFQALRIEKNYLRIQDDSLTGHTSSVDIATKENMEALIGIGKNLLKKNVSRVNIDTGMYESVDGEGTNEEALARFARKLSVERKLRQTNLNSK

SEQ ID NO: 134167 - protein, 400 aa, Triticum aestivum
  Clone ID: PAT_TA_28585.pep
HEALILLILFTCAAIAGSVVLYVGQGKFHASTTTTLDFVVDQADFTVENLRNLSDSLSAAKKVDIGQFLLPPNVMGEINEIQAKLNTSATDLSTRTSENSVKIQKLLNQVRLALIIIAAVMLLLAFIGFLLSILGLEFLVNILVVVGWILVTGTFILCGVFLLLHNVVGDTCVSMDEWVAHPTEHTALDDIIPCVEPATANETLTRTKEVTSQLVNLVNQVLSNVSNRNFPPAATPFYYNQSGPLIPTLCNPFGPNLSKRNCARGEVTLDNATQVFRSFECQTRIVSGTEVCTTVGRLTPRIFGQMAAGLNVSLGLYQYGPFLVQLQDCTFVRDTFSNISQNYCPGLERYSRWVYIGLVLVSAAVMLSLIFWVIYARERRHRAYNKAHRGDKPAPMGGNA

SEQ ID NO: 134168 - protein, 183 aa, Triticum aestivum
  Clone ID: PAT_TA_28586.pep
LSITPLPRRSTRPPSWTLTQPVALHRAPHTLTLATAAAGSSSAAAGASSATAATSGSAAGAASSFTSSATASLVSVSTTAGSFGASASGSAAAAGSGSLVSSVSAAAGASSLVASTSTGAGASTSASTGAGTSSVLATSSAATGVSTAGASSVSAAVGFWTSAVAIAVVDARKCPEWQTLQAS

SEQ ID NO: 134169 - protein, 320 aa, Triticum aestivum
  Clone ID: PAT_TA_28587.pep
MNAMAATATASTSLPARTFSSARPVAWIAARCLPRRAGGGSMLSPSPLRSSAARTLRAEAARASAAGAGGAPAAALPAALLFDCDGVLVDTEKDGHRISFNETFAERELGVSWDVELYGELLKIGGGKERMTAYFNKTEWPAKAPKTDEERKEFVASLHKRKTELFMALIEKKLLPLRPGVQRLIDEALGKGVKVAVCSTSNEKAVSAIVSCLLGPDRAEKITIFAGDVVPRKKPDPAIYLLAATTLEVDPSSCVVVEDSNIGLSAAKAAGMKCIVTKSGYTADEDFVIADAVFDCIGDPPEGRFDLEFCANLLQKQFVS

SEQ ID NO: 134170 - protein, 109 aa, Triticum aestivum
  Clone ID: PAT_TA_28588.pep
MEFKHLCLVRFKEGVVVEDIIEELTKLAAELDTVKFFGWGKDVLNQEALTQGFTHVFSMSFASAEDLAAYMGHEKHSAFAATFMAVLDKVVVLDFPFVVAKPVPSPEAA

SEQ ID NO: 134171 - protein, 103 aa, Triticum aestivum; identical to SEQ ID NO: 107316
  Clone ID: PAT_TA_28589.pep

SEQ ID NO: 134172 - protein, 113 aa, Triticum aestivum
  Clone ID: PAT_TA_28590.pep
MQPKSGGRLRPRLNPVSASGDRRRGTKERKGDRGAAAAAMGVMGRLKIFVVKEPVVAASCLIAGFGLFLPAVVRPMLDSWETEKNAKTPVELKDVVAGVTGQESLVINVSSLC

SEQ ID NO: 134173 - protein, 227 aa, Triticum aestivum
  Clone ID: PAT_TA_28591.pep
MASRLLTRSKALALAAARADAAAPSPLAAAWGARALSALPRDPAAASPASSPRQPAVVSPLGLSKILGYEQASRLGGTHVLPRWFSTGASNGSSDQQTSKTVAGMVQSDALKSQEGASAKVAAFSPIEATISKPRSSPLTLESLKVRRTEMMTKVTFYMIPTLLLVSKNSISTSLLIASVYHQVYMFHKEILLDYVHHDITRKWALIYFKLLLLVMAKDTMVYFDLF

SEQ ID NO: 134174 - protein, 196 aa, Triticum aestivum
  unsure (1)..(196): unsure at all Xaa locations
  Clone ID: PAT_TA_28592.pep
TRLLFLPLTPEPKPQELPMASTTFSSAFSILSLPSSSPSPSASAPRTLPVANRRRRAVAVASTATESPKVLELGDAIAGLTLEEARNLVDHLQERLGVSAASFAPAAAVAAPGRGGGXEEAPVEKTEFDVVIXEEVPSSARIATIKVVRALTNLALKEAKDLIEGLXPKKLKEAVSKDGGRGGPRSSSRESAPRFP

SEQ ID NO: 134175 - protein, 106 aa, Triticum aestivum
  unsure (1)..(106): unsure at all Xaa locations
  Clone ID: PAT_TA_28593.pep
MEFKHLCLVRFKEGVVVEDIIEELTKLAAELDTVKFFGWGKDVLNQEALTQGFTHVFSMSFASAEDLAACMGHEKHSAFAATFXAVLDKVVVLGLPLRRRQAGAIA

SEQ ID NO: 134176 - protein, 122 aa, Triticum aestivum
  Clone ID: PAT_TA_28594.pep
MDPDSVSKAFVQHYYQTFDSNRAALVGLYQDGSMLTFEGEKFGGPAAIAGKLGSLPFQQCQHKIDTVDCQPSGPQGGVLVFVSGTITTGPGEHPLKFSQMFHLLPAGGSFYVQNDMFRLNYG

SEQ ID NO: 134177 - protein, 181 aa, Triticum aestivum
  Clone ID: PAT_TA_28595.pep
PAPPPRAPAPHTLTLATAAAGSSAAAAGARSAAAGASSATAGTSGSAAGAASSFTSSTTAGSASATASLVSASTTAGASGSLGASASGSAAAAGSGSLVSSVSAAAGASSLVSSTSTGTSASTSASAGAGTSSVFVASSAATGVSTAGASSVSAAVGFWTSAVAIAVVDARKCPEWKRVAS

SEQ ID NO: 134178 - protein, 136 aa, Triticum aestivum
  Clone ID: PAT_TA_28596.pep
RLPHGRPLGPQAYTEFLFVYPPGIHELMLYAKRKYGNPAIYVMENGIDEGNNSSLPIREALKDPARINYHYKHLLFLNLAIKQKVNIKGYFSWTFMDCFEWGDGYKDRFGLIYIDRNTLKRYPKESSKWMGRFLKK

SEQ ID NO: 134179 - protein, 196 aa, Triticum aestivum
  Clone ID: PAT_TA_28597.pep
AACGPLIDAVAIKELPTPYPTKDNLIKNDGFEIGPQVFKNSSVGVLLPPKQKDVTSPLPGWIIESLKAVRYIDAAHFSVPAGQYAVELVAGRESAIAQVIRTVPNRAYNLSYVVGDAKNGCHGSMLVEAFAANVTQKVPFESTGKGGFKAASLRFVAAGVRTRVTFYSSYYHTKVTDGVSLCGPVLDQVKIVPMKL

SEQ ID NO: 134180 - protein, 177 aa, Triticum aestivum
  unsure (1)..(177): unsure at all Xaa locations
  Clone ID: PAT_TA_28598.pep
MAAAGDAGEKKMITLKSSDGEEFEVEEAVAMESQTIRHMIEDDCADNGIPXLPNVNSKILSKVIEYCNKHVQAKPADGAAAAGAGASDAAAPAAPAEDLKNWDAEFVKVDQATLFDLILAANYLNIKGLLDLTCQTVADMIKGKTPEEIRXKTFNIKNDFTPEEEEEIRRENQWAFE

SEQ ID NO: 134181 - protein, 103 aa, Triticum aestivum; identical to SEQ ID NO: 107316
  Clone ID: PAT_TA_28599.pep

SEQ ID NO: 134182 - protein, 121 aa, Triticum aestivum
  Clone ID: PAT_TA_28600.pep
SARGLVPNRHEGQLQASTMSGRGKGGKGLGKGGAKRHRKVLRDNIQGITKPAIRRLARRGGVKRISGLIYEETRGVLKIFLENVIRDAVTYTEHARRNTVTAMDVVYALKRQGRTLYGFGG

SEQ ID NO: 134183 - protein, 306 aa, Triticum aestivum
  unsure (1)..(306): unsure at all Xaa locations
  Clone ID: PAT_TA_28601.pep
TALVTANPHRLAVGHPVPHPPDSSPLPRRGQNPTPRSSQLPRSRNPRRHRGHGEGAPLLPAPGGLQPLHTGPPPPPYPRARRLPATXFAPPRPSTSSAANPLPFMSFDIPAQSNSTPPIFTGPIGGSSASFEDEPPLLEELGINTRQIWRKTLSILHPLRSADPSLHADADLSGPFLFLLSFGLFQLLAGKFHFGIVLGWVTVASLFLYFVFSMLSGGRRGDLDLYRCVSLVGYCMLPMVIFSAVSLFLPRGGGLIFGMGMGFVLWSTRVCTRLLAELASSGDEHRGLIAYACWLVYMLFSLLVIF

SEQ ID NO: 134184 - protein, 256 aa, Triticum aestivum
  unsure (1)..(256): unsure at all Xaa locations
  Clone ID: PAT_TA_28602.pep
MGGKAALLVALLAVSLVLEAQAGSGYGGGHPPSPTPVAPPPKHEKPPKGHKPPHHHHHAKPPXASHAPAPPTHGPPTPKPIPPAPKPTPPTYAPIPKPPKPSPSPPAYHPTPKPAPPTYKPPTQPRPSPPAHKPAPPMYKTPTQPKPSPPAYKPAPKXVSPPAYKPAPKVSPPAYKPAPKVSPPAYKPAPKVSPPAYKPAPKVSPPAYKPVPKPSPPPSPTPPAPKPTPPPYKPPTPTPPAYKPPTPSPPPPPYHH

SEQ ID NO: 134185 - protein, 185 aa, Triticum aestivum
  Clone ID: PAT_TA_28603.pep
MSSPSKRREMDLMKLMMSDYKVETVNDGMQEFLVEFRGPQESLYQGGVWKVRVELPDAYPYRSPSIGFVNKIYHPNVDELSGSVCLDVINQTWSPMFDLVNVFEVFLPQLLLYPNPSDPLNGEAAALLMRDRPAYEQKVKEFCEKYAKPEDAGITPEDNSSDEELSEEDDDDSGDDEPILGHADP

SEQ ID NO: 134186 - protein, 127 aa, Triticum aestivum
  unsure (1)..(127): unsure at all Xaa locations
  Clone ID: PAT_TA_28604.pep
MATELAYAPPMKSGKAGFEGPQEAQHRIRITLSSKSVKNLEKVCSDLVRGAKDKLLRVKGPVRMPTKVLNITTRKSPCGEGTXTWDRFEMRVHKRVIDLVSSPDVVKQITSITIEPGVEVEVTISDQ

SEQ ID NO: 134187 - protein, 122 aa, Triticum aestivum
  Clone ID: PAT_TA_28605.pep
ARGTAATTTTTSSTHSEAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134188 - protein, 432 aa, Triticum aestivum
  unsure (1)..(432): unsure at all Xaa locations
  Clone ID: PAT_TA_28606.pep
MCSQADPTLTCPPPSQGRLITVLSIDGGGIRGLIPSTILACLESKLQELDGPDARIADYFDVIAGTSTGALVTSMLAAPXENKRPLFEAKDINKFYLDNGPKIFPQKRXGVLTPMANLFGAVNGPKYDGKFLHDKIKSLTNDVTVADTVTNIIVPTFDIKYLQPVIFNTYEAKVDPLKNAHLSDICISTSAAPTYFPAHYFTTRDPAGKLPDREYHLIDGGVAANNPTMAAMSMITKEVLRRNPDFTHGKPAEYHRYLIISIGTGTAKQAEKYTAPDCAKWGVLRWLYDGGFTPLIDIFSHASADMVDIHAAILFQALNIEKNYLRIQDDSLTGHTSSVDISTKANMEALIGIGNMLLKKKVARVNIXDTGVYEPVDNEGTQXEALAHFAKKLSDERKLRLSPNHPQLPIDKRTIRKRTKTNKLAAMLDGPI

SEQ ID NO: 134189 - protein, 84 aa, Triticum aestivum
  Clone ID: PAT_TA_28607.pep
GRWTCPASAASSPPPTSGSSAPRSSSAAPGKPASPSPSGANAGPTPSWRQRHHARMREEFRSRDRARGRRGEEDRRRCQGRITE

SEQ ID NO: 134190 - protein, 310 aa, Triticum aestivum
  Clone ID: PAT_TA_28608.pep
MATAFDSPTSSPAAAPFHDDPFLSFADSPTPAAADVHVSGDDFPASPDPYAFRHDSAAAHPFGMPDSNGNGMHHEADDDDGLFTDSGPVLPDPAQMGADEGFLLREWRRQNALLLEEKEKHEKELRSQIILEAEEFKKGFVEKRKLNLETSKDHNREREKLFLSNQEKFHKGADKQYWKAISELIPQEIAHIEKRTGKKDKDKKPGIIVVQGPKPGKATDMARMRQILSKLKHTPPPHMKPPPPPAVAPAGKDGAPAAAGKDGAKAAATPAAKDAPANGTVPEKENAPPAAAAAPAAAAPAPPAEPIAAA

SEQ ID NO: 134191 - protein, 119 aa, Triticum aestivum
  Clone ID: PAT_TA_28609.pep
HRSSDSTTARSSRSAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134192 - protein, 106 aa, Triticum aestivum; identical to SEQ ID NO: 134152
  Clone ID: PAT_TA_28610.pep

SEQ ID NO: 134193 - protein, 111 aa, Triticum aestivum
  Clone ID: PAT_TA_28611.pep
MPVSRIAIGAPGELSHPDTFRAGVAEFISMLIFVFAGSGSGMAFGKLTDGAFDGASMNPAVSFGPAVVSGVWENHWVYWLGPFAGAAIAALVYDICFIGQRPHEQLPTADY

SEQ ID NO: 134194 - protein, 476 aa, Triticum aestivum
  unsure (1)..(476): unsure at all Xaa locations
  Clone ID: PAT_TA_28612.pep
SRLCVDEVHRVLLDIVNASANATPGLGRYPPFKREVVAIASNALDSFKSDAKKMVVALVDMERAGVPAQHFIRLVQRRMERQRREDEMKNRPFKIGQESEQSVTNRASSPQTKSEQAGGSSKSTKEKPSPDKDTKEGPNLQVAGPAGEITAGYLLKKSAKANGWSRRWFVLNEKSGKLGYTKKQEERHFRGVITLEECNLEEVDEEEPSKSLKDSKKANGPEKGPSLVFKITNRVAYKTVLKAHSAVVLKAESTADKVEWVNKIKAVIQSKGGSFKAANTEGGPLKQSXQDSSTDAMIRRPADPEEELRWMSQEVRGYVEAVLNSLAANVPKAIVLCQVEKAKEDMLNQLYSSISGQSNAKIEELLQEDHNAKRRREKYQKQSSLLSKLTRQLSIHDNRAAASSYSNDSPEAESPRTPGRPGEDWRSAFDSAANGPAPNIESRSRSADGRRRSENGDPNSTSRRTPNRMPPAPPRY

SEQ ID NO: 134195 - protein, 381 aa, Triticum aestivum
  Clone ID: PAT_TA_28613.pep
MASPASGDSDQVLVEANGSTRTLVLNRPKQLNALSSAMVTGLLKCFTSYEEENTVKLLIVKGKGRAFCAGGDVAEVAQSINNDTWKYGADFFHTEFLLNYIIATYSKPQVSLLTGIVMGGGAGVSIHGRFRVATENTVFAMPETALGLFPDIGASYFLSRLPGFYGEYVGLTGARLDGAEMLACGLATHFVPLNRMSLLEESLKKVDTSDPFAICGIIDQFSQQPSVKGSSAMNRMEIINRCFSKRTVEEIISALEQEAPSMADKLVTAAIHSLRKASPTSLKISLTSIREGRLQTVGECLRREYRMVCHVMRGDFSRDFFEGCRAILVDKDRNPKWMPPTLDKVHDGVVAKYFSKVDDPQWEDLNLPTRPSHGRRIVPKL

SEQ ID NO: 134196 - protein, 111 aa, Triticum aestivum
  Clone ID: PAT_TA_28614.pep
AASISSPAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134197 - protein, 311 aa, Triticum aestivum
  Clone ID: PAT_TA_28615.pep
MRLNQLDWNANAHDHILDNRQPIIEEPASPEPEPETAEMRESAIEDIFLDDPEEIPTIKLNFEEFAQNLKNYMQVNNIEMEDADMSSALVAITPEAASIPTPRLKNVSRLRTEHQVYELPDSHPLLEGYDQREPDDPCPYLLSIWTPGETAQSIDAPKTACNSNESGKLCDSSACFSCNSMREAQAQTVRGTILVPCRTAMRGSFPLNGTYFQVNEVFADHDSSRNPVDVPRRWIWDLPRRTVYFGTSVPSIFKGLTTEDIQQCFWRGFVCVRGFDRTSRAPRPLYARLHFPASKITRNKKGAASAGTDDA

SEQ ID NO: 134198 - protein, 338 aa, Triticum aestivum
  Clone ID: PAT_TA_28616.pep
MGMQSVCGGAGRWRRAVAWWGAVLVLAHLLNCGSAGLLDTNPGLAYNFYATTCPSAEATVRSITWAQVAGNQALPGQLLRLHFHDCFVKGCDASILLDNAQSEKTAPPNGSLGGYPVIDAIKAQLEKACPGVVSCADIVALAARDAVSYQFKASLWQVETGRRDGPVSLASNTGALPSPSAGFNGLLQSFAAKGLDVNDLVALSGAHTIGKASCSSVTPRLYQGNATSIDPLLDSTYAKTLMNACPNTPASTSTVDLDGATPFKFDGNYYTNLQNKRGVLASDAALTQNAAAATIVNDLTNPIKFYAAFSMSMKKMGRVDVLTLKNGQGKIRTKCNVP

SEQ ID NO: 134199 - protein, 81 aa, Triticum aestivum
  unsure (1)..(81): unsure at all Xaa locations
  Clone ID: PAT_TA_28617.pep
RRSTCPASAASSPPPTSGPSAPXSSSTSPTTAKSNSPSGANAELTPSGGGCHHHPRMREELRSWGSRERKAGEGDGEIMAE

SEQ ID NO: 134200 - protein, 248 aa, Triticum aestivum
  Clone ID: PAT_TA_28618.pep
MDSEHWISRLAAAKRFYAAQLGHIDDMAGMGMEEVDMDMEDDGEMDMEMEMQLEEARWPEVACPYCYEDYDLGSLCVHLEEDHPYEPHPAPCPICSEKITRDMLNHITMHHGYLFKNGSRLRRFVIPERRALSLLSRDLRDAHLQALLGGGHSHRSRNTTTATTNIYADPLLSSFGLGFATSDAEEPLKSSVPVLDDTSILKEAPPQPWESSIDSSLTSEEREQKRKQATSRATFVQDLVLSTLFGDD

SEQ ID NO: 134201 - protein, 204 aa, Triticum aestivum
  unsure (1)..(204): unsure at all Xaa locations
  Clone ID: PAT_TA_28619.pep
APLRPRFLLLFLPLTPEPKPQELPMASTTFSSAFSILSLPSSSPSPSASXPRTLPVANRRRRAVAVASTATGVPERSFELGERHCRAHPWRRLRNLVDHLQRTSXRLCRLLRSRLPRSAAPAAAAAEEAPVXEKTEFDVVIEEVPSSARIATIKVVRALTNLALKEAKDLIEGLPKKLKEAVSKDEAEEAKKQLEGVGAKVSIA

SEQ ID NO: 134202 - protein, 371 aa, Triticum aestivum
  unsure (1)..(371): unsure at all Xaa locations
  Clone ID: PAT_TA_28620.pep
MLGAARRSGCVLGQLMQTLRPAATAARSYSATPKEMTVREALNSALDEEMSADPSVFLMGEEVGEYQGAYKITKGLLDKYGPDRVLDTPITEAGFTGIGVGAAYQGLRPVVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKAEVLDSSFSVPIXGKAKIEREGKDVTITAFSKMVGYALQAAEILSKEGISAEVINLRSIRPLDRAAINASVRKTSRLVTVEEGFPQHGVGAEICMSVVEDSFEYLDAPVERIAGADVPMXPYAANLERLAVPQVEDIVRAAKRACYRSSSMAANA

SEQ ID NO: 134203 - protein, 185 aa, Triticum aestivum
  Clone ID: PAT_TA_28621.pep
MSSPSKRREMDLMKLMMSDYKVETVNDGMQEFLVEFRGPQESLYQGGVWKVRVELPDAYPYRSPSIGFVNKIYHPNVDELSGSVCLDVINQTWSPMFDLVNVFEVFLPQLLLYPNPSDPLNGEAAALLMRDRPAYEQKVKEFCEKYAKPEDAGIAPEDNSSDEELSEEDDDDSGDDEPILGHADP

SEQ ID NO: 134204 - protein, 103 aa, Triticum aestivum; identical to SEQ ID NO: 107316
  Clone ID: PAT_TA_28622.pep

SEQ ID NO: 134205 - protein, 201 aa, Triticum aestivum
  unsure (1)..(201): unsure at all Xaa locations
  Clone ID: PAT_TA_28623.pep
NGGGYMFLGDDYVPRWGMTWAPIRGGPDNLYQXKAQKVNYGDQELSMXGTPEISCPVIFDSGSSYTYLPEEMYKNLIDAIKDDSPSFVQDSSDTTLPLCWKADFSVRSFFKPLNLHFGRRWFVVPKTFTIVPDDYLIISEKGNVCLGLLNGTEINHGSTIIVGDVSLRGKLVVYDNERRQIGWANSECTKPQSQKGFPFFL

SEQ ID NO: 134206 - protein, 103 aa, Triticum aestivum; identical to SEQ ID NO: 107316
  Clone ID: PAT_TA_28624.pep

SEQ ID NO: 134207 - protein, 248 aa, Triticum aestivum
  Clone ID: PAT_TA_28625.pep
MKGGGDVEAGGDIEAGTAAPKGAPYAGTTESPELRWALIRKIYVVLCLQLLLTAAVAAVFVTVTAIPHFFVSSYAGLGLYIFILVFPFIVLCPLHIYRQKHPINLLLLGVFTVAISFSVGLTCAFTSGKVILQAGILTIVVVLSLTAYTFWAARRGKDFSFLGPFLFASLMILLVFAFIQIFFPLGKLSHMIYGTLAALIFSGYIVYDTGSIIKRYKYDEYVWAAVTLYLDIINLFLGLLTLFRACDN

SEQ ID NO: 134208 - protein, 65 aa, Triticum aestivum
  Clone ID: PAT_TA_28626.pep
MGVMGRLKIFVVKEPVVAASCLIAGFGLFLPAFVRPMLDSWETEKNAKTPVELKDVVAGVTGKKA

SEQ ID NO: 134209 - protein, 130 aa, Triticum aestivum
  Clone ID: PAT_TA_28627.pep
MKNVAKCDTWCELQNPANHRVFERKLRPRPLGRGHACPNTPASTSTVDLDGATPFKFDGSYYTNLQNKRGVLASDAALTQNAAAATIVNDLTNPIKFYAAFSMSMKKMGRVDVLTLKNGQGKIRTKCNVP

SEQ ID NO: 134210 - protein, 125 aa, Triticum aestivum
  unsure (1)..(125): unsure at all Xaa locations
  Clone ID: PAT_TA_28628.pep
EFGTRHRSSDSTSARSSRSSAMSGRGKGGKGLGKGGAKRHRKVLRDNIQGITKPAIRRLARRGGVKRISGLIYEETRGVLKIFLENVIRDAVTYTEHAXRKTVTAMDVVYALKRQGRTLXYGFGG

SEQ ID NO: 134211 - protein, 103 aa, Triticum aestivum; identical to SEQ ID NO: 107316
  Clone ID: PAT_TA_28629.pep

SEQ ID NO: 134212 - protein, 307 aa, Triticum aestivum
  unsure (1)..(307): unsure at all Xaa locations
  Clone ID: PAT_TA_28630.pep
MGGKAALLVALLAVSLVLEAQAGSGYGGGHAPTPTPVAPPPKHEKPPKGHKPPHHHHHAKPPAASHGPPTHAPAPPTYSPPTPKPTPPAPKPTPPTYAPIPKPPKPSPSPPAYHPTPKXPAPPTYKPPTQPKPSPPAYKPAPKVSPPAYKPAPKVSPPAYKPAPKVSPPAYKPAPKVSPPAYKPAPKVSPPAYKPAPKVSPPAYKPAPKVSPPAYKPAPKVSPPAYKPAPKVSPPAYKPAPKVSPPAHKPVPKVSPPAYKPVPKPSPPTSPTPPAPKPTPPPYKPPTPTPPAYKPPTPSPPPPPYHH

SEQ ID NO: 134213 - protein, 149 aa, Triticum aestivum
  Clone ID: PAT_TA_28631.pep
MAAVLTRPTPGTVQCFGRKKTAVAVAYCKPGRGLIKVNGAPIELIRPEMLRLKAFEPILLAGRSRFKDIDMRIRVRGGGKTSQIYSIRQAIAKSLVAYYQKYVDEAAKKEVKEIFGRYDRTLLVADPRRCEPKKFGGRGARARFQKSYR

SEQ ID NO: 134214 - protein, 376 aa, Triticum aestivum
  Clone ID: PAT_TA_28632.pep
MLGAARRQLGSGPMLGQLLRRLRPAAAASTEAARGYSSAAKEITVRDALNSALDEEMSADPSVFLMGEEVGEYQGAYKITKGLLDKYGPDRVLDTPITEAGFTGIGVGAAYQGLRPVIEFMTFNFSMQAIDHIINSAAKSNYMSAGQINVPIVFRGPNGAAAGVGAQHSQCYAAWFAHVPGLKVLAPYSSEDARGLLKAAIRDPDPVVFLENELLYGESFPVSDEVLDSSFALPIGKAKIEREGKDVTITAFSKMVGYALQAAEILSKEGISAEVINLRSIRPLDRAAINASVRKTNRLVTLEEGFPQHGVGAEICMSVVEESFEYLDAPIERIAGADVPMPYAANLERLAVPQIEDIVRAARRACYRALPMTATA

SEQ ID NO: 134215 - protein, 398 aa, Triticum aestivum
  unsure (1)..(398): unsure at all Xaa locations
  Clone ID: PAT_TA_28633.pep
VRGRVGGRVGLGRIFNGSGKPIDNGPPILPEAYLDISGSSINPSERTYPEEMIQTGISTIDVMNSIARGQKXIPLFSAAGLPHNEIAAQICRQAGLVKRLEQSKHAAEGGEEDNFAIVFAAMGVNMETAQFFKRDFEENGSMERVTLFLNLANDPTIERIITPRIALTTAEYLAYECGKHVLVILTDMSSYADALREVSAAREEVPGRRGYPGYMYTDLATIYERAGRIEGRKGSITQIPILTMPNDDITHPTPDLTGYITEGQIYIDRQLHNRQIYPPINVLPSLSRLMKSAIGEGMTRRDHSDVSNQLYANYAIGKDVQAMKAVVGEEALSSEDLLYLEFLDKFERKFVAQGAYDTRNIFQSLDLAWTLLRIFPRELLHRIPAKTLDQFYSRDATH

SEQ ID NO: 134216 - protein, 119 aa, Triticum aestivum; identical to SEQ ID NO: 134065
  Clone ID: PAT_TA_28634.pep

SEQ ID NO: 134217 - protein, 108 aa, Triticum aestivum
  Clone ID: PAT_TA_28635.pep
MAPKKEKAPAASSKPAKSGGGKQKKKKWSKGKQKEKVNNAVLFDQATYDKLLTEVPKYKQITPSVLSERLRINGSLARRAIKDLMERGLIRMVSIHSSQQIFTRATNT

SEQ ID NO: 134218 - protein, 121 aa, Triticum aestivum
  Clone ID: PAT_TA_28636.pep
GHHRSPDSTSARSSRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134219 - protein, 269 aa, Triticum aestivum
  unsure (1)..(269): unsure at all Xaa locations
  Clone ID: PAT_TA_28637.pep
RPGPEKGPSLVFKITNRVAYKTVLKAHSAVVLKAESMADKIEWVKKIKGIIQSKGGSVKSSNTPEGGSMRQSHSDGSLDTMARRPADPEEELRWMSQEVRGYVEAVLNSLAANVPKAIVLCQVEKAKEDMLNQLYSSISSQSNARIEELLXEDHNAKRRREKAQKQSTLLSKLTRQLSVHDNRAAVASYSDDTSGPESGPQSPSQSGEDWRSAFSAAANGSAARSSSQNESRSRSADSRGRRYENGDANGANSGSRRTPNRLPPAPPKY

SEQ ID NO: 134220 - protein, 126 aa, Triticum aestivum
  Clone ID: PAT_TA_28638.pep
MSMAAAARAATRAPGRAAARFVQTRLRSSGKVLSEEERAAENVYIKKMEQEKREKLARKGPSAGEQAPSTPSAAAADVSSTASASAAGTSTDKNRNYAVLAGTLAGLSALGWYLLSKPKKTEEVVD

SEQ ID NO: 134221 - protein, 201 aa, Triticum aestivum
  unsure (1)..(201): unsure at all Xaa locations
  Clone ID: PAT_TA_28639.pep
MLLREAIMDEEYWXAAWXLRAEDHYEESSSXRSLMFESFKRKFASQEFHALKKRCGRQVGEKYTCFVAVKNDDVTRTVVNSXVVGTVDLCVRHPLYGETYPAEPGNTPFYSRIYQPDQPKFGYLTNVCVAKYARRQGIASNMLLLAIDAARLDGAESIYIHVHKDNLPARRLYDHVGFKMVDMDGARQSSDLCLLSFNSMH

SEQ ID NO: 134222 - protein, 69 aa, Triticum aestivum
  Clone ID: PAT_TA_28640.pep
MTLEEAPFYPREKLVQKQQYFQKLSKHIHLKGRYDVVTSVAIPLALAGTSLFMIGRGIYNMSNGIGKKE

SEQ ID NO: 134223 - protein, 69 aa, Triticum aestivum; identical to SEQ ID NO: 134222
  Clone ID: PAT_TA_28641.pep

SEQ ID NO: 134224 - protein, 103 aa, Triticum aestivum; identical to SEQ ID NO: 107316
  Clone ID: PAT_TA_28642.pep

SEQ ID NO: 134225 - protein, 103 aa, Triticum aestivum; identical to SEQ ID NO: 107316
  Clone ID: PAT_TA_28643.pep

SEQ ID NO: 134226 - protein, 227 aa, Triticum aestivum
  Clone ID: PAT_TA_28644.pep
MDSEHWISRLAAAKRFYAAQLGHAGADRAGMDELDMDGDENAGRPDFTCPYCYEDHDVASLIAHLEEDHPFEPHAAPCPICSEKVSKDMLNHITMQHGYLFKNRRRLRRFAVPGSQSLSLLSRDLREAHLQVLLGGGGHRSSNNNAANISADPLLSSFGLSFPTLDAEETSKLSTPAQSDVPVLKEAAARPWRSSMDSSLTREEREQASVRAAFVQDLLLSTLFRDQ

SEQ ID NO: 134227 - protein, 172 aa, Triticum aestivum
  Clone ID: PAT_TA_28645.pep
RWPRRRPGSSAAAAGCLLRCSRCFLRRRPAPPARQQAPPPPSPPRRLPALPLPRPPWSLSRPRLALWAPRPPSRPQLLARPPWPPPSRRRPVPPPWSPQPRRGQAPRLRPPPARGPPLSWQPPRRRRASPPRAPPPSARPSGSGHQRWPLPSWMQENDRSGRGWLAEASPTL

SEQ ID NO: 134228 - protein, 103 aa, Triticum aestivum
  Clone ID: PAT_TA_28646.pep
MSGRGKGGKGLGKGGAKRHRKVLRDNIQGITKPAIRRLARRGGVKRISGLIYEETRGVLKIFLENVIRDAVTYTEHARRKTVTDMDVVYALKRQGRTLYGFGG

SEQ ID NO: 134229 - protein, 379 aa, Triticum aestivum
  unsure (1)..(379): unsure at all Xaa locations
  Clone ID: PAT_TA_28647.pep
MASLPNGAAAASSAAGGAPPVDKEVDFANYFCTYAYLYHQKEMLCDRVRMDAYHSAVFRNPHHFRGKVVLDVGTGSGILAIWSAQAGARKVYAVEATNVAEHARELVRANGVADIVEVIQGTMEDIVLPEKVDVIISEWMGYYLLRESMFDSVICARDRWLNPGGVMYPSHARMWLAPIRSGLGDKKMEDFEIAMNDWNHFVXEDTQAYYGVNMNALTKAYRAEHEKFYLKSSIWNNLHPNQLIGQPAVVKEMDCLTATVEEIREVRAQVTLPINQDRTRLAALAGWFDVHFRGSKQNPAVEEVELNTAPDENGGTHWGQQVFLMTPAPRVNEGDSINVSFSMVRSKENHRLMDMDITYELHEASGRKLPAVATKIFLE

SEQ ID NO: 134230 - protein, 120 aa, Triticum aestivum
  Clone ID: PAT_TA_28648.pep
KLNHNSEGEDWLPASRTHAGYSAAAPVTWRRTGRAGGDYFFLCAWMNLEFLRSSSVKPAVILVMRAPVTAKPARKGQVRPHSRRKNTGHGSNAEKNFISGRFDLDLRLGLDWIGFESAKI

SEQ ID NO: 134231 - protein, 131 aa, Triticum aestivum
  Clone ID: PAT_TA_28649.pep
PAGLWTAPDATHHRSSHPTLARSSRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134232 - protein, 221 aa, Triticum aestivum
  Clone ID: PAT_TA_28650.pep
GNASTITNVPQPKASRTKQKGNNGGAPTAATGRSARMGAPYITNNTTDIWGALRPIEKLRQRWGTGDACHIYPKSILRALGPSWPSSLLSSSLVPSSAPLSSTVLTALKMGFHRWASRLTTPSAHLSFSASLVSGLWREITVTAWAMASCRSCRSSSPAATGLLLAGRRNLTSMVRASCLKITLAFALYIALAAAVLLQLAAKASRRKRRRKAAMANGSGR

SEQ ID NO: 134233 - protein, 423 aa, Triticum aestivum
  Clone ID: PAT_TA_28651.pep
MASGGRTDLDGAAVAPLTICVIGAGGFIGSHLCEKLMAETPHVVLAVDVYCDKIRHLVDPPPPHLAGRISFHRLNIKNDSRLEGLIKMADLTINLAAICTPADYNTRPLDTIYSNFIDALPVVKYCSENSKRLIHFSTCEVYGKTIGSFLPKDHPLRKEPEFYVLTEDESPCIFGPIVKQRWSYACAKQLIERLVFAEGAENGLEFTIVRPFNWIGPRMDFIPGVDGPSEGVPRVLACFSNNLLRREPLKLVDGGESQRTFVYIKDAIEAVLLMIENPARANGHIFNVGNPDNEVTVRELAEMMTEVYAKVSGEPPLEEPVIDVSAKEFYGEGYDDSDKRIPDMTLINKQLGWNPKTPLKDLLETTLTYQHKTYKEAVKTQMCLGHGDAFKLDDDGAAMLLLIFWKPDTYIVVKPSSSFLSRL

SEQ ID NO: 134234 - protein, 103 aa, Triticum aestivum; identical to SEQ ID NO: 107316
  Clone ID: PAT_TA_28652.pep

SEQ ID NO: 134235 - protein, 130 aa, Triticum aestivum
  Clone ID: PAT_TA_28653.pep
RPFRDPTSRHHHRSSSVSISVSSKQSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134236 - protein, 210 aa, Triticum aestivum
  unsure (1)..(210): unsure at all Xaa locations
  Clone ID: PAT_TA_28654.pep
MPGSIAFGRFDDSFSLASFKAYIAEFISTLIFVFAGVGSAIAYTKVSGGAPLDPSGLIAVAICHGFRAVPSRSAIGANISGGHVNPAVTFGXLPSAGQITILTGIFYWXVAQLLGAIVGAFLXVQFCTGVATPTHGAXSAWGAFEGVVMEIIVTFGLVYTVYATAADPKKGSLGTIAPIAIGFIVGANILVAGPFSGGSMNPARSFGNDY

SEQ ID NO: 134237 - protein, 342 aa, Triticum aestivum
  Clone ID: PAT_TA_28655.pep
SCRIRHERHHRSPPSPPPDLQIPTPSSVHGDRLRLADLLAGGRALPRRPLPQLRRLPRPRRGRRPRLRGRRRLLLPGLPRPLRLPPRLRRRRTPSACPDSNGNGMHHDAEDDGLFTDSGPVLPDPAQMGADEGFLLREWRRQNALLLEEKEKHEKELRSQIILEAEEFKKGFVEKRKLNLETSKDHNREREKLFLSNQEKFHKGADKQYWKAISELIPQEIAHIEKRTGKKDKDKKPGIIVVQGPKPGKATDMARMRQILSKLKHTPPPHMKPPPPPAVAPAGKDGAPAAAGKDGAKAAATPAAKDAPANGTVPEKENAAPAVAAAPAAAAPAPPAEPIAAA

SEQ ID NO: 134238 - protein, 227 aa, Triticum aestivum
  Clone ID: PAT_TA_28656.pep
MDSEHWISRLAAAKRFYAAQLGHAGADRAGMDELDMDGDENAGRPDFACPYCYEDHDVASLIAHLEEDHPFEPHAAPCPICSEKVSKDMLNHITMQHGYLFKNRRRLRRFAVSGSQSLSLLSRDLREAHLQVLLGGGGHRSSNNNAANISADPLLSSFGLSFPTLDAEETSKLSTPAQSDVPVLKEAAARPWRSSMDSSLTREEREQASVRAMFVQDLLLSTLFRDQ

SEQ ID NO: 134239 - protein, 207 aa, Triticum aestivum
  Clone ID: PAT_TA_28657.pep
MSKMADEKVISAPATGGGEDGLIAGDLSAAEARVRPLETLLRAAPLGLCVAAMAVMLRDTQTNEYGTVSYSDLGGFKYLVYANGLCAAYSLVSAFYTAVPRPATLSRSWIVFLLDQVFTYLILAAGAASAELLYLAYNGDKEVTWSEACGVFGGFCRQARTSVAITFGSVVCYILLSLISSYRLFSAYDAPMPSLGNKGVEIAAFPR

SEQ ID NO: 134240 - protein, 185 aa, Triticum aestivum
  Clone ID: PAT_TA_28658.pep
MSSPSKRREMDLMKLMMSDYKVETVNDGMQEFLVEFRGPEESLYQGGVWKVRVELPDAYPYRSPSIGFVNKIYHPNVDELSGSVCLDVINQTWSPMFDLVNVFEVFLPQLLLYPNPSDPLNGEAAALLMRDRPAYEQKVKEFCEKYAKPEDAGITPEDNSSDEELSEEDDDDSGDDEPILGHADP

SEQ ID NO: 134241 - protein, 366 aa, Triticum aestivum
  Clone ID: PAT_TA_28659.pep
MLGAARRSGCVLGQLMQTLRPAASAATAARSYSATPKEMTVREALNSALDEEMSADPSVFLMGEEVGEYQGAYKITKGLLDKYGPDRVLDTPITEAGFTGIGVGAAYQGLRPVVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKAEVLDSSFSVPIGKAKIEREGKDVTITAFSKMVGYALQAAEILSKEGISAEVINLRSIRPLDRAAINASVRKTNRLVTVEEGFPQHGVGAEICMSVVEDSFEYLDAPVERIAGADVPMPYAANLERLAVPQVEDIVRAAKRACYRSS

SEQ ID NO: 134242 - protein, 522 aa, Triticum aestivum
  unsure (1)..(522): unsure at all Xaa locations
  Clone ID: PAT_TA_28660.pep
RPLLSACAHRLSSPSSLLPPSASGRGRERGRERGRAGATRGSIVPSRQLWHSELLIKMPALRMKRKFDDDIFGNEFDTKSMKSMKISNFQVDEFEQAFVLNSSYKDPQDEPESTTQLAGQHSRVTEFSGLHAILGVTSVALLKDLISETVVPPNLEPDSLSNNDDGKSQSNVVNTCDKEFADEDVNSAAQDICAVNDHEKSLGSNPDCSLLDIYNPDDAFPFLFDVPTGLLASYSTFCDEFVPIDSLIDMSGICGVFPLNESTVEGGIGNEPCPSPGDMCFNNSGGECFGHSEVLEWLNPYMDEEDLPNLIDYTELSSNATCVSKEQGARKVTLVLDLDETLVHSTMEHCDDADFSFPVSFGMKEHLVYVRKRPHLHMFLQKMAEMFDVVIFTASQSVYADQLLDRLDPENTLFLKRFFRESCVFTENGYTKDLTVIGVDLAKVAIIDNTPQVFQLQVNNGIPIESWYNNPFDEGLPQLIPFLDTLAVADDVRPIIAKRFGXKRTMAEVFQHVLGRVCWLLT

SEQ ID NO: 134243 - protein, 103 aa, Triticum aestivum; identical to SEQ ID NO: 107316
  Clone ID: PAT_TA_28661.pep

SEQ ID NO: 134244 - protein, 419 aa, Triticum aestivum
  unsure (1)..(419): unsure at all Xaa locations
  Clone ID: PAT_TA_28662.pep
MLGAARRQLGSGPMLGQVLRRLRPAAAASTEAARGYSSAAKEITVRDALNSALDEEMSADPSVFLMGEEVGEYQGAYKITKGLLDKYGPDRVLDTPITEAGFTGIGVGAAYQGLRPVIEFMTFNFSMQAIDHIINSAAKSNYMSAGQINVPIVFRGPNGAAAGVGAQHSQCYAAWFAHVPGLKVLAPYSSEDARGLLKAAIRDPDPVVFLENELLYGESFPVSDEVLDSSFALPIGKAKIEREGKDVTITAFSKMVGYALQAAEILSKEGISAEVINLRSIRPLXDRAAINASVRKTNRLVTXEEGFPQHGXGAEICMSVVEESFEYLDAPIERIAGADVPMPYAANLERLAVPQIEDIVRAARRACYRALPMAGICVIEISLYSGPCFFPSPARAQKETCVFHNGIHNCPNSKRVKFL

SEQ ID NO: 134245 - protein, 127 aa, Triticum aestivum; identical to SEQ ID NO: 134089
  Clone ID: PAT_TA_28663.pep

SEQ ID NO: 134246 - protein, 248 aa, Triticum aestivum
  Clone ID: PAT_TA_28664.pep
MAEHKEESVMDKITEKFHGGSSSSSSSDDEGKLGSSSSVKAKIYRLFGREKPVHSVLGGGKPADLFLWRNKKISGGVLAGATAIWLLFEVLEYHLLTLLCHGFILTLGILFLWSNASAFVNKCPPNIPEVKIPEDLAVNVARSLRYEINRGFASLRAIGQGRDLKKFLIVVAGLWILSFLGSCCNFLTLFYIVFMVLYTVPVLYEKYEDKIDAFGEKAMVELKKYYAIFDEKCLSKIPKGPSKDKKQH

SEQ ID NO: 134247 - protein, 161 aa, Triticum aestivum
  Clone ID: PAT_TA_28665.pep
MGRAAIFLINCGCVLNLIGIYQGGVWKVRVELPDAYPYKSPSIGFINKIYHPNVDEMSGSVCLDVINQTWSPMFDLVNVFEVFLPQLLLYPNPSDPLNGEAAALMMRDRPAYEQKVKEFCEKYAKPEDAGITPEDKSSDEEELSEDEDDSGDEDIVGKPDP

SEQ ID NO: 134248 - protein, 168 aa, Triticum aestivum
  unsure (1)..(168): unsure at all Xaa locations
  Clone ID: PAT_TA_28666.pep
RGRGRGGRREERKEKASRLWAMAEFKHLCMAKFKEGVVVDDIIQELTKLAAELDTVKYFGWGKDVLNQEALTQGFTHVFVMTFASAEDLAACXAHEKHSAFRRPPSWPALRQVVVMDFPFGLRQASAACLDPPPVSLTKHGCANYLSICCSSGVMVGVPELLLAHVNW

SEQ ID NO: 134249 - protein, 248 aa, Triticum aestivum
  Clone ID: PAT_TA_28667.pep
MPGSIAFGRFDDSFSLASFRAYIAEFISTLIFVFAGVGSVIAYTKVSGGAPLDPSGLIAVAICHGFGLFVAVAIGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWVYWAGPLIGGGLAGVVYRYLYMWDDHSPVAGNDY

SEQ ID NO: 134250 - protein, 103 aa, Triticum aestivum; identical to SEQ ID NO: 107316
  Clone ID: PAT_TA_28668.pep

SEQ ID NO: 134251 - protein, 252 aa, Triticum aestivum
  unsure (1)..(252): unsure at all Xaa locations
  Clone ID: PAT_TA_28669.pep
MMGYQKGVDIEAGTSGGTGTAAPTRGLYPGMTESPELRWALIRKIYVILSLQLLLTAVVAAVVVKVRAIPHFFVSSSAGLGLYIFLIIFPFIVLCPLYFYRQKHPVNLLLLGVFTVAISFAVGMTCAFTSGKVILEAAILTTVVVFSLTAYTFWAAKRGQDFSFLGPFLFASLIMLLVFGFIQILFPMGKLSHMIYGALAALIFSGYIVYDTDNIIKRYTYDEYVWAAVSLYLDVINLFLXALLTLFRAGDS

SEQ ID NO: 134252 - protein, 120 aa, Triticum aestivum
  Clone ID: PAT_TA_28670.pep
QHTHTEKPISPEREASTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134253 - protein, 174 aa, Triticum aestivum
  unsure (1)..(174): unsure at all Xaa locations
  Clone ID: PAT_TA_28671.pep
RWRRWHRRACSWREEWQWRERPRKGRRRTSKSRSAYGRGASPAPIRFPPGNFKHSLTLFSKSFSSFPRGTCSLSVSRLYLALDGVYRPIWAAFPNNPTRXRRLVGRQGPGRTGLSPSQAPLSRGLGPGPSLRTPXPDYNSDGTAARFSSWAAPGSLAVTRGILVSFFSSAYLYA

SEQ ID NO: 134254 - protein, 143 aa, Triticum aestivum
  Clone ID: PAT_TA_28672.pep
MATVSDSLVWELVRKNNCFLIKQFGNSNAKVQFSKEPNNLYNVHSYKYSGLANKKTVTVQPAAEKEMTVVLSTTKSKKQNKPAAFTHKTVMRKEFRKMAKAVKNQVSDNYCRPDLTKPALARLSAVYRSLQVAKSGVKKKNRQ

SEQ ID NO: 134255 - protein, 368 aa, Triticum aestivum
  unsure (1)..(368): unsure at all Xaa locations
  Clone ID: PAT_TA_28673.pep
MGKGGKGEAAAAVAGEGENMAAWLVAKNTLKIMPFKLPPLGPYDVRVRMKAVGICGSDVHYLKEMRIAHFVVKEPMVIGHECAGIIEEVGDGVKHLAVGDRVALEPGISCWRCRHCKGGRYNLCDDMKFFATPPYHGSLADQIVHPGDLCFKLPDNVSLEEGAMCEPLSVGVHACRRADVGAEKSVLIMGAXGPIGLVTMLSARAFGAPRIVIADVDDHRLSVAKSLXGADAVVKVSGNTEDLAGEIERIQAAMGGDIDVSLDCAGFSKTMSTALEATRXGGRVCLVGMGHNEMTVPLTSAAIREVDVVGIFXRYKDTWPLCLEFLRSGKIDVKPLITHRFGFSQGEVEEAFEVSARGRDAIKVMFNL

SEQ ID NO: 134256 - protein, 381 aa, Triticum aestivum
  Clone ID: PAT_TA_28674.pep
MASPATGDSDQVLVEANGSTRTLVLNRPKQLNALSSAMVTGLLKCFTSYEEENTVKLLIVKGKGRAFCAGGDVAEVAQSINNDTWKYGADFFHTEFLLNYIIATYSKPQVSLLTGIVMGGGAGVSIHGRFRVATGNTVFAMPETALGLFPDIGASYFLSRLPGFYGEYVGLTGARLDGAEMLACGLATHFVPLNRMPLLEESLKKVDTSDPFAICGIIDQFSQQPSVKGSSAMNRMEIINRCFSKRTVEEIISALEQEAPSVADKLVTAAIQSLRKASPTSLKISLASIREGRLQTVGECLRREYRMVCHVMRGDFSRDFFEGCRAILVDKDRNPKWMPPTLDQVHDGVVAKYFSKVDDPQWEDLNLPTRSSHGRRIVPKL

SEQ ID NO: 134257 - protein, 250 aa, Triticum aestivum
  unsure (1)..(250): unsure at all Xaa locations
  Clone ID: PAT_TA_28675.pep
MAEHKEESVMDKITEKFHGSSSSSSSSDDDERKSGSSSSVKAKIYRLFGREKPVHSVLGGGKPADLFLWRNKKISGGVLAGATAIWLLFEVLEYHLLTLLCHGFILTLGILFLWSNASAFVNKCPPNIPEVKIPEDLAVNVARSLRYEINRGFASLRAIGQGRDLKKFLIVVAGLWILSFLGSCCNFLTLFYXIVFMVLYTVPVLYEKYEDKIDAFGEKAMVELKKYYAIFDEKCLSKIPKGPSKDKKQH

SEQ ID NO: 134258 - protein, 443 aa, Triticum aestivum
  Clone ID: PAT_TA_28676.pep
MASSELTYRGQQAAAADGAHGPAESKPRTRQQLPQPLRYVLGEQRLVFSLVGMALATLVFLLLSPSTTTTTSSSSSVAHLAAVGLVSRQYQSGGAGRMAFEESGTGGVRHGRVPLGLKRKGLRVVVTGGAGFVGSHLVDRLLARGDSVIVVDNFFTGRKENVAHHAGNPNFEMIRHDVVEPILLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGEHVGPFNLGNPGEFTMLELAKVVQDTIDPNARIEFRANTADDPHKRKPDITKAKELLGWEPKVALRNGLPLMVQDFRTRIFGDQKQQQQQPDGSE

SEQ ID NO: 134259 - protein, 124 aa, Triticum aestivum
  unsure (1)..(124): unsure at all Xaa locations
  Clone ID: PAT_TA_28677.pep
NSARGTGRREGRKEKASCLCLWAMAEFKHLCMAKFKEGVVVEDIIQELTKLAAELDTVKYFGWGKDVLNQEALTQGFTHVFVMTFASAEDLGGVXAHEKHTAFAATFMAALDKVVVMGLPLSLR

SEQ ID NO: 134260 - protein, 249 aa, Triticum aestivum
  Clone ID: PAT_TA_28678.pep
MMGYQKGVDIEAGTSGGAAAPTRGLYPGMTESPELRWALIRKIYVILSLQLLLTAVVAAVVVKVRAIPHFFVSSSAGLGLYIFLIIFPFIVLCPLYFYRQKHPVNLLLLGVFTVAISFAVGMTCAFTSGKVILEAAILTTVVVFSLTAYTFWAAKRGQDFSFLGPFLFASLIMLLVFGFIQILFPMGKLSHMIYGALAALIFSGYIVYDTDNIIKRYTYDEYVWAAVSLYLDVINLFLALLTLFRAGDS

SEQ ID NO: 134261 - protein, 378 aa, Triticum aestivum
  unsure (1)..(378): unsure at all Xaa locations
  Clone ID: PAT_TA_28679.pep
MARSIALVCFLVVGLCLVGAVCASAAAVGGNGARLVNAVYVFGDSLVDVGNNDYLPAPAPRANRPYGMDLPGRPTGRFTNGYNLADVISQRMGFEMSPKPYLSMLPHDKILLGPLXIGANYASGGSGILDTTGKGTLTMRTQVEYFKKAADNMICYPSKEEHLARSLFLLSGGGNDFSAFDPSTASPQAYVVKMVTTYIEHIQALYDMGARMVGILDVPPIGCTPGQRIDMPNGECNEQANSLAQAFNGLLRSSFAKAAAANMKELKYSIAANYNILKDMMANSFVAGLRQVKTACCGSGKLNAEVMCSHQGTTACPAAEHDDYMFWDMLHPTHATIQRGVVALFYGNGPKYGEPVNFGTLVTGQNVSPAIKMVVDEQ

SEQ ID NO: 134262 - protein, 103 aa, Triticum aestivum; identical to SEQ ID NO: 107316
  Clone ID: PAT_TA_28680.pep

SEQ ID NO: 134263 - protein, 880 aa, Triticum aestivum
  unsure (1)..(880): unsure at all Xaa locations
  Clone ID: PAT_TA_28681.pep
VDPRVRTFVPNYLGGKGAEQRIIFSEQISGAVDQSMDQAKGASMYSEEALRHSEGVWNHLSTNSRSKLPAEVEQKLTSAAAAASAAVSVAKAAAEAAKMASLAALQAKMMAEEALGSTKSANSLQRRDTGEVDVNNMASVSSLTPKSSWKIKDSTNAPGSTISVAREVARKRVEEASAAAKRAENLDAILKAAELAAEAVFKAGTIIGMGEPLPFTLSELLEAGPDGYWKSDRVKNTKAGNTSENAVTEELEIPTNKSGKKHDSKAKYDQAIQNLEPSSSVKSLQPDKMPSGNGIEDNPTAGPLNGNTTDTAPSIIWNGIGKGSLVEVFAAEGGSRAAWFSAKVLDINEDSACIHYEAHGEGTGLSKEWVSLKQEGEKAPHIRLAHPATISNLKGTRKRRRDTAGNYSWAIGDHVDAWIKNSWREGVISQNGEFGDTKFVVQFSAGDSLVLDAWNLRPSLVWQDGEWTEWSRARERKDKSNKGDSPYEKRQRTAVNDPVPTVEEARPPSKDKKSTNTVVSDPVPTVGEARPPTKDKKSTNTVVSDPVPTAGEARPPTKDKKSTNTVVKPDEPKPLALSDRDVLFNIGKGATEIKTTRRPGXLQKEGTKVFGVPKPGKKKKFMDVSKHYVGDQSDRISEGSASTRYAKHPVPQVPRPRESTLKLDQRAKRASDMRSRGLKSAKPQTTSTNGVPGEDPLSTPVPSSSALESTFAFAASTTSSSNPVNPTVEKNNLAHATDLRTEDASILESRLQATPTVPAVKKNPIAANRAKRKFVPSADSNVNRRVLKTPDVSAKTSSDSAEPRRSNRRIQPTSRLLEGLQSSLIASKITGEKLPRTNFKECYFCLKRKSPWLIQGNRDNHGVFVHIGSLPSMEAKGDRI

SEQ ID NO: 134264 - protein, 272 aa, Triticum aestivum
  unsure (1)..(272): unsure at all Xaa locations
  Clone ID: PAT_TA_28682.pep
MGGKAALLVALLAVSLVLEAQAGSGYGGGHAPTPTPVAPPPKHEKPPKGHKPPHHHHHAKPPAASHGPPTHAPAPPTYSPPTPKPTPPAPKPTPPTYAPIPKPPKPSPSPPAYHPTPKPAPPTYKPPTQPKPSPPXAYHPTPKPAPPTHKSPTQPKPSPPAYKPAPKVSPPAYHPTPKPAPPTHKPPTQPKPSPPAYKPAPKVSPPAYKPAPKVSPPAYKPAPKVSPPAYKPVPKPSPPAPKPTPPPYKPPTPTPPAYKPPTPSPPPPPYHH

SEQ ID NO: 134265 - protein, 212 aa, Triticum aestivum
  unsure (1)..(212): unsure at all Xaa locations
  Clone ID: PAT_TA_28683.pep
HRSPIPSPHLIPLRPRFLLLFLPLTPEAKPRELPMASTTFSSAFSILSLPSSSPSPSASAPRTLPVANRRRRAVAVASTVTESPKVLELGDAIAGLTLEEARNLVDHLQERLGVSAASFAPRCRRSRLPPAAAAEEAPVEKTEFDVVIEEVPSSARIATIKVVRALXTNLALKEAKDLIEGLPKKLKEAVSKDEAEEAKKQLEGVGAKVSIA

SEQ ID NO: 134266 - protein, 344 aa, Triticum aestivum
  unsure (1)..(344): unsure at all Xaa locations
  Clone ID: PAT_TA_28684.pep
MPVSRIAIGAPGELSHPDTFRAGVAEFISMLIFVFAGSGSGMAFGKLTDGGATTPAGLIAAALAHAFALFVAVSVGANISGGHVNPAVTFGAFVGGNISLLKAVVYWVAQLXLGSVVACLLLKIATGGEAVGAFSLSAGVGVWNAVVFEIVMTFGLVYTVYATAVDPKRGDLGVIAPIAIGFIVGANILAGGAFDGASMNPAVSFGPAVVSGVWENHWVXYWLGPFAGAAIAALXYDICFIXGQRPHEQLPTADYWKISIRIPSISHRHERLKLLQESSRCYRVIKQARLVSSSLSLVFEKFRVNSESVSQSGIISCLGVRTSSIMNASIPWSRLMFVQMYCLS

SEQ ID NO: 134267 - protein, 129 aa, Triticum aestivum
  Clone ID: PAT_TA_28685.pep
APPPQPRGSNTHTAAQPISPEKEESTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134268 - protein, 125 aa, Triticum aestivum
  Clone ID: PAT_TA_28686.pep
QLKHTGPRKHSTHKRKEQPGPDRTTYKEMDKTCIRSYTPAPHSWLHSLLKHPFAMTFPRTQGANIIMLRGQVFPICTKQAMHAARHILDLMMSSMRARTSRLSSSDGSMSSLLPASASITSWRLV

SEQ ID NO: 134269 - protein, 379 aa, Triticum aestivum
  unsure (1)..(379): unsure at all Xaa locations
  Clone ID: PAT_TA_28687.pep
MARSIALVCFLVVGLCLVGAVCASTVVAGGKNGGRLVNAVYVFGDSLVDVGNNDYLPAPAPRANRPYGXDLPGKPTGRFTNGYNLADVISQRVGFEMSPKPYLSMLPHDKILLGLCKIGANYASGGSGILDTTGKGTLTMRTQVEYFKKAADNMICYPSKEEHLARSLFLLSGGGNDFSAFDPSTASPQAYVVKMVTTYIEHIQALYNMGARMVGILDVPPIGCTPGQRVSMPNGECNEQANSLAQAFNGLLRAKLAEASATTMKELKYSIAANYNILNDMMDNSLVAGLRHVKTACCGSGKLNAEVMCSHQGTTACPAAEHDDYMFWDMLHPTHATIQRGVVALFYGNGPKYGEPVNFGTLVTGQNVSPAIKMVVDSQ

SEQ ID NO: 134270 - protein, 119 aa, Triticum aestivum
  Clone ID: PAT_TA_28688.pep
TRAATTTSSNTHTAAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134271 - protein, 103 aa, Triticum aestivum; identical to SEQ ID NO: 107316
  Clone ID: PAT_TA_28689.pep

SEQ ID NO: 134272 - protein, 163 aa, Triticum aestivum
  Clone ID: PAT_TA_28690.pep
HHSQAYQHHTLRPRHGDGPPHRSQPRPCPAVRVALRRVRGASRRGGEGLLRREGQDHEHLHQEHQEGGLLHAPKPGLPQRGEEGRHALHLPRPHRLRRAYRQPREARPPRPRLQNQTHRREQMRNLHRSTSATTRARVRSFDHGDRARGRPVKKTEIIGRITK

SEQ ID NO: 134273 - protein, 133 aa, Triticum aestivum
  Clone ID: PAT_TA_28691.pep
VRRSRRPFGNPSSHHRPSDSTSARSSRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134274 - protein, 157 aa, Triticum aestivum
  Clone ID: PAT_TA_28692.pep
KTDGLFLKCCREVAEKYPEITYEEVIIDNCCMTLVKNPGTFDVLVMPNLYGDIISDLCAGLIGGLGLTPSCNIGEGGICLAEAVHGSAPDISGKNLANPTALMLSAVMMLRHLQFNDQADRIHNAILQTIAEGKYRTADLGGKSSTSDYTKAVCDHI

SEQ ID NO: 134275 - protein, 81 aa, Triticum aestivum
  unsure (1)..(81): unsure at all Xaa locations
  Clone ID: PAT_TA_28693.pep
RRLTCPASAASSPPPTSRPSAPXSSSSSPTSATSNSPSGANAELTPSGGGCHHHPRMREEFRSWGSRERKASEGDGEIMAE

SEQ ID NO: 134276 - protein, 91 aa, Triticum aestivum
  Clone ID: PAT_TA_28694.pep
MAKAAAMLVLVALVVAAMATGGAAQCNAGSLAVCTSPIISGTPPSKTCCNNLKSQRGCFCKFARNPAYSSYINSRNAGKTLTSCGIAVPKC

SEQ ID NO: 134277 - protein, 141 aa, Triticum aestivum
  Clone ID: PAT_TA_28695.pep
TLSLSLSLSLSLSLSLSLSLSLSLSLSGNGGGGNGGGGNGGGGNGGGGNGGGGNSTQCPLDALKLGVCANVLGLLNLTLGSPPVQPCCSLIQGLADLEAALCLCTTLNLNLLGINLTLPIALSLVLNNCGKNVPSGFQCPN

SEQ ID NO: 134278 - protein, 151 aa, Triticum aestivum
  Clone ID: PAT_TA_28696.pep
MGRMHSRGKGISSSALPYKRTPPSWVKTAVADVDELITKAAKKGQMPSQIGVLLRDQHGIPLVKSVTGSKILRILKAHGLAPEIPEDLYFLIKKAVAIRKHLERNRKDKDSKFRLILVESRIHRLARYYKRTKKLPPTWKYESTTASTLVA

SEQ ID NO: 134279 - protein, 219 aa, Triticum aestivum
  Clone ID: PAT_TA_28697.pep
MDSEHWISRLAAAKRVYAAQLGHIDDMAGMGMEEEDMDMEDDGEMDMEMEMQLEEARWPEVACPYCYEDYDLGSLCVHLEEDHPYEPHPAPCPICSEKITRDMLNHITMHHGYLFKALLGGGHSHRSRNTTAATTNIYADPLLSSFGLGFATSDAEEPSKSSVPVLDDTSILKEAPPQPWESSIDSSLTSEEREQKRKQATSRATFVQDLVLSTLFGDD

SEQ ID NO: 134280 - protein, 887 aa, Triticum aestivum
  unsure (1)..(887): unsure at all Xaa locations
  Clone ID: PAT_TA_28698.pep
MADAPVELPGRLAILPFRNKVLLPGAIVRIRCTNPSSVKLVEQELWQREDKGLIGVLPVRDSEAAAVGSILSPGVGSDSGEGGRRSPGGSGGESTKQDAKSGKEPIHWHSRGVAARALHLSRGVEKPSGRVTYIVVLEGLCRFSVEELNARGSYHVARVSRLDMTKTELEQAEQDPDLIALSRQFKATAMELISVLEQKQKTVGRTKVLLETVPVYRLAXDIFVASFEISFEEQLAMLDSVDLKVRLSKATELVDRHLQSILVAEKITQKVEGQLSKSQKEFLLRQQMRAIKDELGDNDDDEDDIAALERKMQNAGMPANIWKHAQRELRRLRKMQPQQPGYSSSRAYLELIADLPWQKVSEERELDLRAAKESLDRDHYGLTKVKQRIIEYLAVRKLKPDARGPVLCFVGPPGVGKTSLATSIAKALNRKFIRISLGGVKDEADIRGHRRTYIGSMPGRLIDGLKRVSVNNPVMLLDEIDKTGSDVRGDPASALLEVLDPEQNKTFNDHYLNVPFDLSKVVFVATANRMQPIPPALLDRMEVIELPGYTPEEKLKIAMKHLLPRVLEQHGLSSAYLQIPEAVVKLIIERYTREAGVRNLERNLAALARAAAVKVAELDSTLRLGKEMQPITTTLLDSRLADGGEVEMEVIPMGQDISNTYENSSPMIVDEAMLEKVLGPPRFDDREAADRVSFPGVSVGLVWTSFGGEVQFVEAAAMAGKGDLHLTGQLGDVIKESAQLALTWVRARSADLNLSPTSDINILESRDIHIHFPAGAVPKDGPSAGVTLVTSLVSLFSNRKVRADTAMTGEMTLRGLVLPVGGVKDKVLAAHRYGIKRVILPERNLKDLAEIPAPILAGIEILLVKRIEEVLGHAFENGFPLRLHSSL

SEQ ID NO: 134281 - protein, 108 aa, Triticum aestivum; identical to SEQ ID NO: 134217
  Clone ID: PAT_TA_28699.pep

SEQ ID NO: 134282 - protein, 179 aa, Triticum aestivum
  unsure (1)..(179): unsure at all Xaa locations
  Clone ID: PAT_TA_28700.pep
MASTTFSSAFSILSLPSSSPSPSASAPRTLPVANRRRRAVAVASTATESPKVLELGDAIAXGLTLEEARNLVDHLQXNVLASPAASFAPAAAVAAPAATAAEEAPXVEKTEFDVVIEEVPSSARIATIKVVRALTNLALKEAKDLIEGLPKKLKEAVSKDEAEEAKKQLEGVGAKVSIA

SEQ ID NO: 134283 - protein, 103 aa, Triticum aestivum; identical to SEQ ID NO: 107316
  Clone ID: PAT_TA_28701.pep

SEQ ID NO: 134284 - protein, 103 aa, Triticum aestivum; identical to SEQ ID NO: 107316
  Clone ID: PAT_TA_28702.pep

SEQ ID NO: 134285 - protein, 125 aa, Triticum aestivum
  Clone ID: PAT_TA_28703.pep
QPITTPPPNPTRAAAPRGSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134286 - protein, 151 aa, Triticum aestivum; identical to SEQ ID NO: 134278
  Clone ID: PAT_TA_28704.pep

SEQ ID NO: 134287 - protein, 108 aa, Triticum aestivum; identical to SEQ ID NO: 134217
  Clone ID: PAT_TA_28705.pep

SEQ ID NO: 134288 - protein, 245 aa, Triticum aestivum
  Clone ID: PAT_TA_28706.pep
GKGSLEPWSHAYTWEEDFTASDDDEDEGEYGQIEERKPEKKKKEDKPKKIKEDDKKKKKPARTCVQIEEIPEDNTAGCDAIRKAFAMGNGKGKAKELSPQDAALLIQMNYRAHLAHRSQVLRCLRDLAVAKAKLKELRSLFYNLSYRRRLSHDHEERQRFSEKIIVLLLTVDALEGPDFMVRTAKKSMLEELESMLEIVDPQPPGKQRSFSRRKFDLPEGGAIPNEKTAGVNNAVRVINTGKGKQ

SEQ ID NO: 134289 - protein, 127 aa, Triticum aestivum
  Clone ID: PAT_TA_28707.pep
HASAHASAPATHTQQPSEARRRSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134290 - protein, 166 aa, Triticum aestivum
  Clone ID: PAT_TA_28708.pep
IHGGHRHLLERRLGQHPRQKITIWNLNMMSKFKWELHRVIYLDSVWGSSGYQELHIPCRLPEFPIISADDPDVVCCLLREEEFHGEAWMIMVDMKQAHVQSCTPYINQQSCYAKSVGVDVQARKSRFANVPLLPAVFSRHLERPTGMLWNNDKLAPHPSKKSKFAR

SEQ ID NO: 134291 - protein, 151 aa, Triticum aestivum; identical to SEQ ID NO: 134278
  Clone ID: PAT_TA_28709.pep

SEQ ID NO: 134292 - protein, 369 aa, Triticum aestivum
  unsure (1)..(369): unsure at all Xaa locations
  Clone ID: PAT_TA_28710.pep
MLGAARRSGCVLGQLMQTLRPAATAARSYSATPKEMTVREALNSALDEEMSADPSVFLMGEEVGEYQGAYKITKGLLDKYGPDRVLDTPITEAGFTGIGVGAAYQGLRPVVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKAEVLDSSFXLPIGKAKIEREGKDVTITAFSKMVGYALQAAEILSKEGISAEVINLRSIRPLDRAAINASVRKTNRLVTVEEGFPQHGVGAEICMSVVEDSFEYLDAPVERIAGADVPMPYAANLERLAVPQVEDIVRAAKRACYRSSSMAANA

SEQ ID NO: 134293 - protein, 69 aa, Triticum aestivum
  Clone ID: PAT_TA_28711.pep
MTLEEAPFYPREKLVQKQQYFQKLSKHIHLKGRYDVVTSVAIPLALAGASLFMIGRGIYNMSNGIGKKE

SEQ ID NO: 134294 - protein, 126 aa, Triticum aestivum
  Clone ID: PAT_TA_28712.pep
ISTSLYTSPRQVYLTGEKRREAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134295 - protein, 331 aa, Triticum aestivum
  Clone ID: PAT_TA_28713.pep
MATAFDSPTSSPAAAPFHDDPFLSFADSPTPAAADAHVSGDAFPASPDPYAFRHDSAAAHPFGMPDSNGNGHAMHHDADDDGLFTDPGPVLPDPAQMGADEGFLLREWRRQNALLLEEKEKHEKELRSQIILEAEEFKKGFVEKRKLNLETSKDHNREREKLFLSNQEKFHKGADKQYWKAISELIPQEIAHIEKRTGKKDKDKKPGIIVVQGPKPGKATDMARMRQILSKLKHTPPPHMKPPPPPAAAPAGKDGTPAAAGKDGAKAVATPAAKDAPANGTVPEKENAAPAAAAPAAAAPAPPAEPIGCCLNEGDLVQPLILCSRVIFGCR

SEQ ID NO: 134296 - protein, 109 aa, Triticum aestivum
  Clone ID: PAT_TA_28714.pep
MEFKHLCLVRFKEGVVVEDIIEELTKLAAELDTVKFFGWGKDVLNQEALTQGFTHVFSMSFASAEDLAAYMGHEKHSAFAATFMAVLDKVVVLDFPFVVAKPAPSPEAA

SEQ ID NO: 134297 - protein, 114 aa, Triticum aestivum
  Clone ID: PAT_TA_28715.pep
KPISPEKEASTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134298 - protein, 119 aa, Triticum aestivum; identical to SEQ ID NO: 134065
  Clone ID: PAT_TA_28716.pep

SEQ ID NO: 134299 - protein, 207 aa, Triticum aestivum; identical to SEQ ID NO: 134239
  Clone ID: PAT_TA_28717.pep

SEQ ID NO: 134300 - protein, 91 aa, Triticum aestivum
  Clone ID: PAT_TA_28718.pep
MAKAAAMLVLVALVAAAMATGGAAQCNAGNLAVCASPIVSGTPPSKTCCNNLKSQRGCFCQFAHNRAYSSYINSPNARKTLVSCGVPVPKC

SEQ ID NO: 134301 - protein, 142 aa, Triticum aestivum
  Clone ID: PAT_TA_28719.pep
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRPGQGGPPRAGGPGAPGGAPAGAGAVPGAPAPRV

SEQ ID NO: 134302 - protein, 207 aa, Triticum aestivum
  Clone ID: PAT_TA_28720.pep
MSKMADEKVISAPATGGGEDGLIAGDLSATEARVRPLETLLRAAPLGLCVAAMAVMLRDTQTNEYGTVSYSDLGGFKYLVYANGLCAAYSLVSAFYTAVPRPATLSRSWIVFLLDQVFTYLILAAGAASAELLYLAYNGDKEVTWSEACGVFGGFCRQARTSVAITFGSVVCYILLSLISSYRLFSAYDAPMPSLGNKGVEIAAFPR

SEQ ID NO: 134303 - protein, 374 aa, Triticum aestivum
  Clone ID: PAT_TA_28721.pep
MASLQVGAGRGVGCCFGPLDGRRQERRAMAALRPPRAGAGAKVAEEDKVRLGESSVAVSKLGIGAWSWGDTTYWNDSEWDDRRLKEAKAAFDASIDNGMTFFDTAEVYGTALMGAVNSESLLGDFIRERQQKGAVEVTVATKFAALPWRFGRGSVLSALKKSLERLGLPSVELYQLHWPGLWGNEGYLDGLADAYEQGLVKAVGVSNYNEKRLRDAHARLKKRGVPLAVNQVNYSLIYRTPEENGVKAACDELGVTLIAYSPIAQGVLSGKYTPENPPTGPRGNTYTPEFLAKLQPLMNRIKEIGVSYGKKPTQVSLNWLTCQGNVVPIPGAKNAGQAMEFAGALGWSLTADEVEELRTLAREIKGIKMPIEES

SEQ ID NO: 134304 - protein, 146 aa, Triticum aestivum
  Clone ID: PAT_TA_28722.pep
REQKLELHRGGGRSRTSGSPGLQEFGTRPQQPPPATHTHREAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134305 - protein, 177 aa, Triticum aestivum
  Clone ID: PAT_TA_28723.pep
RWPPRRPAPLPPAAAASTGASSAAAGAAGSASAAGAASSFTSPAAAGSASATASLVSVSTTAGASVSLGASASGSAAAAGSASLASSVSAAAGASSLVSTTSTGAAGASTSVSAGAGTSSVFATSSAATGVSTAGASSVSAADGFCTSAVAIAVVDARKCLEWLAEASATVIDQSLR

SEQ ID NO: 134306 - protein, 108 aa, Triticum aestivum; identical to SEQ ID NO: 134217
  Clone ID: PAT_TA_28724.pep

SEQ ID NO: 134307 - protein, 250 aa, Triticum aestivum
  Clone ID: PAT_TA_28725.pep
SAHLRVTIMYNTTMTTRSVVYIYLPFSHLPVKVEPVGAAEHPINDGRGGDSLARRGRVFSDLQRRDGLGGHEARAGDCRLVERSLVVGRFQVPHFPPGLAGGCAVAPSRSTDDPLEGISLIGAHEPTGGVDIGCALRCPERNPDPAEGSQSLHASVLVQAPRWRDSSGVLTYEGHEEATASGYRSAFFVQPFLAPLSSAASFFSSSRDDGSRVCERFLQPGASSSQPASGRSSSSFAACFFFPFFKTFPA

SEQ ID NO: 134308 - protein, 249 aa, Triticum aestivum
  unsure (1)..(249): unsure at all Xaa locations
  Clone ID: PAT_TA_28726.pep
MAERKEESVMDKITEKFHGGSSSSSSSDDERRSGSSSSVKAKIYRLFGREKPVHSVLGGGKPADLFLWRNKKISGGVLAGATAIWLLFEVLEYHLLTLLCHGFILTLGILFLWSNASAFVNKCPPNIPEVKIPEDLAVNVARSLRYEINRGFASLRAIGQGRDLXKKFLIVVAGLWILSFLGSCCNFLTLFYIVFMVLYTVPVLYEKYEDKIDAFGEKAMVELKKYYAIFDEKCLSKIPKGPSKDKKQH

SEQ ID NO: 134309 - protein, 122 aa, Triticum aestivum
  Clone ID: PAT_TA_28727.pep
RPHRSSDSTTSARSSRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134310 - protein, 121 aa, Triticum aestivum
  Clone ID: PAT_TA_28728.pep
LLVPPILHLLAARRGSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134311 - protein, 225 aa, Triticum aestivum
  Clone ID: PAT_TA_28729.pep
MDSEHWISRLAAAKRFYAAQLGHADRAGMDELDMDGDENAGRPDFACPYCYEDHDVASLVAHLEEDHPFEPHAAPCPVCSEKVSKDMLNHITMQHGYLFKNRRRLRRFAVPGSQSLSLLSRDLREAHLQVLLGGGGHRSSNNNATNISADPLLSSFGLSFPTLDAEETSKLSTPAQSDVPVLKEAAARPWRSSIDSSLTREEREQARVRAAFVQDLLLSTLFRDQ

SEQ ID NO: 134312 - protein, 149 aa, Triticum aestivum
  Clone ID: PAT_TA_28730.pep
MAAVLTRPTPGTVQCFGRKKTAVAVAYCKPGRGLIKVNGAPIELIRPEMLRLKAFEPILLAGRSRFKDIDMRIRVRGGGKTSQIYSIRQAIAKSLVAYYQKYVDEAAKKEVKEIFARYDRTLLVADPRRCEPKKFGGRGARARFQKSYR

SEQ ID NO: 134313 - protein, 193 aa, Triticum aestivum
  unsure (1)..(193): unsure at all Xaa locations
  Clone ID: PAT_TA_28731.pep
LSITPLPRRSTRPPSWTLTQPVALHRAPHTLTLATAAAGSSSAAAGASSATAXTSGSAAGAASSFTSSATAGSASAXSATASLVSVSTTAGSFGASASGSAAAAGSGSLVSFVSAAAGASSLVASTSTGAGASTSASTGAGTSSVLATSSAATGVSTAGASSVSAAVGFWTSAVAIAVVDARKCPEWQTLQAS

SEQ ID NO: 134314 - protein, 147 aa, Triticum aestivum
  Clone ID: PAT_TA_28732.pep
PRVRGNCGGNGGGGNGGGGNGGGGNGGGGNGGGGNGGGGNGGGGNGGGGNGGGGNGGGGNSTQCPLDALKLGVCANVLGLLNITLGSPPVQPCCSLIQGLADLEAALCLCTTLNLNLLGINLTLPIALSLVLNNCGKNVPSGFQCPN

SEQ ID NO: 134315 - protein, 111 aa, Triticum aestivum
  Clone ID: PAT_TA_28733.pep
TASISSPAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134316 - protein, 122 aa, Triticum aestivum
  Clone ID: PAT_TA_28734.pep
AATPTLTEKPISPERGASTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134317 - protein, 550 aa, Triticum aestivum
  unsure (1)..(550): unsure at all Xaa locations
  Clone ID: PAT_TA_28735.pep
MPMPPPPPPPPQLHGVFIITLPPPDQPSKGKTITAFTYTDEPGAGAPAPPLNRGPPMATAGREARRSRRAVSRRAGAMVLVLGALALAAYYSFYSDVAVQFLGMEEEEAQKERNETKSFLFQLYPKAHQGRALREFGNIKLAAKRVDDGGGRKVTKKLDVKGATSAGTNSTVLLPIKGNVFPDGQYYTSIFVGNPPRPYFLDVDTGSDLTWIQCDAPCTNCAQGPHPLYKPAKEKIVPPRDLLCQELQGDQNYCETCKQCDYEIEYADRSSSMGVLAKDDMHLIATNGGKEKLDFVFGCAYDQQGQLLSSPAKTDGILGLSSAAISLPSQLASKGIISNIFGHCITRETNGGGYXFLGDDYVPRWGMTWAPIRGGPDNLYHTEAQKVNYGDQELSMHGHAGNSVQVIFDSGSSYTYLPEEMYKNLIDAIKDDSPNFVQDSSDTTLPLCWKADFSVRSFFKPLNLHFGRRWFVVPKTFTIVPDDYLIISEKGNVCLGLLNGTEINHGSTIIVGDVSLRGKLVVHDNERRQIGWANSECTKAQSQKGFPFFL

SEQ ID NO: 134318 - protein, 148 aa, Triticum aestivum
  Clone ID: PAT_TA_28736.pep
MASKRILKELKDLQKDPPTSCSAGPVGEDMFHWQATIMGPSDSPFTGGLFLVNIHFPPDYPFKPPKVSFRTKVFHPNINSNGSICLDILKEQWSPALTISKVLLSICSLLTDPNPDDPLVPEIAHMYKTDRAKYESTARSWTQKYAMG

SEQ ID NO: 134319 - protein, 175 aa, Triticum aestivum
  Clone ID: PAT_TA_28737.pep
MAAAGDAGEKKMITLKSSDGEEFEVEEAVAMESQTIRHMIEDDCADNGIPLPNVNSKILSKVIEYCNKHVQAKPADGAAAGAGAGASDAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 134320 - protein, 108 aa, Triticum aestivum; identical to SEQ ID NO: 134217
  Clone ID: PAT_TA_28738.pep

SEQ ID NO: 134321 - protein, 121 aa, Triticum aestivum
  Clone ID: PAT_TA_28739.pep
RREERKEKASRLWAMAEFKHLCMAKFKEGVVVDDIIQELTKLAAELDTVKYFGWGKDVLNQEALTQGFTHVFVMTFASAEDLAACMGHEKHSAFAATFMAALDKVVVMDFPLVFVKPAPPA

SEQ ID NO: 134322 - protein, 130 aa, Triticum aestivum
  Clone ID: PAT_TA_28740.pep
DRCNNAPPATHTHTAAKRSSPEREESTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134323 - protein, 149 aa, Triticum aestivum; identical to SEQ ID NO: 134213
  Clone ID: PAT_TA_28741.pep

SEQ ID NO: 134324 - protein, 69 aa, Triticum aestivum; identical to SEQ ID NO: 133977
  Clone ID: PAT_TA_28742.pep

SEQ ID NO: 134325 - protein, 108 aa, Triticum aestivum; identical to SEQ ID NO: 134217
  Clone ID: PAT_TA_28743.pep

SEQ ID NO: 134326 - protein, 119 aa, Triticum aestivum
  Clone ID: PAT_TA_28744.pep
MAKSSFKLEHPLERRQAEATRIREKYSDRIPVIVEKAGKSDIPDIDKKKYLVPADLTVGQFVYVVRKRIKLSAEKAIFIFVKNTLPPTAALMSAIYEENKDEDGFLYMTYSGENTFGLL

SEQ ID NO: 134327 - protein, 225 aa, Triticum aestivum
  Clone ID: PAT_TA_28745.pep
MDSEHWISRLAAAKRFYAAQLGHADRAGMDELDMDGDENAGRPDFACPYCYEDHDVASLVAHLEEDHPFEPHAAPCPICSEKVSKDMLNHITMQHGYLFKNRRRLRRFAVPGSQSLSLLSRDLREAHLQVLLGGGGHRSSNNNATNISADPLLSSFGLSFPTLDAEETSKLSTPAQSDVPVLKETAARPWRSSIDSSLTREEREQASVRAMFVQDLLLSTLFRDQ

SEQ ID NO: 134328 - protein, 149 aa, Triticum aestivum; identical to SEQ ID NO: 134213
  Clone ID: PAT_TA_28746.pep

SEQ ID NO: 134329 - protein, 160 aa, Triticum aestivum
  Clone ID: PAT_TA_28747.pep
PSQLLLRAPLAPHTLTLATAAAAASTGASSAAAGAAGSASAAGAASSFTSSAAAGSASATASLVSVSTTAGASASGSAAAAGSGSFVSSASTAAGASSLVSSTSTGAGASTSASTGAGASSVFATSSAATGFSTAGASSVSAADGFWTSAVAIAVVDARK

SEQ ID NO: 134330 - protein, 247 aa, Triticum aestivum
  Clone ID: PAT_TA_28748.pep
MAPNGDNTVANVHSGIDSTNKTLLKSDALYTYILDTTVFPREHECMRDLRLITDKHPWGYMQSSSDEAQLLGMLIKMAGAKKTIEVGVFTGYSLLATALALPEDGKVVAIDTDRECYEVGRPFIEKAGMAHKVDFREGTGLARLDELLVEDEGAASYDFAFVDADKPNYVRYHEQLLKLVRVGGTIIYDNTLWGGTVALPAGTPMSDLDTRFSAALRDLNAKLAADPRIEVCQLAIADGVTICRRLV

SEQ ID NO: 134331 - protein, 151 aa, Triticum aestivum; identical to SEQ ID NO: 134278
  Clone ID: PAT_TA_28749.pep

SEQ ID NO: 134332 - protein, 252 aa, Triticum aestivum
  Clone ID: PAT_TA_28750.pep
MPVSRIAIGAPGELSHPDTFRAGVAEFISMLIFVFAGSGSGMAFGKLTDGGATTPAGLIAAALAHAFALFVAVSVGANISGGHVNPAVTFGAFVGGNISLLKAVVYWVAQLLGSVVACLLLKIATGGEAVGAFSLSAGVGVWNAVVFEIVMTFGLVYTVYATAVDPKRGDLGVIAPIAIGFIVGANILAGGAFDGASMNPAVSFGPAVVTGVWENHWVYWLGPFAGAAIAALVYDICFIGQRPHEQLPTADY

SEQ ID NO: 134333 - protein, 461 aa, Triticum aestivum
  Clone ID: PAT_TA_28751.pep
MEKALDRQRILLRHLEPAAGASPAASAVSASACAAGDSAAYHRGPCFADDVVIVAAYRTAICKAKRGSFKDTLPEDLLVPVFKALVDKTKLNPSEVGDIVVGTVLAPGSQRAIECRMAALYAGFPDTVPLKTVNRQCSSGLQAVADVAAAIKAGMYDIGIAAGVESMTVNKVNLVEKVNPKVELFAQARDCLLPMGLTSENVAQRFGITRMEQDQAAVESHRKAAAAVAAGKFKEEIVPVNTKIVDPKTGEEKEIVVSADDGIRSNTTLAVLSKLKPAFSKDGTTTAGNASQVSDGAGAVLLMRRDVATQKGLPILGIYRSFAAVGVDPAVMGVGPAVAIPAAVKAAGLQINDVDLFEINEAFASQYVYCSKKLDLDPAKVNVNGGAIALGHPLGATGARCVSTLLNEMKRRGKDCRFGVISMCIGSGMGAAAVFERGDAVDELTNARGVPSLNWLSKDTV

SEQ ID NO: 134334 - protein, 122 aa, Triticum aestivum; identical to SEQ ID NO: 134176
  Clone ID: PAT_TA_28752.pep

SEQ ID NO: 134335 - protein, 217 aa, Triticum aestivum
  Clone ID: PAT_TA_28753.pep
MAEYGGGYGHPYPRVDEYGNPVPPVDQYGNPIPREPGQVPAYSSGGASPSYGSAGAVTSADYGAGVTPGYGLSGAVHPHESVVGGAVSPSGAAHTHEGALSGGLAPGETTAYAYEGMVGRGISTGDQIQPTKEGHTTLGETLRRSSSSSSSSSSEDDGQGGRQRKKKSMKEKIKEKLPGNHKQEEHKAGHTVPAAGTGTHEKKGIMEKIKEKLPGHH

SEQ ID NO: 134336 - protein, 147 aa, Triticum aestivum
  Clone ID: PAT_TA_28754.pep
MTTVPGSLVWELVKKNNCFLIKQFGNSNAKVQFSKEPNNLYNVHSYKFSGLANSKTVAVQPSAGEDKAVVLSTTKTKKQNTPAKLQHKTLMRKEFRKMAKSVKNQVCDNYYRPDLTKPALARLSAVYRSLQVSKSGIKKKNRQPTKL

SEQ ID NO: 134337 - protein, 174 aa, Triticum aestivum
  Clone ID: PAT_TA_28755.pep
MAAAGDAGEKKMITLKSSDGEEFEVEEAVAMESQTIRHMIEDDCADNGIPLPNVNSKILSKVIEYCNKHVQAKPADGAAAAAGASDAAAPAAPAEDLKNWDAEFVKVDQATLFDLILAANYLNIKGLLDLTCQTVTDMIKGKTPEEIRKTFNIKNDFTPEEEEEIRRENQWAFE

SEQ ID NO: 134338 - protein, 103 aa, Triticum aestivum
  Clone ID: PAT_TA_28756.pep
ITIPGALVSGNWNEYNLNPLTRIHWRASLVPAARGNSSICLDILKEQWSPALTISKVLLSICSLLTDPNPDDPLVPEIAHMYKTDRAKYESTARSWTQKYAMG

SEQ ID NO: 134339 - protein, 143 aa, Triticum aestivum; identical to SEQ ID NO: 133983
  Clone ID: PAT_TA_28757.pep

SEQ ID NO: 134340 - protein, 111 aa, Triticum aestivum; identical to SEQ ID NO: 134315
  Clone ID: PAT_TA_28758.pep

SEQ ID NO: 134341 - protein, 191 aa, Triticum aestivum
  unsure (1)..(191): unsure at all Xaa locations
  Clone ID: PAT_TA_28759.pep
PPPWTLTQPAPPPRAPAPHTXRWPRRRPAPLPRPLGPPPLQPVFPRRRPPLLARQQAPPPPSPPRPQPALPLPQPPWSRPRLAPLALWALRPPARRQLLARAPWSPPSQRLPVPPPWSPQPRRGQAPRLRPPPARGPPPSSRPPRRPLASPPRAPPPSARPMGSGPARRTVTFISTTHMSTRTQTNLARAQ

SEQ ID NO: 134342 - protein, 248 aa, Triticum aestivum
  Clone ID: PAT_TA_28760.pep
MPGSIAFGRFDDSFSLASFKAYIAEFISTLIFVFAGVGSAIAYTKVSGGAPLDPSGLIAVAICHGFGLFVAVAIGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWIYWAGPLIGGGLAGVVYRYVYMCDDHSSVAGNDY

SEQ ID NO: 134343 - protein, 91 aa, Triticum aestivum
  Clone ID: PAT_TA_28761.pep
MAKAAAMLVLVALVVAAMATGGAAQCNAGSLAVCASPIISGAKPSTTCCNNLKSQRGCFCQYARNPAYSSYINSPNARKTLTSCGVAVPKC

SEQ ID NO: 134344 - protein, 184 aa, Triticum aestivum
  Clone ID: PAT_TA_28762.pep
TKNIKFNHNSEGEDWLAASRTHAGNSAAAPVTWRRTGRAGGDYLFLCAWTNLEFLRSSSVKPAVILVMRAPVTAKPARKGQVRPHSRRKNTGHGSNAEKNFISGGFDLDLRLGLDWIGFVSAKIWFSLSLWLRCGVDGLERCHQEPSHLYTGIIFEVDKMPDCWFFFCLAYQVAAFFCFLLLWL

SEQ ID NO: 134345 - protein, 247 aa, Triticum aestivum
  Clone ID: PAT_TA_28763.pep
MAPSGDNTVANVHSGIDSTNKTLLKSDALYTYILDTTVFPREHECMRDLRLITDKHPWGYMQSSSDEAQLLGMLIKMAGAKKTIEVGVFTGYSLLATALALPEDGKVVAIDTDRECYEVGRPFIEKAGMAHKVDFREGTGLERLDELLVEDDGAASYDFAFVDADKPNYVRYHEQLLKLVRVGGTIIYDNTLWGGTVALPAGTPMSDLDTRFSAALRDLNAKLAADPRIEVCQLAIADGVTICRRIV

SEQ ID NO: 134346 - protein, 161 aa, Triticum aestivum
  Clone ID: PAT_TA_28764.pep
PMAATLSEAVFFLGFDDSNVAYYITNQSGKNARSWIRTKNRKFNHNSEGGDWLAASRTHAGNSAAAPVTWRRTGRAGGDYLFLCAWTNLEFLRSSSVKPAVILVMRVPVTAKPARKGQVRPHSRRKNTGHGSNAEKNFISGGFDLDLRLGLDWIGFESAKI

SEQ ID NO: 134347 - protein, 119 aa, Triticum aestivum; identical to SEQ ID NO: 134065
  Clone ID: PAT_TA_28765.pep

SEQ ID NO: 134348 - protein, 103 aa, Triticum aestivum; identical to SEQ ID NO: 107316
  Clone ID: PAT_TA_28766.pep

SEQ ID NO: 134349 - protein, 87 aa, Triticum aestivum; identical to SEQ ID NO: 112653
  Clone ID: PAT_TA_28767.pep

SEQ ID NO: 134350 - protein, 248 aa, Triticum aestivum
  Clone ID: PAT_TA_28768.pep
MPGSIAFGRFDDSFSLASFRAYIAEFISTLIFVFAGVGSVIAYTKVSGGAPLDPSGLIAVAICHGFGLFVAVAIGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWVYWAGPLIGGGLAGVVYRYLYMCDDHSPVAGNDY

SEQ ID NO: 134351 - protein, 122 aa, Triticum aestivum; identical to SEQ ID NO: 134176
  Clone ID: PAT_TA_28769.pep

SEQ ID NO: 134352 - protein, 417 aa, Triticum aestivum
  unsure (1)..(417): unsure at all Xaa locations
  Clone ID: PAT_TA_28770.pep
MDSAAAQAQPTHAPADEEEARRRRGTDCVYYLASPLTCNKGSECEYRHSDAARVNPRDCWYWFNGNCANAKCAFRHPPLXDLLGASATPRAPQQPAPQVPVPAQALPPNGTAKPVVPCYYYQKGMCAKGNLCTFSHGPQFAGNPALQPHLQLKNSNSWTKPSNSPQQRTTPAIHGELKVGAQNGRPAQKQNPTSRAYHSPGIYQNQNNNPYVLSGAAKSYQPQRSVQAESAENVMETGEFVREPSAGSSVVAGSAEDDAERSFKEGHASSYRRASGEQNSGIRRQAHGGYELERSSHRSSSDRLVSERRLMQRESMPVTAESSDLRHRLLKQRRLNDSRSTQVPDRRDRRYPEDERGSHHHRRGEERAAHDGLSRSRLQGRIKLPGEASLDRLGPHTHTPHTLSSDQPQSHTSTSFS

SEQ ID NO: 134353 - protein, 139 aa, Triticum aestivum
  Clone ID: PAT_TA_28771.pep
MLTFEGEKFGGPAEGEAMDPDSVSKAFVQHYYHTFDSNRAALVGLYQDGSMLTFEGEKFGGPAAIAGKLGSLPFQQCQHKIDTVDCQPSGPQGGVLVFVSGTITTGPGEHPLKFSQMFHLLPAGGSFYVQNDMFRLNYG

SEQ ID NO: 134354 - protein, 126 aa, Triticum aestivum
  Clone ID: PAT_TA_28772.pep
GIRHEALLPQSTRAAAPRGSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 134355 - protein, 147 aa, Triticum aestivum; identical to SEQ ID NO: 134336
  Clone ID: PAT_TA_28773.pep

SEQ ID NO: 134356 - protein, 127 aa, Triticum aestivum
  Clone ID: PAT_TA_28774.pep
MATELAYAPPMKSGKLGFEGTQEVQHRIRITLSSKSVKNLEKVCSDLVKGAKEKQLKVKGPVRMPTKVLNITTRKSPCGEGTNTWDRFEMRVHKRVIDLVSSPDVVKQITSITIEPGVEVEVTISDQ

SEQ ID NO: 134357 - protein, 151 aa, Triticum aestivum; identical to SEQ ID NO: 134278
  Clone ID: PAT_TA_28775.pep

SEQ ID NO: 134358 - protein, 143 aa, Triticum aestivum; identical to SEQ ID NO: 133983
  Clone ID: PAT_TA_28776.pep

SEQ ID NO: 134359 - protein, 488 aa, Triticum aestivum
  Clone ID: PAT_TA_28777.pep
MGLVKEGADMEEGTLEIGIEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGSSINPSERTYPEEMIQTGISTIDVMNSIARGQKIPLFSAAGLPHNEIAAQICRQAGLVKRLEKGKHAEGGGEDDNFAIVFAAMGVNMETAQFFKRDFEENGSMERVTLFLNLANDPTIERIITPRIALTTAEYLAYECGKHVLVILTDMSSYADALREVSAAREEVPGRRGYPGYMYTDLATIYERAGRIEGRTGSITQIPILTMPNDDITHPTPDLTGYITEGQIYIDRQLHNRQIYPPINVLPSLSRLMKSAIGEGMTRRDHSDVSNQLYANYAIGKDVQAMKAVVGEEALSSEDLLYLEFLDKFERKFVAQGAYDTRNIFQSLDLAWTLLRIFPRELLHRIPAKTLDAFYSRDAAH

SEQ ID NO: 134360 - protein, 166 aa, Triticum aestivum
  Clone ID: PAT_TA_28778.pep
MAADGERWVGLAVDFSEGSRAALQWAADNLLRSGDNLLLLHVLKDPDYEQGETLLWEASGSPLIPLSEFSHPSIAKKYGVKPDAETLDMLNTIAKQKEVSVVSKVLFGDPREKLCQAIHDMPISSLVIGSRGLGKLKRVLLGSVSDYVVNNAACPVTVVKPASNHA

SEQ ID NO: 134361 - protein, 127 aa, Triticum aestivum; identical to SEQ ID NO: 134356
  Clone ID: PAT_TA_28779.pep

SEQ ID NO: 134362 - protein, 143 aa, Triticum aestivum
  Clone ID: PAT_TA_28780.pep
MATVSDSLVWELVRKNNCFLIKQFGNSNAKVQFSKEPNNLYNVHSYKYSGLANKKTVTVQPAADKEMTVVLSTTKSKKQNKPAAFTHKTVMRKEFRKMAKAIKNQVSDNYYRPDLTKPALARLSAVYRSLQVAKSGVKKKNRQ

SEQ ID NO: 134363 - protein, 127 aa, Triticum aestivum; identical to SEQ ID NO: 134356
  Clone ID: PAT_TA_28781.pep

SEQ ID NO: 134364 - protein, 219 aa, Triticum aestivum
  unsure (1)..(219): unsure at all Xaa locations
  Clone ID: PAT_TA_28782.pep
KVALHSSPLHWLTEHHAVPRRSTRLPPWTLTQPAPRPRAPAPHTXRWPPRRPAPLPRPRVPPPQQPVLPRRRPQPPARQQAPPPPSPPRPPPALPQPRPPWSLSRPRLAPRPPARPQLRARAPWSPPSQRRPAPPPXSPQPRRGQQALRLRPPPAWGPPPSSRPPRRPGVSPPRAPPPSARPPGSGHQQWPLPSWMQENARSGRRWLAQASATVTLWLI

SEQ ID NO: 134365 - protein, 149 aa, Triticum aestivum; identical to SEQ ID NO: 134213
  Clone ID: PAT_TA_28783.pep

SEQ ID NO: 134366 - protein, 168 aa, Triticum aestivum
  Clone ID: PAT_TA_28784.pep
VQSKSLNEDHPFEPHAAPCPVYSEKVSKDMLNHITMQHGYLFKNRRRLRRFAVPGSQSLSLLSRDLREAHLQVLLGGGGHRSSNNNATNISADPLLSSFGLSFPTLDAEETSKLSTPAQSDVPVLKETAARPWRSSIDSSLTREEREQASVRAMFVQDLLLSTLFRDQ

SEQ ID NO: 134367 - protein, 249 aa, Triticum aestivum
  unsure (1)..(249): unsure at all Xaa locations
  Clone ID: PAT_TA_28785.pep
MPASIAFGRFDDSFSLASFKAYIAEFISTLIFVFAGVGSAIAYSKVSGGAPLDPSGLIAVAICHGFGLFVAVAVGANISGGHVNPAVTFGLALGGQITILTGIFYWVAQLLGAIVGAFLVQFCTGVATPTHGLSGVGAFEGVVMEIIVTFGLVYTVYATAADPXKKGSLGTIAPIAIGFIVGANILVAGPFSGGSMNPARSFGPAVASGDFTNIWIYWAGPLIGGGLAGVVYRYLYMCDDHTAVAGNDY

SEQ ID NO: 134368 - protein, 177 aa, Triticum aestivum
  Clone ID: PAT_TA_28786.pep
MTTVPGSLVWELVKKNNCFLIKQFGNSNAKVQFSKEPNNLYNVHSYKFSGLANSKTVAVQPSAGEDKAVILSTTKTKKQNTPAKLQHKTLMRKEFRKMAKSVKNQVCDNYYRPDLTKPALARLSAVYKQITPSVLSERLRINGSLARRAIKDLMERGLIRMVSIHSSQQIFTRATNT

SEQ ID NO: 134369 - protein, 149 aa, Triticum aestivum
  Clone ID: PAT_TA_28787.pep
WRPAGNWDFERPPRAGRATSPNIWVYLGPAPLIGRVALARASSTDTYTCATTTSPVARATTTKPSHGKSRSVHNAFGNIKSAYVVGKSHECLDDVKEHPVVWVQDRSCSWMMHVPLSVKCDVVKVGWGFEKFFKKKKKKKKKKKKKLET

SEQ ID NO: 134370 - protein, 362 aa, Triticum aestivum
  Clone ID: PAT_TA_28788.pep
MALRRLLQGIVLPRTTGRHVGASFSTEAGETIRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKANGRERVSAIHKANIMRKTDGLFLKCCREVAEKYPEITYEEVIIDNCCMTLVKNPGTFDVLVMPNLYGDIISDLCAGLIGGLGLTPSCNIGEGGICLAEAVHGSAPDISGKNLANPTALMLSAVMMLRHLQFNDQADRIHNAILQTIAEGKYRTADLGGKSSTSDYTKAVCDHI

SEQ ID NO: 134371 - protein, 144 aa, Triticum aestivum
  unsure (1)..(144): unsure at all Xaa locations
  Clone ID: PAT_TA_28789.pep
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPEAWTGWPAPXGGPGGPGGAPAGAGAVPGAPAPRVAL

SEQ ID NO: 134372 - protein, 371 aa, Triticum aestivum
  Clone ID: PAT_TA_28790.pep
MFTKNRPPVNGLSEGPMIVACQWNMSSPTGPALHEVGGSFCRSLSSLRILLDAMGSNPAGGGAGAAAGGGGLSPLRRRRAAVGDHGARGGGEPTRPRTRGRTRGQPIPPTTSAQPAQTELASRAMAPNGDNTVANVHSGIDSTNKTLLKSDALYTYILDTTVFPREHECMRDLRLITDKHPWGYMQSSSDEAQLLGMLIKMAGAKKTIEVGVFTGYSLLATALALPEDGKVVAIDTDRECYEVGRPFIEKAGMAHKVDFREGTGLARLDELLVEDDGAASYDFAFVDADKPNYVRYHEQLLKLVRVGGTIIYDNTLWGGTVALPAGTPMSDLDTRFSAALRDLNAKLAADPRIEVCQLAIADGVTICRRIV

SEQ ID NO: 134373 - protein, 139 aa, Triticum aestivum
  Clone ID: PAT_TA_28791.pep
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRPGQGGPPRAGGPGGAPAGAGAVPGAPAPRV

SEQ ID NO: 134374 - protein, 436 aa, Triticum aestivum
  unsure (1)..(436): unsure at all Xaa locations
  Clone ID: PAT_TA_28792.pep
MPVSRIAIGAPGELSHPDTFRAGVAEFISMLIFVFAGSGSGMAFGKLTDGGVWNAVVFEIVMTFGLVYTVYATAVDPKRGDLGVIAPIAIGFIVGGNILDGESLRKHVKXLKRKSLWPKNLEEVIEKLVDIVHFLDLEIYDAFGHAESEEPQEPVKRHNRLGPAGLALHYANIISQIDTLVSRSSSISSNTRDNLYQGLPPTDKSALRPKLQTFEIKEELTVSQIKAEMEKTLRWLVPIAHNTTKAHHGFGWVGEWANTGSELSCKLSGQMDLTRIETLYHAEKDKTEAHILELVVWLHHLISKCRAANGDIRSPIKSPVRSPTQKGHTIRLQLDPANNSSPILTPEDQDMLRCVKYRKFVPGISKSQEFDTKSRHDKHSRLCKSNSHSPTSGNRKDLLSFRRFSMLPVIDFEIDRTKALDLIDRLDGLEIQSGIN

SEQ ID NO: 134375 - protein, 116 aa, Triticum aestivum
  Clone ID: PAT_TA_28793.pep
MARAQVMLMAVALVLMLAAVPRAAVAIDCGHVDSLVRPCLSYVQGGPGPSGQCCDGVKNLHNQARSQSDRQSACNCLKGIARGIHNLNEDNARSIPPKCGVNLPYTISLNIDCSRV

SEQ ID NO: 134376 - protein, 148 aa, Triticum aestivum; identical to SEQ ID NO: 134318
  Clone ID: PAT_TA_28794.pep

SEQ ID NO: 134377 - protein, 230 aa, Triticum aestivum
  unsure (1)..(230): unsure at all Xaa locations
  Clone ID: PAT_TA_28795.pep
HSHSTPSKKYHSTPLHWLTQHHAVPRRSTRPPPWKLTRPAPPPRAPAPHTLTXPPRRPAPLPRPRAPPPVQPVPPRRRPVLLARQEARPPPSPPRAPLALPQPRPPWSLSRPRLAPLSLWGPRPPARPQLLARAPWPPPSQRRQVPPPWSPRPRRGQQAPXPRPRPARGPPPSSRPPRRRRASPPWAPPPSARPSGSGHQRWPLPSWMQENARSGRGWLAEASATVIHRA

SEQ ID NO: 134378 - protein, 116 aa, Triticum aestivum
  Clone ID: PAT_TA_28796.pep
MARAQVMLMAVALVLMLAAVPRAAVAIDCGHVDSLVRPCLSYVQGGPSPSGQCCGGVQSLHNQAQSKSDRQAACNCLKGIARGIHNLNEDNARSLAPKCGVNLPYHISLDIDCNSV

SEQ ID NO: 134379 - protein, 214 aa, Triticum aestivum
  Clone ID: PAT_TA_28797.pep
MSSSQPEQDPKTKALNGYRRRLLEHRELDAKLKEMRLGLRTLDKEYDKSEDDIKALQSVGQVIGEVLKQLDDERFIVKNTSGPRYVVGCRNIIDKEKLKQGARVALDMTTLTIMRILPREVDPLVYNMSMEDPGDVSFAGIGGLSEQIRELREVIELPLMNPELFLRVGVKPPKGVLLYGPPGTGKTLLAKAVASTLQVNFLKVVSSAIVDKYI

SEQ ID NO: 134380 - protein, 102 aa, Triticum aestivum
  Clone ID: PAT_TA_28798.pep
SSHPILPNNPHSSILKSQHNLPIKTVKYCSSEHYGLLIYKHLLGAARDHADAHDVGDSSINPGFLSEESFSPRAQRELALRIAEVVYGELTIGGDVFHGEAA

SEQ ID NO: 134381 - protein, 153 aa, Triticum aestivum
  unsure (1)..(153): unsure at all Xaa locations
  Clone ID: PAT_TA_28799.pep
TAALCLDNFSSQVXERHNTPEIESGKSKEVLMNPLVISRNENEKVLIEPSVNSVRVSIKIKQADDLERILCHKFSRFLMMRAENFVILRRKPVEGYDISFLITNSHTEQMYKHKLVDFIVHFMEEVDKEISEMKLSVNTRARTVAESYLIQFA

SEQ ID NO: 134382 - protein, 325 aa, Triticum aestivum
  Clone ID: PAT_TA_28800.pep
MAPTKGAKKSGENINNNLHTQIKANHAPYGKDFDGHLATGRFSNGLVPSDLLAQKLHVKKLVAPWLNVDHTPEDLLTGVSFASGATGYDPLTPKIVSVITLEQQLEYFDEYRGKLVAIAGEEEAERIIDGAFFFVCAGTDDVANTYFTTPFRILEYDIPSYVDLLLVGVDKFLRSVSARGAKLIGFVGLPPIGCVPSQRTVGGGFHRRCEPKRNYAAQLYNSRVQVLINGLNAEAGFNTRIVYLGIYDIIQELAEGGERWGFTETTRGCCGTGLIEVTNLCDSRFMAVCQKVSKHVFFESIRPPERGSTIIVDSIWSPYSSPLHP

SEQ ID NO: 134383 - protein, 241 aa, Triticum aestivum
  unsure (1)..(241): unsure at all Xaa locations
  Clone ID: PAT_TA_28801.pep
GRVGFGVQNTVYNEGTHFVIPWFESPIIYDVRAKPRNVASLTGXXKDLQMVNITCRVLSKPRVDQLATVYRTLGQDYDERILPSIVNEVLKSVVAQFTASQLITQRERVSRLVRENLVRRALRFNIILDDVSITHVGFSPVFESAVEAKQIAQQDAQRAAFIVDKARQEKQSIIVRAQGEAKSAELIGEALKNKPGFLXLKRIEAARXVASMISRSPKKVMLYFETLLPKTHSNKEKVADE

SEQ ID NO: 134384 - protein, 135 aa, Triticum aestivum
  Clone ID: PAT_TA_28802.pep
SSATGYTGTRDRGRSGILCAHHQLNLQVFARQQKRRRHTHTRTDFYWHGLLVRVDAYVTRGPAGRASSVAAGAVGAGAAGAAAALAVVLRGLLHLEVALLGVNHDDAVGVALLHALGLVGAVAVAALVSHGGLGL

SEQ ID NO: 134385 - protein, 120 aa, Triticum aestivum
  Clone ID: PAT_TA_28803.pep
MEKSTKMVAVLVLAVLAAATSAEARNIKTTDAAAASKDAVLQPTTFPPFDRLGGLPGGSSMPGFSLPGSSGATPGISGIGSMPFLGGSSPGLGGSTGLGGFGGMPGSPAAAAVDEHAKKP

SEQ ID NO: 134386 - protein, 62 aa, Triticum aestivum
  Clone ID: PAT_TA_28804.pep
MADKCGNCDCADKTQCVKKGDGYGIVMVDTEKSHFEVQEAAENDGKCKCGASCTCTNCTCGH

SEQ ID NO: 134387 - protein, 121 aa, Triticum aestivum
  Clone ID: PAT_TA_28805.pep
MEKSTKMVAVLVLAVLAAATSAEARNIKTTEAASASKDAVLQPTTFPPFDRLGSGSPGFGGLPGSSGMPGFSLPGSSGATPGFGSIGSMPFLGGSSPGLGGFGGMPGSPAAAAVDEHAKKP

SEQ ID NO: 134388 - protein, 227 aa, Triticum aestivum
  Clone ID: PAT_TA_28806.pep
KQQANKASSHSHISQEQEHQFRSRLAMEKSTKMAAMLVLAVLAAATSAEARNIKTTEAAAASKDAVLQPTTLPALRPPRQRATGIQRRQPACRDSASPAAHGATCGSSAASANQCPSSARASSPWTSAVSPGPGRLLAGSCRGSPSWRVPDRPTPTAIDAGEDGDGRPLVARSAGVWEALDGAHWLMVQEVPLGVVLACWCGVRYPPRVPAFGGLDVLVFFLARLRH

SEQ ID NO: 134389 - protein, 117 aa, Triticum aestivum
  Clone ID: PAT_TA_28807.pep
AEAEAEAGLDSKKSSGMATALPILSRKLAGRALRPSLAAAAATQHQPATARLLHSTTKMQKGLISSHAQPKRENPVWRFYRRAKWYHLLMMYGPAFVFGYASMWDRPDGKKEPAPDQ

SEQ ID NO: 134390 - protein, 275 aa, Triticum aestivum
  unsure (1)..(275): unsure at all Xaa locations
  Clone ID: PAT_TA_28808.pep
MTRLSGKVAIVTGAASGIGFETAVLFAKEGAKVVCADLNEEGAKKTVVKISELVGKQDVAIAFKVDVSKESEVKALVDKAVEVYGKLNIMFNNAGIMHPQDDNALNTEERIWDLTMDINVKGVWYGCKYAIIAMRKSGGGSIINTASFVALMGAATPXLAYTASKGAVLAMTRELAMVHARENIRFNSLCPGPIRTPLLMGFLKTQEKKQRRLVPVPQGRFGEAIEQAYGALFLASDESSFVTGVAFKVAGGLASAYVTPEGEPTGTGPKNFAEI

SEQ ID NO: 134391 - protein, 184 aa, Triticum aestivum
  Clone ID: PAT_TA_28809.pep
MSLAKQNFANQSEEALNQQVNTELQASQVYLSMSAWAQHTSVALPGLEKYFREAAHEEREHAQKLIDYINTRGGRVVLRALQAPETDWKSAKNAVESALQLEKDVNKSLLNLHKIADSNGDPQMCDFIEAEYLGEQVEAIKKLADMVTQLNRVGEGLGVYLWDQQLYRDGTGAGSRATGNVKHG

SEQ ID NO: 134392 - protein, 101 aa, Triticum aestivum
  Clone ID: PAT_TA_28810.pep
FATTFTEFKQKFNDHNILICHFFYLYLVYTMPPSQHWDLGELHSWHTACCKNLQKNPWQDTSYPSTKHLYLSAASLVCKHLSAASLILAVHSAGNCSGRVG

SEQ ID NO: 134393 - protein, 101 aa, Triticum aestivum
  Clone ID: PAT_TA_28811.pep
LWATVMGALVQLLSARLGVVTGKHLAELCREEYPPWATRALWVMTELALVGADIQEVIGSAIAIKILSGGIVPLWGGVVITAFDWSVCFPAPAPAPARDQN

SEQ ID NO: 134394 - protein, 100 aa, Triticum aestivum
  Clone ID: PAT_TA_28812.pep
GPSWRVPTGRRDGTVSTMQEAVRELPSPSMTFPQLVALFAGKGLDVRDLVWLSGAHTIGIAHCSSFADRLYSYPSAGNGTGTVPPLDAAYAANLRQRKCR

SEQ ID NO: 134395 - protein, 271 aa, Triticum aestivum
  unsure (1)..(271): unsure at all Xaa locations
  Clone ID: PAT_TA_28813.pep
LVYLKGYNAIREAYPDIQMISNWDGASGPLDHPADLYDLHVYTGSRALFSMKNTFDNTSRSGPKAFVSEYAVTGNDAGRGSLLASLAEAAFLTGLEKNSDVVHMASYAPLFINDNDRTWNPDAIVFNSWQQYGTPSYWMQKFFRESSGATIHPITISSSYSGSLAASAXITWHDDENSFLRVKIVNFGPDAVSLTFSATGLQGSINALGSTATVLTSGSVMDENSFANPNKVVPVTIELRNASEEMEVTLPPHSLSAFDLALAQSRLVAEM

SEQ ID NO: 134396 - protein, 176 aa, Triticum aestivum
  Clone ID: PAT_TA_28814.pep
MAGDDGNGNSSAVRGGGGGSGQEEVQIEIAGSSKPAVSLAHEAPPQSAPVKHWQWWLMVVLNMFFLVAGQTSATLLGRFYYNEGGNSKWLSTFVQTAGFPVLFVAQFLFRPKSPSTQATTSGPEASITKITLIYIALGLIIAADDLMYSYGLLYLPVSTYSLVCASQLAFNAVFSY

SEQ ID NO: 134397 - protein, 189 aa, Triticum aestivum
  Clone ID: PAT_TA_28815.pep
MAVGGPPVPGLPGGRSGVGPTLFSMQSHPTYSLILSLMQVTFEKVIKRETFSVVLNMQIYTAFVATLASLVGLFASGEWKTLEGEMHMFSPGKVSYVMTVLWTAISWQIASVGVVGLIFVVSSLFSNVISTLALPIIPVFAVIFFHDKMDGIKIIAMLIAIWGFISYGYQLYVDDKKSRKTSSSVEENS

SEQ ID NO: 134398 - protein, 206 aa, Triticum aestivum
  Clone ID: PAT_TA_28816.pep
SNYKSVIQDLFSYNVIKRKQILNHYFFKDTIYISSSMTTKGVDNIQNIYNVWQNLNRTEPTITNIVFSGQTAVVHLIHNLSPIILPKFMSLGVPAISTLYFRETEPNSGLLKIYKQEDSLTLEGLIQCMPIMSFWYNHVLRVIAGKILVSTGDIFESALVYAQSITLQSQKIQMLTSGSEIKRSDSDSSDTYKGEPLQEHIYLEEE

SEQ ID NO: 134399 - protein, 280 aa, Triticum aestivum
  unsure (1)..(280): unsure at all Xaa locations
  Clone ID: PAT_TA_28817.pep
MAATLFSTALSHHFIPLPSAARPAAASAASFACGPLRAVSALLAPRRRLLLPVAVAVSSEFGTEDAEEEQSEGEGGGDSEAEYSEDLKVFVGNLPFTVDSAQLAGLFEQAGSVEXMVEVVYDRMTGRSRGFGFVTMGSAEEVAAAVEQFNGYTFQGRPLRVNSGPPPPXRDEFAPRTPRTMGGGGGGGSFDSANKLYVGNLSWGVDNSTLENLFSEQGKVLDAKVIYDRDSGRSRGFGFVTYGSADEVNNAISXLDGVDLDGRHIRVTVAAAKPREQRRF

SEQ ID NO: 134400 - protein, 206 aa, Triticum aestivum
  Clone ID: PAT_TA_28818.pep
MLRRRGGNGSSGQLAPEEQAAVLQCYVDALSLASLRRGHRLLSKSTSRYSGIAAPIVHRIATLYCKLGAPADARRVLEGASRPAPGKPADAAQAKRKEAYEKVRELHEEIRAAGYVPDTRFVLHDIDEAAKERALMYHSERLAIAFGLVSTPPGTPLRVMKNLRICGDCHSAVKLIAKVTGREIIVRDNKRFHHFKDGGCSCGDYW

SEQ ID NO: 134401 - protein, 180 aa, Triticum aestivum
  Clone ID: PAT_TA_28819.pep
STMARKLMYPRILAVLALVMATAWTPCSADTTVPTMSPAAARGDNAPVRAAASAPVSSTVAVPAAGAATTQATAMTSNKIPLAPPDVVEPAAEVVSALPVPVPETLPSAEGLGFGSSGFNGGQGGFGCCGGFGYNGGLGYNNGPLFFNSAPARRLSLTSMATGNGLAALLVAGAAAMFYV

SEQ ID NO: 134402 - protein, 257 aa, Triticum aestivum
  Clone ID: PAT_TA_28820.pep
MLPIGCGLIGPKAVGDLLIDLDAMKFGKWLKRQIEQSLPAWKDEFLSYNELKPVIGAVSPADFVARLDVQIEKINAFFIEQEEFFIITHRELQGAIRSALERKPAVPAAAHEAEIAAIRREIVNFHGEMVLLLNYSSVNYIGLAKILKKYDKRTGAGIRLAVIETVLVQPFFTAEAVSLMVRECEAMMEAVFPTAPGEGQAAARRDREALVAAEQRIFRNTVSALLAMQDVRSGSSTRGRHSLPPLNLPDSDWLRSF

SEQ ID NO: 134403 - protein, 139 aa, Triticum aestivum
  Clone ID: PAT_TA_28821.pep
RRAKDPEACLRQLRERAAEFLGGGSKSFKDAEKEIKESPSVEEPLIPLAPNALPPNLEINGVKQKGILTGESIRKFNGRFLTDDYACITSDLGIIRVDYEAEFGGRGEFLSGQTRSHVLRLCSTSPLSSVWVFSPLTKI

SEQ ID NO: 134404 - protein, 235 aa, Triticum aestivum
  Clone ID: PAT_TA_28822.pep
MKNIPTPPIVPAKPSTPSVVQLEQPIPEFDTKEEAEKAFFSLLKETGVKSDWTWDQAMRAIITKPLYRALKTIVERKAAFQAYVDAESKREREEKEEFERQQKQSFMALIDRHKEMVKPYTRYSTFAHLASHDPAFNTIKSDKQREAYFEEYVQNMQRAEKDKLRDLRKNSMERFGQLLRSIPDITYRTQWKEALSLYMEPNHDLKQEFQGMDMLDFLSVFEEYNRALWEEPLNE

SEQ ID NO: 134405 - protein, 135 aa, Triticum aestivum
  Clone ID: PAT_TA_28823.pep
ARTKQTARKSTGGKAPRKQLATKAARKSAPSTGGVKKPHRYRPGTVALREIRRYQKSTELLIRKLPFQRLVREIAQDFKTDLRFQSSAIGALQEASEAYLVSLFEDTNLAAIHAKRVTIQPKDIQLARRLRGERS

SEQ ID NO: 134406 - protein, 198 aa, Triticum aestivum
  unsure (1)..(198): unsure at all Xaa locations
  Clone ID: PAT_TA_28824.pep
MLYIVNEMTFSGYSVVNLDLLYIIAILLGILVIISKNPIVSVLFLIGLFLCISAYLILTGLNFIGLSYLLVYVGAVSILFLFILMLINVRISELLIDSINSIPLAILVGSFFNYFVNNVLPYMVMTNNLLYHFSIKKNLTNVTSVSXDGYLAETSHITSIGNILYGNYSIXLIITSIILLLAMVGAIVITLKPQTNAK

SEQ ID NO: 134407 - protein, 271 aa, Triticum aestivum
  Clone ID: PAT_TA_28825.pep
MAGVSSNAIALVALLSMLFTSVRSAVNYDTAVARSYTSGWLPAKATWYGAPNGAGPDDNGGACGFKNVNQYPISSMGACGNEPIFAGGEGCGMCYEIKCEYSNNPSCSGQPRRIVITDMNYYPVARYHLDLSGTAFGSMAKYGLNDRLRHAGIIDMQFRRVPCNFPGMKVTFHVQRGSNPNYLAVLVEYVNVDGTVVRMELMQTMNGRPTGYWQDMRRSWGSVWRMDTNRPVQGPFSIRITSDTGKTLVANNAIPAYWQQDHAYWSNLQFY

SEQ ID NO: 134408 - protein, 211 aa, Triticum aestivum
  Clone ID: PAT_TA_28826.pep
MRTICDVCESAVAVLFCAADEAALCRPCDEKVHMCNKLASRHVRVGLADPNKLVRCDICESSPAFFYCDIDGTSLCLSCDMAVHVGGKRTHGRYLLLRQRVEFPGDKPGHMDDVAMQQMESENPRDQNNAHSVAKEQMVNHHHNAYDPASDGNCNGQGAIDSKMFDLNMRPARNNGQGSSSQTHGVDHSHNNNHDSSGVVPTCNYDGATDK

SEQ ID NO: 134409 - protein, 256 aa, Triticum aestivum
  Clone ID: PAT_TA_28827.pep
MTNKWSIQIPETPSPNYILVKNISSKSTEQTVREFFLFCGKIKEFELKSDDEDNKYQIALIHFERESAAKTASLLSNALLDDSHIMAFPYFDISSSDDENGIDSEHLETQESKPKSRIAAEILANGYILQDHVVAKGIEYDNKYNLSSRLTSFLNALQTNVKHFEEKYRIWDNVINIDRKYKLSEKAQTAAQTAQNRAQVALQTPTGQKVHEFASQTLAQIAAVHYEAKKIQSERLNNNNNGASNDTSENPIATPA

SEQ ID NO: 134410 - protein, 146 aa, Triticum aestivum
  Clone ID: PAT_TA_28828.pep
FSAQHYQLILCCPAAFLRTRKGYRRREPFTLEGPIGSAIAAPLTVAGDICRLLELRVPRRLGSDDSCVGPNFSVDARMVSLRLLSLDMPLVSDEGLLVGDPGASSSSVMLSSISDLRMNQTSSLPGFPFCSRKRYSPTFTSCRIPS

SEQ ID NO: 134411 - protein, 78 aa, Triticum aestivum
  Clone ID: PAT_TA_28829.pep
NRLGVIGLLYAGMESGMVTARDGQDDWINSVVAGLGTGALFRAAQGPRSAAVAGAVGGVLAAAAMAAKQAAKRYAPAF

SEQ ID NO: 134412 - protein, 186 aa, Triticum aestivum
  Clone ID: PAT_TA_28830.pep
MASGVFGTPISEKTVLATGEYKEPITQKDVADYTMKMINAGGKDINAQTFVDNLKERYGNGISVKCLIYNATGATLNLANYKDWHGHIYDTPYPSDIQNGQWGAFLHVHPSGAAVGSAGAVVYRTKVPSSSSSSGWLFSSPVPHIGVGVTCSAFSKAMPQVWVGGLKYIYGMWLMKIYILTTKNKD

SEQ ID NO: 134413 - protein, 144 aa, Triticum aestivum
  Clone ID: PAT_TA_28831.pep
SGSTGPEIITTPYDWRIHVGDGESAPRDRSERICHPAAPPVAGVMTTKMTTVGRTKTEIVGAVTAPGTAGAGGRGCVAASPAPPGTTTATVVESSKEVVMAVGDAMRKWPLRCCYVAPAPPAWWPHTMRRWCQLLLRRLPVQSP

SEQ ID NO: 134414 - protein, 102 aa, Triticum aestivum
  Clone ID: PAT_TA_28832.pep
PRVRKGRVLGYERAKRNQNPNVSLIQVEGVQTTKDAQFYLGKRVAYVYRAQREINGSKIRVIWGRIARTHGTNGVVKARFRKNLPPKVFGASVRVMLYPSNI

SEQ ID NO: 134415 - protein, 90 aa, Triticum aestivum
  unsure (1)..(90): unsure at all Xaa locations
  Clone ID: PAT_TA_28833.pep
PCFPLEPRRXGVHLGXSXAFXMYDGXDFGWXRAXAVRSARANXLDGKCRVPRAQAGDGSLXVGMCLAPDTMGRLLCDDEFLQFVSHAPSP

SEQ ID NO: 134416 - protein, 103 aa, Triticum aestivum
  Clone ID: PAT_TA_28834.pep
MGLFDKFSEQHGEVQNTPHEHKGHLSHELIAGAASFEAIKAYNKHCEENGKPVDHGTAKALLAGFAGMALDKLVETKGLDFIDKQKAKRHAEDEVKQYYEEEH

SEQ ID NO: 134417 - protein, 263 aa, Triticum aestivum
  Clone ID: PAT_TA_28835.pep
LMPSVDSSSKPLTLSRVYGTLTIVQSVSAAVYSVYVLIHGVQLVSANFGGVELANRTLPLTRPLYQEKGTEIVLVVGSALVHLFSGIAKFGIRAYWKRFGQDTSHPALLPYHRFVGHMQVPALLLHYYLVRLLPIQKYGDSSFIDFSYIGWGLQNRPKFTYALHTTLIVGSMYHAVSGMSFIYARYLKKGKSTEKAAQVAQHSKSVEQHVLIEKYKRNQRIKKGLVAALSITLISSLVIIGKDTTKIPLRLDFESMYSKIIGL

SEQ ID NO: 134418 - protein, 196 aa, Triticum aestivum
  Clone ID: PAT_TA_28836.pep
VPSRQQEQQEQQQQARPRGLDPEVVASFPAMTYAEARALRDKGGDDAAVLECAVCLSEFEDGDQLRLLPKCSHAFHPDCIGEWLAGHVTCPVCRCSLAPEEPAPAAAEENGAGAEEQRAPEVAIDMDREGDGEAQEERMREAAELERIGSLRRAVRSRSGRPFSRAHSTGHSLSARFDGDLERFTLRLPEHVRRDM

SEQ ID NO: 134419 - protein, 481 aa, Triticum aestivum
  unsure (1)..(481): unsure at all Xaa locations
  Clone ID: PAT_TA_28837.pep
MAMALLLLATAASAAAAGASWSPRPEGDLVTGLPGQPEVGFKHYAGYVDVGTGGDRALFYWFFEAEKEPEKKPLALRLNGGPGXSSIAYGAAQELGPFLVRGYGANLTRNAYAWNKAVNLLFLEAPVGVGFSYTNKTADLGRLGDRVTAQDSHTFLLNWLAKFPEFKGRDFYIAGESYAGHYVPQLADLIYEGNKAAGRGRIINLKGFIIGNAVLNDETDQLGMVEYAWSHAIISDELHSAVTRECDYFREEADGGKPGKGCSSAVRAFMGAFDDIDIYSIYTPTCLSPSAGPGSTAPRPSRLVAAPRLFSQHEAWHMMRRAPAGYDPCTEAYVTRYFNRQDVQRALHANRTGLKYRYSAGSAVISKWNDSPATVLPILKKLMAAGLRVWVYSGDTDGRVPVTSTRYSVNAMKLRARARSGWRAWFYRQQVAGWAVEYEEGLTLVTVRGAGHQVPLFAPDRSLAMLYHFLRGQPLPAAAPR

SEQ ID NO: 134420 - protein, 191 aa, Triticum aestivum
  Clone ID: PAT_TA_28838.pep
MAEQSINIPQVIVFIVVTFLAVRWYLRKPTAAAPGTRAAANRAALRVSPAQIDQVAEMLPQLSRRDIAWDLQRNGGNVAATTERALSGRGLDTAPASFQIPTPAPRVAATPARASPAPARPAHPDLITRYNLSSKLSQVSQPAQEEQPKAKSWSADKSERQANLQRRREEMILAARRKLEAQEKAKASGAA

SEQ ID NO: 134421 - protein, 250 aa, Triticum aestivum
  Clone ID: PAT_TA_28839.pep
TRNNVYMAKLAEQAERYDEMVQFTKEVAKMGAELSVEERNLLSVAYKNVIGSRRASWRIVSSIEQKEESKGNSAQVEKIRTYRQKIETELQEVCKDILSVLSEDLIPVAEGGESKVFYYKMKGDYHRYLAEFLTGEARKESATEAHEAYKSATDVAQTELAPTHPIRLGLALNFSVFYYEILNSPDRACHLAKQAGDDAIAELDTLSEESYKDSTLIMQLLRDNLTLWTSDLQDESDKPEPKAEEAEESK

SEQ ID NO: 134422 - protein, 130 aa, Triticum aestivum
  Clone ID: PAT_TA_28840.pep
MAPSKLALFLALNLVLLAAVQGCGPNCPPVVPTPPIRPPPVVPSTGGGSCPINTLKLGVCANVPEPTEAHDRCAGHTQQCRPRSWGGLRRPPTPLCASCSRHPGPTSSGIASLNVPHRPRTLLPSSPVPQ

SEQ ID NO: 134423 - protein, 168 aa, Triticum aestivum
  unsure (1)..(168): unsure at all Xaa locations
  Clone ID: PAT_TA_28841.pep
RAADKDIMLCIXRGRGRGTFGGNPLASAVAIASLKVVKDEGLVERAAELGQEFRDQLRKVQQKFPDIIREIRGRGLLNAVDLSSKALYPASAYDICIKLKERGILAKPTHDTIIRLAPPISISPEELTEASKALSDVLEHDLPQLQKQIKKPESEAKTPVCDRCGRDL

SEQ ID NO: 134424 - protein, 352 aa, Triticum aestivum
  Clone ID: PAT_TA_28842.pep
PRVRLSAHKGVNLPNTPVDLPALSEKDKADLRFGVEQKVDFIFASFVRRGQDVRDIRKVLGPDGKNIKIISKIENHQGVENFDDILAETDGVMVARGDMGIEIPLERVFIAQKMMITKCNLAGKPVICATQMLESMTYNPRPTRAEVSDVANAVLDGADCVMLSGETAKGNYPVDAVKTMHDICKLAESVLCYPAIFNELRNLTELPTETTETVACAAVAAAHEQNAGCIIVLTTSGNSARLISKYKPNAPIVVVTRNPQTARQIHLYRGCFPFLYPKASSAITSLLNSSSQGHLSPVENAPWQEDVDHRIRWGMEQAMKYGLLSRGQPVVAVQGWRGGLGNTNTLRIIYAP

SEQ ID NO: 134425 - protein, 182 aa, Triticum aestivum
  Clone ID: PAT_TA_28843.pep
RTRGRTRGQTSSTYICIYILYIYIYIFLFFVSCVEYGSLGKASRKSDVFSYGIMLLEVFTRRRPTDAMFGGELTLRQWVHHAFPTELMGVVDDQILQGCFSSYDLANGFLVPVFELGLLCCSDSPDERTTISNVVVRLKKIKAEYTKKAATTSRGVAQQLISHAPPSRSVLIEDNERPSTTS

SEQ ID NO: 134426 - protein, 192 aa, Triticum aestivum
  Clone ID: PAT_TA_28844.pep
MTAAEVAEPTLPPLNTDIFWWKSIVGQDQISNYLTETTKQEANPTEEILAATTITTTTSVMPTETTRATTTLDSAESTIVDSSTTLIAASSATLSSDVSSSGSVTASSASISEASSTSSASMSTASSGAWSTSAIVSSSPTMSSQVLAKPSGSPSSSTTSSTLASSDGSQRMASVGKILVSITLATLYFTFA

SEQ ID NO: 134427 - protein, 247 aa, Triticum aestivum
  Clone ID: PAT_TA_28845.pep
MTAGPKSGGGGAAAARAAAAGPRTVLITGVSRGLGRALALELARRGHAVVGCGRSADPIRSLEAEMGSPSRHFLTVADVRSDSSMGELAKAVVERKQIPDIIVNNAGTINKNNKTWNVPAEEFDTVVDTNIKGTANVLRHFVPLMIQKKHGMIINLSSGWGRSAAAEVAPYCASKWAIEGLTRSLAKELPPGLAAIALSPGVVNTDMLTSCFGSSAALYQSTEQWAPKAATMILSLSLEDNGASLTV

SEQ ID NO: 134428 - protein, 136 aa, Triticum aestivum
  Clone ID: PAT_TA_28846.pep
RPAKAVTFVDNHDTGSTQAMWPFPSDKVMQGYAYILTHPGIPCIFYDHFFTWGFKDEIAALVAIRKRNGITATSALKILMHEGDAYVAEIDGKVVVKIGSRYDVGAVIPAGFVTSAHGNDYAVWEKPGAAATLQRS

SEQ ID NO: 134429 - protein, 442 aa, Triticum aestivum
  unsure (1)..(442): unsure at all Xaa locations
  Clone ID: PAT_TA_28847.pep
MGRNGNLCCFSLLLLLLAGFASGHQVLFQGFNWESWKQSGGWYNMMTGKVDDIAAAGVTHVWLPPPSHSVSTQGYMPGRLYDIDASKYGNAADLKSLIAALHGKGVQAIADIVINHRCADYKDSRGIYCIFEGGTSDGRLDWGPHMICRDDTTYSDGTANLDTGADFAAAPDIDHLNDRVQRELKEWLLWLKSDLGFDAWRFDFAKGYSPEMAKVYIDGTSPSLAVAEVWDNMATGGDGKPNYDQDAHRQNLVNWVDKVGGAASAGMVFDFTTKGILNAAVEGELWRLIDPQGKAPGVXMGWWPAKAVTFVDNPRTGXPRRAMWPFPSDKVMQGYAYILTHPGIPCIFYDHFFTWGFKDQIAALVAIRKRNGITATSALKILMHEGDAYVAEIDSKVLVKIGSRYDVGAVIPAGFVTSAHGNDYDRLGRKPRRRRRTTAAGA

SEQ ID NO: 134430 - protein, 281 aa, Triticum aestivum
  Clone ID: PAT_TA_28848.pep
MQEPGRRPFAGAVDLRRPKGYPAPSATAQAEVGAAAAEEGEAHGDPCPRCESRDTKFCYYNNYNTSQPRHYCKSCRRYWTKGGTLRNVPVGGGSRKSSSSSSSSSSSPKRAKNSKRRRVAPAAPPAPEAEPGADASAAVAATTKEAAATEDVTAAEDPAAAPTADGCFAFTAGEPDAPPAKEGCFTLTAGEPDAPPAADGDGCFAFTAGEPDVPPAAEGNGGLAFTDHPSVALGLGVADDAGGKELADPSPFEWPSGCDLGSYWVAGVFADTDPALFLSPP

SEQ ID NO: 134431 - protein, 179 aa, Triticum aestivum
  Clone ID: PAT_TA_28849.pep
NPEVMRKVKEELSGVLGDKPLMEESDIARLPYLQGNSQVISVVAAEVPLVPRKAEADIEVNGYRIPKGTNVILNAWAINRSADAWSDPDKFVPERFIGGETKNFQLGQDFDMIPFGLGRRICPGMPLAQKLIPLILGTLLHRFEWELPAEVKEAGIGQVEKCGVVLSLVTPLTAIPKEI

SEQ ID NO: 134432 - protein, 184 aa, Triticum aestivum
  Clone ID: PAT_TA_28850.pep
MAADGGLRRLFEKPLPENPTLLEALSAWNRVHPKRPVDPTSFTEIFGELHFHEKQQQPDHKSPSASSLLLCTEGLGSESTVDVLRDDDDELAAAFRRQVETRDDADVVDANQEEKENQRPPPSFPPPIRSISVRGGKPSVCFRSFRAEGRFVLVEVVIPGKELLRASREGGRLRLQFAGATAHA

SEQ ID NO: 134433 - protein, 47 aa, Triticum aestivum
  Clone ID: PAT_TA_28851.pep
SSEAYIQKFLSCTNSHITAMEDHPSNYLSSVITPHNIKIAFRNFGLR

SEQ ID NO: 134434 - protein, 259 aa, Triticum aestivum
  Clone ID: PAT_TA_28852.pep
GPKKHMKRLAAPKHWMLDKLLGSYAPKPSSGPHKTRECLPLIVFIRNRLKYALNGREVQSILMQRLVKVDGKVRTDSTFPAGFMDVISVEKTGENFRLVYDVKGRFAVHRITDEEAKYKLCKVKKVMIGSKGVPYITTHDGRTIRYPDPLIKTNDTIRFNLETGKIEDFVKFDVGNVVMVTGGRNIGRVGQLVHRERHIGGFEIVHIKDALDHVFATRISNVFTIGQGNKPWVSLPKGKGVKLTITEERDRRRAAAAAQ

SEQ ID NO: 134435 - protein, 351 aa, Triticum aestivum
  unsure (1)..(351): unsure at all Xaa locations
  Clone ID: PAT_TA_28853.pep
MPSTESAAGVAWDRRRELQAFDDTKAGVKGLVDAGVTALPPIFRHSPESLEGITSSNHVAGAIPTVDLAAPRREDAVALVRHAAGTVGFFQVVNHGVPAELMAGMLEGVRRFNEGPAEAKQAIYSRDQARKVRFASNFDLFSSAAANWRDTLFFHLAPDPAPSEELPEAVRDVVTEYGHAVTKVGLSVLELLSESLGLSSDHLRDMDCAANLXNALCQYYPPCPEPGAXHGARGGTRHTDPGFLTVLLQDGMGGLQVLVDGKTWVDVPPVPGAFIINIGDLLQLVSNDQFRSVEHRVRGEQEQTDTAXRSLVASFFNTNIERSTRFYXPVTDGRNPPIYRSVPAIVFMRNV

SEQ ID NO: 134436 - protein, 96 aa, Triticum aestivum
  Clone ID: PAT_TA_28854.pep
KFRQLSIREHMLEKSRTALVNSEEKPEAQVTELKAQEKALAKDKHNAKYQFVQDAVDAIIPLAGLGLLKADEGIVGLAGMTTSLLAMNSQWKKLNG

SEQ ID NO: 134437 - protein, 266 aa, Triticum aestivum
  Clone ID: PAT_TA_28855.pep
EQGIAGFAIGLAAMGNRAIAEIQFADYIFPAFDQIVNEAAKFRYRSGNEFNCGGLTIRSPYGAVGHGGHYHSQSPEAFFCHVPGLKVVIPRSPREAKGLLLASIRDPNPVIFFEPKWLYRLSVEEVPEGDYMLPLSQAEVIRKGSDITLIGWGAQLAVLEQACEDASKDGISCELIDLRTLIPWDKETVEASVSKTGKLLISHEAPITGGFGAEIAASIAERCFQRLEAPVARVCGLDTPFPLVYEPFYMPTKNKILDAIKATVNY

SEQ ID NO: 134438 - protein, 67 aa, Triticum aestivum
  Clone ID: PAT_TA_28856.pep
KARSRRRSLGSTTRTAASPPSTSALRLPSASSQRSCSPMPSTYLARKFSMSLFFLIDLESVINWLMY

SEQ ID NO: 134439 - protein, 98 aa, Triticum aestivum
  Clone ID: PAT_TA_28857.pep
MFSEQHGEVHETSHEHKGHLSHELIAGAASYEAVKAYQKHCEEKGEPVDHSTAKALLAGFAGAALDKLIETKGLDFIDKQKAKRHAEDQVKQYYDEER

SEQ ID NO: 134440 - protein, 341 aa, Triticum aestivum
  Clone ID: PAT_TA_28858.pep
TTDNHDWTLIKASSLIKDQKVITIEGSLPVEEACDILIKSNISSAPVYDTKVKHIAPETAIIHPRSYVGMFDYGDVIAYILLVLRKIKPNDDTKEDINLEIKDIIKRASEGKEIPVKLASDLSQKNPFYSILPEATLLSAVEEFSYGIHRVCVLNPDGSIKGILSQSTVAKYFYTSQHHFPDVECIMNKTLRQLGLGISDVISVNADSPVLDALSLMSKHDISSVAVLSHMGVIVGNISMTDVKFVMKSYRHQLLWKTCFQFVSLVRTQQGIEDGQDRIPVFDVRLDTTLGFTVAKLLATKSHRVWVVDERERAIGVVSLTDVMRIIATNSGIEIKQKEEK

SEQ ID NO: 134441 - protein, 273 aa, Triticum aestivum
  Clone ID: PAT_TA_28859.pep
TWQVVAKNDGIRMLDPSTSRTLRIYPLDTLTKWEVLDSTVFAIWAKTSVDFEAKRIRLKSNSYTSNTLLDTVTAATVQFKEIGEDARAKGTVDAGKSSIQSNEKKKGFDWMFAKPVDEVKDHWVPDEAAKKCQSCAGDFSHFNRRHHCRNCGEIFCDKCSQGRIALTAEDNAPLVRVCDRCMAEVSQRLSMAQEAANRSTTVQSHGDLAKKLKEELERNRKSSGTASGGASGTRMREVACPTCTVHLQVEVPISGSETVECGVCQHAFLVSAN

SEQ ID NO: 134442 - protein, 85 aa, Triticum aestivum
  Clone ID: PAT_TA_28860.pep
EIDDCVTSLKFVTNQGATYGPFGRGDGAHHSLPVLDGGSLVGMFCRAGDFLHAIGFYVRPLAIVEPTASPAKPEGESLLAVAIEG

SEQ ID NO: 134443 - protein, 136 aa, Triticum aestivum
  unsure (1)..(136): unsure at all Xaa locations
  Clone ID: PAT_TA_28861.pep
ILPHGRVSRVDGECDEGAMAAIAQSAPDSVLMTLAEFETAREAWNALKEMRIEXNRVTKARAQVLKRQFHKLQMEKTESVNDYAMRLTTLVGEIHALGAKLDETEIVEKFFSSVTDKFTYIIGTLEQLYDIDDMTI

SEQ ID NO: 134444 - protein, 145 aa, Triticum aestivum
  unsure (1)..(145): unsure at all Xaa locations
  Clone ID: PAT_TA_28862.pep
ECDKGAMAAIAQSAPDSVLMTLAEFETTREAWNALKEMRIEXNRVTKARAQVLKRQFHKLQMEKSESVNDYAMQMXKLDETEIVEKFFSSVTDKFTYIIGTLEQLYDIDDMTITEAIGCLRTWEENARGCRKRKGGGDDQLMYSR

SEQ ID NO: 134445 - protein, 217 aa, Triticum aestivum
  unsure (1)..(217): unsure at all Xaa locations
  Clone ID: PAT_TA_28863.pep
XPDHDDPAHTGHYSLYGDERDGRWGTPGPRRGTGRARAGSWFSRPSLFYEKRRLIGCSFCSRQYGVPDLTLYYSQRKAWRVALRAINALEGKVKGRVMVRMLSPMSHFENGTWDQGGNCKRTEPVRSNQTVMEGRDLQFYTAQMEEYRAAEKAARAKGLRLMLMDATAAMLMRPDGHPSRYGHWPNEKVQLYNDCIHWCLPGPIDIWNDLLFQMMLV

SEQ ID NO: 134446 - protein, 80 aa, Triticum aestivum
  Clone ID: PAT_TA_28864.pep
MQITGKVKWFNESKGFGFITPDDGSKDVFVHFTAIAGNGFKTLAEGQRVEFEIQDGQKGPSAVNVKALELEEDKSISSKL

SEQ ID NO: 134447 - protein, 105 aa, Triticum aestivum
  unsure (1)..(105): unsure at all Xaa locations
  Clone ID: PAT_TA_28865.pep
ETYGYRWLAPEIIDGDPESVSETCMSNVYXYGMVLWEMVTGEEAYSTYSPVQAAVGIAACGLRPEIPRDCPPFLRSLMSRCWDNCPLKRPQFSEIISTLQKQSLR

SEQ ID NO: 134448 - protein, 233 aa, Triticum aestivum
  Clone ID: PAT_TA_28866.pep
SARPRFAESTKEPGLTFAFAKFDGIFGLGYDTISVKHTIPPFYHMVNRDLVDEPLFSFWLNDANKDQENGGELIFGGVDEDHFEGDIHWSDVRRKGYWEITMENIKFGDDYVDIDPVGAAIDTGSSLLVAPTTVAALINKELGAEKNWAGQYTVDCNKVPSMPEFCFVFNGKDFCLEGKDYILEVQGQCISGFMGMDIPEPAGPLWIVGDVFLRKFYSVYDLGNNRVGLAPSK

SEQ ID NO: 134449 - protein, 151 aa, Triticum aestivum
  Clone ID: PAT_TA_28867.pep
MKLEICSFSGQKIYPAKGKTYVRIDSRTFRFINGKTESYFLQRLNPRKIRWTAIYRRLNKKGMTEEVQKKRSRRTVKHERAVVGASWDAIRAKRNQKPDARAAARQAAIAKSKEAKKTAAAAKKANPAASQPKVSKQQAKGFAPKAAATSR

SEQ ID NO: 134450 - protein, 255 aa, Triticum aestivum
  Clone ID: PAT_TA_28868.pep
GIPAAQMIRVETVQQQPSIPDLTNYTNLDEPYRCLGWLKDQLINGDENEKIVLKEVFGSYQKLFGTEKPLGLKEFYTVLKIAFPQPSSVEESFANGENPLETVLCNIKYSPTRRKDGSICRWEGCEQSFDDKTELHKHIVKDHLEVENDCKWMKCSRKTFGGKANAIQHMRTHFAGKISKQHASKPKTFAITKIPVDESEVSGIPLTSALLLRNLARHKQYHTYYLPYQSELILLAMQRPKISKYILTVLGELNF

SEQ ID NO: 134451 - protein, 200 aa, Triticum aestivum
  Clone ID: PAT_TA_28869.pep
INLKSATLILAVLGTISHLYGALTLTALSDEFDDADIGAVFGLTAYSYLSGFACLAGAIGVLKNNAKKLKFFNIYYWADLALHTFFSVASAVLLFSLDKEICKEVVSEVKDDELDMNTCESIYIQSAWIVTLAMAINMLLKLHFAFAIHSYTHRVQQESEMNNVEEQIIVAPYPTAFITKEQPVFVAGQEFIPDEKKASE

SEQ ID NO: 134452 - protein, 354 aa, Triticum aestivum
  Clone ID: PAT_TA_28870.pep
MYNMIPALLVLAGVITGVRAAAPPPVPVPVPPKVPAAPPAAAGPLKYPALLAFGDSIIDTGNNNYIRTIVRANFPPYGRDFPGHKATGRFTDGRISVDFLAAALGVKENVPPYLKKDLTLDDLKTGVSFASAGSGYDNATCRTMSALSMEQQLKMFLEYKAKVGTIPDQALYLLVWGSNDVVEHFTFGDPMSVEQYSDLMSQRAITFIQTLISLGAKRIALTGAPPVGCVPSQRILSGGIRRQCSPDRNQLASMFNNKIKGKMATLGAKLPGVTLTFIDLYAIFEDVIHRHEALGFKNARDSCCGFLGLAVAVLCNFASPVCAEPAKYVFWDSYHPSSSAYKVIIDLVVEKYFR

SEQ ID NO: 134453 - protein, 100 aa, Triticum aestivum
  Clone ID: PAT_TA_28871.pep
SFEPQHPPSALAMASSSVPKMAAVFMLALFAGQALMATLAMAEGLGNRHNLLEKYDETQCRGYATCNIVCFYQVFQVCIIYSPVAFCNTWAFGFCKDKRY

SEQ ID NO: 134454 - protein, 157 aa, Triticum aestivum
  Clone ID: PAT_TA_28872.pep
HLSLSLKRFQQPGQAHRQEVHTKRRSRLVHDKMSDLVFIKFNSKLKDKKLNKLKDPIEKQVVDVLEDDENEWITGVVPNGDEEQVEGEDQDQEIPYASSHAGPGTSAINPLKRKRGVYGKKKKMMIPVTPQEDLLSASSASESDDDEDTNMSSGSDM

SEQ ID NO: 134455 - protein, 363 aa, Triticum aestivum
  Clone ID: PAT_TA_28873.pep
MVRSIWPSPPAHGRRSPAILLVRGLFAALPAASVDMGDMLMMDRFRQWQATHNRSYLSAEERLRRFRVYRDNVEYIDATNRRGDLTYELGENEFADLTQEEFLARYASSYDGAGDDTGITLPVGGGDAELWSSGGDNDSSLEAPPPSWDWRSKGAVTPVKSQGAGCASCWAFVTVATIETLNWIRTGQLVPLSEQQLVDCDQYDGGCNRGSYHRAYNWIVENGGLTTAADYPYTAVRGACNRAKSAHHTVKILGGGVIPPRNEPEMQLAVSGQPIGVAIEVGSGMQFYRSGVYSGPCGTNLAHAVTIVGYGIDAATGAKYWLVKNSWGQTWGESGYIRMRRDVGGPGLCGIALDVVYPKMARA

SEQ ID NO: 134456 - protein, 210 aa, Triticum aestivum
  Clone ID: PAT_TA_28874.pep
HASEFNLGAYKYLEELARKKQSDVSRFLLRVRCWEYRQLNVIHRASRPSRPDKARRLGYKAKQGYVIYRIRVRRGGRKRPVPKGATYGKPVNEGVSQLKYQRSLRSTAEERVGRKCRNLRVLNSYWINQDATYKYFEVILVDPSHKAIRNDARINWIANPVHKRREARGLTAVGKKSRGHQKGHRFNNTKGSGRRATWKRRNTLSLRRYR

SEQ ID NO: 134457 - protein, 283 aa, Triticum aestivum
  Clone ID: PAT_TA_28875.pep
PRVRINREREFHNEETCTYWLPKDEEEQQRLTGQHFALKELFEGNLSCSVQRNLDFEKGISVLDVGCGPGAWIMDMTQDYPNCTYHGCDIVDVTNKNLKIDQFTFNFGNVIQGLPYEDNTFDFVQMRLFTAALRKEEWPIALKEIIRLTKPGGMIQLMEPDFRLSEDDSSAYNKFIKALDSVCTSKGQDLHITYQLEKLLLETRLIKVTEHDTRHCNMNSNTATAKKFAWDFIELAKGTISGIKPLMGISSEEEVSKFLNELRHCLTHTDIHLYVNRISVQKL

SEQ ID NO: 134458 - protein, 127 aa, Triticum aestivum
  Clone ID: PAT_TA_28876.pep
AYRKPKPSHGDDDDRPSYGRKKNDDDDDDERRSRYKKRDDDDDDERKPRYKKHDDDDDDHERRPRYKKRDDDDDDDDDRKPRYKKRYDDDDDDDRKPRYKKHDDDDDDDDDRKQRRGNNRRRHDDDD

SEQ ID NO: 134459 - protein, 96 aa, Triticum aestivum
  Clone ID: PAT_TA_28877.pep
MDASLAGSYAKEEAWRCYHAGLLCVQESPELRPTMSSVVLMLIGDQAQLPAPEQPPLFASPKKSPASDQSSLAMRSETTSKTHSVNDVSITMIQPR

SEQ ID NO: 134460 - protein, 394 aa, Triticum aestivum
  unsure (1)..(394): unsure at all Xaa locations
  Clone ID: PAT_TA_28878.pep
YVREMRKLFIIELLSRRRVQSAYYARDAQIDKLIETLTVVGPNPVPLEAHIFATMDRIVGLFAFGESYAGEQFKGQFVPLLNATMDMLGSFSAQDFFPNAVGRLIDRITGVKAHRQRVFRQLDRFFEHIIEQCDGRKATGGGGSDLVQELLDIMKRPAASAAGTFTRDHVKAILMNTFIGXIDTTTVTITWAMAELIRKPRVLQRAQLEIRTAAGGGXRVHQADMPKMSYLRMVLSETLRLHPPATLLVPRETLRRVQVAGYDIPAKTQVIVNAWAXSRDPSAWKEPEEFNPERFQDTDVDFNGSHFEFTPFGAGRRICPGLGMGVGNAEYILANLLYSFNWALPNRGGAGGGXNMEEEGVLTYRKKTSLMLVPTRYHPAQGERGGELEPLNIP

SEQ ID NO: 134461 - protein, 158 aa, Triticum aestivum
  Clone ID: PAT_TA_28879.pep
MAPMNKRRQNSNVFAMFDKAQVMEFKDAFSIMDTNSDGLVDINDLKITFERLGQPATEEEIKEMMGDATGPINFTVFLTLMADKLADTDSENVILKAFSAFDDHHSGKINANYLRECMMTMGDRFTDEEVDIMFKGSVVDEEGNFNYKDFVRILKHGE

SEQ ID NO: 134462 - protein, 100 aa, Triticum aestivum
  unsure (1)..(100): unsure at all Xaa locations
  Clone ID: PAT_TA_28880.pep
RQXXSCLIGPDVAIGPGCVVEDGVRLSRCTVMRGVRIKKHACISNSIIGWHSTVGQWARIENMTILGEDVHVCDEVYSNGGVVLPHKEIKSSILKPEIVM

SEQ ID NO: 134463 - protein, 129 aa, Triticum aestivum
  unsure (1)..(129): unsure at all Xaa locations
  Clone ID: PAT_TA_28881.pep
LESLRKKSAAKLAAGAHVVGNVLXVHESAKIGEGCLIGPDVAIGPGCVVEDGVRLSRCTVMRGVRIKKHACISNSIIGWHSTVGQWARIENMTILGEDVHVGDEVYSNGGVVLPHKEIKSSILKPEIVM

SEQ ID NO: 134464 - protein, 364 aa, Triticum aestivum
  unsure (1)..(364): unsure at all Xaa locations
  Clone ID: PAT_TA_28882.pep
MKALILVGGFGTRLRPLTLSFPKPLVDFANKPMILHQIEALKDVGVTEXVILAINYRPEVXMINVLGKDFEDKLGITITCSQETEPLGTAGPLALARDKLVDGSGEPFFVLNSDVISEYPFAELIQFHKSHGGEATIMVTKVDEPSKYGVVVMEDTTGVVERFVEKPKIFVGNKINAGIYLLNPSVLDRIELKPTSIEKEVFPRIAADQKLYAMVLPGFWMDIGQPRDYITGLRLYLDSLRKKSAAKLAAGAHIVGNVLVHDSAKIGEGCLIGPDVAIGPGCVVEDGVRLSRCTVMRGVRIKKHACISNSIIGWHSTVGQWARIENMTILGEDVHVGDEVYSNGGVVLPHKEIKSSILKPEIVM

SEQ ID NO: 134465 - protein, 172 aa, Triticum aestivum
  Clone ID: PAT_TA_28883.pep
SQYYVLIRLGRSGFKKIMSNLTATADHLADRLKATGRFEIMSEGQGRGLPLVAFRLKDEHHYNEFDISSKLREGGWIVPAYTMAPNVEHIKMLRVVVREDFSRSRCEILVKDIIAALRALDTSDKEAVAKRREHIEEHSHSSIYSNDVNPKSKTTGTESESTEDSKTAQGIC

SEQ ID NO: 134466 - protein, 175 aa, Triticum aestivum
  Clone ID: PAT_TA_28884.pep
PVPESQLIVQYVEEAFPASSPRFLPPDPHERAVARFWASYVDGELLSAWLPVYGGRTGEERAEAAGRVGAALETLERAFGECSKGKGFFGGDTVGLVDVVLGGFVGWLQTSEAMCGVRLLDAAATPLLAAWAERFRALDGVKEVMPDAQRLLEYNLMRRARLGLPLTQPPPPQHQ

SEQ ID NO: 134467 - protein, 240 aa, Triticum aestivum
  Clone ID: PAT_TA_28885.pep
MEEELTLVGYWSSPFALRARFALNLKGLPYAYVEEVGLFDGKSPLLLASNPVHKRVPVLIHNGKPVPESQLIVQYVEEAFPASSPRFLPPDPHERAVARFWASYVDGELLSAWLPVYGGRTGEERAEAAGRVGAALETLERAFGECSKGKGFFGGDTVGLVDVVLGGFVGWLQTSEAMCGVRLLDAAATPLLAAWAERFRALDGVKEVMPDAQRLLEYNLMRRARLGLPPTSPPPPLQHQ

SEQ ID NO: 134468 - protein, 88 aa, Triticum aestivum
  Clone ID: PAT_TA_28886.pep
EIKHKLQLRHQCSIVDDQSSIHHMLLASTKTPKGLPLPHVQHPIYIYFEYLLARNRLGSKLVIQELATSLLGNGMNSTSSFSSTIIGG

SEQ ID NO: 134469 - protein, 110 aa, Triticum aestivum
  Clone ID: PAT_TA_28887.pep
SNNPTIQNRQACLCKCLKKVQCFCSRCVHLLQSPFFLDHMNNLFSLLFYVNVGAPWGVEQGTLQEVEEASYEVIKLQVKRPDVLECQFSYYVMSVSTPSVNFYKILTFVI

SEQ ID NO: 134470 - protein, 281 aa, Triticum aestivum
  Clone ID: PAT_TA_28888.pep
MSKVPTILNPTEEDLQLLLAAQAHLGAKNLNTRMSPYVFKRRADGVHLINLGKTWEKLIFAARVIAAIENPADIVVVSARPYGHRAALKFARYIGAEAVVGRFTPGTFTNYITRSFREPRLVVCTDPRSDFQAILEASYVNIPVISLADTDASLQYVDVVIPTNNKGKHAIGLIYWLLARAVLRLRGTLDYATPWDVMVDMFFYRDPEEIEKENEAAELEEAGRNVEWGATTEEQDWTIEAEGPASFAGNAADWSAEAPSADAVGDWADDVNTAPATSGWD

SEQ ID NO: 134471 - protein, 266 aa, Triticum aestivum
  Clone ID: PAT_TA_28889.pep
MASSRRALILLAVVLAAVPAALSQKTTAPAPEAPETPDAPAAGTTPKAAAAPNVTAVLEKAGQYTKFIRLMASTQQDTQLNAQANDSDTGFTVFAPTDSAFNSLKPGTLNSLSQQDQVTLVQAHIVPTFYSMESFETASNPVRTQASGTDGPCTVNVTATSNSAVNVSTGIVHTTVGAALRATRPLAVYSVDKVLLPMDLFGPKPPASAPPAHGKKPSSAKGAAKAPSGDDEDEEEAPPAGAAAAVGAGWRSLVAVVAAATAACLL

SEQ ID NO: 134472 - protein, 317 aa, Triticum aestivum
  Clone ID: PAT_TA_28890.pep
MEEELLIPLHVKYIQCLDKRQDELEYWLTEHLRLNGIYWGLTALDLMNHIDALPREEVISYVKSLQQSNGGFSAHTGHDTHITCTLSAVQVLITLDALEVIDVDKVINYIQSLQNQDGSFRGDAWGEVDSRFAYIALCCCSLLKRLDAIDVEKTVEWILKCKNYDGGFGSRPGSESHSGQIFCCVSALAIADALHHVDTDLLSWWLCERQLKNGGLNGRPQKLEDVCYSWWVLSALSTLGNTHWIDKDKLIRFILSAQDPEKGGISDRPGDMVDVFHTLFGLTGLSLLGYPGLKSVDPVYCMPTYVLQRIGLRPSVE

SEQ ID NO: 134473 - protein, 230 aa, Triticum aestivum
  Clone ID: PAT_TA_28891.pep
TCYQSVKIKTAGSDPLTTRRQEKTVNDPLTLGAVSTLYDVTFLSNALEKANALDRISFDLSLARGLDYYTGVIYEAVFKGVTQVGSIAAGGRYDKLVGMFSNKQVPAVGVSLGIERVFAIMEQQEKEKNQVIRATETEVLVSILGKDLILAAELVNELWSAGIKAEFKLTTRVQNHIKYATQTGIPWMVLVGESELRDGKVKLKDIRANQEEEVPRKDFVEVLKQRLSNP

SEQ ID NO: 134474 - protein, 169 aa, Triticum aestivum
  Clone ID: PAT_TA_28892.pep
MASRDAATFQLYRPMAMPTATPMSQTMAMPGFSSAEAADDAVVAVPVPAPRKAGAAKGAKDRHSKVNGRGRRVRMPIVCAARVFQLTRELGLKSDGQTVEWLLRQAEPSILAATGSGTTPAVFSCSSAPSAAAVSLLGKRPREEHEHEAAPSFWEALQARPVPWGLSPS

SEQ ID NO: 134475 - protein, 241 aa, Triticum aestivum
  Clone ID: PAT_TA_28893.pep
KKGSNSRKVDAFNRYLGTTVGREKLCRLVQYFARFYAFYLFRTGASKDTVQRWVDLKTHLGNGRKFFRLLKPVEFAQVGVKSLSMNDQVLRYTAVAKQAGMFFYYLSEAFVLSNAINFYKPSNIKKITEFGQKCWLTALVASLLSGLYKSKQLVAREKILEKTRKMIVNSEKDSEVQILELKAQEKTLAKDKYNTKYQMIQDAVDAIIPLAGLGYLKADEGIVGLAGMTTSILAMNTQWKN

SEQ ID NO: 134476 - protein, 278 aa, Triticum aestivum
  Clone ID: PAT_TA_28894.pep
IMKFSVAAISALVLSTAVSFTTADSYSDAMKSWCSGLDVTFPTASTVVVAGSKTKVTVTRKADKRTKTVTGLDLYSVDSKGKAKYVQNVWKGKYALQSSASITDTIPKSAAAGLYYYRVWVTNLVNGQHGPDCLETSHTFKVTSGSHTNAAGVTEYAEHLDDANIFSNEHYNGCFGLSVDYPKAGSTFNVDDHIHIQVDRDSTSQTDSLTKVELYKGDELVEVAWSGSEALQNSFTLKDHLKLNNVDTSADYHYKLEVTSKKSDTSCTFESNTFKISN

SEQ ID NO: 134477 - protein, 206 aa, Triticum aestivum
  Clone ID: PAT_TA_28895.pep
LAKRRDLFKRAAKYHAEYKAAERKEITLRRQAKSNGNYYVPAQEKLVFVVRIRGINNIAPKPRKVLQLLRLLQINNGVFVRLNKATSEMLQLVQPYVTYGTPNLKTIRELIYKRGYAKVSKQRIPIHDNAVIEQALGKYGIICIEDLIHEIATVGPHFKEANNFLWPFKLSNPNNMWKQRKFRHFIEGGDAGNREQFINNLVQAMN

SEQ ID NO: 134478 - protein, 169 aa, Triticum aestivum
  unsure (1)..(169): unsure at all Xaa locations
  Clone ID: PAT_TA_28896.pep
HALAKELVXEKGVQTTVITDSAVFAMISRXVTWLKVGVHAIMANGGVIAPVGMNMVALAAQRHAVPFVVVAGSHKLCPLYPHNPEVLLNELKSPSDLLDFGEFSNCMNFSTQDGTPLLNVANPTFDYVPPKLVSLFITDTGGHSPSYMYRLISEYYSADDLVVRRKSTS

SEQ ID NO: 134479 - protein, 103 aa, Triticum aestivum
  Clone ID: PAT_TA_28897.pep
VTARTHKMENLTGIRVAFGTFEQSEPAITELKDLLTKMGASWSDEVSVETTHLLAQLPGGTNYDRAVQHSIPIVKPDWLVQCDRNKKIQPALPYYIINVSHND

SEQ ID NO: 134480 - protein, 77 aa, Triticum aestivum
  Clone ID: PAT_TA_28898.pep
LLSSMILPSNSLLEWHKRKLFISNSCSAAQKLGGSLKNIKAWIKMFYVEHYQKVCILFLLTIFSSPDAWADAWADAW

SEQ ID NO: 134481 - protein, 145 aa, Triticum aestivum
  Clone ID: PAT_TA_28899.pep
RPGDSLNDELRKKENNRLILAKHTSLLKNMKRKLILAKTKVAKAEMALAKVQEYLSPAELPTDLETVTDEERFLFRRIGLKMKAFLMLGRREVFDGTVQNMHFHWKHRELVKIVVKGKTFEQVKHIAISLEAESGGVLIALDKTT

SEQ ID NO: 134482 - protein, 149 aa, Triticum aestivum
  Clone ID: PAT_TA_28900.pep
GRVGGRVGGRGGKKMLNIKFACLFFAFFAFFAMTHAMVVNPTVLTPTTGTKWRAGGTYVVKWETTYFDGEKQAPIPSGQRGYIKLGYLEKDDPDNEHITWDLADDFPLDSGAQTVTLPSELETKTSYIIILFGDSGNISKKFTIQAARS

SEQ ID NO: 134483 - protein, 299 aa, Triticum aestivum
  Clone ID: PAT_TA_28901.pep
MTPTQEATVVDTAVNVEYTAINTDRELHNEESSTYWLPKDDEEQKRLTGQHFLFKEFFEGNISRSVREALDFEKGISVLDVGCGSGVWIMDMINDYPNCTYHGCDIVDTTNKILKVDQFTYNYGNVLVGLPYEDNTFDFVHMRFFALALRKEEWPIALKEAVRVVKPGGRIQLTEPGMRLPDDNSSAYYKFIKAVRSVAHSKGQDSYIAYQLEKLLTETNMVKIIQHDIRHCNMSSNTATAKKFIWDFVEIAKSLLRFIGPNLGLNSKEEISRFLDELEHCLSHTNCYVYASCVSAQKL

SEQ ID NO: 134484 - protein, 78 aa, Triticum aestivum
  Clone ID: PAT_TA_28902.pep
FPLSLICIFSSRLRWQVAAARMSSNGSTEVRRQRWCSSRRQWSSGAAVNGGGALTWQALKIYGEGCNSPLFEEIIFWV

SEQ ID NO: 134485 - protein, 240 aa, Triticum aestivum
  unsure (1)..(240): unsure at all Xaa locations
  Clone ID: PAT_TA_28903.pep
VTAASXXEYVXKHLFSNLXIKHPKFMTDTKAAIAETFNHTDSEFLKADSSHTRDAGSTASTAILVGGRLVVANVGDSRAVVSKGGKAIAVSRDHKPDQTDERQRIEEAGGFVMWAGTWRVGGVLAVSRAFGDKLLKQYVVADPEIKEEVVDSSLEFLILASDGLWDVVTNDEAVAMVKPIEDPEQAAKGLLQKASQRGSADNITVVIVRFLDGTTTSAGDGPSEEVAKDQSEEAAKDQSS

SEQ ID NO: 134486 - protein, 365 aa, Triticum aestivum
  unsure (1)..(365): unsure at all Xaa locations
  Clone ID: PAT_TA_28904.pep
MHERSPGPSLAATRLPSPASLLLLLLLSLSLLAGRSHGWWCREDDEGCSLMGFRGDDLPVTGGGISEKGRFSYGFASCAGKRASMEDFYETRVDDVDGETVGLFGVFDGHGGARAAEYVKKHLFSNLIKHPKFMTDTKAATAEIFNHTDSEFLKADSSHTRDAGSTASTAILVAGRLVFAKVGDSRSDISKGGKASFERRDGYCDYPESRQRHDGWEVVMLGIGTLGADGXRPWVVGGVVANSGAFGGSLQNQYLGSGGRGDVEADDRALALLXILASDGLWXVWLNARSFSMGKSLEDPWQAAKGLLXEASPDGGARADNITDVLIRVVGRNDDVCLVDGPGVMRLPIDQSEEVAQGPILHRAL

SEQ ID NO: 134487 - protein, 212 aa, Triticum aestivum
  unsure (1)..(212): unsure at all Xaa locations
  Clone ID: PAT_TA_28905.pep
EKYKKSKQVHSILRHXAEKNDIALKTLYETIGWPLYKKYGHAYDAFKMAILDTDAIFSGIDISKELLDELLSIIKRRMTPQPVKIRAQLDIRCTGIDGVNAIKNALKAGEQVGDEDVPVKITYLAAPFYVVTVDSLDKEQGFQIIEKAIEAIKTTLDQHSWTRFKVEKEAKVVSDSDDRDFAALLAQAEKENELVSGDEDEGDGVAASEDDI

SEQ ID NO: 134488 - protein, 221 aa, Triticum aestivum
  Clone ID: PAT_TA_28906.pep
MKKPEWYSDAQKYWNAVPATVDGMLGGFETIDPIDVKGSICFIKEFVDQNIISTEYACDCGAGIGRVTKNFLLQVPFKRVDLVEQAESFVQQAKSDYLAQEIEQGKVGNVFCQGLQGFTPEEGKYDLIWCQWVLGHLTDEHFINFFKRCIKGLKPNGFIGVKENNASKEALFDDEDSSVTRPNQELKRLFAEAGLNIVKEEVQKGFPAGLFAVRMYLLKPQ

SEQ ID NO: 134489 - protein, 289 aa, Triticum aestivum
  Clone ID: PAT_TA_28907.pep
MRVYDDNDDEETDLSEDSDENGDSLSVESDSADDLVVIDTEMVTSSAFTAGNASESSTGNSENGNFSTNGTQLLVSAMKGSRAKRGIVTKLIVSWAPDVYDPPVTSDSHTVKPHQRSSRKSHYKYKPPKGSSSSSSSRTSSGSKKDKKHSHHSSSSSKRDKKPSHRSSNGGSSRIDTSDPQHRKAYGSITSSRTDTSVPEYHKLSPWQPPASAAVEEAIPTVPVLKAMEQIKRSSSCCKEPPISMKAMEQIKRSSSCCKEPPISMLSRQFVAAKYKGMFSFLSQNHLAS

SEQ ID NO: 134490 - protein, 215 aa, Triticum aestivum
  Clone ID: PAT_TA_28908.pep
ISEKKNSSTTGTQLLVSAMKGSRAKRGIVTKLSVSWAPDVYDPPVTSDSHTVKPHQRSSRKSHYKYKPPKGSSSSSSRSSSGSKKDKKHSHHSSSSSSKRDKKPSHRSSNGGSSRTDTSDPQHRKAYGSSITSRTDTSVPEYHKLSPWQPLASAAVEEAMPPVPVLKAMEQIKRSSSCCKEPPISMKAMEQIKRSSSYDLRFDLLLVLVLRIVWL

SEQ ID NO: 134491 - protein, 170 aa, Triticum aestivum
  Clone ID: PAT_TA_28909.pep
NMKKRACTYICIFLVDDMYASLSQKMKKICMHLNSKKKRTCMHPRACYSASIRWACAPHVYHEPFERGAGADGKCCKTSQRQQDGARCLMAIASCLKPTMRRWKTLSCRCCKPVSAVGDEGISYKYPRQRCCKVSTRFSATPIADEMFSGRMTSAIGAPAGTDRGAPHRH

SEQ ID NO: 134492 - protein, 123 aa, Triticum aestivum
  Clone ID: PAT_TA_28910.pep
ETFSPYKVRYRLGTGVALLMYRMIVPKDSAWNTIVVPSTTLVFARPCARPASMVLIRRGSGSVHASAGSRPSSPSGNAPSPSRRAAGQPPPPWRCARSSSSSLPAYVRVLLLPCLRSSPEPGR

SEQ ID NO: 134493 - protein, 223 aa, Triticum aestivum
  Clone ID: PAT_TA_28911.pep
PDLKEYDQEQVRLMEEMCIVIDENDKRIGADSKKTCHLMSNINDGLLHRAFSVFLFDSQNRLLLQQRASEKITFPDMWTNTCCSHPLNTPSELVEENQLGVRTAAQRKLEHELGIPPEQVPLEKFKYLTRIHYVAPSDGQWGEHEIDYILFMKADVTLSLNPNEIRDIKYVTPQELQEMFRDPNIPMTPWFKLICNTFLFKWWNQIETIETTEQDDTIHRLGF

SEQ ID NO: 134494 - protein, 71 aa, Triticum aestivum
  Clone ID: PAT_TA_28912.pep
FDIKYLMGLTIIKEVQDGIFACESCLPLLISFMKCIIDQCYVRQLSINFTAYNLSYVMSLPTMRLAPVDLE

SEQ ID NO: 134495 - protein, 362 aa, Triticum aestivum
  Clone ID: PAT_TA_28913.pep
DAADPRHAALKRVMISLAAARMHHVAPVFRIAFGAVFDAADAGLGDGPVQFNKLNEHHMFDFTCSALFGGTPPSKAMGDGAVTKAIKWLGVQLHPLASKIIKPWLLEDLLLHTFRLPPLLVRRDYADLTAYFAEAAAGFLNDADKAQSGISRDELLHNLVFTAIFNAYGGFKIFLPHVIKWLARAGPALHARLASEVRAAVPNGSDITVPAVDKMPLVKSVVWEALRMNPPVEFQYGRARQDLVVESHAAAYQVRKGEMLFGYQPLATRDERVFKQAGEFVPDRFVGGEGRLLGNVVWSNGPENSEPAEGNKQCPGKDMVVAVGRLMVAELFRRYDTFTADVKEMPLEPVVTFTSLTRAKAE

SEQ ID NO: 134496 - protein, 77 aa, Triticum aestivum
  Clone ID: PAT_TA_28914.pep
FTGPRVWPRWRSSATPACTSTPSTWRRWRSRSVEDRQRSGRVCLGQFLSNQKLNFQIAASKHIFQQILSFFYVAFLS

SEQ ID NO: 134497 - protein, 109 aa, Triticum aestivum
  Clone ID: PAT_TA_28915.pep
GAGPRVPPPLRPGLLARDDLQTRRRSWLRPDGARHGVLRRRGQAQLLRQALPRPRQLYLLGHLPSDESRVGSGRGGALQRPRQVRPPHQRGGAGGVVGWRTVSDLAVCA

SEQ ID NO: 134498 - protein, 137 aa, Triticum aestivum
  Clone ID: PAT_TA_28916.pep
QRYVGQSEEEEEEEVLMEDEYVSVMDPILLSIIQHPARCIFCTHSTCFDANVFFKFQVTSMNWQCPICCVKIRGIQDLYIDYQTKVALNKYPNQDRLLKQKDNTYTTTSWIESNNGTKRMHEIITIQDEGSKRLKQI

SEQ ID NO: 134499 - protein, 129 aa, Triticum aestivum
  Clone ID: PAT_TA_28917.pep
YSTRSLFDTLREQQRQANDGCTVIEAWKQHGAPYRWLFGYSDENDYFSLISKQLANKVEEYKQCIWEIERIVDSWIKNKVQSPQDIARIIHAQNLTLLNLGNKVAYLHEYVQQEKEHYQRSVFPLMTEA

SEQ ID NO: 134500 - protein, 216 aa, Triticum aestivum
  unsure (1)..(216): unsure at all Xaa locations
  Clone ID: PAT_TA_28918.pep
PHPQVRFPALVLWLLHTLTPEHDWPAHTVTQAAELDWPAHTLSGIKISVCSSTASNGTESGPNINKNKCRHNPTADLINPFYVAPLRVMWSRLDLVTERPEQKFVHPGSRRIGFGEGNEIVQLLFLLLDLRRKVSPGGFVTLVGVEEPAKPPAWKHRRTQGPRRCCAEGSRHRRRPCGSEVVRVRVPRSFAFRRREGDAIVQCGARGAIASCRIXC

SEQ ID NO: 134501 - protein, 100 aa, Triticum aestivum
  Clone ID: PAT_TA_28919.pep
PGREPLNPALTVVLSGLFSLFRRLFLLRHGFPLPSLTSDVPGSLVPLWASQLSSPAQKRVMRLVKAAIVLGFSWPRCLASHSSQTLCLKAAKASASGQST

SEQ ID NO: 134502 - protein, 116 aa, Triticum aestivum
  unsure (1)..(116): unsure at all Xaa locations
  Clone ID: PAT_TA_28920.pep
HSGLNLIYEDTLNRMQMDMSRIDQSNTTFHSIIPSREARCSGKIKLDVVFSTPENYRSEEFLFHVSSLNRGYHGLLGXDTFTCFQAVPHYXYMKLKMPGHNRIITITSDPDIALRA

SEQ ID NO: 134503 - protein, 97 aa, Triticum aestivum
  Clone ID: PAT_TA_28921.pep
NRKCKGDAASSVECYIHEYGVTGEVAIARIYELIEDEWRTLNKARFENHALLPALKRIIGLALSTSLFYDNRNDVYTDSKHLHKTIKSLFVKPVLSG

SEQ ID NO: 134504 - protein, 91 aa, Triticum aestivum
  Clone ID: PAT_TA_28922.pep
SRGGDPTVVQDPETPDDLDNQYYDNVQKRKVLFKSDATLLSSQTTLRLVDNHAKDPQEWLKQFKAAMVKMGSIEVKTEANGQIRKHCRFVN

SEQ ID NO: 134505 - protein, 114 aa, Triticum aestivum
  Clone ID: PAT_TA_28923.pep
GRVGAFNSDSTILVSGSADRTMRTWDVNKNTPNEFREESSSDFKRTKLNGKGKDKKEKMKPLLMDLKRNKKNSLESDDHLSVFPTKNTPIYTVQFTQRNLCLAAGAKSSVSLSL

SEQ ID NO: 134506 - protein, 116 aa, Triticum aestivum
  Clone ID: PAT_TA_28924.pep
IDAATVSHTREVDAGPRDAMRRREMSAWTTPHTQGDDGLSAPKAAGCSRTVSQGGSREYDGPGETMEQCINAGAPLLLHASSPAPASNVDQAKGIELGNRCDGCDLSFWREGGGGG

SEQ ID NO: 134507 - protein, 230 aa, Triticum aestivum
  Clone ID: PAT_TA_28925.pep
QDPFLIVKSQVEDNLSNATNLFESWKRIQQTVSSPKNQELLWTADELNSTLEAIEQDLDDLHEALHISQANPSQFNLTSNDLNSRRQFLDKSRNLIQSIRYTLANPPAKSKLSNNQSIETVRQNENSRFIESEQMQQSFVIQEQDQHLDAMGGTLINLKEIAGTMNREIDDHVIILDDLGERVDRSEGRLNTAMRRVTDILRKEEESKSGYCICCLIIILIILLVLVIIM

SEQ ID NO: 134508 - protein, 249 aa, Triticum aestivum
  Clone ID: PAT_TA_28926.pep
MKAEYCVDYLSYKWKTDDLIETYRETRKHSIVNKLKQDKHEEYKLKRLQNALWREMARNCTSNLSQSNLLIDPSLMSWQKESDITWLYGPIYTNTKTQVYVPTSHLEGVKPVLKRQNTSIVQHSPLPTYSDDLFMVDYHSSNNTTLVSSRNNSFSSMSTTTTTTTTTTNQKAVYFNPEIIEIEYQPEYPVTPTSFPLMEEHEDIVWLPLLEYVKNNISTLQLFILLFKSFISFTTDYIVGSSKKKKKIV

SEQ ID NO: 134509 - protein, 283 aa, Triticum aestivum
  unsure (1)..(283): unsure at all Xaa locations
  Clone ID: PAT_TA_28927.pep
MRFLFYFLLFLSTLQQCFGTITILETNDTLVDRLAAFGPRIDQIITGYLSAPSNDMYGCSAVKNITQKNWIAVLERGQCSFLQKVQAMQESGAIAVVVGDRHFNGWVTMYAPGDTXNIHIPSVFVAQYQYKSLLNLLVQKNNSLLIEITGDDLLAWPLLDMLLIVVLSPAVMMLFIYLTWQLRQRQHKQNDMAPSQFVAKLPTYIFRREKVIDTDHMDCAICLEDYSDGEQLRVLPCKHEFHAKCVDAWLTSHKKYCPICKFDTCQKPNDKSRPNERTPLLSA

SEQ ID NO: 134510 - protein, 34 aa, Triticum aestivum
  Clone ID: PAT_TA_28928.pep
FHDTSDHLQSEVVLIIWQILVQIQVSQRLLPFCV

SEQ ID NO: 134511 - protein, 83 aa, Triticum aestivum
  Clone ID: PAT_TA_28929.pep
RFMLKSSAPATKGTAGVLFRPSGGGVVIHAMNVSVAAVPSFSRENLHSFFNNQRQLTTIATSYSSRQRERRREVQKKKERDEG

SEQ ID NO: 134512 - protein, 218 aa, Triticum aestivum
  unsure (1)..(218): unsure at all Xaa locations
  Clone ID: PAT_TA_28930.pep
IIEEQLQSLQQEASEVIXKVQVYQRKVMTPVWEKRREMIKKIPGFWGTAIGNHSVFGAAPSEEDVEALENLTDFHVEFDEANPNYRKVIASFKKNNVFKNETLTKEYVCNADDESSVISKSTIDYIEKKNNKRKAEDNENDEPTTYSFLDWFGDDSIDAGVVLTDHIFPDAVDFYKGIDEDDSDDEDLEREIELVSEDEEDDEEDEEEEKPKAKKSRK

SEQ ID NO: 134513 - protein, 461 aa, Triticum aestivum
  unsure (1)..(461): unsure at all Xaa locations
  Clone ID: PAT_TA_28931.pep
MARPGLADPTPAEPRGMQDARQEAADVRLRAPPEVQAHAAALRLRTSISGAXLRREVPRITLAGQDATVPFMHYQPRPGRPLLRRFFAVRLSDHTVXPPASPDCRRLFGQLSSXAGLFERXVGHTSKFLLVASSVLFCIALYCVLACSSTGANMFAGGLIGFIWIQSGWIGHDSGHQQTPRHPAHNGLLQVVLRDRRTEPCAAXGTATSSEANLMTSNTPRAAALQARQATTGPPPKNPVWGALTTSAXGVRGLDQDLLQRVEPCVQAVIGFCLDSVDILILLALEIVLDXRVARLQFLEFTRVFMLQLWTVTPHLDWWVRVAMVTAXFVLVVPHQLHCWAIHPFLLACFVITRYTEWVVRPEPLLLRRECSPWMGXFQVGLQNQVEHYLFPRLPRCHYRMVAPIVRDLCKKHGLSYGAATFWEANVMTWKTLRAAALQAREATTGAAPKNLVWEALNTHG

SEQ ID NO: 134514 - protein, 216 aa, Triticum aestivum
  Clone ID: PAT_TA_28932.pep
MGRRPARCYRYCKNKPYPKSRYCRGVPDAKLRIYDLGRKKASVDDFPLCIHLVSNEYEQLSAEALEAGRICANKYMAKTSGKDSFHMRIRVHPYHVTRINKMLSCAGADRLQTGMRGAFGKPNGLVARVNIGQIIFSVRSKDSNKAVVIEALRRCKYKFPGQQKIIISKKWGFTPLDRADYVEARSKGLVKPDGCYVKFVPQKGSLANYFKEAVKA

SEQ ID NO: 134515 - protein, 73 aa, Triticum aestivum
  Clone ID: PAT_TA_28933.pep
KSRATTFLNIGDCLSSCRLINLINTISFLVPSNNSVILLFWAVFSNLKLSLDFSFVNHFELFNLGMRCMCATD

SEQ ID NO: 134516 - protein, 300 aa, Triticum aestivum
  Clone ID: PAT_TA_28934.pep
PRVRKAVVTGASGLLGRQVVKAFENANCEVVGTAFSRASGNLVKLNLTEVEAVKSFIDEQQPDVLVHCAAERRPDVAEKDQSGVLRLNVETPRNLASICKSKGVMLIYISTDYVFDGTSPPYEVDDKPNPLQFYGQTKLDGENVIREVYPDAVILRVPILYGATEYNGESAVNVLIDTVLSKKVSKVDNVAQRYPTNVADVARVLKDLAVKKIKNKQDIRGIYHFSAKESMTKYQMCETFASILNVPMDHLTPQNTVDPSASVSRPDNSHLSVKRLEEAGIDTHFVKFATWFDGQLKLSA

SEQ ID NO: 134517 - protein, 178 aa, Triticum aestivum
  Clone ID: PAT_TA_28935.pep
MSEMSEKEELLFLNEIHELLAYCYAAKDVLKARDQKQLDFEELSRYLDQAALEKERILHPKFNDRANIAEYVTDKINEVRGISMQQARREKLSRLETKIKELQEEVTQANDESNKFSSQVVKEFGLFQKTKIMELKQGLLAYADCHIAFHEKGMSIWEKILPVLENMDSVRGDGEATV

SEQ ID NO: 134518 - protein, 105 aa, Triticum aestivum
  Clone ID: PAT_TA_28936.pep
MSTPGGEEDKKPASAGGEGGGAHINLKVKGQDGNEVFFRIKRSTQLKKLMNAYCDRQSVDMKAIAFLFDGRRLRAEQTPDELEMEDGDEIDAMLHQTGGRLPPSA

SEQ ID NO: 134519 - protein, 162 aa, Triticum aestivum
  Clone ID: PAT_TA_28937.pep
IKELHPSAVSTLDRKRRLNQSKLKRGVRSKKPITTLVKKPQTQQQPRSLVPAAAPKEALDEGQMNCKQQLLCALYIRIIICYYYYTVTGSPPMEPRRHRAGRSLFRGSAAPMPASRRPTRSGHRVSRSTGGVGGGRPWDSTRMDQSTCTSSHWHDLTSSYRM

SEQ ID NO: 134520 - protein, 122 aa, Triticum aestivum
  Clone ID: PAT_TA_28938.pep
MNKGKIFKLAKGFRGRAKNCIRIARERVEKALQYSYRDRRNKKRDMRSLWIERINAGTRLHGVNYGNFMHGLMKENIQLNRKVLSELSMHEPYSFKALVDVSSTAFPGNRPPAQKEGLAAIL

SEQ ID NO: 134521 - protein, 70 aa, Triticum aestivum
  Clone ID: PAT_TA_28939.pep
FNNQWSKDEMLTINFKAIGLLEVQNPSSMVHVLVSRLESTRGPRKNGEGEKYHNTKNSLRGGAVLTTSLT

SEQ ID NO: 134522 - protein, 126 aa, Triticum aestivum
  Clone ID: PAT_TA_28940.pep
MRGDEEEDDIIYKSEDSIEDDDSDWEKPRKMNHKRQSFASFTNNKTKSRKSSFLSQKDDIKCYHCQTTNTPLWRRSPEGAVLCNACGLFLKLHGVVRPLSLKSDVIKKRNRSGKRQKTRKQKKQRI

SEQ ID NO: 134523 - protein, 216 aa, Triticum aestivum
  Clone ID: PAT_TA_28941.pep
LVSPPAHAAPHPSPNSCTHFTATALHLQSVAAVLEANLEAGSRLYRDCRLRNIFMMNNICYMVQKVKNSDLKSFLGDDWIRLHNRMFQHQATNYERASWSQVLSYLSDDGLCAAGGAASRKIIREKFKNFNLSFEDVYRVQTAWSVPDDQLREDVRISISLKVIQAYRTFVGRYSAFLDGTKQRDRYIKYRPEDLEELLLDLFEGTQKSLQHSGRA

SEQ ID NO: 134524 - protein, 139 aa, Triticum aestivum
  Clone ID: PAT_TA_28942.pep
SGTISPAYQGRPEAVCPANTSQFTNVTTEIDLSTPVVLDNNYYKLVQLNLGLHFSDDQLIRNATLKAFVDAFAANETLWKDKFLAAMIKMGNISPKTGTQGEIRLNCSLVNPASSSSSAYAGVIEMLRRQGSDDKVAKG

SEQ ID NO: 134525 - protein, 160 aa, Triticum aestivum
  Clone ID: PAT_TA_28943.pep
SHTLGRSHCNSFIVRNRERLASGTIGPGRQALLEALCPANTSQFTNVTTEIDLSTPVVLDNNYYKLVQLNLGLHFSDDQLIRNATLKGFVDTFAANETLWKEKFIAAMIKMGNIAPKTGTQGEIRLNCSIVNPSSTSSSGYDGAIQMLRRPGSDDKVASG

SEQ ID NO: 134526 - protein, 357 aa, Triticum aestivum
  unsure (1)..(357): unsure at all Xaa locations
  Clone ID: PAT_TA_28944.pep
MASSSSSLAGLLLTAVLCLQLPVHSRAQLRVGFYNTTCPNAEAIVRQAVTAAFATNSGVAAGLIRLHFXHDCFVEGCDSSVPPCPVNPGXGTPERDAAPNNPSLRGFALVDAARAALEQSCPRTVSCADILAFAARDSVNITGSNAFYQVPSGRRDGNLSTEAGAFTLPGPNLTADGLVSGFRDRGLTAEDMVVLSGSHTLGRSHCNSFIVRNRERLASGTISPAYQALLEALCPANTSQFTNVTTEIDLSTPVVLDNNYYKLVQLNLGLHFSDDQLIRNATLKGFVDAFAANETLWKEKFIAAMIKMGNIAPKTGTQGEIRLNCSIVNPSSSSSSGYAGVIEMLRRPGSDDKLAMG

SEQ ID NO: 134527 - protein, 163 aa, Triticum aestivum
  unsure (1)..(163): unsure at all Xaa locations
  Clone ID: PAT_TA_28945.pep
TGTLPRSPRRRRTSRPCRCPSPAAPPPSTRTAARRPTTAPRPPGYRPTPTASPPAPRRRSRSSARPPCSRRPPPQRVPAPPRRRARPRGTAXRASAGRRRPPVPGRRAPACPPAVPSGTPRRRPRAAGSRRSRTPARRRRHRLASSGDPFMSCCTKFFFVPCR

SEQ ID NO: 134528 - protein, 417 aa, Triticum aestivum
  unsure (1)..(417): unsure at all Xaa locations
  Clone ID: PAT_TA_28946.pep
GKSTMGGNILYLTGMVDKRTXEKYEREAKEAGRESWYLSWALDTNTEERAKGKTVETGRAYFETDKRRYTILDAPGHKNFVPSMIQGASQADIGVLVISARKGEFETGFERGGQTREHTMLAKTSGINKLIIAVNKMDDPTVQWDKARYDEILSKLNLFLKQTGYNPKTDVHFMPLSGFTGANIKDRDTKSCPWYDGPSLLEFLDDYKTNDRKINAPLMIPISEKYKDMGTIVVGKIESGHVKKGSHVLMMPNKQSVEITAIYNETEEEIEQAVCGDNIRLRLKGIEEDEVSPGFVLCSKKNPVQTTTVFEAQLAILEHKSIICAGYTAVLHVHSASEEVTLSALLHLIDKKTGKRSKRPPQFVKQGQKAIARIETSGPICVETFAKLPQLGRFTLRDEGKTVAIGKITKVLDPNAV

SEQ ID NO: 134529 - protein, 115 aa, Triticum aestivum
  Clone ID: PAT_TA_28947.pep
MARTAATKLVLVALVAAMLLVASDAAISCGQVNSALASCVSYAKGSGASPPGACCSGVRRLAGLARSTADKQAACRCIKSAAGGLNPGKAASIPSKCGVSIPYSISASVDCSKIH

SEQ ID NO: 134530 - protein, 252 aa, Triticum aestivum
  Clone ID: PAT_TA_28948.pep
MGRGRVELKRIENKINRQVTFAKRRNGLLKKAYELSVLCDAEVALIIFSNRGKLYEFCSGQSMPKTLERYQKCSYGGPDTAIQNKENELVQSSRNEYLKLKARVENLQRTQRNLLGEDLGSLGIKDLEQLEKQLDSSLRHIRSTRTQHMLDQLTDLQRKEQMLCEANKCLRRKLEESSQQMQGQMWEQHAANLLGYDQLRQSPHQQQAPHHGGNGFFHPLDPTTEPTLQIGYTQEQINNACVAASFMPTWLP

SEQ ID NO: 134531 - protein, 246 aa, Triticum aestivum
  Clone ID: PAT_TA_28949.pep
MGRGRVELKRIENKINRQVTFAKRRNGLLKKAYELSVLCDAEVALIVFSNRGKLYEFCSTQSMTKTLDKYQKCSYAGPETTVQNRENEQLKNSRNEYLKLKARVDNLQRTQRNLLGEDLDSLGIKELESLEKQLDSSLKHIRTTRTQHMVDQLTELQRREQMFSEANKCLRIKLEESNQVHGQQLWEHNNNVLGYERQPEVQPPMHGGNGFFHPLDAAGEPTLHIGYPPESMSNSCMTTFMPPWLP

SEQ ID NO: 134532 - protein, 117 aa, Triticum aestivum
  unsure (1)..(117): unsure at all Xaa locations
  Clone ID: PAT_TA_28950.pep
MARTAATKLVLVALVAAMILAASDAAISCGQVSSALXPCVAYAKGSGTSPSGACCSGVRKLAGLARSTADKQATCRCLXKSVAGGLNPNKAAGIPSKXCGVSVPYTISASVDCSKIH

SEQ ID NO: 134533 - protein, 89 aa, Triticum aestivum
  Clone ID: PAT_TA_28951.pep
VRLTHNRLLNTLAHALQSSGIDLSQANISVQINLGKRAVKRPTAGQSSSFKEHIDLAPTNEMMGHQQTMLGNAAEELPHAAKRYKPGNT

SEQ ID NO: 134534 - protein, 81 aa, Triticum aestivum
  Clone ID: PAT_TA_28952.pep
MSGRGKGGKGLGKGGAKRHRKVLRDNIQGITKPAIRRLARRGGVKRISGLIYEETRRKTVTAMDVVYALKRQGRTLYGFGG

SEQ ID NO: 134535 - protein, 57 aa, Triticum aestivum
  Clone ID: PAT_TA_28953.pep
GSIPEREPEKRLPHPRKAAAGPGASNSPPAPPSNAATSVGATAGFGLVALLAAGLMA

SEQ ID NO: 134536 - protein, 96 aa, Triticum aestivum
  Clone ID: PAT_TA_28954.pep
MPVLAVVFPREGSDPSKWRSYGTTQARQCFSVRGVYPLMGSTDDVCTSYLEEYGIKLALNYGRSVGIIKPYDRVIIFEKIGDSSVVKIIECDDSER

SEQ ID NO: 134537 - protein, 131 aa, Triticum aestivum
  unsure (1)..(131): unsure at all Xaa locations
  Clone ID: PAT_TA_28955.pep
MASSSSCRTWHCLLALFLLSSAAYGQLSPSFYAKSCPSLELIVRATMIKALLAERRMGASLLRLHFHDCFVQGCDGSILLDDVGXSWAKKTAFPNVNSVRGYEVIDEIKRNVELVCPGVVSCADITALAAR

SEQ ID NO: 134538 - protein, 177 aa, Triticum aestivum
  unsure (1)..(177): unsure at all Xaa locations
  Clone ID: PAT_TA_28956.pep
MASRTWHFLLALSLLSSAAYGQLSPSFYATSCPLLELTVRATMIAALLAERRMGASLLRLQFHDCFVQGCDGSILLDDVGSFVGEKTAXPNVNSVRGYEVIDRIKANVELVCPGIVSCADNRRPRRTRRISGTYCHQKNKDYQIIKSRYIILSIQTSISTDKYGTHSSRVNACILLC

SEQ ID NO: 134539 - protein, 138 aa, Triticum aestivum
  unsure (1)..(138): unsure at all Xaa locations
  Clone ID: PAT_TA_28957.pep
DLKNFVLIYHVDITKVPDFNSMYELYDPSTVMFFFRNKHIMIDLGTRNNNKINWAMKDKEEFVDIVETVYRGARKAXRLVIAPMDYSTKYSLPLCSSHTKKHCWAPLMTKTERVGSSIPWYLYPQPNYGPSNLRSAGD

SEQ ID NO: 134540 - protein, 162 aa, Triticum aestivum
  Clone ID: PAT_TA_28958.pep
MASRTWHFLLALSLLSSAAYGQLSPSFYATSCPLLELTVRATMIAALLAERRMGASLLRLHFHDCFVQGCDGSILLDDVGSFVGEKTAFPNVNSVRGYEVIDRIKATVELVCPGVVSCADIVALAARDGTFLLGGPSWAVPLGRRDSTTASLAEANADLPGP

SEQ ID NO: 134541 - protein, 142 aa, Triticum aestivum
  Clone ID: PAT_TA_28959.pep
MSYLLPHLHSGWAVDQAILAEEERLVIIRFGHDWDETCMQMDEVLSGVAETIKNFAVIYLVDITEVPDFNTMYELYDPSTVMFFFRNKHIMIDLGTGNNNKINWAMKDKQEFVDIVETVYRGARKGRGLVIAPKDYSTKYRY

SEQ ID NO: 134542 - protein, 208 aa, Triticum aestivum
  Clone ID: PAT_TA_28960.pep
CFTQMLNQQFQEPWLAVVIDPTRTVSAGKVDIGAFRTYPKDYKPPDEPVSEYQTIPLNKIEDFGVHCKQYYSLDITYFKSSLDSHLLDLLWNKYWVNTLSSSPLLGNRDYVAGQIFDLADKLEQAEGQLAHSRFGMLMPSQRKKEQEESPLAKVTRDSSKITAEQVHGLMSQVIKDILFNSVHPSSKSKASGSGTAPDSPVPEPMVEA

SEQ ID NO: 134543 - protein, 96 aa, Triticum aestivum
  Clone ID: PAT_TA_28961.pep
DEGTISVSSQYSQELLNTLTHALQSSGIDLSQANISVQINLGKRAVKRPTAGQSSSFKEHTDLGPTNNMMGHQQVMLGNATEELPHATKRYKPGNT

SEQ ID NO: 134544 - protein, 120 aa, Triticum aestivum
  Clone ID: PAT_TA_28962.pep
MLAGWYWVNTLSSSPLLGNRDYIAGQIFDLADKLEQAEGQLAHSRFGMLMPSQRKKEQEESPLAKVTRDSSKITAEQVHGLMSQVIKDILFNSVHPSSKSKASASGTAPDSPVPEPMVEA

SEQ ID NO: 134545 - protein, 95 aa, Triticum aestivum
  unsure (1)..(95): unsure at all Xaa locations
  Clone ID: PAT_TA_28963.pep
SRPRRQNFVLIYHVDITKVPDFNTMYELYDPSTVMFFFRNKHIMIDLGTRNNNKINWAMKDKEEFVDIVETVYRGARKAXRLVIAPMDYSTKYRY

SEQ ID NO: 134546 - protein, 144 aa, Triticum aestivum
  Clone ID: PAT_TA_28964.pep
AIDYSVVRVIRSGYDFSGHVNHPVFSPDGRSIVVTADLAAVSADPMSLPLLLHSQRPYGDIFTVDIDPDDMEKNQDVEEFARVTHSRYENATPDWTVFSTHDPHAQWNLLVMEDNYTPACPYAHHDGGESWHMTGQMCIPKRVC

SEQ ID NO: 134547 - protein, 154 aa, Triticum aestivum
  unsure (1)..(154): unsure at all Xaa locations
  Clone ID: PAT_TA_28965.pep
MASSSSCRAWHCLLALFLLSSAAYGQLSPSFYARSCPTLQLIVRATMIKALLVERRMGASLLRLHFHDCFVQGCDGSILLDDVGSFXGEKTAAPNNNSLRGYEVIDEIQAERGACSALASVSCADIXLALATRDGTFLLRGANWAVPLGRXDQQ

SEQ ID NO: 134548 - protein, 143 aa, Triticum aestivum
  Clone ID: PAT_TA_28966.pep
MSYLLPHLHSGWAVDQAILAEEERLVMIRFGHDWDETCMQVDLLILSGVAETIKNFAVIYLVDITEVPDFNTMYELYDPSTVMFFFRNKHIMIDLGTGNNNKINWAMKDKQEFVDIVETVYRGARKGRGLVIAPKDYSTKYRY

SEQ ID NO: 134549 - protein, 176 aa, Triticum aestivum
  Clone ID: PAT_TA_28967.pep
MAAMKITLLAVAAISALLLGTASAATYGVGEPGGSWTLNTDYSNWVSNKKFHPGDEIVFKYSTPAHDVVEVSKAGYDSCSTDGAINTLTSGNDVISLNATGTRYFICGVPSHCSPTAAASMKVTIEVVPGASSPSSPMPAAGPGATNPPPPSSTATSVGAAAGFGLVALLAAGLMA

SEQ ID NO: 134550 - protein, 185 aa, Triticum aestivum
  unsure (1)..(185): unsure at all Xaa locations
  Clone ID: PAT_TA_28968.pep
MAAMKITLLAVAALLGTASAVTYNVGEQGGWXTLNTDYSSWVSGKKFNVGDEIXVFKYSSAXAHDVVEVXSKAGYDSXSIDGAINTFKSXGNDVIPLSATGTGYXICGITGHCSPTAAASMKXMIDVASGSSSPSSTMPTASPGATISPAQPLRATPSCTDWLSPMAVVGTIYDAPLAKMYTRYR

SEQ ID NO: 134551 - protein, 137 aa, Triticum aestivum
  Clone ID: PAT_TA_28969.pep
MAAMKITLLAVATISAVLLGTASAATYGVGEPGGSWTLNTDYSNWVSNKKFHPGDEIIFKYSPAAHDVVEVSKAGYDSCSTASAINTFKSGREQPAATLLYRILCRGHSRIWPCRPTGRQSHGLKCIFQPAACRTHI

SEQ ID NO: 134552 - protein, 258 aa, Triticum aestivum
  Clone ID: PAT_TA_28970.pep
ADGIIISRGDLGIDLPPERVFMSQKTGIHKCNMAGKPVIITRVVDSMIDNLRPTRAEATDVANAVLDGTDGILLGAETLRGQYPVDAVRTVGRICAEAETVYNQSLHFKKVVRHVGEPMVHEESVASSAVRSAMKVKAAAIVVFTFSGRAARLIAKYRAPMPVLAVVFPREGSDPSKWRSYGTTQARQCFSVRGVYPLMGSTDDAETGGLTKEEYGIKLALNYGRSVGIIKPYDRVIIFEKIGDSSVVKIIECDDSER

SEQ ID NO: 134553 - protein, 176 aa, Triticum aestivum
  Clone ID: PAT_TA_28971.pep
MAAMKITLLAVAAISAVLLGTASAATYGVGEPGGSWTLNTDYSNWVSNKKFHPGDEIVFKYSTPAHNVVEVSKAGYDSCSTDSAINTLTSGNDVVAINATGTRYFICGIPGHCSPTAAASMKVVIDVVPSSSSPSSPMPAAGPGASNLPPPSSTATSAGATAGFGLVVLLAASLMA

SEQ ID NO: 134554 - protein, 166 aa, Triticum aestivum
  unsure (1)..(166): unsure at all Xaa locations
  Clone ID: PAT_TA_28972.pep
MAAMKIALLAVAAMAVLLGTASAVTYNVGDQGGWTLSTDYSSWVSGKKFNVGDEIXVFKYSDXTHDVVEVXSKAGYDSCNIXDGAINTLASGNDVINLKXATGTRYFICGVPNXLQPTAAASMKVVINSPRSSSPSSPSTAVWPRISPRLNALLVVHGLALPLAVA

SEQ ID NO: 134555 - protein, 124 aa, Triticum aestivum
  unsure (1)..(124): unsure at all Xaa locations
  Clone ID: PAT_TA_28973.pep
MAAMKITLLAVAAMAVLLGSASAVTYNVGDQGGWALSTDYSNWVSGKKFNVGDDIVFKVXSTPTHDVVEVXSRPGYDSCSTDGAINTLTSGQXDSSPSNATGTRYFICGVPXHCNPAAAGQMKA

SEQ ID NO: 134556 - protein, 337 aa, Triticum aestivum
  unsure (1)..(337): unsure at all Xaa locations
  Clone ID: PAT_TA_28974.pep
NSARAGAFPAFSKDGSKLAFVDNEFKAVWLADSDGMRVVFETDGPDGVFSPVWNQKKDILYVCMGPSFKANEILEIYAIPHVSSGARERRLLTKGKFNNAFPSTNSDGTKLVFRSTRNGGDKKYKNLYMMDAEIGEDGGEAERITEGDWIDTHCQWSPGXDWIVFSSNRDKPADAPERDHGMDPGYFAVYLMNAIDRSVVRVIRSGYDFSGHVNHPVFSPDGRSIVVTADLAAVSADPMSLPLLLHSQRPYGDIFTVDIDPDDMEKNQDVEEFARVTHSRYENATPDWTVFSTHDPHAQWNLLVMEEEYTPACPYAHHDGGESWHMTGQMCIPKRVC

SEQ ID NO: 134557 - protein, 93 aa, Triticum aestivum
  Clone ID: PAT_TA_28975.pep
KRIHVFTRDNNYSIVVNNIKARMCARQTWPRPSKRPPGQGVHMSHVSLGSTVLNLIQVFCYDQRISMSLPKVLSCCLGLGNDILQLYEEFLYL

SEQ ID NO: 134558 - protein, 142 aa, Triticum aestivum; identical to SEQ ID NO: 134541
  Clone ID: PAT_TA_28976.pep

SEQ ID NO: 134559 - protein, 176 aa, Triticum aestivum
  Clone ID: PAT_TA_28977.pep
MAAMKITLLAVAAMAVLLGTASAVTYNVGDQGGWTLSTDYSSWVSGKKFNVGDDIVFKYSTPAHNLVEVSKAGYDSCSTDGAINTLASGNDVITLNATGTRYFICGVPSHCSPTAAASMKVVIDVASGSSSPSSPMPAAGPGASNSPPAPPSNAATSVGATAGFGLVALLAAGLMA

SEQ ID NO: 134560 - protein, 364 aa, Triticum aestivum
  Clone ID: PAT_TA_28978.pep
MEPTSSSAVARQTWELENNIPAAASDPDAMDAIYHYDEAANARAHQEKPWATDPHHFRRARISALALLKMVVHARAGGTIEIMGLMQGKFEGDSIIVMDAFALPVEGTETRVNAQADAYEYMVEYSTINKQAGRLENVVGWYHSHPGYGCWLSGIDVSTQMLNQQFQEPWLAVVIDPTRTVSAGKVDIGAFRTYPKDYKPPDEPVSEYQTIPLNKIEDFGVHCKQYYSLDITYFKSSLDSHLLDLLWNKYWVNTLSSSPLLGNRDYIAGQIFDLADKLEQAEGQLAHSRFGMLMPSQRKKEQEESPLAKVTRDSSKITAEQVHGLMSQVIKDILFNSVHPSSKSKASASGAAPDSPVPEPMVEA

SEQ ID NO: 134561 - protein, 175 aa, Triticum aestivum
  Clone ID: PAT_TA_28979.pep
TGFVPEDAAIVGNTCLYGATGGQVFVRGKTGERFAVRNSLGQAVVEGTGDHCCEYMTGGCVVVLGKVGRNVAAGMTGGLAYMLDEDDTLVPKVNKEIVKMQRVNAPAGQMQLKGLIEAYVEKTGSTKGAKILNEWEAYLPLFWQLVPPSEEDSPEACAEFERVLARQKTAVQSAK
